United States Patent 11,141,474 (ARTIFICIAL NUCLEIC ACID MOLECULES ENCODING A NOROVIRUS ANTIGEN AND USES THEREOF) - sequence listing, part 14

SEQ ID NO: 30504 - RNA, 1608 nt, Artificial Sequence
  derived and/or modified sequence opt5 from VP1__Norovirus_and/or_Norovirus-like__GQ856464
augaugauggccagcaaggacgcucccaccuccccugauggcgccucuggggcgggacagcuggugccggaggcuaacacagccgaacaaaucagcauggaccccgucgccggcgcuuccacggccguugcuaccgccgggcaggucaauaugauugauccuuggaucuucaacaauuuugugcaggcgccccagggagaguucacaauuucuccuaacaauacccccggcgacauccucuuugaucugcaacuugggccucaccugaacccguuccucgcccaucugagccagauguacaauggaugggucggcaacaugagagugcggauucuucuggcuggcaaugccuuuacagcugggaaaaucaucauuugcuguguucccccuggauucgacgcccgcauccucaccauugcgcaggccacacuguuuccccaccugaucgcugaugugagaacccucgaaccugucgagcugccccuugaagacgugcggaacguucuguaucauaauuccucucagccgcaaccuacgaugcgccucguggccaugcuguacacaccccuuagaaccggcgggggaagcggcgggaccgaugcuuucgucguggccggacgggugcugacaugcccugcccccgacuuuuccuuccucuuucuggugcccccuagcguugagcagaagacccgcguguucucugugccgaacauuccccugaaagaucucuccaauagcagagucccugugcccauccagggcauguuuaugucuccugacguuaaccaguccgugcaauuccagaauggccggugucagauugaugggcaacugcagggaacgacacccgucagccuuucucagcugugcaagauccgcggcaaaaccuccagcaacgcuagagugcucaaccuguccgagguugacgggacaccguucaucccucuugaaucucccgcgccugugggauuucccgaccugggcgggugugauuggcacgucaauuucaccuuucagacccaagaccgggauccuagccaguccgugacauucgccacgaacgacgcuagcuuuguccccuaucucggaucuguguccccgcauaauggcgagggcuuccaggccggggauauuaucggaagccugggcuggauuucugccccuagcgacaacucccaguuuaauguuugggcuauccccaaguacgggucuagccugcccgaugugacccaccucgccccugcggucuucccgcccggauuuggcgaagugauucuguauuucuacuccacauuuccugggagcggccaacccucucagcuucagguuccuugccugcucccccaggaguucaucacccacuuuuguaacgagcaagcuccuaucgccggagaagccgcucugcuucauuauguggaccccgauacaggccgcaaucugggggaguucaagcucuacccggacggauucaugaccugcgucccuaacuccgugagcucuggcccccagacgcugccuauuaaugggguguuuguuuucgucuccugggugagcagauuuuaccagcugaaacccgugggaacagccuccgcugcccggcgccucuga

SEQ ID NO: 30505 - RNA, 1608 nt, Artificial Sequence
  derived and/or modified sequence opt5 from VP1__Norovirus_and/or_Norovirus-like__GQ856463
augaugauggccagcaaggacgcucccaccuccccugauggcgccucuggggcgggacagcuggugccggaggcuaacacagccgaacaaaucagcauggaccccgucgccggcgcuuccacggccguugcuaccgccggacaggugaauaugguggauccuuggauuuucaacaauuuuguccaggcgccccagggggaguucacaaucucuccuaacaauacccccggcgacauucucuuugaucugcaacuugggccucaccugaacccguuccucgcccaucugagccagauguacaauggaugggugggcaacaugagaguucggauccuucuggcuggcaaugccuuuacagcugggaaaauuaucaucugcugugugcccccuggauucgacgcccgcauucucaccaucgcgcaggccacacuguuuccccaccugauugcugaugucagaacccucgaaccuguggagcugccccuugaagacguucggaacgugcuguaucauaauuccucucagccgcaaccuacgaugcgccucgucgccaugcuguacacaccccuuagaaccggcgggggaagcggcgggaccgaugcuuucgugguggccggacggguccugacaugcccugcccccgacuuuuccuuccucuuucugguucccccuagcguggagcagaagacccgcguguucucugucccgaacaucccccugaaagaucucuccaauagcagagugccuguucccauucagggcauguuuaugucuccugacgugaaccaguccguccaauuccagaauggccggugucagaucgaugggcaacugcagggaacgacacccgugagccuuucucagcugugcaagauucgcggcaaaaccuccagcaacgcuagaguucucaaccuguccgagguggacgggacaccguucaucccucuugaaucucccgcgccugucggauuucccgaccugggcgggugugauuggcacgugaauuucaccuuucagacccaagaccgggauccuagccaguccgucacauucgccacgaacgacgcuagcuuugugcccuaucucggaucuguuuccccgcauaauggcgagggcuuccaggccggggauaucauuggaagccugggcuggaucucugccccuagcgacaacucccaguuuaaugugugggcuauucccaaguacgggucuagccugcccgaugucacccaccucgccccugcgguguucccgcccggauuuggcgaaguuauccuguauuucuacuccacauuuccugggagcggccaacccucucagcuucaggugccuugccugcucccccaggaguucauuacccacuuuuguaacgagcaagcuccuaucgccggagaagccgcucugcuucauuaugucgaccccgauacaggccgcaaucugggggaguucaagcucuacccggacggauucaugaccugcgugccuaacuccgugagcucuggcccccagacgcugccuaucaaugggguuuuugucuucguguccugggugagcagauuuuaccagcugaaacccgucggaacagccuccgcugcccggcgccucuga

SEQ ID NO: 30506 - RNA, 1608 nt, Artificial Sequence
  derived and/or modified sequence opt5 from VP1__Norovirus_and/or_Norovirus-like__KM036372
augaugauggccagcaaggacgcucccaccuccccugauggcgccucuggggcgggacagcuggugccggaggcuaacacagccgaacaaaucagcauggaccccgucgccggcgcuuccacggccguugcuaccgccgggcaggucaauaugauugauccuuggaucuucaacaauuuugugcaggcgccccagggagaguucacaauuucuccuaacaauacccccggcgacauccucuuugaucugcaacuugggccucaccugaacccguuccucgcccaucugagccagauguacaauggaugggucggcaacaugagagugcggauucuucuggcuggcaaugccuuuacagcugggaaaaucaucauuugcuguguucccccuggauucgacgcccgcauccucaccauugcgcaggccacacuguuuccccaccugaucgcugaugugagaacccucgaaccugucgagcugccccuugaagacgugcggaacguucuguaucauaauuccucucagccgcaaccuacgaugcgccucguggccaugcuguacacaccccuuagaaccggcgggggaagcggcgggaccgaugcuuucgucguggccggacgggugcugacaugcccugcccccgacuuuuccuuccucuuucuggugcccccuagcguugagcagaagacccgcguguucucugugccgaacauuccccugaaagaucucuccaauagcagagucccugugcccguucagggcauguuugugucuccugacgucaaccaguccgugcaauuccagaauggccggugucagaucgaugggcaacugcagggaacgacacccguuagccuuucucagcugugcaagauucgcggcaaaaccuccagcaacgcuagagugcucaaccuguccgaggucgacgggacaccguucaucccucuugaaucucccgcgccugugggauuucccgaccugggcgggugugauuggcacgucaauuucaccuuucagacccaagaccgggauccuagccaguccgugacauucgccacgaacgacgcuagcuuuguucccuaucucggaucuguguccccgcauaauggcgagggcuuccaggccggggauaucauuggaagccugggcuggaucucugccccuagcgacaacucccaguuuaaugucugggcuauucccaaguacgggucuagccugcccgaugugacccaccucgccccugcgguuuucccgcccggauuuggcgaagugauccuguauuucuacuccacauuuccugggagcggccaacccucucagcuucaggucccuugccugcucccccaggaguucauuacccacuuuuguaacgagcaagcuccuaucgccggagaagccgcucugcuucauuauguggaccccgauacaggccgcaaucugggggaguucaagcucuacccggacggauucaugaccugcgugccuaacuccguuagcucuggcccccagacgcugccuaucaauggggucuuuguguucguguccugggucagcagauuuuaccagcugaaacccgugggaacagccuccgcugcccggcgccucuga

SEQ ID NO: 30507 - RNA, 1608 nt, Artificial Sequence
  derived and/or modified sequence opt5 from VP1__Norovirus_and/or_Norovirus-like__AF538678
augaagauggccagcaaagacgcucccccuuccccggauggcgccucuggggcgggacagcuggugcccgaggucaacaccgcugaccaaaucagcauggauccuguugccggcgccuccacagcuguggccacggcuggacaggugaauaugauugaccccuggaucuucaacaauuuuguccaggccccucagggggaguucaccauuucucccaacaauacaccuggcgauauccucuuugaccugcaacuugggccgcaccugaaccccuuccucgcgcaucugagccagauguacaauggaugggugggcaacaugagaguucggauucuucuggccggcaaugcuuuuaccgccgggaagaucaucauuugcugugugccucccggauucgaugcucgcauccucacaauugcccaggcgacccuguuuccucaccugaucgccgacgucagaacacucgaacccguggaacugccgcuugaggauguucggaacgugcuguaucauaauuccucucagccucaacccaccaugcgccucgucgcuaugcuguacacgccucuuagaaccggcgggggaagcggcgggacagacgccuucgugguggcuggacggguccugaccugccccgcccccgauuuuuccuuccucuuucugguuccuccgagcguggaacagaaaacacgcguguucucuguccccaacauuccucugaaggaccucuccaauagcagagugcccacccugauccagggcauguuuguuucuccugaugugaaccaguccguccaauuccagaauggccggugucagauugacgggcaacuucagggaacgacacccgugagccugucucagcucugcaaaauccgcggcaagaccuccagcaacacaagaguucugaaccuuuccgagguggacgggaccccguucgucccucuggagucucccgccccugugggauuucccgauaucggcgggugugacuggcacgucggauucaccuuugaagcucgggaucaggacccuagccaaaaugugacauucgcgacgaacgauuccagcuuuguucccuaucucggcucuauuuccccgcauaauggcgacggguuccacagcggagauaucgugggcucucuggacuggauuagcgccccuuccgaugggucugcucuggacgucuggagcauccccaaguacggauccagccuccccgaugugacccaccuggccccuguuguguuuccgcccggcuucggggaggucauucuuuauuuucauucuaaauucccuggcuccggacccacagacaagcugcgcgugccuugccucaugccccaggaauuuaucacccacuucuguaacgagcaggccccuaucgcuggcgaggccgcgcugcuucauuacguggaccccgauacagggagaaaucugggagaauuuaaacucuauagcgacggcuucaugaccugcguuccgaacucuauuuccagcgggccucagacgcugcccaucaauggagucuucguguuuguguccugggucucucgguucuaccaacugaagccugugggcacagcuagcgccgcccgcagacucuga

SEQ ID NO: 30508 - RNA, 1608 nt, Artificial Sequence
  derived and/or modified sequence opt5 from VP1__Norovirus_and/or_Norovirus-like__KC294198
augaugauggccagcaaggacgcucccaccuccccugauggcgccucuggggcgggacagcuggugccggaagcuaacacagccgaacaaaucagcauggaccccgucgccggcgcuuccacggccguugcuaccgccgggcaggucaauaugauugauccuuggaucuucaacaauuuugugcaggcgccccagggagaguucacaauuucuccuaacaauacccccggcgacauccucuuugaucugcaacuugggccucaccugaacccguuccucgcccaucugagccagauguacaauggaugggucggcaacaugagagugcggauucuucuggcuggcaaugccuuuacagcugggaaaaucaucauuugcuguguucccccuggauucgacgcccgcauccucaccauugcgcaggccacacuguuuccccaccugaucgcugaugugagaacccucgaaccugucgagcugccccuugaagacgugcggaacguucuguuccauaauuccucucagccgcaaccuacgaugcgccucguggccaugcuguauacaccccuuagaaccggcgggggaagcggcgggaccgaugcuuuugucguggccggacgggugcugacaugcccugcccccgacuucuccuuucucuuccuggugcccccuagcguugagcagaagacccgcguguuuucugugccgaacauuccccugaaagaucucuccaauagcagagucccugugcccguucagggcauguucaugucuccugacgugaaccaguccguccaauuccagaauggccggugucagaucgaugggcaacugcagggaacgacacccgugagccuuucucagcugugcaagauucgcggcaaaaccuccagcaacgcuagaguucucaaccuguccgagguggacgggacaccguuuaucccucuugaaucucccgcgccugucggauuccccgaccugggcgggugugauuggcacgugaauuuuaccuuccaggcccaaaaccaggacccuagccaguccgucaccuuugcuacaaaugaugccagcuucgugcccuaccucggaucuaucuccccgcauaacggcggcgacuuucacgccggggauauuaucggaagccugggcuggauuucugcuccuagcgacaauucccagcugaacguuuggacgauccccaaguaugggucuagccuccccgaugugacccaccuggccccugcggucuucccgcccggauuuggcgaggugauucuuuacuucuauuccacauuuccugggagcggccaaucuucccagcugcagguucccugccuccugccucaggaguucaucacccauuuuuguaaugaacaagcucccaucgccggagaggccgcccuucugcacuacguggacccugauacaggccggaaccucggggaguucaagcuguaucccgacggauucaugaccugcgucccgaauagcgugucuuccggcccucagacgcugcccauuaacgggguguuuguuuucgucagcugggugucccgcuuuuaccagcucaaaccugugggaacagcuucugcugccagacggcuguga

SEQ ID NO: 30509 - RNA, 1608 nt, Artificial Sequence
  derived and/or modified sequence opt5 from VP1__Norovirus_and/or_Norovirus-like__KT732280
augaugauggccagcaaggacgcucccaccuccccugauggcgccucuggggcgggacagcuggugccggaggucaacacagcugaccaaaucagcauggaucccguugccggcgccuccacggcuguggccaccgcuggacaggugaauaugauugacccuuggaucuucaacaauuuuguccaggcgccccagggggaguucacaauuucuccuaacaauacccccggcgauauccucuuugaccugcaacuugggccucaccugaacccguuccucgcccaucugagccagauguacaauggaugggugggcaacaugagaguucggauucuucuggccggcaaugcuuuuacagccgggaaaaucaucauuugcugugugcccccuggauucgaugcucgcauccucaccauugcccaggcgacacuguuuccccacaugaucgccgacgucagaacccuggaaccuguggaacucccccuggaggauguucggaacgugcuuuaucauaauuccucucagccgcaaccuacgaugcgccuggucgcuaugcucuacacaccccugagaaccggcgggggaagcggcgggaccgacgccuucgugguggcuggacggguccuuacaugcccugcccccgauuuuuccuuccuguuucucguucccccuagcguggaacagaagacccgcguguucucugucccgaacauuccccugaaagaccuguccaauagcagagugccuacgcucauccagggcauguuuguuucucccgaugugaaccaguccguccaauuccagaauggccggugucagauugacgggcaacugcagggaacaaccccugugagccuuucucagcugugcaagauccgcggcaaaacauccagcaacgccagaguucucaaccuguccgagguggacgggacccccuucgucccgcuugagucuccugcucccgugggauuuccugaucugggcgggugugacuggcacgucggauucaccuuugaagcgcgggaucaggaccccagccaaaaugugacauucgccacgaacgauuccagcuuuguuccuuaucucggcucuaucagcccccauaauggcgacggguuccacuccggagauauuaucggcucucuggacuggauuagcgcuccguccgaugggucuacccuggacguguggagcaucccuaaguacggauccagccuccccgaugucacacaccuggcccccgccguguuuccuccgggcuucggggagguuauucuuuauuuucauucuaaguuccccggcuccggaccuaccgacaaacugcgcgugcccugccucaucccucaggaauuuaucacacacuucuguaacgagcaggcucccauugccggcgaggcggcucugcuucauuacgucgacccugauaccgggagaaaucugggagaauuuaagcucuaucccgacggcuucaugacgugcgugccgaacagcaucucuuccgggccucagacacugcccaccaauggaguguucguuuuugucagcugggugucccgguucuaccaacugaaaccugugggcaccgccucuauggcccgcagacucuga

SEQ ID NO: 30510 - RNA, 1608 nt, Artificial Sequence
  derived and/or modified sequence opt5 from VP1__Norovirus_and/or_Norovirus-like__LC101822
augaugauggccagcaaggacgugcccaccuccccugauggcgcuucuggggccggacagcuggucccggagguuaacacagcggaccaaaucagcauggaucccguggcuggcgccuccacggccguggcuaccgccgggcaggucaauaugauugacccuuggaucuucaacaauuuugugcaggcuccccagggagaguucacaauuucuccuaacaauacccccggcgauauccucuuugaccugcaacuugggccucaccugaacccguuccucgcccaucugagccagauguacaauggauggguuggcaacaugagagugcggauucuucuggcgggcaaugccuuuacagcugggaaaaucaucauuugcugugugcccccuggauucgaugcccgcauccucaccauugcucaggccacacuguuuccccaccugaucgcggacgucagaacccucgaaccuguugaacugccccuugaggaugugcggaacguccuguaucauaauuccucucagccgcaaccuacgaugcgccucguggccaugcuguacacaccccuuagaaccggcgggggaagcggcgggaccgacgcuuucguggucgccggacggguucugacaugcccugcucccgauuuuuccuuccucuuucuggugcccccuagcguggaacagaagacccgcgucuucucugugccgaacauuccccugaaagaccucuccaauagcagaguuccuacgcugauccagggcauguuugugucucccgaugucaaccaguccgugcaauuccagaauggccggugucagauugacgggcaacuucagggaacaaccccuguuagccugucucagcucugcaagauccgcggcaaaacauccagcaacaccagagugcugaaccuuuccgaggucgacgggacccccuucgugccgcuggagucuccugcccccgucggauuuccugauaucggcgggugugacuggcacgugggauucacauuugaagcccgggaucagggccccagccaaaauguuacguucgcuaccaacgacuccagcuuugugccuuaucucggcucuauuagcccccauaauggggauggauuccacuccggcgacaucauugggucucuggauuggaucagcgcgccguccgacggaucugcccuggaugucuggagcauuccuaaguacggcuccagccuccccgacgugacacaccuggcucccgccguuuuuccuccgggguucggcgaggugauccuuuauuuucauucuaaguuccccggauccggcccuaccgauaaacugcgcguccccugccucaugccucaggaauuuaucacacacuucugugacgagcaggcccccauugcuggggaggccgcgcugcuucauuacguggacccugaugcuggaagaaaccugggcgaauuuaagcucuaucccgacggguucaugaccugcgugccgaauagcaucucuuccggaccucagacgcugcccauuaacggcguuuucgucuuugugagcugggugucccgguucuaccaacugaaaccugucgggacagccucuauggcccgcagacucuga

SEQ ID NO: 30511 - RNA, 1608 nt, Artificial Sequence
  derived and/or modified sequence opt5 from VP1__Norovirus_and/or_Norovirus-like__KP407451
augaugauggccagcaaggacgcucccaccuccccugauggcgccucuggggcgggacagcuggugccggaggcuaacacagccgaacaaaucagcauggaccccgucgccggcgcuuccacggccguugcuaccgccgggcaggucaauaugauugauccuuggaucuucaacaauuuugugcaggcgccccagggagaguucacaauuucuccuaacaauacccccggcgacauccucuuugaucugcaacuugggccucaccugaacccguuccucgcccaucugagccagauguacaauggaugggucggcaacaugagagugcggauucuucuggcuggcaaugccuuuacagcugggaaaaucaucauuugcuguguucccccuggauucgacgcccgcauccucaccauugcgcaggccacacuguuuccccaccugaucgcugaugugagaacccucgaaccugucgagcugccccuugaagacgugcggaacguucuguaucauaauuccucucagccgcaaccuacgaugcgccucguggccaugcuguacacaccccuuagaaccggcgggggaagcggcgggaccgaugcuuucgucguggccggacgggugcugacaugcccugcccccgacuuuuccuuccucuuucuggugcccccuagcguugagcagaagacccgcguguucucugugccgaacauuccccugaaagaucucuccaauagcagagucccugugcccauccagggcauguuuaugucuccugacguuaaccaguccgugcaauuccagaauggccggugucagauugaugggcaacugcagggaacgacacccgucagccuuucucagcugugcaagauccgcggcaaaaccuccagcaacgcuagagugcucaaccuguccgagguugacgggacaccguucaucccucuugaaucucccgcgccugugggauuucccgaccugggcgggugugauuggcacgucaauuucagcuuucagacccaagaccgggauccuucccagagcgugaccuucgccacaaacgacgcuucuuuuguccccuaucucggauccgugagcccgcauaauggcgagggcuuccaggccggggauauuaucggaucucugggcuggauuagcgccccuuccgacaacucucaguuuaauguuugggcuauccccaaguacgggagcucccugcccgaugugacgcaccucgccccugcggucuucccgcccggauuuggcgaagugauucuguauuucuacagcaccuuuccugggucuggccaacccucccagcuucagguuccuugccugcucccccaggaguucaucacacacuuuuguaacgagcaagcuccuaucgccggagaagccgcucugcuucauuauguggaccccgauaccggccgcaaucugggggaguucaagcucuacccggacggauucaugacaugcgucccuaacagcgugucuuccggcccccagacccugccuauuaaugggguguuuguuuucgucagcuggguguccagauuuuaccagcugaaacccgugggaacggccucugcugcccggcgccucuga

SEQ ID NO: 30512 - RNA, 1608 nt, Artificial Sequence
  derived and/or modified sequence opt5 from VP1__Norovirus_and/or_Norovirus-like__LN854564
augaugauggccagcaaggacgcucccaccuccccugauggcgccucuggggcgggacagcuggugccggaggcuaacacagccgaacaaaucagcauggaccccgucgccggcgcuuccacggccguugcuaccgccgggcaggucaauaugauugauccuuggaucuucaacaauuuugugcaggcgccccagggagaguucacaauuucuccuaacaauacccccggcgacauccucuuugaucugcaacuugggccucaccugaacccguuccucgcccaucugagccagauguacaauggaugggucggcaacaugagagugcggauucuucuggcuggcaaugccuuuacagcugggaaaaucaucauuugcuguguucccccuggauucgacgcccgcauccucaccauugcgcaggccacacuguuuccccaccugaucgcugaugugagaacccucgaaccugucgagcugccccuugaagacgugcggaacguucuguaucauaauuccucucagccgcaaccuacgaugcgccucguggccaugcuguacacaccccuuagaaccggcgggggaagcggcgggaccgaugcuuucgucguggccggacgggugcugacaugcccugcccccgacuuuuccuuccucuuucuggugcccccuagcguugagcagaagacccgcguguucucugugccgaacauuccccugaaagaucucuccaauagcagagucccugugcccauccagggcauguuuaugucuccugacguuaaccaguccgugcaauuccagaauggccggugucagauugaugggcaacugcagggaacgacacccgucagccuuucucagcugugcaagauccgcggcaaaaccuccagcaacgcuagagugcucaaccuguccgagguugacgggacaccguucaucccucuugaaucucccgcgccugugggauuucccgaccugggcgggugugauuggcacgucaauuucaccuuucaggcccaaaaccaggacccuagccaguccgugaccuucgcuacaaaugaugccagcuuuguccccuaucucggaucuauuuccccgcauaacggcggcgacuuccacgccggggauaucauuggaagccugggcuggaucucugcuccuagcgacaauucccagcugaacguguggacgauucccaaguacgggucuagccuccccgauguuacccaccuggccccugcgguguuuccgcccggauucggcgaggucauccuuuauuuuuacuccacauucccugggagcggccaacccucucagcuucaggugccuugccuccugccccaggaauuuaucacccauuucuguaaugagcaagcuccuauugccggagaggccgcucugcugcacuauguugaccccgauacaggccggaaccucggggaauuuaagcuguacccggacggauucaugaccugcgugccuaauuccgucagcucuggcccccagacgcugccuaucaacgggguguucguguuuguuuccugggucagccgcuucuaccagcucaaacccgugggaacagccuccgcugccagacggcuguga

SEQ ID NO: 30513 - RNA, 1608 nt, Artificial Sequence
  derived and/or modified sequence opt5 from VP1__Norovirus_and/or_Norovirus-like__JQ388274
augaugauggccagcaaggacgcucccaccuccccugauggcgccucuggggcgggacagcuggugccggaggcuaacacagccgaacaaaucagcauggaccccgucgccggcgcuuccacggccguugcuaccgccgggcaggucaauaugauugauccuuggaucuucaacaauuuugugcaggcgccccagggagaguucacaauuucuccuaacaauacccccggcgacauccucuuugaucugcaacuugggccucaccugaacccguuccucgcccaucugagccagauguacaauggaugggucggcaacaugagagugcggauucuucuggcuggcaaugccuuuacagcugggaaaaucaucauuugcuguguucccccuggauucgacgcccgcauccucaccauugcgcaggccacacuguuuccccaccugaucgcugaugugagaacccucgaaccugucgagcugccccuugaagacgugcggaacguucuguaucauaauuccucucagccgcaaccuacgaugcgccucguggccaugcuguacacaccccuuagaaccggcgggggaagcggcgggaccgaugcuuucgucguggccggacgggugcugacaugcccugcccccgacuuuuccuuccucuuucuggugcccccuagcguugagcagaagacccgcguguucucugugccgaacauuccccugaaagaucucuccaauagcagagucccugugcccguucagggcauguuuaugucuccugacgugaaccaguccguccaauuccagaauggccggugucagaucgaugggcaacugcagggaacgacacccgugagccuuucucagcugugcaagauucgcggcaaaaccuccagcaacgcuagaguucucaaccuguccgagguggacgggacaccguucaucccucuugaaucucccgcgccugucggauuucccgaccugggcgggugugauuggcacgugaauuucaccuuucaggcccaaaaccaggacccuagccaguccgucaccuucgcuacaaaugaugccagcuuugugcccuaucucggaucuaucuccccgcauaacggcggcgacuuccacgccggggauauuaucggaagccugggcuggauuucugcuccuagcgacaauucccagcugaacguuuggacgauccccaaguacgggucuagccuccccgaugugacccaccuggccccugcggucuuuccgcccggauucggcgaggugauucuuuauuuuuacuccacauucccugggagcggccaacccucucagcugcagguuccuugccuccugccccaggaauuuaucacccauuucuguaaugagcaagcuccuaucgccggagaggccgcccuucugcacuauguggaccccgauacaggccggaaccucggggaauuuaagcuguacccggacggauucaugaccugcgucccuaauuccgugagcucuggcccccagacgcugccuauuaacgggguguucguuuuugucuccugggugagccgcuucuaccagcucaaacccgugggaacagcuuccgcugccagacggcuguga

SEQ ID NO: 30514 - RNA, 1608 nt, Artificial Sequence
  derived and/or modified sequence opt5 from VP1__Norovirus_and/or_Norovirus-like__KP027330
augaugauggccagcaaggacgcucccaccuccccugauggcgccucuggggcgggacagcuggugccggaggucaacacagcugaccaaaucagcauggaucccguugccggcgccuccacggcuguggccaccgcuggacaggugaauaugauugacccuuggaucuucaacaauuuuguccaggcgccccagggggaguucacaauuucuccuaacaauacccccggcgauauccucuuugaccugcaacuugggccucaccugaacccguuccucgcccaucugagccagauguacaauggaugggugggcaacaugagaguucggauucuucuggccggcaaugcuuuuacagccgggaaaaucaucauuugcugugugcccccuggauucgaugcucgcauccucaccauugcccaggcgacacuguuuccccacaugaucgccgacgucagaacccuggaaccuguggaacucccccuggaggauguucggaacgugcuuuaucauaauuccucucagccgcaaccuacgaugcgccuggucgcuaugcucuacacaccccugagaaccggcgggggaagcggcgggaccgacgccuucgugguggcuggacggguccuuacaugcccugcccccgauuuuuccuuccuguuucucguucccccuagcguggaacagaagacccgcguguucucugucccgaacauuccccugaaagaccuguccaauagcagagugccuacgcucauccagggcauguuuguuucucccgaugugaaccaguccguccaauuccagaauggccggugucagauugacgggcaacugcagggaacaaccccugugagccuuucucagcugugcaagauccgcggcaaaacauccagcaacgccagaguucucaaccuguccgagguggacgggacccccuucgucccgcuugagucuccugcucccgugggauuuccugaucugggcgggugugacuggcacgucggauucaccuuugaagcgcgggaucaggaccccagccaaaaugugacauucgccacgaacgauuccagcuuuguuccuuaucucggcucuaucagcccccauaauggcgacggguuccacuccggagauauuaucggcucucuggacuggauuagcgcuccguccgaugggucuacccuggacguguggagcaucccuaaguacggauccagccuccccgaugucacacaccuggcccccgccguguuuccuccgggcuucggggagguuauucuuuauuuucauucuaaguuccccggcuccggaccuaccgacaaacugcgcgugcccugccucaucccucaggaauuuaucacacacuucuguaacgagcaggcucccauugccggcgaggcggcucugcuucauuacgucgacccugauaccgggagaaaucugggagaauuuaagcucuaucccgacggcuacaugacgugcgugccgaacagcaucucuuccgggccucagacacugcccaccaauggaguguucguuuucgucagcugggugucccgguuuuaccaacugaaaccugugggcaccgccucuauggcccgcagacucuga

SEQ ID NO: 30515 - RNA, 1608 nt, Artificial Sequence
  derived and/or modified sequence opt5 from VP1__Norovirus_and/or_Norovirus-like__AF093797
augaugauggccagcaaggacgcucccccuuccccggauggcgccucuggggcgggacagcuggugcccgaggucaacaccgcugaccaaaucagcauggauccuguugccggcgccuccacagcuguggccacggcuggacaggugaauaugauugaccccuggaucuucaacaauuuuguccaggccccucagggggaguucaccauuucucccaacaauacaccuggcgauauccucuuugaccugcaacuugggccgcaccugaaccccuuccucgcgcaucugagccagauguacaauggaugggugggcaacaugagaguucggauucuucuggccggcaaugcuuuuaccgccgggaaagugaucaucugcugugucccucccggauucgaugcucgcauucucacaaucgcccaggcgacccuguuuccucaccugauugccgacgugagaacacucgaacccguugaacugccgcuugaggaugugcggaacguccuguaucauaauuccucucagccucaacccaccaugcgccucguggcuaugcuguacacgccucuuagaaccggcgggggaagcggcgggacagacgccuucguggucgcuggacggguucugaccugccccgcccccgauuuuuccuuccucuuucuggugccuccgagcguggaacagaagacacgcgucuucucugugcccaacaucccucugaaagaccucuccaauagcagaguucccacccugauucagggcauguuugugucuccugaugucaaccaguccgugcaauuccagaauggccggugucagaucgacgggcaacuucagggaacgacacccguuagccugucucagcucugcaagauucgcggcagaaccuccagcaacacacgggugcugaaccuuuccgaggucgacgggaccccguucgugccucuggagucucccgccccugucggauuucccgauaucggcgggugugacuggcacgugggauucaccuuugaagcucgcgaucaggacccuagccaaaauguuacauucgcgacgaacgauuccagcuuugugcccuaucucggcucuaucuccccgcauaauggcgacggguuccacagcggagauauuaucggcucucuggacuggauuagcgccccuuccgaugggucugcucuggacgucuggagcauccccaaauacggauccagccuccccgaugugacccaccuggccccugccguuuuuccgcccggcuucggggaggugauucuuuauuuucauucuaaguucccuggcuccggacccacagacaagcugagagucccuugccucaucccccaggaauuuaucacccacuucuguaacgagcaggcuccuauugccggcgaggcggcucugcuucauuacguggaccccgauacagggcggaaucugggagaauuuaaacucuauccggacggcuucaugaccugcgugccuaacagcaucucuuccgggccccagacgcugccuauuaauggaguuuucgucuuugugagcugggugucccgcuucuaccaacugaagcccgucggcacagccucugccgcuagacggcucuga

SEQ ID NO: 30516 - RNA, 1608 nt, Artificial Sequence
  derived and/or modified sequence opt5 from VP1__Norovirus_and/or_Norovirus-like__AB810006
augaagauggccagcaacgacgcugcccccuccaaugauggcgcggcuucucuggugccugaggccaucaacgaaaccaugccgcucgagcccgucgccggggcuagcauugccgcuccuguugccggacagacaaauaucauugaccccuggaucagaacgaacuucgugcaagcgccuaauggcgaauuuaccgugucuccccggaacuccccuggggagauucugcuuaaucuggaacucggaccggaucugaaccccuaccuugcccaccugagccgcauguauaauggcuacgcugggggagucgaggugcagguucuccuggccggcaacgcuuucacagccggcaaaauccuguuugcggccaucccucccaauuucccuguggacaugauuucccccgcucagaucaccaugcucccgcaucugauugucgaugugagaacacuugagccuaucaugauuccccugccugacguucggaacguguuuuaucacuucaauaaccagccccaaccccgcaugagacucgucgccaugcuguacaccccucuucggucuaaugggagcggagaugacguguuuacaguguccugccgcguccugaccagaccgacgcccgauuucgaauuuaucuaucucguuccucccagcguggagucuaagaccaaaccuuucacacugcccauucugaccaucuccgaacucacaaacagccgguuuccgaucccuauugagcagcuguacaccgcucccaacgagaauaacgugguccagugucagaauggccgcugcacgcuugacggggaacugcaaggaacaacccagcuccugucuuccgccguguguagcuauagaggccggacaguugccaaccgcggggauaauugggaccagaaccuucugcagcucaccuacccuucuggagcuuccuacgaucccaccgacgaggugccugcgccccugggcacacaagacuucagcggcauccuguaugggguccucacgcaggauaauguguccgaaggaaccggcgaggccaagaacgcuaaagggguuuacauuucuacaaccagcggaaaguuuacaccgaagaucggcuccauugggcugcauagcaucaccgaaaaugugcacccuaaccagcaaucuagauucacgcccgucggaguggcccagaaugagaacacacccuuccagcaguggguccuuccucauuaugccggcgcucuggcccucaauaccaaccuggcgccggcuguggcccccaccuuuccuggcgagcaacuucuguucuuucggucccgcguucccugcgugcaggggcucagaggacaggacgccuucaucgauugucugcugccucaggaaugggucaaucacuuuuaccaagaggcugcccccagccaggcugacguggcccucauucgguauguuaacccugauacaggcagaacccuguucgaagcgaaacuucaccgcucuggguuuaucacagugagccauacgggagccuacccccuggucgugccgccuaacggccccuuccgguuugacuccugggugaaucaguucuauucucucgcuccuauggggaccggcuga

SEQ ID NO: 30517 - RNA, 1605 nt, Artificial Sequence
  derived and/or modified sequence opt5 from VP1__Norovirus_and/or_Norovirus-like__LC101825
augaugauggccagcaaggacgcuacccccuccgccgauggcgcgaacggggcuggacagcuggugccugaggucaauaacgccgaaccgcucccccuggacccuguugccggcgcuucuacagcccuugcuacggccgggcaagugaauaugaucgaucccuggaucuucaacaauuuugugcaggcgccucagggagaguucaccaucagccccaacaauacaccuggcgacauucuguuugaucuccagcuggggccgcaccuuaaccccuuccuggcccaucucucccaaauguacaauggaugggucggcaacaugagagugcggguuauccuggcuggcaaugccuuuaccgcugggaaagugauuaucugcugugucccucccggauuccagucucgcacacugagcaucgcccaggcgacccucuuuccucacgugauugccgacguuagaacacuggaaccccuugagaucccgcuggaagaugugcggaacacccucuaucauaauaacgacucccagccuacgaugcgccugcuuugcaugcuguacacaccccucagaaccggcgggggaucuggcgggaccgaugcuuucgucguggccggacgggugcugacauguccuagccccgacuuuaauuuccuguuucucguucccccuaccgucgagcaaaagacgcgcccguucuccgugcccaacauuccucugcagaaccuuagcaauucuagagugcccucccugauccagagcaugguccucucuuccgaucacgcucagacagugcaauuucagaacggccggugcaccacagacggccaucugcuugggaccaccccuguuagcucuggacagcugaugaaauuccgcggcaaggugacacccggguccaaaguccucaaucugacggagcuggauggaagcccguuccucgccuuugaaccucccgccccugcuggcuuccccgaccuggggaagugugacuggcacauugagaugucccuuuaucaagugaacaaucaggauaacccuaucguucugagagcgauugaacccaauucuagcuccuuugugccgcaccucggaagcgucucuuucaaccagaauguggacgccgcuggcgauuacgucugcaccauccaguauacauccccucccagcaacucucaugacgccgauguggacuuuuggagcauccccgauuacggcuccaaucuggccgaggcuucucaacuugccccuguuguguauccgcccggguucggagaggcgauugucuacuuuaugagccgggugccuggcuggaaccgcaccaauagacugaaccucguucccugucugcugccucaggaguucaucgggcacuuuguguccgaacaggcucccgccauuggagaagccgcucuccugcauuacgucgacccugauacaaaucggaaccuuggcgaguucaagcuguaucccgaaggguuuauuaccugcgugccgaacggcacgggaccucagcaacucccccugaauggcguguucguuuuuagcucuugggucucccgcuucuaccagcugaaaccuguggggacagccagcucugcuagauga

SEQ ID NO: 30518 - RNA, 1605 nt, Artificial Sequence
  derived and/or modified sequence opt5 from VP1__Norovirus_and/or_Norovirus-like__AB081723
augaugauggccagcaaggacgcucccaccuccccugauggcgccucuggggcgggacagcuggugccggaggcuaacacagccgaacaaaucagcauggaccccgucgccggcgcuuccacggccguugcuaccgccgggcaggucaauaugauugauccuuggaucuucaacaauuuugugcaggcgccccagggagaguucacaauuucuccuaacaauacccccggcgacauccucuuugaucugcaacuugggccucaccugaacccguuccucgcccaucugagccagauguacaauggaugggucggcaacaugagagugcggauucuucuggcuggcaaugccuuuacagcugggaaaaucaucauuugcuguguucccccuggauucgacgcccgcauccucaccauugcgcaggccacacuguuuccccaccugaucgcugaugugagaacccucgaaccugucgagcugccccuugaagacgugcggaacguucuguaucauaauuccucucagccgcaaccuacgaugcgccucguggccaugcuguacacaccccuuagaaccggcgggggaagcggcgggaccgaugcuuucgucguggccggacgggugcugacaugcccugcccccgacuuuuccuuccucuuucuggugcccccuagcguugagcagaagacccgcguguucucugugccgaacauuccccugaaagaucucuccaauagcagagucccugugcccauccagggcauguuuaugucuccugacguuaaccaguccgugcaauuccagaauggccggugucagauugaugggcaacugcagggaacgacacccgucagccuuucucagcugugcaagauccgcggcaaaaccuccagcaacgcuagagugcucaaccuguccgagguugacgggacaccguucaucccucuugaaucucccgcgccugugggauuucccgaccugggcgggugugauuggcacgucaauuucaccuuucaggcccaaaaccaggacccuagccaguccgugaccuucgcuacaaaugaugccagcuuuguccccuaucucggaucuauuuccccgcauaacggcggcgacuuccacgccggggauaucauuggaagccugggcuggaucucugcuccuagcgacaauacgcagcugaacguguggaccauucccaaguacggguccucucuccaaaugagccugacacuucaucugcucugcagcccccggcugugggagguuauccuuuauuuuuacuccaccuucccuggaucuggccagccgucccagcuucaggugcccugucuccugccucaagaauuuaucacacacuucugcaaugagcaggcccccauugcgggggaggcugcccugcuccacuaugucgauccugacaccggccgcaaccugggagaauuuaagcuguaccccgauggcuucaugacgugugugccuaauagcguuucuuccgggccccagacacugccgaucaacggaguguuugucuucgugagcuggguguccagauucuaccagcucaaaccuguuggcaccgccucugcugcccggcgccuguga

SEQ ID NO: 30519 - RNA, 1605 nt, Artificial Sequence
  derived and/or modified sequence opt5 from VP1__Norovirus_and/or_Norovirus-like__JN005886
augaugauggccagcaaggacgcucccuccaacauggauggcaccucuggggccggacagcuggugccugaggucaaugcggcugaaccgcucccccuggagccuguugugggcgccgccacagcugccgcuacggccgggcaagugaaccuuaucgaccccuggauuaugaauaacuucguccaggcgccugaaggagaguuuaccaucagccccaauaacacaccuggcgauauucuguucgaccuccaccuggggccgcaucuuaaucccuuucugcagcaccucucccagauguacaacggaugggugggcaauaugagaguucgggugaugcuggccggcaacgcuuucaccgccgggaaaaucauuaucugcugugucccucccggauuugcuucucaaaauaucagcauuggccaggccacaauguucccucaugugaucgcggauguucgcgugcuggaacccauugagaucccgcucgacgaugucagaaacgugcuguuucacaccaaugagaaccggccuacaaugcgccuucugugcaugcucuauacgccccugagagccgggggagcuuccucuggcaccgacccuuucgugauugccgggcggguccuuaccugucccagccccgauuuuaauuuccuguuucucguuccuccguccguggaacagaagacacgccagcugaccgugcccaacaucccucugaacaaucucgcuaacagcagaguccccgccaugauuaauaaaaugacagugucuaccgaccaaaaccagguugugcaguuccagaauggacggugcacgcuggagggccaacuucugggcacaaccccugucuccgccagccagguggcucgcaucagagggaagguuuucucuacagcguccggaaaaggccucaaccugaccgaacuugaugggacccccuaccaugccuucgagagcccggcuccucugggauuccccgacaucggcgccugugauuggcacgugucuacauuuaaggucgaccagaaucucuccggggacccuaugagccggcuggaugugaagcaaaacgcccccuucgcuccucaccugggauccauugaguuuacgucugaccaggaucccaccggcgaccagcucggcacacuggccugggucagcccguccaccagcggggcgcgcguggauccuuggaaaauccccucuuauggauccacaguuaccgaaagcacgcaucuugcucccccuauuuucccgcccggcuuuggggaggccaucguguacuucaugucugacuuuccuauugucagcggaaauacagcccaggugcccugcacccugccucaagaauuuguuucccacuuuguggagcagcaggcucccgucagaggcgaagccgcucuccugcauuauguggauccugacacccaccggaaccuuggggaguucaagcuguaccccgauggcuuuaucacaugugugccgaauaccggaggcgggccucagaaccuccccacaaauggaguuuucgucuuuucuagcugggugucccgcuauuaccaacugaaaccugugggcacggccgggcccgcgagacggcuguga

SEQ ID NO: 30520 - RNA, 1605 nt, Artificial Sequence
  derived and/or modified sequence opt5 from VP1__Norovirus_and/or_Norovirus-like__AB758449
augaugauggccagcaaggacgcucccuccaacauggauggcaccucuggggccggacagcuggugccugaggucaaugcggcugaaccgcucccccuggagccuguugugggcgccgccacagcugccgcuacggccgggcaagugaaccuuaucgaccccuggauuaugaauaacuucguccaggcgccugaaggagaguuuaccaucagccccaauaacacaccuggcgauauucuguucgaccuccagcuggggccgcaccuuaaucccuuucugcagcaucucucccaaauguacaacggaugggugggcaauaugagaguucgggugaugcuggccggcaacgcuuucaccgccgggaaaaucauuaucugcugugucccucccggauuugcuucucagaauaucagcauuggccaggccacaauguucccucacgugaucgcggauguucgcgugcuggaacccauugagaucccgcucgacgaugucagaaacgugcuguuucauaccaaugagaaccggccuacaaugcgccuucugugcaugcucuauacgccccugagagccgggggagcuuccucuggcaccgacccuuucgugauugccgggcggguccuuaccugucccagccccgauuuuaauuuccuguuucucguuccuccguccguggaacagaagacacgccaacugaccgugcccaacaucccucugaacaaucucgcuaacagcagaguccccgccaugauuaauaaaaugacagugucuaccgaccagaaccagguugugcaguuccaaaauggacggugcacgcuggagggccagcuucugggcacaaccccugucuccgccagccagguggcucgcaucagagggaagguguuuucuacagcguccggaaaaggccucaaccugaccgaacuugaugggacccccuaccacgccuucgagagcccggcuccucugggauuccccgacaucggcgccugugauuggcauguuucuacauuuaaggucgaccaaaaucucuccggggacccuaugagccggcuggauauuaagcagaacgcccccuucgcuccucaccugggauccaucgaguuuacgucugaccaggaacccaccggcgaucagcucggcacacuggccugggugagcccguccaccagcggggcgcgcgucgacccuuggaaaauucccucuuauggauccacagugaccgagagcacgcaccuugcucccccuaucuucccgcccggcuuuggggaagccauuguuuacuucaugucugauuuuccuaucgugagcggaaauacagcccaaguccccugcacccugccucaggaguucgugucccauuuuguugaacagcaggcucccaucagaggcgaggccgcucuccugcacuauguggacccugauacccaucggaaccuuggggaguucaagcuguaccccgacggcuuuauuacaugugucccgaauaccggaggcgggccucaaaaccuccccaucaauggaguguucguguuuucuagcuggguuucccgcuauuaccagcugaaaccugucggcacagccgggcccgcgagacggcuguga

SEQ ID NO: 30521 - RNA, 1605 nt, Artificial Sequence
  derived and/or modified sequence opt5 from VP1__Norovirus_and/or_Norovirus-like__KX907729
augaugauggccagcaaggacgcucccuccaacauggauggcaccucuggggccggacagcuggugccugaggucaaugcggcugaaccgcucccccuggagccuguugugggcgccgccacagcuguggccacggcugggcaagucaaccuuaucgaccccuggauuaugaauaacuucgugcaggccccugaaggagaguuuaccaucagccccaauaacacaccuggcgauauucuguucgaccuccagcuggggccgcaccuuaaucccuuucugcagcaucucucccaaauguacaacggauggguuggcaauaugagagugcgggucaugcuggcgggcaacgccuucaccgcugggaaaaucauuaucugcugugugccucccggauuugccucucagaauaucagcauuggccaggcuacaauguucccucacguuaucgccgaugugcgcguccuggaacccauugagaucccgcucgacgaugugagaaacgugcuguuucauaccaaugagucccggccuacaaugcgccuucugugcaugcucuauacgccccugagagccgggggagcgucuagcggcaccgacccuuucgucauugcugggcggguucuuaccugucccucccccgauuuuaacuuccuguuucucgugccuccgagcguggaacagaagacacgccaacugaccguccccaauaucccucugaacaaccucgccaauucuagagugcccgcuaugauuaacaaaaugacaguuuccaccgaccagagccaggugguccaguuccaaaauggacggugcacgcuggagggccagcuucugggcacaaccccugugucugccucccagguugcccgcaucagagggaagguguuuagcacagcuucuggaaaaggccucaaccugaccgaacuugaugggacccccuaccacgcguucgaguccccggccccucugggauuccccgacaucggcgcuugugauuggcaugucagcacauuuaagguggaccaaaaucucuccggggacccuaugucucggcuggauauuaagcagaacgcccccuucgccccucaccugggaagcaucgaguuuacguccgaccaggaacccaccggcgaucagcucggcacacuggcuugggucagcccgucuaccuccggggcccgcguggacccuuggaaaauucccagcuauggaucuacaguuaccgagagcacgcaccuugcgcccccuaucuucccgcccggcuuuggggaagcuauuguguacuucauguccgauuuuccuaucgucucuggaaauacagcccaagugcccugcacccugccucaggaguucguuagccauuuuguggaacagcaggcccccaucagaggcgaggcugcccuccugcacuaugucgacccugauacccaucggaaccuuggggaguucaagcuguaccccgacggcuuuauuacaugugugccgaauaccggaggcgggccucaaaaccuccccaucaauggaguguucgucuuuuccagcuggguuucucgcuauuaccagcugaaaccugugggcacagcugggcccgccagacggcuguga

SEQ ID NO: 30522 - RNA, 1602 nt, Artificial Sequence
  derived and/or modified sequence opt5 from VP1__Norovirus_and/or_Norovirus-like__JN899243
augaugauggccagcaaggacgcucccuccaacauggauggcaccucuggggccggacagcuggugccugaggucaauacagcggaaccgcucccccuggagccuguugugggcgcugccacggccgcugccaccgcugggcaagugaaccuuaucgaccccuggauuaugaauaacuucguccaggccccugaaggagaguuuacaaucagccccaauaacaccccuggcgauauucuguucgaccucagacuggggccgcaccuuaaucccuuucugcuccaucugucccagauguacaacggaugggugggcaauaugcggauccgcguuaugcuggcgggcaacgccuucucugcugggaaaauuaucaucugcugugugccucccggauuugaaagccagaauauuuccaucggccaagccacaauguucccucacgucauugcugaugugagaguucucgagcccaucgagauuccgcuggacgaugugcggaacguccuuuaucauaccaaugaaaaccgcccuacaaugagacugcucugcaugcuguacacgccccuucgggccgggggagcgucuagcggcaccgacccuuuugugaucgccgggcgcgugcugaccugucccgcucccgauuucaauuuucucuuccuggucccuccguccguugagcagaagacaagacagcugaccauucccaacaucccucucaacaaucuggccaacagccgggugcccgcuaugaucaauaaaauggccgugucugccgaccagaaccaagucgugcaguuucagaauggacgcugcacacuugaaggccagcugcucggcaccacgccuguuuccgcuaaccaaguggcgcggauuagagggaaggucuucagcacaaauucuggaaccggccugaaccuuacagagaccgaugggacccccuaucacgccuuugaguccccggcuccucugggauuccccgacaucggcgauugugacuggcauguguacgccuucaaaguuaaucagaacacaggggacccuauguaucgccucgauauuacgcagggaaauagcuuugcuccccaccugggcucuaucgaguucaccuccgaccaacacccuagcggcgaucagcuggggacacucaccuggauuucuccccugaacaaugccuccagaguggacccguggaagaucccuagcuacggauccacacuuaccgaaagcacgaaccuggccccucccaucuuucccccgggcuucggggaagcgauugucuauuuuaugucugauuuccccaucguguccggaaauacaacccagauuccuugcacccucccccaggaguuuaucagcucuuucgucgaacaacaggcuccuauucggggcgaggccgcccugcuucauuacguggaccccgauacacaccgcaaccugggggaguuuaagcucuacccugacggcuucaucaccuguguucccaacacaggaggcgggccgcagaaucugccuagcaacggaguguuuaucuucuccucuugggucagcagauauuaccagcugaaacccgugggcacggcugggccugcccggagacucuga

SEQ ID NO: 30523 - RNA, 1602 nt, Artificial Sequence
  derived and/or modified sequence opt5 from VP1__Norovirus_and/or_Norovirus-like__AB810004
augaagauggccagcaacgacgcugcccccuccaaugauggcgcggcuucucuggugccugaggccaucaacgaaaccaugccgcucgagcccgucgccggggcuagcauugccgcuccuguugccggacagacaaauaucauugaccccuggaucagaacgaacuucgugcaagcgccuaauggcgaauuuaccgugucuccccggaacuccccuggggagauucugcuuaaucuggaacucggaccggaucugaaccccuaccuugcccaccugagccgcauguauaauggcuacgcugggggagucgaggugcagguucuccuggccggcaacgcuuucacagccggcaaaauccuguuugcggccaucccucccaauuucccuguggacaugauuucccccgcucagaucaccaugcucccgcaucugauugucgaugugagaacacuugagccuaucaugauuccccugccugacguucggaacguguuuuaucacuucaauaaccagccccaaccccgcaugagacucgucgccaugcuguacaccccucuucggucuaaugggagcggagaugacguguuuacaguguccugccgcguccugaccagaccgacgcccgauuucgaauuuaucuaucucguuccucccagcguggagucuaagaccaaaccuuucacacugcccauucugaccaucuccgaacucacaaacagccgguuuccgaucccuauugagcagcuguacaccgcucccaacgagaauaacgugguccagugucagaauggccgcugcacgcuugacggggaacugcaaggaacaacccagcuccugucuuccgccguguguagcuauagaggccggacaguugccaaccgcggggauaauugggaccagaaccuucugcagcucaccuacccuucuggagcuuccuacgaucccaccgacgaggugccugcgccccugggcacacaagacuucagcggcauccuguaugggguccucacgcaggauaauguguccgaaggaaccggcgaggccaagaacgcuaaagggguuuacauuucuacaaccagcggaaaguuuacaccgaagaucggcuccauugggcugcauagcaucaccgaaaaugugcacccuaaccagcaaucuagauucacgcccgucggaguggcccagaaugagaacacacccuuccagcaguggguccuuccucauuaugccggcgcucuggcccucaauaccaaccuggcgccggcuguggcccccaccuuuccuggcgagcaacuucuguucuuucggucccgcguucccugcgugcaggggcucagaggacaggacgccuucaucgauugucugcugccucaggaaugggucaaucacuuuuaccaagaggcugcccccagccaggcugacguggcccucauucgguauguuaacccugauacaggcagaacccuguucgaagcgaaacuucaccgcucuggguuuaucacagugagccauacgggagccuacccccuggucgugccgccuaacggccacuuccgguuugacuccugggugaaucaguucuauucucucgcucccaugggguga

SEQ ID NO: 30524 - RNA, 1602 nt, Artificial Sequence
  derived and/or modified sequence opt5 from VP1__Norovirus_and/or_Norovirus-like__JN183163
augaugauggccagcaaggacgcuacccccuccgccgauggcgcgacaggggcuggacagcuggugccugaggucaacacggccgacccgauccccauugauccuguugccggcucuagcaccgcucucgccacagcugggcaagugaaucugaucgaccccuggauuaucaacaauuucgugcaggccccucagggagaauuuaccauuucccccaacaauacaccuggcgauguccuuuucgaccugcagcucgggccgcaccugaaccccuuucuuucucaucugagccaaauguacaauggaugggugggcaacaugagaguucgggugguccucgcgggcaaugccuucaccgcugggaaagugaucaucugcuguguuccucccggauuucagucccgcacacugucuauugcccaggcuacccuguucccucacgugaucgccgaugucagaacgcucgaccccguggaggugccgcuggaagauguccggaacguucuuuaucauaauaacgacacccagccuacaaugcgccugcucugcaugcuguacacaccccuuagaaccggcggggcgagcggaggcaccgauuccuuugugguggccgggcggguccugacguguccuggacccgacuucaauuuucucuuccuggugcccccuacaguugagcaaaagacccgcccguuuacagugcccaacauuccucugaaauaucucagcaauucuagaauccccaacccuauugaaggcaugucccugagccccgaucagacccagaacguccaguuccaaaauggccggugcaccaucgacgggcagccgcuuggaacaacgccugugucuguuucccagcuguguaaguuucgcggcagaauuaccagcgggcaacgggugcucaaccugacagagcuugacggaucucccuucauggcuuucgccgcuccugcccccgccggcuuuccugaucugggguccugcgacuggcacaucgagaugagcaaaauccccaauuccucuacccagaacaauccgauugucgugaacagcgucaagccuaauucccagcaguucgugccccaucucagcucuaucacacuggaugacaacguuuccagcggaggcgauuacauuggcaccauccaauggacgucucccccuagcgacuccgggggagcuaauacaaacuuuuggaagauuccggauuauggcucuagccuggcggaagccucccagcucgcucccgccguguacccucccggguucaaugaggucaucguguauuuuauggccagcaucccuggacccaaccagucuggcuccccuaaucugguucccugucuucugccgcaggaauacauuacccacuucaucagcgagcaagcuccuauucagggggaggccgcgcuccugcacuacguggaccccgauaccaaccgcaaucuuggcgaauuuaaacuguauccuggaggcuaccucacaugcguccccaacucuuccagcaccgggccgcagcagcugccucuggacggaguguucguguuugcuuccuggguuucuagauucuaucaacucaagcccgucggcacagccuga

SEQ ID NO: 30525 - RNA, 1599 nt, Artificial Sequence
  derived and/or modified sequence opt5 from VP1__Norovirus_and/or_Norovirus-like__EU373815
augaagauggccagcaacgacgcuucccccucuagcgauggcuccgccaaucuggugccugagaucaacaaugaagucauggcgcucgagccgguugcuggggccgccauugcugcccccguggcuggacagcaaaacaucauugacccuuggaucagaaauaacuucgugcaggcccccggcggggaauuuaccgucucuccucggaaugcgcccggagaggugcugcuuaaccugccucucagcccggauauuaaucccuaccuggcccaccuuucccgcauguauaacggcuacgcugggggaguugaaguggaggucgugcuggccggcaaugcuuucacagccggcaaaaucaucuuugcggccguuccucccaacuucccucccgagaaucucucuccgagccagauuacgaugcugccucauaucauuguggacgucagacagcuggaacccgugcggaucccucuccccgaugugcgcaacaauuuuuaucacuacuccagagagaacgacagcacccugcggcuugucgcuaugcuguauacaccccuccgcgccaacaaugcuggggaugacguuuucaccgugucuugcagagugcugacacggccuuccccggauuuugacuucauuuuucuugugcccccuaccgucgaaagcaagucuaaacccuucacaaucccuauucugaccaucgaggagaugacgaacucccgcuuucccgccccgcucgaaaugaugaccacaggaccuagccaugauaucguugugcaaccccagaauggcagauguaccauugacgggguccugcugggaacaacccagcucucuccugugaacaucugcuccaugcggggcguucccacgaagcgcacaaaugggaccgauaacuguuucgugcagcuggagaauccuaacggaagcgccuacgaccccacagaagacauuccggcuguccuuggcuccccugauuuugugggcgaguucuaugggaccaucacccaaagaucucccaauaacagcacacgggcgcaccccuucacgcugaauaccggauccccucgcuacacaccgaaaauuggcagcgucgacauccaugugaccgauguugacgaucucaacgaccacgaacccgugaagcugacaccugucgggcuuucuggauccagcggcucuauccaccaguggcagcugcccaauuacagcgggguggccacccauaacaugcaccucgcuccuuccguugcuccccuguuuccuggagagcagauucuguucuuuagaucuacggugcccggcugcggcggguauccgaauacaaacaucgauugucucauuccucaagaguggguccagcauuucuaccaggaaggagcccccgcccggaccgacguggcccugcuuagauuuaucaacccugauaccggccgcgugcuguucgagugcaagcuccacaaacacggguuuauuacaguugcguauagcggaaaucaugaccuggucaugcccccgaacggcuacuuccgguuugaauccugggugaaucaauuccacacccuugcuccuauggggacaggcagagccgaggaauga

SEQ ID NO: 30526 - RNA, 1599 nt, Artificial Sequence
  derived and/or modified sequence opt5 from VP1__Norovirus_and/or_Norovirus-like__KC473547
auggccagcaaggacgcucccaccuccccugauggcgccucuggggcgggacagcuggugccggaggcuaacacagccgaacaaaucagcauggaccccgucgccggcgcuuccacggccguugcuaccgccgggcaggucaauaugauugauccuuggaucuucaacaauuuugugcaggcgccccagggagaguucacaauuucuccuaacaauacccccggcgacauccucuuugaucugcaacuugggccucaccugaacccguuccucgcccaucugagccagauguacaauggaugggucggcaacaugagagugcggauucuucuggcuggcaaugccuuuacagcugggaaaaucaucauuugcuguguucccccuggauucgacgcccgcauccucaccauugcgcaggccacacuguuuccccaccugaucgcugaugugagaacccucgaaccugucgagcugccccuugaagacgugcggaacguucuguaucauaauuccucucagccgcaaccuacgaugcgccucguggccaugcuguacacaccccuuagaaccggcgggggaagcggcgggaccgaugcuuucgucguggccggacgggugcugacaugcccugcccccgacuuuuccuuccucuuucuggugcccccuagcguugagcagaagacccgcguguucucugugccgaacauuccccugaaagaucucuccaauagcagagucccugugcccauccagggcauguuuaugucuccugacguuaaccaguccgugcaauuccagaauggccggugucagauugaugggcaacugcagggaacgacacccgucagccuuucucagcugugcaagauccgcggcaaaaccuccagcaacgcuagagugcucaaccuguccgagguugacgggacaccguucaucccucuugaaucucccgcgccugugggauuucccgaccugggcgggugugauuggcacgucaauuucagcuuucagacccaagaccgggauccuucccagagcgugaccuucgccacaaacgacgcuucuuuuguccccuaucucggauccgugagcccgcauaauggcgagggcuuccaggccggggauauuaucggaucucugggcuggauuagcgccccuuccgacaacucucaguuuaauguuugggcuauccccaaguacgggagcucccugcaaaugagccccauucuccugcuucugugcucuccucgccucugggaagugauccuguauuucuacuccacguuuccgggaagcggccagcccucucagcuucaggucccuugucugcucccccaagaguucaucacccacuuuugcaacgagcaggccccuauugcgggggaagcugcccugcugcacuauguggaucccgacacaggcagaaaucucggagaguucaagcuguacccugauggcuuuaugaccuguguucccaacuccgugagcuccgggccgcagacacuuccuaucaauggagucuucguguucgugucuuggguuagccgguuuuaccagcugaaacccgucggcaccgccuccgcugcccgcagacucuga

SEQ ID NO: 30527 - RNA, 1599 nt, Artificial Sequence
  derived and/or modified sequence opt5 from VP1__Norovirus_and/or_Norovirus-like__GQ266692
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauuccuacgcugggggauucgaaguccaggugauccuugccggcaacgcuuuuacggccggcaaaauuaucuucgcggccguuccucccaauuuuccuaccgaggggcugucucccagccaggugacaauguucccgcauaucauugucgacgugagacaacucgagccugugcugaucccccugccugauguccggaacaauuuuuaucacuacaaccaguccaaugaccccaccauuaagcucaucgcuaugcuguauacaccccuucgcgccaacaacgcuggagaugacguuuucaccgugagcugcagagugcugacacggccuucuccggauuuugacuucauuuuucucgugcccccuaccgucgaaucccgcacgaaacccuucagcguuccuauccugaccguggaggaaaugacaaauucuagauuucccauuccgcuugagaagcuguucaccggcccuuccagcgccuucgucgugcagccccagaacgggcgguguacaaccgauggaguucuccugggcacgacacaacugucuccugugaauaucugcaccuuucgcggggacgucacacauaucgccggaacccaggaguacaccaugaaccucgcuucccagaauuggaacaauuaugaucccacagaagagauuccugcgccccugggcacgccggacuucgugggcaaaauccaggggguccuuacccaaacaaccagacgggacggaagcacacgcggccacaaggccaccguguccacggggucuguucaguuuacaccuaagcugggacggauucaguucagcaccgauaccuccaacgacuuugaaacaggccaaaauaccagauucacacccgugggggucgugcaggauggaagcacgacccaucagaacgagccccagcaauggguucucccuaauuacucuggccgcgacucccacaacgugcaccuggcuccggccgucgcccccagcuuuccuggcgaacagcuucuguucuuuagaucuacaaugcccggguguagcggauacccuaauaugaaccucgauugccugcugccccaggagugggugcagcauuucuaucaagaggcugccccugcgcaguccgacguggcucuccugcgguuuguuaaucccgauaccggcagaguccuuuucgaauguaaacugcacaagucuggguacgugacaguggcccauaccggacagcacgaccucgucaucccgccuaacggcuauuuucgcuucgauagcugggugaaccaguucuacacgcuggccuccauggcuaccuga

SEQ ID NO: 30528 - RNA, 1599 nt, Artificial Sequence
  derived and/or modified sequence opt5 from VP1__Norovirus_and/or_Norovirus-like__GQ266693
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacagcuacgcugggggauucgaaguccaggugauccuugccggcaaugcuuuuacggccggcaaaauuaucuucgcggccguuccucccaacuuuccuaccgaggggcugucccccucucaggugacaauguucccgcauaucauugucgacgugagacaacucgagccugugcugaucccccugccugauguccggaauaacuuuuaucacuacaaucagagcaacgaccccaccauuaagcucaucgcuaugcuguauacaccccuucgcgccaacaaugcuggagaugacguuuucaccguguccugcagagugcugacacggccuagcccggauuuugacuucauuuuucucgugcccccuaccgucgaaucucgcacgaaacccuucuccguuccuauccugaccguggaggaaaugacaaacagcagauuucccauuccgcuugagaagcuguucaccggcccuucuuccacauucgucgugcagccccagaaugggcgguguaccacggauggaguucuccugggcacaacccaacugagcccugugaacaucugcacauuucgcggggacgucacccauaucgccucuaccagaguguacacaaugaaucucgccucccagaacuggaauaacuaugaucccacggaggaaauuccugcuccccugggaaccccggacuucgucggcaaaauccagggcgugcuuacacagaccacaagaggggacggaagcacccgcggccacaaggcgacgguuuccacagggucuguggaguuuaccccuaagcugggacggauucaauucagcaccgauacauccaaugacuuugaaaccggccagaacacacgguucacgcccgucggggugauccaggauggaaauaccacacaucaaaacgagccccagcagugggcccucccuaauuacagcggcucuggcucccacaacguucaccuggcuccggccguggcccccagcuuuccuggggaacagcuucuguucuuucgcucuaccaugcccggauguagcggcuacccuaauaugaaccucgagugccugcugccccaagaguggguccagcauuucuaucaggaagcugccccugcgcaguccgacguggcucuccugagauuugugaaccccgauacagggcggguucuuuucgaguguaaacugcacaagucuggauacgucaccguggcccauacgggccaacacgaccucgugauuccgccuaauggguauuuuagauucgauagcuggaucaaccaguucuacacccuggccuccauggcuacauga

SEQ ID NO: 30529 - RNA, 1599 nt, Artificial Sequence
  derived and/or modified sequence opt5 from VP1__Norovirus_and/or_Norovirus-like__EU004673
augagaaugagcgacggcgccgcucccaaggccuccgggucugaggcgagcggacaggaucuggugccuaccgcugucgaacaagccguuccgauccagcccguggccggcgcugcccucgcugccccugcggccgggcagauuaaccagaucgaccccuggauuuuccaaaauuuugugcagugcccucugggagaguucuccaucucuccccggaacacaccuggcgaaauucuuuuugaucuggcucucgggccgggacugaaucccuaccuugcccaccugagcgcuauguauacgggcugggucggcaacauggaggugcagcucguucuggccgggaaugcguucaccgccggaaaaguggucguggcucugguuccucccuacuuuccuaagggcucccucacaaccgcccagaucacauguuucccccaugugaugugcgacguccgcacccuggaaccgauccaacuuccucugcucgaugugagacgggugcuguggcacgcuacacaggaccaggaggagucuaugcgccuugucuguaugcuguauacgccccucagaaccaacagcccuggggaugaauccuuuguugugagcggacggcugcugucuaaacccgccgccgacuucaauuuuguguaccucacacccccuauugagcgcaccaucuauagaauggucgaucugccggugcuucagccccggcugugcacccaugcucgcuggccugcgcccguuuacggccuccugguggacccuucccuucccagcaacccgcaauggcagaaugggagaguccacauugauggaacacugcucggcaccacgccugugucuggcuccuggguuagcuguuucgccgcugaagccgccuaugaguuucagucugggacaggagagguggcuaccuucacacugaucgaacaagacggcuccgccuacguccccggggaucgggcggcuccucugggauaccccgacuuuagcggccagcucgagauugaagugcagaccgagaccacacgcgccggggacaagcugaaagucacgaccuucgaaaugauccuuggaccuacaaccaacguggaucaggcccccuaucaaggcagaguuuacgcuucccugacagccgcugccucucucgaccugguggauggccggguccgcgcggugccgagaagcauuuauuccuuccaggacguucuuccugaguacaaugaugggcugcucgugccccuggcucccccuaucggaccguuucugcccggcgagguccuccugcgguucagaaccuauaugcgccagguggacagcucugaugccgccgcugaagccaucgacugcgcgcuuccucaggaguuuguguccugguucgccagcaacggguuuacgguucaaucugaagcucugcuccugcgguacagaaauacacugaccggacagcuucucuucgaguguaagcuguauagcgaaggcuacauugcccuguccuacucugggagcggcccccucaccuuuccuacagauggauucuuugaggucguguccugggugccccgccuguuccagcuugcuagcgucggcucuuga

SEQ ID NO: 30530 - RNA, 1599 nt, Artificial Sequence
  derived and/or modified sequence opt5 from VP1__Norovirus_and/or_Norovirus-like__AB601769
augagaaugagcgacggcgccgcucccaaggccaacggguccgaggcgucuggacaggaucuggugcucaccgcugucgaacaagccguuccuauccagccgguggccggcgcugcccuggcugcccccgcggccgggcagauuaaucagaucgacccuuggauuuuccaaaacuuugugcagugcccccuuggagaguucagcaucuccccucggaauacacccggcgaaauucuguuugaucucgcucuggggccuggacuuaacccguaccuggcccaccucucugcuauguauacgggcugggucggcaauauggaggugcagcugguucuggccgggaacgcguucaccgccggaaaaguggucguggcucucguucccccuuacuuucccaagggcagccugacaaccgcccagaucacauguuucccucaugugaugugcgacguccgcacccuugaacccauccaacugccgcuccuggaugugagacgggugcuuuggcacgcuacacaggaccaggaggaguccaugcgccuggucuguaugcucuauaccccucugagaacgaauagccccggggaugaaucuuuuguuguguccggacggcugcucagcaaaccugccgccgacuucaacuuuguguaccugaccccucccauugagcgcacaaucuauagaauggucgaucuucccgugcugcagccgcggcucugcacccaugcucgcuggcccgcgccuguuuacggccugcuuguggaccccucucugccuuccaauccccaauggcagaacgggagaguccacguggauggaacacuccugggcaccacgccgguuagcggcucuuggguguccuguuucgccgcugaagccgccuaugaguuucagagcgggacaggagaggucgcuaccuucacacugauugaacaagacggcucugccuacgugccuggggagcgggcggcuccccucggauacccugauuuuuccggccagcuggaaaucgagguccagaccgaaaccacaaagcgcggggagaaacuuaaggugacgaccuucgagaugauucugggacccacaaccaauguugaccaggccccuuaucaaggcagaguguacgccagccucuccgcugccgcuucucuggaccuugucgauggccgggugcgcgccguucccagaagcaucuauggguuccaggacgugauuccggaauacaacgauggacugcucgucccucuggcgccucccaucggccccuuucugccgggggaggugcuccugcgguucagaacauauaugcgccagguggacuccagcgaugccgcugccgaagcuaucgacugcgcccuuccccaggaguuuguuucuugguucgcguccaauggauuuaccguccaaagcgaagcccugcuccugcgguacagaaacacgcugacaggccagcuucucuucgaguguaagcuguauucugagggguacauugcucugagcuacuccggcucuggaccucucaccuuucccaccgauggcuucuuugaaguggugagcugggucccucgccuguaucagcuugccuccguggggagcuga

SEQ ID NO: 30531 - RNA, 1599 nt, Artificial Sequence
  derived and/or modified sequence opt5 from VP1__Norovirus_and/or_Norovirus-like__EU004676
augagaaugagcgacggcgccgcucccaaggccaacggguccgaggcgucuggacaggaucuggugccuaccgcugucgaacaagccguuccgauccagcccguggccggcgcugcccucgcugccccugcggccgggcagauuaaucagaucgaccccuggauuuuccaaaacuuugugcagugcccucugggagaguucagcaucagcccccggaauacaccuggcgaaauucuuuuugaucuggcucucgggccgggacugaaccccuaccuugcccaccugucugcuauguauacgggcugggucggcaauauggaggugcagcucguucuggccgggaacgcguucaccgccggaaaaguggucguggcucugguuccucccuacuuuccuaagggcagccucacaaccgcccagaucacauguuucccccaugugaugugcgacguccgcacccuggaaccgauccaacuuccucugcucgaugugagacgggugcuguggcacgcuacacaggaccaggaggaguccaugcgccuugucuguaugcuguauacgccccucagaaccaauucuccuggggaugaauccuuuguuguguccggacggcugcugagcaaacccgcccccgacuucaacuuuguguaccucaccccuccgauugagcgcacaaucuauagaauggucgaucugcccgugcuucagccucggcugugcacccaugcccgcuggcccgcuccuguuuacggccuccugguggaccccucucuuccguccaauccucaauggcagaacgggagaguccagguggauggaacacugcucggcaccacgcccguuagcggcucuuggguguccuguuucgcggccgaagcugccuaugaguuucaagccgggacaggagaggucgugaccuucacaaugauugaacaggacggcagcgcuuacgucccuggggaucgggccgcgccccugggauacccugacuuuucuggccagcuggagaucgaagugcagaccgagaccacaaagacgggggacaaacuccgcguuaccacauucgaaaugauucugggacccaccacaaauguggaucaagcuccguaucagggcagagccuacgccucccuuaccgcugccgcuagccuggaccucgucgauggccgggugcgcgccguuccuagauccaucuauucuuuccaggacgagcugcccgaguacaacgaugggcuucuggugccccucgcgccuccgcugggacccuuucugccuggcgaaguccuccugcgguucagaacguauaugcgccagcuugacacagccgaugcugccgcucaacccauugacugcgcccugccucaggaguuuaucagcugguucgcguccaauaacuuuaccgugcagagcgaugcccuccuggugcgguacagaaauacccugacagggcagcuucucuucgaagcuaagcuguauucugagggauacaucgccguuuccuacagcggcucugggccccugaccuuuccuacagacggcuucuuugaagucgugagcugggugccccgccucuuccaacuggcuuccgucggaucuuga

SEQ ID NO: 30532 - RNA, 1599 nt, Artificial Sequence
  derived and/or modified sequence opt5 from VP1__Norovirus_and/or_Norovirus-like__JQ237823
augagaaugagcgacggcgccgcucccaaggccaacggguccgaggcgucuggacaggaucuggugccuaccgcugucgaacaagccguuccgauccagcccguggccggcgcugcccucgcugccccugcggccgggcagauuaaucagaucgaccccuggauuuuccaaaacuuugugcagugcccucugggagaguucagcaucagcccccggaauacaccuggcgaaauucuuuuugaucuggcucucgggccgggacugaaccccuaccuugcccaccugucugcuauguauacgggcugggucggcaauauggaggugcagcucguucuggccgggaacgcguucaccgccggaaaaguggucguggcucugguuccucccuacuuuccuaagggcagccucacaaccgcccagaucacauguuucccccaugugaugugcgacguccgcacccuggaaccgauccaacuuccucugcucgaugugagacgggugcuguggcacgcuacacaggaccaggaggaguccaugcgccuugucuguaugcuguauacgccccucagaaccaauucuccuggggaugaauccuuuguuguguccggacggcugcugagcaaacccgcccccgacuucaacuuuguguaccucaccccuccgauugagcgcacaaucuauagaauggucgaucugcccgugcuucagccucggcugugcacccaugcccgcuggcccgcuccuguuuacggccuccugguggaccccucucuuccguccaauccucaauggcagaacgggagaguccagguggauggaacacugcucggcaccacgcccguuagcggcucuuggguguccuguuucgcggccgaagcugccuaugaguuucaagccgggacaggagaggucgugaccuucacaaugauugaacaggacggcagcgcuuacgucccuggggaucgggccgcgccccugggauacccugacuuuucuggccagcuggagaucgaagugcagaccgagaccacaaagacgggggacaaacuccgcguuaccacauucgaaaugauucugggacccaccacaaauguggaucaagcuccguaucagggcagagccuacgccucccuuaccgcugccgcuagccuggaccucgucgauggccgggugcgcgccguuccuagauccaucuauucuuuccaggacgagcugcccgaguacaacgauggggugcuugucccccuggcgccuccgcucggacccuuucugccuggcgaagugcugcuccgguucagaacguauaugcgccagcuggacacagccgaugcugccgcucaacccauugacugcgcccuuccucaggaguuuaucagcugguucgcguccaauaacuuuaccgugcagagcgaugcccugcucguucgguacagaaauacccugacagggcagcugcuuuucgaagcuaagcucuauucugagggauacaucgccgucuccuacagcggcucugggccccugaccuuuccuacagacggcuucuuugaaguggugagcugggucccccgccuguuccaacucgcuuccgugggaucuuga

SEQ ID NO: 30533 - RNA, 1599 nt, Artificial Sequence
  derived and/or modified sequence opt5 from VP1__Norovirus_and/or_Norovirus-like__DQ223043
augagaaugagcgacggcgccgcucccaaggccaacggguccgaggcgucuggacaggaucuggugccuaccgcugucgaacaagccguuccgauccagcccguggccggcgcugcccucgcugccccugcggccgggcagauuaaucagaucgaccccuggauuuuccaaaacuuugugcagugcccucugggagaguucagcaucagcccccggaauacaccuggcgaaauucuuuuugaucuggcucucgggccgggacugaaccccuaccuugcccaccugucugcuauguauacgggcugggucggcaauauggaggugcagcucguucuggccgggaacgcguucaccgccggaaaaguggucguggcucugguuccucccuacuuuccuaagggcagccucacaaccgcccagaucacauguuucccccaugugaugugcgacguccgcacccuggaaccgauccaacuuccucugcucgaugugagacgggugcuguggcacgcuacacaggaccaggaggaguccaugcgccuugucuguaugcuguauacgccccucagaaccaauucuccuggggaugaauccuuuguuguguccggacggcugcugagcaaacccgccucugacuucaacuuuguguaccucacacccccuauugagcgcaccaucuauagaauggucgaucugccggugcuucagccccggcugugcacccaugcccgcuggccugcucccguuuacggccuccugguggacccuucccuucccagcaauccgcaauggcagaacgggagaguccacguggauggaacacugcucggcaccacgccuguuucuggcuccugggugagcuguuucgcggccgaagcugccuaugaguuucagucugggacaggagaggucgccaccuucacaaugauugaacaagacggcuccgcuuacgugcccggggaucgggccgcgccucugggauaccccgacuuuagcggccagcuggagaucgaaguccagaccgagaccacaaagacgggggacaaacucaaggugaccacauucgaaaugauucugggaccuaccacaaauguugaucaggcucccuaucaaggccgcgccuacgccucccuuaccgcugccgcuucucuggaccucguggauggcagaguccgggccgugccgcgcagcguuuauuccuuccaggacgagcugccugaguacaacgaugggcuucuggugccccucgcgcccccucugggaccguuucugcccggcgaaguccuccugagauuccggacguauaugagacagcuugacacagccgaugcuagcgcccagccuaucgacugcgcucugccccaagaguuuauuucuugguucgccuccaauaacuuuaccgugcagagcgaugcgcuccuggugcgcuaccggaauacccugacagggcagcuucucuucgaagccaagcuguauucugagggauacaucgcuguuagcuacuccggcucugggccucugaccuuucccacagacggcuucuuugaagucgugagcugggugccuagacucuuccagcuggccuccgucggaagcuga

SEQ ID NO: 30534 - RNA, 1599 nt, Artificial Sequence
  derived and/or modified sequence opt5 from VP1__Norovirus_and/or_Norovirus-like__JX048594
augagaaugagcgacggcgccgcucccaaggccaacggguccgaggcgucuggacaggaucuggugccuaccgcugucgaacaagccguuccgauccagcccguggccggcgcugcccucgcugccccugcggccgggcagauuaaucagaucgaccccuggauuuuccaaaacuuugugcagugcccucugggagaguucagcaucagcccccggaauacaccuggcgaaauucuuuuugaucuggcucucgggccgggacugaaccccuaccuugcccaccugucugcuauguauacgggcugggucggcaauauggaggugcagcucguucuggccgggaacgcguucaccgccggaaaaguggucguggcucugguuccucccuacuuuccuaagggcagccucacaaccgcccagaucacauguuucccccaugugaugugcgacguccgcgcucuggaaccgauccaacuuccucugcucgaugugagacgggugcuguggcacgccacccaggaccaggaggaguccaugcgccuugucuguaugcuguauacaccccucagaaccaauucuccuggggaugaauccuuuguuguguccggacggcugcugagcaaacccgccgcugacuucaacuuuguguaccucacgcccccuauugagcgcaccaucuauagaauggucgaucugccggugcuucagccccggcugugcacacaugcgcgcuggccugcccccguuuacggccuccugguggacccuucucuucccuccaauccgcaauggcagaacgggagaguccacguggauggaacccugcucggcacaaccccuguuagcggcucuuggguguccuguuucgcugccgaagccgcuuaugaguaccagagcgaggucggggaaguggccacguuuacacugauugagcaagacggaucugcguacguccccggcgaucgggcugccccucugggguaucccgacuacuccggacagcucgaaaucgaggugcagaccgaaacaaccaagaccggcgacaaacugaagguuacaacguucgauaugauucuugggccuaccacaaauguggaccagguccccuaucaaggaaagguguacgccagccugaccacagcuuccucucucgaucugguugacggccgcgccagagcugugccgcggagcgucuauuccuuucaggaugugcuuccugaguacaacgacggccugcucgugccccuggcgcccccucuggggccguaucuccccggagagguucugcuucgcuucagaaccuacaugcggcagcuggauacggccgacgccgcugcccagccuaucgauugcgcucucccccaagaguucauuagcugguuugccucuaauaacuucacaguccaguccgacgcgcugcugaucagauaccgcaauacccuuaccggccagcuccuguuugaagccaaacuguauagcgaaggguacaucgcugugucuuauagcggauccggcccucucacauuccccaccgauggguuuuucgagguggucucuugggugccucggcuguuucagcuugccagcguuggcuccuga

SEQ ID NO: 30535 - RNA, 1596 nt, Artificial Sequence
  derived and/or modified sequence opt5 from VP1__Norovirus_and/or_Norovirus-like__GQ266691
augaagauggccagcuccgacgcuaaccccucugauggcagcaccgccucccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugucuccucggaacgcccccggagagauucuguggagcgcgccucuuggcccggaucugaaucccuaccucucccaccuggcccgcauguauaacggguacgcuggaggcuucgaaguccaggugauccuugccggcaaugcuuuuacggccgggaaaauuaucuucgcggccguuccucccaacuuuccuaccgagggacugucucccagccaggugacaauguucccgcauaucauugucgacgugagacaacucgagccugugcugaucccccugccugauguccggaauaacuuuuaucacuacaaucaguccaacgaccccaccauuaagcucaucgcuaugcuguauacaccccuucgcgccaauaacgcuggcgaugacguuuucaccgugagcugcagagugcugacacggccuucuccggauuuugacuucauuuuucucgugcccccuaccgucgaaucccgcacgaaacccuucagcguuccuauccugaccauugaggaaaugacaaacucuagauuucccaucccgcuugagaagcuguucaccgggccuuccagcgccuucgugguccagccccagaauggacgguguacaaucgauggcgugcuccuggggaccacgcaacugucuccuguuaacauuugcacauuucgcggagacgugacccauaucgagggcuccaaagucuacacaaugaaucucgccagccagaacuggaauaacuaugaucccaccgaagagauuccugcuccccugggcaccccggacuucaaggggagaauccagggagugcuuacacagacgacccgguccgacggcucuacacgcgggcacaccgcgacagucagcaccggauccgccgaauuuacgccuaagcugggccggauucaauucagcacagauaccaauaacgacuuugagaccgggcagaauacaaaauucacccccgugggaguugugcagaacggcucuacaacgcaucaaaaugaaccccagcagugggagcucccugauuacuccggcagagggauccacaacguccaccuggcuccggccguggcccccaccuacccuggagagcagauccuguuuuuccgcagcacaaugcccggcuguucuggguauccuaauaugaaccuugacugccuccugccccaagauuggguuagacauuuuuaccaggaagcugccccugcgcagagcgacguggcucugcuccgguucgucaaucccgauaccggaagagugcuguuugaguguaaacuucacaaguccggcuaugugacaguugcccauaccgggcagcacgaccuggucauuccgccuaacggcuacuuccgcuuugauucuugggugaaccaauucuauacgcucgcccccaugggauga

SEQ ID NO: 30536 - RNA, 1596 nt, Artificial Sequence
  derived and/or modified sequence opt5 from VP1__Norovirus_and/or_Norovirus-like__GQ266690
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauuccuacgcugggggauucgaaguccaggugauccuugccggcaacgcuuuuacggccggcaaaauuaucuucgcggccguuccucccaauuuuccuaccgaggggcugucucccagccaggugacaauguucccgcauaucauugucgacgugagacaacucgagccugugcugaucccccugccugauguccggaacaauuuuuaucacuacaaccaguccaaugaccccaccauuaagcucaucgcuaugcuguauacaccccuucgcgccaacaacgcuggagaugacguuuucaccgugagcugcagagugcugacacggccuucuccggauuuugacuucauuuuucucgugcccccuaccgucgaaucccgcacgaaacccuucagcguuccuauccugaccguggaggaaaugacaaauucuagauuucccauuccgcuugagaagcuguucaccggcccuuccagcgccuucgucgugcagccccagaacgggcgguguacaaccgauggaguucuccugggcacgacacaacugucuccugugaauaucugcaccuuucgcggggacgucacacauaucgccggaacccaggaguacaccaugaaccucgcuucccagaauuggaacaauuaugaucccacagaagagauuccugcgccccugggcacgccggacuucgugggcagaauccaggggguccuuacccaaacaacccggcgcgacggaagcacaagaggccacaaagccaccguguccacggggucuguucauuuuacaccuaagcugggacggauucaguucagcaccgauaccuccaacgacuuugaaacaggccagaauacccgcuucacacccgugggggucgugcaagauggaggcacgacccaccagaacgagccccagcaguggguucucccuaauuacagcggcagagacgggcacaacgugcaucuggcuccggccgucgcccccucuuuuccuggagaacaaauccuuuucuuucgguccacaaugcccggcuguagcggguacccuaauaugaaccuggauugccuccugccccaggagugggugcagcacuucuaucaggaggcugccccugcgcaaucugacguggcucugcucagauuuguuaaucccgauaccggacgcguccuguucgaauguaaacuucauaagagcggcuacgugacaguggcccacaccgggcagcacgaccuggucauuccgccuaacggcuauuuucgguucgauuccugggugaaccaguucuacacgcucgcccccaugggauga

SEQ ID NO: 30537 - RNA, 1596 nt, Artificial Sequence
  derived and/or modified sequence opt5 from VP1__Norovirus_and/or_Norovirus-like__JN183164
augaugauggccagcaaggacgcucccaccaacauggauggcacauccggggccggacagcuggugccugaggucucuacggcggaaccgaucagcauggagcccguugcuggcgccgccaccgcugccgcuacagccgggcaagugaauaugauugacccuuggaucauguccaacuacgugcaggcgccccagggagaguucaccauuucuccuaauaacacacccggcgauauccucuuugaccugcagcuugggccucaccugaauccguuccucagccaucuggcccaaauguauaacggaugggucggcaauaugaaagugagaguucuucuggcuggcaacgccuuuaccgcugggaagauuaucaucuccugcgugcccccuggauucgccgcgcagaaugucucuauugcccaggcuacaauguuuccccacgugaucgccgauguucgggugcucgaaccuauugaagucccccuggaggacgugcgcaacgugcuguuccauaauaacgauagcaccccgacgaugagacucaucuguaugcuguacaccccucuucgggcuuccggcucuagcuccgggacagaccccuuugucauugccggacgcguucugaccugcccuagccccgauuucaauuuucucuuccuggugcccccuaacguggagcagaaaacaaagccguuuucuguccccaaucuuccucugaacgugcucuccaacagcagaguucccucucugaucaaauccaugauggugagccaagaccacggccagaugguccaguuccagaaugggcgggugacccuggauggacaacuccagggcacgacaccuaccuccgccucucagcuguguaagauucgcggcacaguuuaucaugcuaccgggggacaaggccuuaaccugaccgaaaucgacgggacacccuaccacgcguuugagagcccggccccuaucggauuccccgaucucggcgaaugcgacuggcacauuaaugcuuccccugccaacgccuucacggacgggagcaucauucauagaaucgauguggcucaggacucuaccuuugcgccccaccugggaacaauucauuauaccaaugccgauuacaacgcuaaugucggccuuaucuguucccuggaguggcucagcccucccucuggcggggccccgaaggugaacccuugggccaucccccgguauggaagcacacugaccgaggcugcccagcuggcucccccuauuuacccgcccggcuucggggaagccaucgucuuuuucauguccgacuuuccuauugcgaauggaucugauggccucagcgugcccugcacgaucccucaggaguucguuacacacuuugugaacgaacaagcccccacccgcggggaggcugcccugcuucacuacgucgacccugauacccauagaaaucugggcgaguucaaacucuaucccgaaggauuuaugacaugugugccgaacuccagcggcucugggccucagacccugcccauuaauggaguuuucacauuuaucuccugggugagccgguucuaccagcuuaagccugucggcacguga

SEQ ID NO: 30538 - RNA, 1596 nt, Artificial Sequence
  derived and/or modified sequence opt5 from VP1__Norovirus_and/or_Norovirus-like__AB809995
augaagauggccagcaacgacgcugcccccuccaaugauggcgcggcuucucuggugccugaggccaucaacgaaaccaugccgcucgagcccgucgccggggcuagcauugccgcuccuguugccggacagacaaauaucauugaccccuggaucagaacgaacuucgugcaagcgccuaauggcgaauuuaccgugucuccccggaacuccccuggggagauucugcuuaaucuggaacucggaccggaucugaaccccuaccuugcccaccugagccgcauguauaauggcuacgcugggggagucgaggugcagguucuccuggccggcaacgcuuucacagccggcaaaauccuguuugcggccaucccucccaauuucccuguggacaugauuucccccgcucagaucaccaugcucccgcaucugauugucgaugugagaacacuugagccuaucaugauuccccugccugacguucggaacguguuuuaucacuucaauaaccagccccaaccccgcaugagacucgucgccaugcuguacaccccucuucggucuaaugggagcggagaugacguguuuacaguguccugccgcguccugaccagaccgacgcccgauuucgaauuuaucuaucucguuccucccagcguggagucuaagaccaaaccuuucacacugcccauucugaccaucuccgaacucacaaacagccgguuuccgaucccuauugagcagcuguacaccgcucccaacgagaauaacgugguccagugucagaauggccgcugcacgcuugacggggaacugcaaggaacaacccagcuccugucuuccgccguguguagcuauagaggccggacaguugccaacucuggggauaauugggaccagaaccuucugcagcucaccuacccuuccggagcuagcuacgaucccaccgacgaggugccugcgccccugggcacacaagacuucuccggcauccuguaugggguccucacgcaggauaaugugucugaaggaaccggcgaggccaagaacgcuaaagggguuuacauuagcacaaccuccggaaaguuuacaccgaagaucggcagcauugggcugcauucuaucaccgaaaaugugcacccuaaccagcaaucccgcuucacgcccgucggaguggcccagaaugagaacacacccuuccagcaguggguccuuccucauuaugccggcgcucuggcccucaauaccaaccuggcgccggcuguggcccccaccuuuccuggcgagcaacuucuguucuuuagaagccggguucccugcgugcaggggcuccgcggacaggacgccuucaucgauugucugcugccucaggaaugggucaaucacuuuuaccaagaggcugcccccucucaggcugacguggcccucauuagauauguuaacccugauacaggccggacccuguucgaagcgaaacuucacagaagcggguuuaucacagugucccauacgggagccuacccccuggucgugccgccuaacggccacuuccgcuuugacucuugggugaaucaguucuauagccucgcucccuga

SEQ ID NO: 30539 - RNA, 1593 nt, Artificial Sequence
  derived and/or modified sequence opt5 from VP1__Norovirus_and/or_Norovirus-like__KT732275
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauagcaaucagcccaacucccgcaugagacuugucgcuaugcuguacacaccccuccggucuaacggcagcggggacgauguguucaccguguccugccgcguccugacgagaccuaccccggacuuugaguucacauaucugguucccccuagcguggaaucuaagaccaaacccuuuucccucccuauucugacacuuagcgagcugaccaauucucgguuccccgugccgaucgauucccucuuuacggcccaaaacaauguccuucaggugcagugucagaacggacgcugcacacuugacggcgagcugcaagggaccacacagcuccugccuagcggaauuugugcuuucagaggccggguuaccgcccagaucaaucagcgcgauagauggcauaugcaacugcagaaccucaauggcaccacauacgaccccacggaugacgugccugcuccccuggggaccccugacuucaagggagucguguuuggcaugguuucucagcggaacguggggaaugaugcccccggauccacacgcgcgcaacaggccugggucagcaccuauuccccgcaguucgugccuaaacuuggcucugucaaccugagaauuagcgacaaugaugacuuucaguuccaacccacaaaguuuacccccguggggguuaacgaugacgaugacggacacccuuuccggcagugggaacucccgaauuacuccggcgagcugacgcuuaacaugaaucuggcucccccuguggcccccaacuuuccuggcgaacagcuccuguucuuucgcagcuucguccccugcucugggggauacaaccagggcaucaucgauugucugauuccucaagaguggauccagcauuuuuaucaggaauccgcccccagccagucugacguggcucucauuagauacguuaauccggauacagggcggacccuguucgaggccaagcugcacagaagcggauauaucaccguggcgcacuccggcgacuacccucuggucgugcccgcuaacgggcauuuucgcuucgacucuugggugaaucaauucuauagccucgccccuauguga

SEQ ID NO: 30540 - RNA, 1593 nt, Artificial Sequence
  derived and/or modified sequence opt5 from VP1__Norovirus_and/or_Norovirus-like__AB809998
augaagauggccagcaacgacgcugcccccuccaaugauggcgcggcuucucuggugccugaggccaucaacgaaaccaugccgcucgagcccgucgccggggcuagcauugccgcuccuguugccggacagacaaauaucauugaccccuggaucagaacgaacuucgugcaagcgccuaauggcgaauuuaccgugucuccccggaacuccccuggggagauucugcuuaaucuggaacucggaccggaucugaaccccuaccuugcccaccugagccgcauguauaauggcuacgcugggggagucgaggugcagguucuccuggccggcaacgcuuucacagccggcaaaauccuguuugcggccaucccucccaauuucccuguggacaugauuucccccgcucagaucaccaugcucccgcaucugauugucgaugugagaacacuugagccuaucaugauuccccugccugacguucggaacguguuuuaucacuucaauaaccagccccaaccccgcaugagacucgucgccaugcuguacaccccucuucggucuaaugggagcggagaugacguguuuacaguguccugccgcguccugaccagaccgacgcccgauuucgaauuuaucuaucucguuccucccagcguggagucuaagaccaaaccuuucacacugcccauucugaccaucuccgaacucacaaacagccgguuuccgaucccuauugagcagcuguacaccgcucccaacgagaauaacgugguccagugucagaauggccgcugcacgcuugacggggaacugcaaggaacaacccagcuccugucuuccgccguguguagcuauagaggccggacaguugccaacucuggggauaauugggaccagaaccuucugcagcucaccuacccuuccggagcuagcuacgaucccaccgacgaggugccugcgccccugggcacacaagacuucuccggcauccuguaugggguccucacgcaggauaaugugucugaagccaccggagaggcuaagaacgccaaaggcguuuacauuagcacaaccuccgggaaguuuacaccgaagaucggaagcauuggccugcauucuaucaccgaaaaugugcacccuaaccagcaaucccgcuucacgcccgucgggguggcccagaaugagaacacacccuuccagcaguggguccuuccucauuaugcuggagcccuggcgcucaauaccaaccuggcuccggccguggcccccaccuuuccuggcgagcaacuucuguucuuuagaagccggguucccugcgugcagggccuccgcgggagagacgcuuucaucgauugucugcugccucaggaaugggucaaucacuuuuaccaggaggccgcucccucucaagccgacguggcgcucauucgguauguuaacccugauacaggaagaacccuguucgaagccaaacuucaccgcagcggcuuuaucacagugucccauacgggggcuuacccccuggucgugccgccuaacggacacuuccgguuugacucuugggugaaucaguucuauagccucgccuga

SEQ ID NO: 30541 - RNA, 1593 nt, Artificial Sequence
  derived and/or modified sequence opt5 from VP1__Norovirus_and/or_Norovirus-like__AB809984
augaagauggccagcaacgacgcugcccccuccaaugauggcgcggcuucucuggugccugaggccaucaacgaaaccaugccgcucgagcccgucgccggggcuagcauugccgcuccuguugccggacagacaaauaucauugaccccuggaucagaacgaacuucgugcaagcgccuaauggcgaauuuaccgugucuccccggaacuccccuggggagauucugcuuaaucuggaacucggaccggaucugaaccccuaccuugcccaccugagccgcauguauaauggcuacgcugggggagucgaggugcagguucuccuggccggcaacgcuuucacagccggcaaaauccuguuugcggccaucccucccaauuucccuguggacaugauuucccccgcucagaucaccaugcucccgcaucugauugucgaugugagaacacuugagccuaucaugauuccccugccugacguucggaacguguuuuaucacuucaauaaccagccccaaccccgcaugagacucgucgccaugcuguacaccccucuucggucuaaugggagcggagaugacguguuuacaguguccugccgcguccugaccagaccgacgcccgauuucgaauuuaucuaucucguuccucccagcguggagucuaagaccaaaccuuucacacugcccauucugaccaucuccgaacucacaaacagccgguuuccgaucccuauugagcagcuguacaccgcucccaacgagaauaacgugguccagugucagaauggccgcugcacgcuugacggggaacugcaaggaacaacccagcuccugucuuccgccguguguagcuauagaggccggacaguugccaacucuggggauaauugggaccagaaccuucugcagcucaccuacccuuccggagcuagcuacgaucccaccgacgaggugccugcgccccugggcacacaagacuucuccggcauccuguaugggguccucacgcaggauaaugugucugaaggaaccggcgaggccaagaacgcuaaagggguuuacauuagcacaaccuccggaaaguuuacaccgaagaucggcagcauugggcugcauucuaucaccgaaaaugugcacccuaaccagcaaucccgcuucacgcccgucggaguggcccagaaugagaacacacccuuccagcaguggguccuuccucauuaugccggcgcucuggcccucaauaccaaccuggcgccggcuguggcccccaccuuuccuggcgagcaacuucuguucuuuagaagccggguucccugcgugcaggggcuccgcggacaggacgccuucaucgauugucugcugccucaggaaugggucaaucacuuuuaccaagaggcugcccccucucaggcugacguggcccucauuagauauguuaacccugauacaggccggacccuguucgaagcgaaacuucacagaagcggguuuaucacagugucccauacgggagccuacccccuggucgugccgccuaacggccacuuccgcuuugacucuugggugaaucaguucuauagccucgcuuga

SEQ ID NO: 30542 - RNA, 1590 nt, Artificial Sequence
  derived and/or modified sequence opt5 from VP1__Norovirus_and/or_Norovirus-like__KT732276
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauagcaaucagcccaacucccgcaugagacuugucgcuaugcuguacacaccccuccggucuaacggcagcggggacgauguguucaccguguccugccgcguccugacgagaccuaccccggacuuugaguucacauaucugguucccccuagcguggaaucuaagaccaaacccuuuucccucccuauucugacacuuagcgagcugaccaauucucgguuccccgugccgaucgauucccucuuuacggcccaaaacaauguccuucaggugcagugucagaacggacgcugcacacuugacggcgagcugcaagggaccacacagcuccugccuagcggaauuugugcuuucagaggccggguuaccgcccagaucaaucagcgcgauagauggcauaugcaacugcagaaccucaauggcaccacauacgaccccacggaugacgugccugcuccccuggggaccccugacuucaagggagucguguuuggcaugguuucucagcggaacguggggaaugaugcccccggauccacacgcgcgcaacaggccugggucagcaccuauuccccgcaguucgugccuaaacuuggcucugucaaccugagaauuagcgacaaugaugacuuucaguuccaacccacaaaguuuacccccguggggguuaacgaugacgaugacggacacccuuuccggcagugggaacucccgaauuacuccggcgagcugacgcuuaacaugaaucuggcucccccuguggcccccaacuuuccuggcgaacagcuccuguucuuucgcagcuucguccccugcucugggggauacaaccagggcaucaucgauugucugauuccucaagaguggauccagcauuuuuaucaggaauccgcccccagccagucugacguggcucucauuagauacguuaauccggauacagggcggacccuguucgaggccaagcugcacagaagcggauauaucaccguggcgcacuccggcgacuacccucuggucgugcccgcuaacgggcauuuucgcuucgacucuugggugaaucaauucuauagccucgccccuuga

SEQ ID NO: 30543 - RNA, 1590 nt, Artificial Sequence
  derived and/or modified sequence opt5 from VP1__Norovirus_and/or_Norovirus-like__AB810009
augaagauggccagcaacgacgcugcccccuccaaugauggcgcggcuucucuggugccugaggccaucaacgaaaccaugccgcucgagcccgucgccggggcuagcauugccgcuccuguugccggacagacaaauaucauugaccccuggaucagaacgaacuucgugcaagcgccuaauggcgaauuuaccgugucuccccggaacuccccuggggagauucugcuuaaucuggaacucggaccggaucugaaccccuaccuugcccaccugagccgcauguauaauggcuacgcugggggagucgaggugcagguucuccuggccggcaacgcuuucacagccggcaaaauccuguuugcggccaucccucccaauuucccuguggacaugauuucccccgcucagaucaccaugcucccgcaucugauugucgaugugagaacacuugagccuaucaugauuccccugccugacguucggaacguguuuuaucacuucaauaaccagccccaaccccgcaugagacucgucgccaugcuguacaccccucuucggucuaaugggagcggagaugacguguuuacaguguccugccgcguccugaccagaccgacgcccgauuucgaauuuaucuaucucguuccucccagcguggagucuaagaccaaaccuuucacacugcccauucugaccaucuccgaacucacaaacagccgguuuccgaucccuauugagcagcuguacaccgcucccaacgagaauaacgugguccagugucagaauggccgcugcacgcuugacggggaacugcaaggaacaacccagcuccugucuuccgccguguguagcuauagaggccggacaguugccaaccgcggggauaauugggaccagaaccuucugcagcucaccuacccuucuggagcuuccuacgaucccaccgacgaggugccugcgccccugggcacacaagacuucagcggcauccuguaugggguccucacgcaggauaauguguccgaaggaaccggcgaggccaagaacgcuaaagggguuuacauuucuacaaccagcggaaaguuuacaccgaagaucggcuccauugggcugcauagcaucaccgaaaaugugcacccuaaccagcaaucuagauucacgcccgucggaguggcccagaaugagaacacacccuuccagcaguggguccuuccucauuaugccggcgcucuggcccucaauaccaaccuggcgccggcuguggcccccaccuuuccuggcgagcaacuucuguucuuucggucccgcguucccugcgugcaggggcucagaggacaggacgccuucaucgauugucugcugccucaggaaugggucaaucacuuuuaccaagaggcugcccccagccaggcugacguggcccucauucgguauguuaacccugauacaggcagaacccuguucgaagcgaaacuucaccgcucuggguuuaucacagugagccauacgggagccuacccccuggucgugccgccuaacggccacuuccgguuugacuccugggugaaucaguucuauucucucuga

SEQ ID NO: 30544 - RNA, 1590 nt, Artificial Sequence
  derived and/or modified sequence opt5 from VP1__Norovirus_and/or_Norovirus-like__KM461690
augaagauggccagcuccgacgcugcccccucuaacgauggcgcggcuaaucuggugccugaggccaacaaugaagucauggcccucgagccgguugugggggcuagcaucgccgcucccguggucggacagcaaaacauuaucgacccuuggauuagagaaaauuucgugcaggcgccccagggcgaguuuaccguuuccccucggaacucucccggggaaaugcugcuuaaucuggagcucggaccugagcugaacccguaccuuagccaccugucccgcauguauaauggcuacgccgggggaaugcaagugcaggucgugcucgccggcaacgcuuucacagccggcaaaaucauuuuugcugccguucccccucauuuccccguggaaaauaucucugcggcccagaucacgaugugcccucacgucauuguggaugugagacagcuggagcccguccugcucccgcugccugacauccggaaccgcuuuuuccauuauaaucaggaaaacacccccagaaugcggcuuguugcuaugcuguacacaccucuccgcgccaauagcggggaggauguguuuaccguguccuguagaguccugacacggcccgcucccgacuucgaguuuaccuuccuugugccuccgacaguugaaagcaagaccaaacccuuuacgcugccuauucucacccugggagagcugucuaacucccgcuuccccgccccuaucgauaugcucuauacagaccccaacgaaggcauugugguccaaccgcagaaugggagaugcacccuggauggaacacuucagggcaccacgcagcuggugccuacacaaaucugugccuuucgggggacccucauuggacagacaagcagaucuuccgacagcaccgauucugcucccagacggcgcgaccacccucugcauguucagcuuaagaaccuggauggcacccaauacgaccccacagacgaggugccugcgguccucggcgccaucgauuucaaagggacgguguucggagucgcuucccagagagacgugagcggccagcagguuggggccacccgggcccacgaagugcacaucaauacaaccgaucccagauauacaccgaagcugggauccauucugaugcauucugagagcgacgauuuugucaccggccaaccugugcgcuucacgcccaucgggaugggagacaacgauuggcaccagugggagcuccccgacuacuccggccggcugacacuuaauaugaaccuggcuccugccguugcgccggcuuuucccggcgaacgcauucucuucuuucgcagcaucgugccuucugccgggggauacggcuccgggcagauugauugccugaucccccaggaguggguccaacauuucuaucaggaagccgcuccuagccagucugccguggcucuuauccgguacgugaaucccgacaccggaagaaacauuuuugaggccaagcugcaccgcgaaggcuucaucaccguugcgaauagcgggaacaauccuauugucgugcccccgaacggcuauuuucgguucgaggccugggugaauuga

SEQ ID NO: 30545 - RNA, 1587 nt, Artificial Sequence
  derived and/or modified sequence opt5 from VP1__Norovirus_and/or_Norovirus-like__JN400618
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccucgcuuugaauccagaaccaaaccguucagcguccccgugcucacgguugaggaaaugaccaauucucgguuuccuauuccccuggagaaacuuuucacagggccuuccagcgccuuugugguccagccccagaacggacgcuguaccacagauggcgugcugcucgggaccacgcaacugucuccgguuaauaucugcacauucagaggagacgugacccauauuccuggcucccggaacuacacaaugaaucuggccagccagaacuggaacuccuauggccccaccgaggaaaucccugcuccccucgggaccccugauuucgucggaaagauccagggcgugcugacacagacgacccgcacaaaugggucuaccagaggacacaaggcgacagucuacaccggcagcgccgacuuuucccccaaacuugggcgggugcaauucgcuacggauacagacaaugacuuugagaccaaccagaauaccaaguucacaccgguuggagugauucaggauggcagcaccacaccucgcaacgaaccccaacaguggguccugcccucuuacuccggcagaaauauccauaacgugcaccucgccccugccguugcuccgacguuucccggggagcagcugcuuuucuuucggagcaccaugccuggauguucuggcuaucccaauauggaccuggauugccuccugccucaggaaugggugcaauacuucuaucaggaggccgcgcccgcucagagcgacgucgcccugcucagauuugugaacccugauacagggcgcgugcuguucgaguguaaacuucacaaguccggauacguuaccgucgcccauacaggccagcacgaccuggugauucccccgaacggguauuuucgguucgauucuugggugaaucaauuuuacacccucgcuccuaugggcaacggaacgggcagacgccgguga

SEQ ID NO: 30546 - RNA, 1587 nt, Artificial Sequence
  derived and/or modified sequence opt5 from VP1__Norovirus_and/or_Norovirus-like__JQ653095
augaagauggccagcaacgacgcugcccccuccaaugauggcgcggcugggcuggugccugaggucaacaaugaaaccauggcccucgagccgguugccggagcuucuaucgccgcuccccugacaggccagaacaaugugauugacccuuggaucagacuuaacuucgugcaagcccacaauggggaauuuacggucagcccccggaacuccccuggagaggugcugcucaaucuggaacuuggccccgagcugaacccuuaccucgcgcaucugucucgcauguauaauggguacgccggaggcguugaggugcagguccugcucgcuggcaacgccuucaccgcugggaaacugguguuugccgcgguuccgccccacuucccucuugaaaauauuagccccggacagaucacaauguuuccucaugugauuaucgaugucagaacccuggagcccgugcuccugccgcuuccugacgugcggaacaauuucuuucacuauaaccagcaaaacgaaccccgcaugagacuggucgccaugcucuacacaccucugcgguccaauggcucuggggaugacguuuucaccgugagcugccgcgugcccacaagacccuccccugauuuugacuucaacuaucuggucccgcccaccguggagagcaagacgaaaccuuuuacccuccccauccugacaauuggagagcuuaccaauucucgguucccuguucccaucgaugaacuguacacauccccgaacgagagccucgugguccagccucagaauggccgcugugcucuggacggggaacuucagggaaccacgcaacugcuccccacagccauuugcucuuuuagaggccggaucaaccagaagguguccggcgagaaucauguuuggaacaugcaagugaccaauauuaacgggacaccuuucgaucccaccgaagacgucccugcuccccugggaaccccggauuucagcggcaaacuguuuggggugcucucucagcgcgaccacgacaaugccuguagaucccacgaugccgucaucgcuacaaacagcgcgaaguucacgccuaagcugggagccauucagaucggcaccugggagcaggacgaugugcauaucaaucagcccacaaaauuuacccccguugggcuuuucgaguccgaaggauuuaaccaauggacacugccuaauuauucuggcgcucucaccccgaacaugggccuggcucccccuguggcccccacguucccuggggagcagauucuguuuuuccggagccacaucccccuuaagggaggcgucgccgacccugugauugauugccucguuccccaggaauggauccagcaucuguaccaagaguccgccccgagccagacagacguggcgcugauucgcuuuaccaacccugauaccgggagaguccucuucgaagcuaaacugcaccggucuggauacaucacaguggccaauaccggcuccagacccaucgugguuccugccaacggguauuuucgcuucgacagcugggucaaucaguuuuacucucuugcucccgugggcacaggauga

SEQ ID NO: 30547 - RNA, 1587 nt, Artificial Sequence
  derived and/or modified sequence opt5 from VP1__Norovirus_and/or_Norovirus-like__JN183161
augaugauggccagcaaggacgcucccuccaacauggauggcaccucuggggccggacagcuggugccugaggucaaugcggcugaaccgcucccccuggagccuguugugggcgccgccacagcugccgcuacggccgggcaagugaaccuuaucgaccccuggauuaugaauaacuucguccaggcgccugaaggagaguuuaccaucagccccaauaacacaccuggcgauauucuguucgaccuccaccuggggccgcaucuuaaucccuuucugcagcaccucucccagauguacaacggaugggugggcaauaugagaguucgggugaugcuggccggcaacgcuuucaccgccgggaaaaucauuaucugcugugucccucccggauuugcuucucaaaauaucagcauuggccaggccacaauguucccucaugugaucgcggauguucgcgugcuggaacccauugagaucccgcucgacgaugucagaaacgugcuguuucacaccaaugagaaccggccuacaaugcgccuucugugcaugcucuauacgccccugagagccgggggagcuuccucuggcaccgacccuuucgugauugccgggcggguccuuaccugucccgcucccgauuuuaauuuccuguuucucguuccuccgagcguggaacagaagacacgccagcugaccgugcccaacaucccucugaacaauauggccaacuccagaguccccgccaugauuaauaaaaugacagugagcucugaccaaaaccagguugugcaguuccagaauggacggugcacccucgagggccaacugcuuggcacgacaccugucuccgcuagccagguggcgcgcaucagagggaagguuuucucuaccgccuccggaaaaggccugaaccucacagaacuggaugggacccccuaccaugcuuucgagagcccggccccucuuggauuccccgacaucggcgccugugauuggcacgugucuaccuuuaaggucgaccagaaucuguccggggacccuaugagccggcucgauauuaagcaaaacgcucccuucgccccucaccugggauccaucgaguuuacaucugaccaggaucccacgggcgaccagcugggcacccucgcgugggugagcccguccacaagcgggacccgcgucgauccuuggaaaauucccucuuauggauccacagugaccgaaagcacgcaucuggcucccccuaucuucccgcccggcuuuggggaggccauuguuuacuucaugucugacuuuccuaucgugagcggaaauacagcccagguccccugcacccuuccucaagaauuugugucccacuuuguugagcagcaggcucccaucagaggcgaagccgcucugcuccauuauguggauccugacacccaccggaaccugggggaguucaaacuuuaccccgauggcuuuauuacaugugucccgaauaccggaggcgggccucagaaccugcccacaaauggaguguucguguuuucuagcuggguuucccgcuauuaccaacucaagccugucggcacggccuga

SEQ ID NO: 30548 - RNA, 1587 nt, Artificial Sequence
  derived and/or modified sequence opt5 from VP1__Norovirus_and/or_Norovirus-like__KT906670
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauagcaaucagcccaacucccgcaugagacuugucgcuaugcuguacacaccccuccggucuaacggcagcggggacgauguguucaccguguccugccgcguccugacgagaccuaccccggacuuugaguucacauaucugguucccccuagcguggaaucuaagaccaaacccuuuucccucccuauucugacacuuagcgagcugaccaauucucgguuccccgugccgaucgauucccucuuuacggcccaaaacaauguccuucaggugcagugucagaacggacgcugcacacuugacggcgagcugcaagggaccacacagcuccugccuagcggaauuugugcuuucagaggccggguuaccgcccagaucaaucagcgcgauagauggcauaugcaacugcagaaccucaauggcaccacauacgaccccacggaugacgugccugcuccccuggggaccccugacuucaagggagucguguuuggcaugguuucucagcggaacguggggaaugaugcccccggauccacacgcgcgcaacaggccugggucagcaccuauuccccgcaguucgugccuaaacuuggcucugucaaccugagaauuagcgacaaugaugacuuucaguuccaacccacaaaguuuacccccguggggguuaacgaugacgaugacggacacccuuuccggcagugggaacucccgaauuacuccggcgagcugacgcuuaacaugaaucuggcucccccuguggcccccaacuuuccuggcgaacagcuccuguucuuucgcagcuucguccccugcucugggggauacaaccagggcaucaucgauugucugauuccucaagaguggauccagcauuuuuaucaggaauccgcccccagccagucugacguggcucucauuagauacguuaauccggauacagggcggacccuguucgaggccaagcugcacagaagcggauauaucaccguggcgcacuccggcgacuacccucuggucgugcccgcuaacgggcauuuucgcuucgacucuugggugaaucaauucuauagccucgccuga

SEQ ID NO: 30549 - RNA, 1587 nt, Artificial Sequence
  derived and/or modified sequence opt5 from VP1__Norovirus_and/or_Norovirus-like__KT906671
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauagcaaucagcccaacucccgcaugagacuugucgcuaugcuguacacaccccuccggucuaacggcagcggggacgauguguucaccguguccugccgcguccugacgagaccuaccccggacuuugaguucacauaucugguucccccuagcguggaaucuaagaccaaacccuuuucccucccuauucugacacuuagcgagcugaccaauucucgguuccccgugccgaucgauucccucuuuacggcccaaaacaauguccuucaggugcagugucagaacggacgcugcacacuugacggcgagcugcaagggaccacacagcuccugccuaccggaauuugugcuuucagaggccggguuaccgcccagaucaaucagcgcgauagauggcauaugcaacugcagaaccucaauggcacaacguacgaccccaccgaugacgugccugcuccccuggggacaccugacuucaagggagucguguuuggcaugguuagccagcggaacguggggaaugaugcccccggaucuacccgcgcgcaacaggccugggucuccacauauagcccgcaguucgugccuaaacuuggcuccgucaaccugagaauuucugacaaugaugacuuucaguuccaacccaccaaguuuacgcccguggggguuaacgaugacgaugacggacacccuuuccggcagugggaacucccgaauuacagcggcgagcugacacuuaacaugaaucuggcucccccuguggcccccaacuuuccuggcgaacagcuccuguucuuuagauccuucguccccugcagcgggggauacaaccagggcaucaucgauugucugauuccucaagaguggauccagcauuuuuaucaggaaucugcccccucccagagcgacguggcucucauucgcuacguuaauccggauaccgggcggacccuguucgaggccaagcugcacagaucuggauauaucacaguggcgcacagcggcgacuacccucuggucgugcccgcuaacgggcauuuucgcuucgacuccugggugaaucaauucuauucucucgccuga

SEQ ID NO: 30550 - RNA, 1587 nt, Artificial Sequence
  derived and/or modified sequence opt5 from VP1__Norovirus_and/or_Norovirus-like__AB810013
augaagauggccagcaacgacgcugcccccuccaaugauggcgcggcuucucuggugccugaggccaucaacgaaaccaugccgcucgagcccgucgccggggcuagcauugccgcuccuguugccggacagacaaauaucauugaccccuggaucagaacgaacuucgugcaagcgccuaauggcgaauuuaccgugucuccccggaacuccccuggggagauucugcuuaaucuggaacucggaccggaucugaaccccuaccuugcccaccugagccgcauguauaauggcuacgcugggggagucgaggugcagguucuccuggccggcaacgcuuucacagccggcaaaauccuguuugcggccaucccucccaauuucccuguggacaugauuucccccgcucagaucaccaugcucccgcaucugauugucgaugugagaacacuugagccuaucaugauuccccugccugacguucggaacguguuuuaucacuucaauaaccagccccaaccccgcaugagacucgucgccaugcuguacaccccucuucggucuaaugggagcggagaugacguguuuacaguguccugccgcguccugaccagaccgacgcccgauuucgaauuuaucuaucucguuccucccagcguggagucuaagaccaaaccuuucacacugcccauucugaccaucuccgaacucacaaacagccgguuuccgaucccuauugagcagcuguacaccgcucccaacgagaauaacgugguccagugucagaauggccgcugcacgcuugacggggaacugcaaggaacaacccagcuccugucuuccgccguguguagcuauagaggccggacaguugccaaccgcggggauaauugggaccagaaccuucugcagcucaccuacccuucuggagcuuccuacgaucccaccgacgaggugccugcgccccugggcacacaagacuucagcggcauccuguaugggguccucacgcaggauaauguguccgaaggaaccggcgaggccaagaacgcuaaagggguuuacauuucuacaaccagcggaaaguuuacaccgaagaucggcuccauugggcugcauagcaucaccgaaaaugugcacccuaaccagcaaucuagauucacgcccgucggaguggcccagaaugagaacacacccuuccagcaguggguccuuccucauuaugccggcgcucuggcccucaauaccaaccuggcgccggcuguggcccccaccuuuccuggcgagcaacuucuguucuuucggucccgcguucccugcgugcaggggcucagaggacaggacgccuucaucgauugucugcugccucaggaaugggucaaucacuuuuaccaagaggcugcccccagccaggcugacguggcccucauucgguauguuaacccugauacaggcagaacccuguucgaagcgaaacuucaccgcucuggguuuaucacagugagccauacgggagccuacccccuggucgugccgccuaacggccacuuccgguuugacuccugggugaaucaguucuauucuuga

SEQ ID NO: 30551 - RNA, 1584 nt, Artificial Sequence
  derived and/or modified sequence opt5 from VP1__Norovirus_and/or_Norovirus-like__EU096510
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaugacguuuucaccgugagcugcagagugcugacacggccuuccccggauuuugacuucauuuuucucgugcccccuaccgucgaaagccgcacgaaacccuucaccguuccuauccugacaguggaggaaaugaccaacucuagauuucccauuccgcuugagaagcuguucacagggccuuccggagccuucgucgugcagccccagaauggccgguguaccacggaugggguucuccugggaacaacccaacugagcccugugaacaucugcacauuucgcggcgacgucacccauaucgccggcacccacaauuacacaaugaaccucgcuucucagaauuggaacaauuaugaucccacggaggaaauuccugcgccccuggggaccccggacuucgugggaagaauccagggcaugcuuacacagaccacacgcggggacggauccacccggggccauaaagccacggucagcacaggggaugugcacuuuaccccuaagcugggaucuauucaauucaacaccgacacaaauaacgauuuugagaccggccagaauacaaaguucacgcccguuggcgugguccaggacgggaacggaacccaccaaaaugaaccccagcagugggugcucccuuccuacagcggcagaacagggcauaacgcucaccuggccccggccguugcucccaccuuuccuggagagcagcuucuguucuuucgguccacaaugcccggcuguucuggguacccuaacaugaaucucgauugccugcugccccaagaaugggugcagcauuucuaucaggaggccgcgccugcucagagcgacgucgcccuccugcgcuuugugaaccccgauaccggcagagugcuuuucgaguguaaacugcacaaguccggauacguuacggucgcccacaccggccaacaugaccucgugaucccgccuaauggguauuuucgguucgauagcugggugaaccaguucuacacacuguga

SEQ ID NO: 30552 - RNA, 1584 nt, Artificial Sequence
  derived and/or modified sequence opt5 from VP1__Norovirus_and/or_Norovirus-like__EU096513
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacaauuaugacccuaccgaagagauucccgccccucuugggacacccgauuucgugggaaaaauccagggcguccugacgcagaccacaaagggggacggaucuacccggggccacaaggcuacaguguacaccggguccgccccguuuacgccuaaacucggaagcguucaguucuccacagacaccgaaaacgauuuugaggcccaucaaaauaccaaguucacacccgugggcgucauucaggacggcucuaccacacaccgcaacgaaccccagcaaugggugcugccuagcuacuccgggagaaauguucacaacgugcaucuugcuccggccgucgcgcccacguuuccuggagagcagcuccuguucuuucggagcaccaugcccggcuguucuggguauccuaauauggaucuggacugccugcucccccaggagugggugcagcacuucuaccaagaagcugccccugcccaguccgauguggcucugcuucgcuuuguuaaccccgacacaggaagaguccuguucgaguguaaacuccauaagagcggcuaugugaccguggcccacacagggcagcacgaucuggucaucccgccuaacggcuacuuucgguucgacucuugggugaaucaguucuauacccuuuga

SEQ ID NO: 30553 - RNA, 1584 nt, Artificial Sequence
  derived and/or modified sequence opt5 from VP1__Norovirus_and/or_Norovirus-like__EU096514
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacaauuaugacccuaccgaagagauucccgccccucuugggacacccgauuucgugggaaaaauccagggcguccugacgcagaccacaaagggggacggaucuacccggggccacaaggcuacaguguacaccggguccgccccguuuacgccuaaacucggaagcguucaguucuccacagacaccgaaaacgauuuugagacccaucaaaauacaaaguucacccccgugggcgucauucaggacggcgggacaacgcaccgcaacgaaccccagcaaugggugcugccuucuuacagcggaagaaauguucacaacgugcaucuugccccggcugucgcccccaccuuuccuggcgagcagcuccuguucuuucgguccacaaugcccggguguagcggauauccuaauauggaucuggacugccugcucccccaggagugggugcagcacuucuaccaagaagcggcuccugcccagucugauguggcccugcuucgcuuuguuaaccccgacaccggcagaguccuguucgaguguaaacuccauaaguccggguaugugacaguggcucacaccggccagcacgaucuggucaucccgccuaacggauacuuucgguucgacagcugggugaaucaguucuauacgcuuuga

SEQ ID NO: 30554 - RNA, 1584 nt, Artificial Sequence
  derived and/or modified sequence opt5 from VP1__Norovirus_and/or_Norovirus-like__EU096512
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacaauuaugacccuaccgaagagauucccgccccucuugggacacccgauuucgugggaaaaauccagggcguccugacgcagaccacaaagggggacggaucuacccggggccacaaggcuacaguguacaccggguccgccccguuuacgccuaaacucggaagcguucaguucuccacagacaccgaaaacgauuuugagacccaucaaaauacaaaguucacccccgugggcgucauucaggacggcucuacaacgcaccgcaacgaaccccagcaaugggugcugccuagcuacuccgggagaaauguucacaacgugcaucuugccccggcugucgcccccaccuuuccuggagagcagcuccuguucuuucggagcacaaugcccggcuguucuggguauccuaauauggaucuggacugccugcucccccaggagugggugcagcacuucuaccaagaagcggcuccugcccaguccgauguggcccugcuucgcuuuguuaaccccgacaccggaagaguccuguucgaguguaaacuccauaagagcggcuaugugacaguggcucacaccgggcagcacgaucuggucaucccgccuaacggcuacuuucgguucgacucuugggugaaucaguucuauacgcuuuga

SEQ ID NO: 30555 - RNA, 1581 nt, Artificial Sequence
  derived and/or modified sequence opt5 from VP1__Norovirus_and/or_Norovirus-like__KU311161
augaugauggccagcaaggacgcucccuccaacauggauggcaccucuggggccggacagcuggugccugaagucaaugcggcugaaccgcucccccuggagccuguugugggcgccgccacagcugccgcuacggccgggcaagugaacaugaucgaccccuggauuaugaauaacuucguccaggcgccugaaggagaguuuaccaucagccccaauaacacaccuggcgauauucuuuucgaccugagacucgggccgcaccugaaucccuuucuucugcaucucucccagauguacaacggaugggugggcaauaugcggguucgcgugaugcuggccggcaacgcuuucucugccgggaaaaucauuaucugcugugucccucccggauuugaaagccagaauaucuccauuggccaagcuaccauguucccucacgugaucgccgauguuagagugcuggagcccauugaggucccgcucgacgaugugcggaacgugcuguuucauacaaaugaaaaccgcccuaccaugagacuucugugcaugcucuauacaccccugcgggccgggggagccucuagcggcaccgacccuuucgucaucgcugggcgcguucuuacgugucccgcccccgauuuuaauuuccuguuucucgugccuccguccguggagcagaagaccagacagcugacaauucccaacaucccucugaacaaucucgcuaacagccggguccccgccaugauuaauaaaaugaccgugucugccgaccagaaccaaguugugcaguuccagaauggacgcugcacacuggaaggccagcuucugggcaccacgccugucuccgcuaaccaaguggcgagaauccgggggaagguuuuuagcacaaauucuggaaccggccucaaccugacagagguggaugggacccccuaccacgccuucgaguccccggcuccucuuggauuccccgacaucggcaauugugauuggcaugucuaugccuuuaaagugaaccagaauaccggggacccuauguaccgccuggacauuacacagggaaacagcuucgcgccccaccucggcucuaucgaauuuuccagcgagaaucacccuuccggcgaucaacuggggacgcugaccuggauuucuccccucaacaaugcuagcagagucgacccguggaagaucccuacauauggauccacccugacagaaagcaccaaccuugccccucccauuuuucccccgggcuucggggagucuaucguguacuucauguccgauuuucccaucguuagcggaaacacggcgcagauuccuugcacacugccccaggaguucgugucuagcuuugucgaacagcaagcuccuauccggggcgaggccgcccuccugcauuauguggaccccgauacccaccgcaaucuuggggaguucaagcuguacccugacggcuuuauuaccuguguucccaacacaggaggcgggccgcagaaucucccuuccaacggaguguucgucuuuucuagcuggguguccagauacuaucagcugaaacccgugggcaccuga

SEQ ID NO: 30556 - RNA, 1581 nt, Artificial Sequence
  derived and/or modified sequence opt5 from VP1__Norovirus_and/or_Norovirus-like__KX907730
augaugauggccagcaaggacgcucccuccaacauggauggcaccucuggggccggacagcuggugccugaagucaaugcggcugaaccgcucccccuggagccuguugugggcgccgccacagcuguggccacggcugggcaagucaacaugaucgaccccuggauuaugaauaacuucgugcaggccccugaaggagaguuuaccaucagccccaauaacacaccuggcgauauucuuuucgaccugagacucgggccgcaccugaaucccuuucuucugcaucucucccagauguacaacggauggguuggcaauaugcgggugcgcgucaugcuggcgggcaacgccuucucugcugggaaaaucauuaucugcugugugccucccggauuugaaagccagaauaucuccauuggccaagccaccauguucccucacguuaucgcugaugugagaguccuggagcccauugaggugccgcucgacgaugugcggaacguccuguuucauacaaaugaaaaccgcccuaccaugagacuucugugcaugcucuauacaccccugcgggccgggggagcgucuagcggcaccgacccuuucguuaucgccgggcgcgugcuuacgugucccgcucccgauuuuaauuuccuguuucucgugccuccguccgucgagcagaagaccagacagcugacaauucccaacaucccucugaacaaucucgccaacagccgggugcccgcuaugauuaauaaaaugaccguuucugccgaccagaaccaagugguccaguuccagaauggacgcugcacacuggaaggccagcuucugggcaccacgccuguguccgccaaccaaguugcuagaauccgggggaagguguuuagcacaaauucuggaaccggccucaaccugacagaggucgaugggacccccuaccacgcguucgaguccccggccccucuuggauuccccgacaucggcaauugugauuggcauguguaugcuuuuaaagucaaccagaauaccggggacccuauguaccgccuggacauuacacagggaaacagcuucgcuccccaccucggcucuaucgaauuuuccagcgagaaucacccuuccggcgaucaacuggggacgcugaccuggauuucuccccucaacaaugccagcagaguggacccguggaagaucccuacauauggauccacccugacagaaagcaccaaccuugccccucccauuuuucccccgggcuucggggaggccaucguuuacuucaugucugauuuucccaucguguccggaaacacggcgcagauuccuugcacacugccccaggaguucgucagcucuuuuguggaacagcaagcuccuauccggggcgaggccgcccuccugcauuauguugaccccgauacccaccgcaaucuuggggaguucaagcuguacccugacggcuuuauuaccugugugcccaacacaggaggcgggccgcagaaucucccuagcaacggagucuucguguuuuccucuugggugagcagauacuaucagcugaaacccguuggcaccuga

SEQ ID NO: 30557 - RNA, 1581 nt, Artificial Sequence
  derived and/or modified sequence opt5 from VP1__Norovirus_and/or_Norovirus-like__EU096507
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgacagcaccauuaagcucaucgcuaugcuguauacaccccuucgcgccaacaaugcuggcgaugacguuuucaccguguccugcagagugcugacacggcccagcccugauuuugacuucauuuuucucgucccgcccaccguggaaucucgcacgaaaccuuucaccguucccauccugacaguggaggaaauguccaacagcagauuuccugucccccuugagaagcuguacaccgggccgucuuccgccuucgugguucagccucagaauggacgguguacaaccgauggcgugcuccuggggacgacacaacugagcgccgucaacauuugcaccuuccgcggagacgugacacauaucgcuggcucucacgauuauaccaugaaucucgcgucccagaacuggaauaacuacgaccccaccgaggaaaucccugcuccccugggcacaccugacuuugucgggaaaauucagggagugcuuacgcagaccacaagagaggauggcagcacccgggcccauaaggccacaguuuccaccgggucugugcacuucacgcccaagcugggaagcguccaauacacaaccgacaccaauaacgauuuucagacaggccagaauaccaaauucacaccgguggggguuauccaagacggauccaaccaccagaaugaaccucagcagugggugcuccccaacuauagcggccgcacgggccauaauguccaccuggcccccgcuguggccccuaccuuuccgggggagcaacuucuguucuuuagaucuacaaugcccggauguuccggcuacccuaacaugaaccucgauugccugcugccccaggaaugggugcagcauuucuaucaggaggcggcuccugcccaaagcgacguugcccuccugcgguuugucaaucccgauaccgggcgcgugcuuuucgaguguaagcugcacaaaucuggauacgugacagucgcucacaccggcccucaugaccucgugauucccccgaacggguauuuuagauucgauagcuggguuaaucaguuuuacacgcuguga

SEQ ID NO: 30558 - RNA, 1581 nt, Artificial Sequence
  derived and/or modified sequence opt5 from VP1__Norovirus_and/or_Norovirus-like__AB810007
augaagauggccagcaacgacgcugcccccuccaaugauggcgcggcuucucuggugccugaggccaucaacgaaaccaugccgcucgagcccgucgccggggcuagcauugccgcuccuguugccggacagacaaauaucauugaccccuggaucagaacgaacuucgugcaagcgccuaauggcgaauuuaccgugucuccccggaacuccccuggggagauucugcuuaaucuggaacucggaccggaucugaaccccuaccuugcccaccugagccgcauguauaauggcuacgcugggggagucgaggugcagguucuccuggccggcaacgcuuucacagccggcaaaauccuguuugcggccaucccucccaauuucccuguggacaugauuucccccgcucagaucaccaugcucccgcaucugauugucgaugugagaacacuugagccuaucaugauuccccugccugacguucggaacguguuuuaucacuucaauaaccagccccaaccccgcaugagacucgucgccaugcuguacaccccucuucggucuaaugggagcggagaugacguguuuacaguguccugccgcguccugaccagaccgacgcccgauuucgaauuuaucuaucucguuccucccagcguggagucuaagaccaaaccuuucacacugcccauucugaccaucuccgaacucacaaacagccgguuuccgaucccuauugagcagcuguacaccgcucccaacgagaauaacgugguccagugucagaauggccgcugcacgcuugacggggaacugcaaggaacaacccagcuccugucuuccgccguguguagcuauagaggccggacaguugccaaccgcggggauaauugggaccagaaccuucugcagcucaccuacccuucuggagcuuccuacgaucccaccgacgaggugccugcgccccugggcacacaagacuucagcggcauccuguaugggguccucacgcaggauaauguguccgaaggaaccggcgaggccaagaacgcuaaagggguuuacauuucuacaaccagcggaaaguuuacaccgaagaucggcuccauugggcugcauagcaucaccgaaaaugugcacccuaaccagcaaucuagauucacgcccgucggaguggcccagaaugagaacacacccuuccagcaguggguccuuccucauuaugccggcgcucuggcccucaauaccaaccuggcgccggcuguggcccccaccuuuccuggcgagcaacuucuguucuuucggucccgcguucccugcgugcaggggcucagaggacaggacgccuucaucgauugucugcugccucaggaaugggucaaucacuuuuaccaagaggcugcccccagccaggcugacguggcccucauucgguauguuaacccugauacaggcagaacccuguucgaagcgaaacuucaccgcucuggguuuaucacagugagccauacgggagccuacccccuggucgugccgccuaacggccacuuccgguuugacuccugggugaaucaguucuga

SEQ ID NO: 30559 - RNA, 1581 nt, Artificial Sequence
  derived and/or modified sequence opt5 from VP1__Norovirus_and/or_Norovirus-like__AB809989
augaagauggccagcaacgacgcugcccccuccaaugauggcgcggcuucucuggugccugaggccaucaacgaaaccaugccgcucgagcccgucgccggggcuagcauugccgcuccuguugccggacagacaaauaucauugaccccuggaucagaacgaacuucgugcaagcgccuaauggcgaauuuaccgugucuccccggaacuccccuggggagauucugcuuaaucuggaacucggaccggaucugaaccccuaccuugcccaccugagccgcauguauaauggcuacgcugggggagucgaggugcagguucuccuggccggcaacgcuuucacagccggcaaaauccuguuugcggccaucccucccaauuucccuguggacaugauuucccccgcucagaucaccaugcucccgcaucugauugucgaugugagaacacuugagccuaucaugauuccccugccugacguucggaacguguuuuaucacuucaauaaccagccccaaccccgcaugagacucgucgccaugcuguacaccccucuucggucuaaugggagcggagaugacguguuuacaguguccugccgcguccugaccagaccgacgcccgauuucgaauuuaucuaucucguuccucccagcguggagucuaagaccaaaccuuucacacugcccauucugaccaucuccgaacucacaaacagccgguuuccgaucccuauugagcagcuguacaccgcucccaacgagaauaacgugguccagugucagaauggccgcugcacgcuugacggggaacugcaaggaacaacccagcuccugucuuccgccguguguagcuauagaggccggacaguugccaacucuggggauaauugggaccagaaccuucugcagcucaccuacccuuccggagcuagcuacgaucccaccgacgaggugccugcgccccugggcacacaagacuucuccggcauccuguaugggguccucacgcaggauaaugugucugaaggaaccggcgaggccaagaacgcuaaagggguuuacauuagcacaaccuccggaaaguuuacaccgaagaucggcagcauugggcugcauucuaucaccgaaaaugugcacccuaaccagcaaucccgcuucacgcccgucggaguggcccagaaugagaacacacccuuccagcaguggguccuuccucauuaugccggcgcucuggcccucaauaccaaccuggcgccggcuguggcccccaccuuuccuggcgagcaacuucuguucuuuagaagccggguucccugcgugcaggggcuccgcggacaggacgccuucaucgauugucugcugccucaggaaugggucaaucacuuuuaccaagaggcugcccccucucaggcugacguggcccucauuagauauguuaacccugauacaggccggacccuguucgaagcgaaacuucacagaagcggguuuaucacagugucccauacgggagccuacccccuggucgugccgccuaacggccacuuccgcuuugacucuugggugaaucaguucuga

SEQ ID NO: 30560 - RNA, 1581 nt, Artificial Sequence
  derived and/or modified sequence opt5 from VP1__Norovirus_and/or_Norovirus-like__AB810000
augaagauggccagcaacgacgcugcccccuccaaugauggcgcggcuucucuggugccugaggccaucaacgaaaccaugccgcucgagcccgucgccggggcuagcauugccgcuccuguugccggacagacaaauaucauugaccccuggaucagaacgaacuucgugcaagcgccuaauggcgaauuuaccgugucuccccggaacuccccuggggagauucugcuuaaucuggaacucggaccggaucugaaccccuaccuugcccaccugagccgcauguauaauggcuacgcugggggagucgaggugcagguucuccuggccggcaacgcuuucacagccggcaaaauccuguuugcggccaucccucccaauuucccuguggacaugauuucccccgcucagaucaccaugcucccgcaucugauugucgaugugagaacacuugagccuaucaugauuccccugccugacguucggaacguguuuuaucacuucaauaaccagccccaaccccgcaugagacucgucgccaugcuguacaccccucuucggucuaaugggagcggagaugacguguuuacaguguccugccgcguccugaccagaccgacgcccgauuucgaauuuaucuaucucguuccucccagcguggagucuaagaccaaaccuuucacacugcccauucugaccaucuccgaacucacaaacagccgguuuccgaucccuauugagcagcuguacaccgcucccaacgagaauaacgugguccagugucagaauggccgcugcacgcuugacggggaacugcaaggaacaacccagcuccugucuuccgccguguguagcuauagaggccggacaguugccaacucuggggauaauugggaccagaaccuucugcagcucaccuacccuuccggagcuagcuacgaucccaccgacgaggugccugcgccccugggcacacaagacuucuccggcauccuguaugggguccucacgcaggauaaugugucugaaggaaccggcgaggccaagaacgcuaaagggguuuacauuagcacaaccuccggaaaguuuacaccgaagaucggcagcauugggcugcauucuaucaccgaaaaugugcacccuaaccagcaaucccgcuucacgcccgucggaguggcccagaaugagaacacacccuuccagcaguggguccuuccucauuaugccggcgcucuggcccucaauaccaaccuggcgccggcuguggcccccaccuuuccuggcgagcaacuucuguucuuuagaagccggguucccugcgugcaggggcuccgcggacaggacgccuucaucgauugucugcugccucaggaaugggucaaucacuuuuaccaagaggcugcccccucucaggcugacguggcccucauuagauauguuaacccugauacaggccggacccuguucgaagcgaaacuucacagaagcggguuuaucacagugucccauacgggagucuacccccugguggugccgccuaacggccacuuccgcuuugacucuuggguuaaucaguucuga

SEQ ID NO: 30561 - RNA, 1575 nt, Artificial Sequence
  derived and/or modified sequence opt5 from VP1__Norovirus_and/or_Norovirus-like__AB809999
augaagauggccagcaacgacgcugcccccuccaaugauggcgcggcuucucuggugccugaggccaucaacgaaaccaugccgcucgagcccgucgccggggcuagcauugccgcuccuguugccggacagacaaauaucauugaccccuggaucagaacgaacuucgugcaagcgccuaauggcgaauuuaccgugucuccccggaacuccccuggggagauucugcuuaaucuggaacucggaccggaucugaaccccuaccuugcccaccugagccgcauguauaauggcuacgcugggggagucgaggugcagguucuccuggccggcaacgcuuucacagccggcaaaauccuguuugcggccaucccucccaauuucccuguggacaugauuucccccgcucagaucaccaugcucccgcaucugauugucgaugugagaacacuugagccuaucaugauuccccugccugacguucggaacguguuuuaucacuucaauaaccagccccaaccccgcaugagacucgucgccaugcuguacaccccucuucggucuaaugggagcggagaugacguguuuacaguguccugccgcguccugaccagaccgacgcccgauuucgaauuuaucuaucucguuccucccagcguggagucuaagaccaaauccuucacacugccuauucugaccaucagcgaacucacaaacucucgguuucccaccccgaucgagcagcuguacacggcuccuaacgagaauaacgugguccagugucagaauggccgcugcacacuugacggggaacugcaaggaaccacacagcuccuguccagcgccguguguucuuauagaggccggaccguugccaacuccggggauaauugggaccagaaccuucugcagcucaccuaccccagcggagcuuccuacgauccuacagacgaggugcccgcgccucugggcacgcaagacuucucuggcauucuguaugggggacucacccaggauaaugucagcgaaggcacaggggaggccaagaacgcuaaaggaguguacaucuccaccacaagcggcaaguuuacccccaagauugggucuaucggacugcauuccauuacggaaaauguucacccgaaccagcaaagccgcuucacaccugugggcgucgcccagaaugagaacacccccuuccagcagugggugcuuccccauuaugccggcgcucuggcccucaauaccaaccuggcgccugcugucgccccgacauuucccggggagcaacuucuguucuuuagaucucgggugccuugcguucagggacuccgcggccaggacgccuucaucgauugucugcugccccaggaaugggugaaucacuuuuaccaagaggcugccccuagccaggcugacgucgcccucaucagauaugugaaccccgauaccgggcggacacuguucgaagcgaaacuucacagauccggauuuauuacgguuucucauaccggcgccuacccucugguggugcccccgaacgggcacuuccgcuuugacagcugggucaauuga

SEQ ID NO: 30562 - RNA, 1572 nt, Artificial Sequence
  derived and/or modified sequence opt5 from VP1__Norovirus_and/or_Norovirus-like__FJ692501
augaugauggccagcuccgacgcuacacccccuucugagggcgccaccaaccuggugccggaagucaauacgcagguugugccccucgagccuguggcgggggcugccgccgcugcccccuucaccggacaaaacaaugucaucgauccuuggauuuuucagaacuucgugcaggcuccccagggcgaauuuacaguuagcccuagaaauaccccgggggagauccugcuucggauuccccugggaccuaaccucaaucccuuccuggcccaccuuucccgcauguacaacgcgugggugggcgggauggaagccgagaugauccuggcuggaaaugccuuuacagcuggcaagcuccugauugucgcccugccucccggcuucgaggcgacccaacucacaccggcccaggcuaccgccuuuccucaugugaucgcugacguuagaacgcuggaacccaucccuauuccccuucccgauauccggaacgugcuguuccacuauaauggggacccuaccccgacaauucagaucgucgugaugcucuacacaccccugcgcaccaacggaaauggcgaugacguguuuaccgucucugggagacuucugacgcggccugcccccgauuucagcuuuuccuuccucguuccucccacaguggagcagaaaacccgcccguuuacacugccuaaccuggccgugucugaccucagcaauuccagauuccccgcuccugucaacauucugcgggcggaucccaacaccacccuugcccuggacuaucaaaauggacgcugcacacucgauggcgcucugcaggggacgaccccuacaaacagcucuuuccuuggauaccugagaggcaccguggaccggguuaauuccgaucaggugcauguccaccuccgcgaacccaacggcgacccguuucagcuggggcugccuggaccccaaggcgugcccgacuauagagccacacucgauaucuacguugacugggagaauaagaaccaugggaauccuugugagggaacccugaacacgggcagccagacagaauauaccccggggcuuggaacccugacauucaauaaaaccucuggcgauacacccgagcagggcgacccugugauuaugcggcucgucgccuuucgcuccaaccugacggaucaacuucccgcuuacaauggggccuucggacagggcgaaaaccuggcgccucccgugagcccucccgucccgggggagguguuucuccaguucggaucuagauacacccggcugggcgaaagagagcuggcuguucagugccuccugccuuccgaguggaucacacacuuuuauagcgaagccgcccccauccaaggggaggcuaugcuucugcgcuacgugcagccugaccucggccggauucuguucgaagccaagcuguauaaagagggauuugucaccguggcuggcgggacaaaucccguuaccuucccgaucgauggaacguuuguggccgucuccugggugucuagaaacuucgugcuuagcccuaugggcuccgggcagggacgccggagauga

SEQ ID NO: 30563 - RNA, 1572 nt, Artificial Sequence
  derived and/or modified sequence opt5 from VP1__Norovirus_and/or_Norovirus-like__FJ692500
augaugauggccagcuccgacgcuacacccccuucugagggcgccaccaaccuggugccggaagucaauacgcagguugugccccucgagccuguggcgggggcugccgccgcugcccccuucaccggacaaaacaaugucaucgauccuuggauuuuucagaacuucgugcaggcuccccagggcgaauuuacaguuagcccuagaaauaccccgggggagauccugcuucggauuccccugggaccuaaccucaaucccuuccuggcccaccuuucccgcauguacaacgcgugggugggcgggauggaagccgagaugauccuggcuggaaaugccuuuacagcuggcaagcuccugauugucgcccugccucccggcuucgaggcgacccaacucacaccggcccaggcuaccgccuuuccucaugugaucgcugacguuagaacgcuggaacccaucccuauuccccuucccgauauccggaacgugcuguuccacuauaauggggacccuaccccgacaauucagaucgucgugaugcucuacacaccccugcgcaccaacggaaauggcgaugacguguuuaccgucucugggagacuucugacgcggccugcccccgauuucagcuuuuccuuccucguuccucccacaguggagcagaaaacccgcucuuuuacacugccgaaccuggccgugagcgaccucuccaauagcagauucccugcucccgucaacauucugcgggcggauccuaacaccacccuugcccuggacuaucaaaauggacgcugcacacucgauggcgcucugcaggggacgacccccacaaacucuuccuuccuuggauaccugagaggcaccguggaccggguuaauagcgaucaggugcauguccaccuccgcgaaccuaacggcgaccccuuucagcuggggcugccgggaccucaaggcgugcccgacuauagagccacacucgauaucuacguugacugggagaauaagaaccaugggaaucccugugagggaacccugaacacgggcucucagacagaauauaccccugggcuuggaacccugacauucaauaaaaccuccggcgauacaccggagcagggcgaccccgugauuaugcggcucgucgccuuucgcagcaaccugacggaucaacuuccugcuuacaauggggccuucggacagggcgaaaaccuggcgcccccugugucucccccuguccccggggagguguuucuccaguucggauccagauacacccggcugggcgaaagagagcuggcuguucagugccuccugccgagcgaguggaucacacacuuuuauuccgaagccgccccuauccaaggggaggcuaugcuucugcgcuacgugcagcccgaccucggccggauucuguucgaagccaagcuguauaaagagggauuugucaccguggcuggcgggacaaauccuguuaccuuccccaucgauggaacguuuguggccgucucuugggugagcagaaacuucgugcuuuccccgaugggcagcgggcagggacgccggagauga

SEQ ID NO: 30564 - RNA, 1572 nt, Artificial Sequence
  derived and/or modified sequence opt5 from VP1__Norovirus_and/or_Norovirus-like__AB031013
augaugauggccagcaaggacgcuaccuccucuguggauggcgccagcggggcgggacagcugguccccgagguuaacgcuuccgacccucucgccauggauccgguggccggcucuagcacagcuguggccacggcugggcaagucaaucccaucgacccuuggauuaucaacaauuucgugcaggcgccccagggagaauuuaccauuuccccuaacaauacacccggcgggguucuguucgaucuuucucugggaccucaccucaacccguuucugcuucaucugagccagauguacaauggcugggugggcaacaugagaguccggaucaugcucgccgggaaugccuucaccgcuggaaaaauuaucguguccugcauucccccuggcuuugggagccacaaccugacaaucgcccaagcuacccuguucccccauguuaucgccgacgugcgcacacucgauccuauugaggucccccuggaagacgugagaaaugugcuuuuucacaacaaugaucggaaccagcagaccaugcgccuggucuguaugcucuauacgccgcugagaaccggaggcgggacaggagacucuuucguuguggcgggccgggugaugaccugcccuucccccgauuuuaauuuccuuuuucuggucccucccacaguggagcagaagacccgccccuucacgcucccuaaccugccgcugagcucucucuccaacagcagagcuccccugccuaucucuggcauggggauuucccccgacaauguucaaagcgugcaguuucagaacggacgguguacacuugauggccgccuggucgggaccacaccugugucccucucucauguugccaaaaucagaggaaccagcaauggcaccgugauuaaccugacagaacuugacgggacgcccuuccacccguucgagggaccugcccccaucggcuuuccugaccugggcgggugcgauuggcacaucaauaugacccaguucggacauuccagccaaacacaguacgacgucgauaccacacccgacaccuuugugccucaccucggcucuauucaggcuaacgggaucggauccggcaauuauauugggguccugagcugggugucucccccgagccauccuuccggcucucaaguugaucuguggaagauccccaacuacggaagcuccauuacggaggccacacaccucgcccccagcguguauccuccgggcuucggggaaguccugguguuuuucaugucuaaaauccccggaccuggcgcuuacucccuucccugucugcucccucaggaguauaucagccaccuggcgucugaacaggcccccaccguuggggaggcugcccuucugcauuacguggacccugauaccggacggacacucggcgaguuuaaggccuaccccgacggguuccugaccugcgucccgaauggcgcuuccagcggaccucagcaacugcccauuaacggcguguuuguguucguuuccugggucucucgcuuuuaucagcucaagccuguggggacagccagcuccgcgagauga

SEQ ID NO: 30565 - RNA, 1572 nt, Artificial Sequence
  derived and/or modified sequence opt5 from VP1__Norovirus_and/or_Norovirus-like__KU253442
augaugauggccagcaaggacgcuaccuccucuguggauggcgccagcggggcgggacagcugguccccgagguuaacgcuuccgacccucucgccauggauccgguggccggcucuagcacagcuguggccacggcugggcaagucaaucccaucgacccuuggauuaucaacaauuucgugcaggcgccccagggagaauuuaccauuuccccuaacaauacacccggcgauguucuguucgaccuuucucuggggccucaccucaacccguuucugcuucaucugagccagauguacaauggaugggugggcaacaugagaguccggaucaugcucgccggcaaugccuucaccgcugggaaaauuaucguguccugcauucccccuggauuuggcagccacaaccugacaaucgcccaagcuacccuguucccccauguuaucgccgaugugcgcacacucgacccuauugaggucccccuggaagaugugagaaaugugcuuuuucacaacaaugaccggaaccagcagaccaugcgccuggucuguaugcucuauacgccgcugagaaccgggggaggcacaggggauucuuccguuguggcgggacgggugaugaccugcccuagccccgacuucaauuuucuuuuccuggucccucccacaguggagcagaagacccgccccuuuacgcucccuaaccugccgcugucuucccucagcaacucuagagcuccccugccuaucuccagcaugggcauuucccccgauaauguucaaucugugcagcuucagaacggccgguguacacuggacgggcgccucgucggaaccacaccugugagccugucccauguugccaaaaucagaggcaccagcaaugggaccgccauuaaccuuacagaacuggacggaacgcccuuccacccguuugagggcccugcucccaucgggcucccugaucugggaggcugcgaccggcacaucaauaugacccaguucggccauucuucccaaacacagcacgaugccgacaccacacccgauaccagcgugccucaucuggggucuauucaggccaacggaaucggcagcgggaauuacgucggagugcucuccuggauuucucccccgagccacccuuccggcagccaagucgaccuguggaagauccccaacuaugggucuuccauuacggaggcuacacaccuugcgcccagcguguacccuccgggcuucggagaaguucugguguuuuucaugucuaaaaugcccggcccuggggccuauaaucuccccugucugcuuccucaggaguacaucucccaucuggcuagcgaacaggcccccaccgucggagaggccgcucuccugcacuauguggauccugacaccggccgcaaccugggggaguuuaaggccuaccccgauggauuccucacaugcguuccgaauggcgcguccucugggccucagcaacugcccaucaacggcguguuugucuucgugagcuggguguccagauuuuaccagcuuaagccuguuggaaccgcuucuagcgcccgguga

SEQ ID NO: 30566 - RNA, 1572 nt, Artificial Sequence
  derived and/or modified sequence opt5 from VP1__Norovirus_and/or_Norovirus-like__EF547392
augaugauggccagcaaggacgcuaccuccucuguggauggcgccagcggggcgggacagcugguccccgagguuaacgcuuccgacccucucgccauggauccgguggccggcucuagcacagcuguggccacggcugggcaagucaaucccaucgacccuuggauuaucaacaauuucgugcaggcgccccagggagaauuuaccauuuccccuaacaauacacccggcgauguucuguucgaccuuucucuggggccucaccucaacccguuucugcuucaucugagccagauguacaauggaugggugggcaacaugagaguccggaucaugcucgccggcaaugccuucaccgcugggaaaauuaucguguccugcauucccccuggauuuggcagccacaaccugacaaucgcccaagcuacccuguucccccauguuaucgccgaugugcgcacacucgacccuauugaggucccccuggaagaugugagaaaugugcuuuuucacaacaaugaccggaaccagcagaccaugcgccuggucuguaugcucuauacgccgcugagaaccgggggaggcacaggggauucuuucguuguggcgggacgggugaugaccugcccuucccccgacuuuaauuuccuuuuucuggucccucccacaguggagcagaagacccgccccuucacgcucccuaaccugccgcugagcucucucuccaacagcagagcuccccugccuaucucuggcaugggcauuucccccgauaauguucaaagcgugcaguuucagaacgggcgguguacacuugacggacgccuggucggcaccacaccugugucccucucucauguugccaaaaucagagggaccagcaauggaaccgugauuaaccugacagaacuugacggcacgcccuuccacccguucgaggggccugcccccaucggauuuccugaucugggcggcugcgacuggcacaucaauaugacccaguucgggcauuccagccaaacacaguacgaugucgacaccacacccgauaccuuugugccucaccucggaucuauucaggcuaacggcgucuccagcgggaauuauaucggagugcugucuuggguuagcccgcccucccauccuucuggcagccaaguggaccuguggaagauucccaacuacggguccagcaucacggaggccacacaccucgcccccucugucuauccuccgggcuucggagaagugcugguguuuuucauguccaaaauucccggcccuggggcuuacagccuucccugucugcucccucaggaguauaucucucaccuggcguccgaacaggcccccaccguuggagaggcugcccuucugcauuacgucgauccugacaccggccggaaucucggggaguuuaaggccuaccccgauggauuccugacaugcgugccgaacggcgcuagcuccgggccucagcaacugcccaucaauggcguguuuguuuucgucucuugggugagccgcuuuuaucagcucaagccugugggaaccgccuccacagcgagauga

SEQ ID NO: 30567 - RNA, 1572 nt, Artificial Sequence
  derived and/or modified sequence opt5 from VP1__Norovirus_and/or_Norovirus-like__KT943503
augaugauggccagcaaggacgcuaccuccucuguggauggcgccagcggggcgggacagcugguccccgagguuaacgcuuccgacccucucgccauggauccgguggccggcucuagcacagcuguggccacggcugggcaagucaaucccaucgacccuuggauuaucaacaauuucgugcaggcgccccagggagaauuuaccauuuccccuaacaauacacccggcgauguucuguucgaccuuucucuggggccucaccucaacccguuucugcuucaucugagccagauguacaauggaugggugggcaacaugagaguccggaucaugcucgccggcaaugccuucaccgcugggaaaauuaucguguccugcauucccccuggauuuggcagccacaaccugacaaucgcccaagcuacccuguucccccauguuaucgccgaugugcgcacacucgacccuauugaggucccccuggaagaugugagaaaugugcuuuuucacaacaaugaccggaaccagcagaccaugcgccuggucuguaugcucuauacgccgcugagaaccgggggaggcacaggggauucuuucguuguggcgggacgggugaugaccugcccuucccccgacuuuaauuuccuuuuucuggucccucccacaguggagcagaagacccgccccuucacgcucccuaaccugccgcugagcucucucuccaacagcagagcuccccugccuaucucuuccaugggcauuagccccgauaauguucaauccgugcaguuucagaacggccgguguacacuugacgggcgccuggucggaaccacaccugugucucucagccauguugccaaaaucagaggcaccuccaaugggaccgugauuaaccugacagaacuugacggaacgcccuuccacccguucgagggcccugcccccaucggguuuccugaucugggaggcugcgacuggcacaucaauaugacccaguucggccauagcucucaaacacaguacgaugucgacaccacacccgauaccuuugugccucaccucggguccauucaggcuaacggaaucggcagcgggaauuaugucggagugcugucuuggauuagcccgcccucccauccuucuggcagccaaguugaccuguggaagauccccaacuacggguccagcauuacggaggccacacaccucgcccccucuguguauccuccgggcuucggagaaguccugguguuuuucauguccaaaaugcccggcccuggggcuuacaaucuucccugucugcucccucaggaguauaucagccaccuggcgucugaacaggcccccaccguuggagaggcugcccuucugcauuacguggauccugacaccggccggaaccucggggaguuuaaggccuaccccgauggauuccugacaugcgucccgaauggcgcuuccagcgggccucagcaacugcccaucaacggcguguuuguguucguuuccugggucucucgcuuuuaucagcucaagccugugggaaccgccagcuccgcgagauga

SEQ ID NO: 30568 - RNA, 1572 nt, Artificial Sequence
  derived and/or modified sequence opt5 from VP1__Norovirus_and/or_Norovirus-like__AY502016
augaugauggccagcaaggacgcuaccuccaacguggauggcgccucuggggcgggacagcugguccccgaagcuaauacaagcgacccucucgccauggauccgguugccggcuccucuacggcuguggccaccgcugggcaagugaaccccaucgacccuuggauuaucaauaacuucguccaggcgccccagggagaauuuacaauuagcccuaauaacacccccggcgaugugcuguucgaccuuucccuggggccucaccucaauccguuucugcuucaucugucucagauguacaacggauggguuggcaauaugagagugcggaucaugcucgccggcaacgccuucacagcugggaaaauuaucgucagcugcauucccccuggauuuggcucccacaaucugaccaucgcccaaagcacacuguucccccaugugaucgcugauguucgcacccucgacccuauugaggugccccuggaagaugucagaaacgugcuuuuucacaauaacgaccggaaucagcagacgaugcgccugguguguaugcucuauaccccgcugagaacagggggaggcaccggggauucuuucgucguugccggacgggugaugacaugcccuucccccgacuuuaacuuccuuuuucuggugccucccaccgucgagcagaagacgcgccccuucacacucccuaaccugccgcugagcucucucuccaauagcagagcgccccugccuaucucuuccaugggcauuagccccgauaacgugcaauccguucaguuucagaauggccgguguacccuugacgggcgccuggugggaacaaccccugucucucucagccagguggccaaaaucagaggcaccuccaacgggacaguuauuaaucugacggaacuugacggaacccccuuccauccguucgagggcccugcucccaucggguuuccugaucugggaggcugcgacuggcacgugaacaugacacaauucggccacagcucucagacccaguuugaugucgacacaacccccgagacguucgugccucaucucggguccauccaagccaauggagucggcagcgggaacuacauuggagugcugucuuggaucagcccgcccucccacccuucuggcagccagguugaucuguggaagauucccaauuauggguccagcaucacagaagcuacccaucucgcccccucuguguuuccuccgggcuucggagagguccugguguuuuucauguccaaaauucccggcccuggggccuacaaccuucccugucugcucccucaggaauauaucagccacuuugcuucugagcaggcgcccaccguuggagaggccgcucugcuucacuacguggacccugauacaggccggaaucugggggaguucaaggccuaucccgacggauuucugaccugcgucccgaacggcgccuccagcgggccucaacagcuccccaucaauggcguguucguguuuguuuccugggucucucgcuucuaccagcugaagccugugggaacagcuagcuccgccagauga

SEQ ID NO: 30569 - RNA, 1572 nt, Artificial Sequence
  derived and/or modified sequence opt5 from VP1__Norovirus_and/or_Norovirus-like__KU253446
augaugauggccagcaaggacgcuaccuccucuguggauggcgccagcggggcgggacagcugguccccgagguuaacgcuuccgacccucucgccauggauccgguggccggcucuagcacagcuguggccacggcugggcaagucaaucccaucgacccuuggauuaucaacaauuucgugcaggcgccccagggagaauuuaccauuuccccuaacaauacacccggcgauguucuguucgaccuuucucuggggccucaccucaacccguuucugcuucaucugagccagauguacaauggaugggugggcaacaugagaguccggaucaugcucgccggcaaugccuucaccgcugggaaaauuaucguguccugcauucccccuggauuuggcagccacaaccugacaaucgcccaagcuacccuguucccccauguuaucgccgaugugcgcacacucgacccuauugaggucccccuggaagaugugagaaaugugcuuuuucacaacaaugaccggaaccagcagaccaugcgccuggucuguaugcucuauacgccgcugagaaccgggggaggcacaggggauucuuucguuguggcgggacgggugaugaccugcccuucccccgacuuuaauuuccuuuuucuggucccucccacaguggagcagaagacccgccccuucacgcucccuaaccugccgcugagcucucucuccaacagcagagcuccccugccuaucucuuccaugggcauuagccccgauaauguucaauccgugcaguuucagaacggccgguguacacuugacgggcgccuggucggaaccacaccugugucucucagccauguugccaaaaucagaggcaccuccaaugggaccgugauuaaccugacagaacuugacggaacgcccuuccacccguucgagggcccugcccccaucggguuuccugaucugggaggcugcgacuggcacaucaauaugacccaguucggccauagcucucaaacacaguacgaugucgacaccacacccgauaccuuugugccucaccucggguccauucaggcuaacggaaucggcagcgggaauuaugucggagugcugucuuggauuagcccgcccucccauccuucuggcagccaaguugaccuguggaagauccccaacuacggguccagcauuacggaggccacacaccucgcccccucuguguauccuccgggcuucggagaaguccugguguuuuucauguccaaaaugcccggcccuggggcuuacaaucuucccugucugcucccucaggaguauaucagccaccuggcgucugaacaggcccccaccguuggagaggcugcccuucugcauuacguggauccugacaccggccggaaccucggggaguuuaaggccuaccccgauggauuccugacaugcgucccgaauggcgcuuccagcgggccucagcaacugcccaucauuggcguguuuguguucguuuccugggucucucgcuuuuaucagcucaagccugugggaaccgccagcuccgcgagauga

SEQ ID NO: 30570 - RNA, 1572 nt, Artificial Sequence
  derived and/or modified sequence opt5 from VP1__Norovirus_and/or_Norovirus-like__KU253445
augaugauggccagcaaggacgcuaccuccucuguggauggcgccagcggggcgggacagcugguccccgagguuaacgcuuccgacccucucgccauggauccgguggccggcucuagcacagcuguggccacggcugggcaagucaaucccaucgacccuuggauuaucaacaauuucgugcaggcgccccagggagaauuuaccauuuccccuaacaauacacccggcgauguucuguucgaccuuucucuggggccucaccucaacccguuucugcuucaucugagccagauguacaauggaugggugggcaacaugagaguccggaucaugcucgccggcaaugccuucaccgcugggaaaauuaucguguccugcauucccccuggauuuggcagccacaaccugacaaucgcccaagcuacccuguucccccauguuaucgccgaugugcgcacacucgacccuauugaggucccccuggaagaugugagaaaugugcuuuuucacaacaaugaccggaaccagcagaccaugcgccuggucuguaugcucuauacgccgcugagaaccgggggaggcacaggggauucuuucguuguggcgggacgggugaugaccugcccuucccccgacuuuaauuuccuuuuucuggucccucccacaguggagcagaagacccgccccuucacgcucccuaaccugccgcugagcucucucuccaacagccuggcuccccuuccuaucucuuccaugggcauuagccccgauaauguucaauccgugcaguuucagaacggcagauguacacuggacgggcggcucgucggaaccacaccugugucucugagccauguugccaaaauccgcggcaccuccaaugggaccgugauuaaccuuacagaacuggacggaacgcccuuccacccguucgagggcccugcccccaucggguuuccugaucucggaggcugcgacuggcacaucaauaugacccaguucggccauagcucucaaacacaguacgaugucgacaccacacccgauaccuuugugccucaccugggguccauucaggcuaacggaaucggcagcgggaauuaugucggagugcugucuuggauuagcccgcccucccauccuucuggcagccaaguugaccucuggaagauccccaacuacggguccagcauuacggaggccacacaccuggcccccucuguguauccuccgggcuucggagaaguccuuguguuuuucauguccaaaaugcccggcccuggggcuuacaaucugcccugucuccugccucaggaguauaucagccaccuugcgucugaacaggcccccaccguuggagaggcugcccugcuccauuacguggauccugacaccggcagaaaccugggggaguuuaaggccuaccccgauggauuccugacaugcgucccgaauggcgcuuccagcgggccucagcaacuccccaucaacggcguguuuguguucguuuccugggucucucgguuuuaucagcugaagccugugggaaccgccagcuccgcgcgcuga

SEQ ID NO: 30571 - RNA, 1572 nt, Artificial Sequence
  derived and/or modified sequence opt5 from VP1__Norovirus_and/or_Norovirus-like__KF039735
augaugauggccagcaaggacgcuaccuccucuguggauggcgccagcggggcgggacagcugguccccgagguuaacgcuuccgacccucucgccauggauccgguggccggcucuagcacagcuguggccacgaccgggcaagucaaucccaucgacccuuggauuaucaacaauuucgugcaggcuccccagggagaauuuacaauuuccccuaacaauacccccggcgauguucuguucgaccuuucucuggggccucaccucaacccguuucugcuucaucugagccagauguacaauggaugggugggcaacaugagaguccggaucaugcucgccggcaaugcguucacagccgggaaaauuaucguguccugcauucccccuggauuuggcagccacaaccugaccaucgcucaagccacacuguucccccauguuaucgcugaugugcgcacccucgacccuauugaggucccccuggaagaugugagaaaugugcuuuuucacaacaaugaccggaaccagcagacgaugcgccuggucuguaugcucuauaccccgcugagaacagggggaggcaccggggauucuuucguuguggccggacgggugaugacaugcccuucccccgacuuuaauuuccuuuuucuggucccucccaccguggagcagaagacgcgccccuucacacucccuaaccugccgcugagcucucucuccaacagcagagcgccccugccuaucucuuccaugggcauuagccccgauaauguucaauccgugcaguuucagaacggccgguguacccuugacgggcgccuggucggaacaaccccugugucucucagccauguugccaaaaucagaggcaccuccaaugggacagugauuaaccugacggaacuugacggaacccccuuccacccguucgagggcccugcucccaucggguuuccugaucugggaggcugcgacuggcacaucaauaugacacaguucggccauagcucucaaacccaguacgaugucgacacaacccccgauacguuugugccucaccucggguccauucaggccaacggaaucggcagcgggaauuaugucggagugcugucuuggauuagcccgcccucccauccuucuggcagccaaguugaccuguggaagauccccaacuacggguccagcauuacagaggcuacccaccucgcccccucuguguauccuccgggcuucggagaaguccugguguuuuucauguccaaaaugcccggcccuggggccuacaaucuucccugucugcucccucaggaguauaucagccaccuggcuucugaacaggcgcccaccguuggagaggccgcccuucugcauuacguggauccugacacaggccggaaccucggggaguuuaaggcuuaccccgauggauuccugaccugcgucccgaauggcgccuccagcgggccucagcaacugcccaucaacggcguguuuguguucguuuccugggucucucgcuuuuaucagcucaagccugugggaacagcuagcuccgccagauga

SEQ ID NO: 30572 - RNA, 1572 nt, Artificial Sequence
  derived and/or modified sequence opt5 from VP1__Norovirus_and/or_Norovirus-like__KF039732
augaugauggccagcaaggacgcuaccuccucuguggauggcgccagcggggcgggacagcugguccccgagguuaacgcuuccgacccucucgccauggauccgguggccggcucuagcacagcuguggccacggcugggcaagucaaucccaucgacccuuggauuaucaacaauuucgugcaggcgccccagggagaauuuaccauuuccccuaacaauacacccggcgauguucuguucgaccuuucucuggggccucaccucaacccguuucugcuucaucugagccagauguacaauggaugggugggcaacaugagaguccggaucaugcucgccggcaaugccuucaccgcugggaaaauuaucguguccugcauucccccuggauuuggcagccacaaccugacaaucgcccaagcuacccuguucccccauguuaucgccgaugugcgcacacucgacccuauugaggucccccuggaagaugugagaaaugugcuuuuucacaacaaugaccggaaccagcagaccaugcgccuggucuguaugcucuauacgccgcugagaaccgggggaggcacaggggauucuuucguuguggcgggacgggugaugaccugcccuucccccgacuuuaauuuccuuuuucuggucccucccacaguggagcagaagacccgccccuucacgcucccuaaccugccgcugagcucucucuccaacagcagagcuccccugccuaucucuuccaugggcauuagccccgauaauguucaauccgugcaguuucagaacggccgguguacacuugacgggcgccuggucggaaccacaccugugucucucagccauguugccaaaaucagaggcaccuccaaugggaccgugauuaaccugacagaacuugacggaacgcccuuccacccguucgagggcccugcccccaucggguuuccugaucugggaggcugcgacuggcacaucaauaugacccaguucggccauagcucucaaacacaguacgaugucgacaccacacccgugaccuuugucccucaccucggguccauucaggcuaacggaaucggcagcgggaauuaugugggaguucugucuuggauuagcccgcccucccauccuucuggcagccaaguggaucuguggaagauccccaacuacggguccagcauuacggaggccacacaccucgcccccucugucuauccuccgggcuucggagaagugcugguguuuuucauguccaaaaugcccggcccuggggcuuacaaucuucccugucugcucccucaggaguauaucagccaccuggcgucugaacaggcccccaccguuggagaggcugcccuucugcauuacgucgacccugauaccggccggaaccucggggaguuuaaggccuaccccgacggauuccugacaugcgugccgaauggcgcuuccagcgggccucagcaacugcccaucaacggcguguuuguuuucgucuccugggugucucgcuuuuaucagcucaagccugugggaaccgccagcuccgcgagauga

SEQ ID NO: 30573 - RNA, 1572 nt, Artificial Sequence
  derived and/or modified sequence opt5 from VP1__Norovirus_and/or_Norovirus-like__KF039734
augaugauggccagcaaggacgcuaccuccucuguggauggcgccagcggggcgggacagcugguccccgagguuaacgcuuccgacccucucgccauggauccgguggccggcucuagcacagcuguggccacggcugggcaagucaaucccaucgacccuuggauuaucaacaauuucgugcaggcgccccagggagaauuuaccauuuccccuaacaauacacccggcgauguucuguucgaccuuucucuggggccucaccucaacccguuucugcuucaucugagccagauguacaauggaugggugggcaacaugagaguccggaucaugcucgccggcaaugccuucaccgcugggaaaauuaucguguccugcauucccccuggauuuggcagccacaaccugacaaucgcccaagcuacccuguucccccauguuaucgccgaugugcgcacacucgacccuauugaggucccccuggaagaugugagaaaugugcuuuuucacaacaaugaccggaaccagcagaccaugcgccuggucuguaugcucuauacgccgcugagaaccgggggaggcacaggggauucuuucguuguggcgggacgggugaugaccugcccuucccccgacuuuaauuuccuuuuucuggucccucccacaguggagcagaagacccgccccuucacgcucccuaaccugccgcugagcucucucuccaacagcagagcuccccugccuaucucuuccaugggcauuagccccgauaauguucaauccgugcaguuucagaacggccgguguacacuugacgggcgccuggucggaaccacaccugugucucucagccauguugccaaaaucagaggcaccuccaaugggaccgugauuaaccugacagaacuugacggaacgcccuuccacccguucgagggcccugcccccaucggguuuccugaucugggaggcugcgacuggcacaucaauaugacccaguucggccauagcucucaaacacaguacgaugucgacaccacacccgauaccuuugugccucaccucggguccauucaggcuaacggaaucggcagcgggaauuaugucggagugcugucuuggauuagcccgcccucccggccuucuggcagccaaguugaccuguggaagauccccaacuacggguccagcauuacggaggccacacaucucgcccccucuguguauccuccgggcuucggagaaguccugguguuuuucauguccaaaaugcccggcccuggggcuuacaaucuucccugucugcucccucaggaguauaucagccaccuggcgucugaacaggcccccaccguuggagaggcugcccuucugcacuacguggauccugacaccggccgcaaccucggggaguuuaaggccuaccccgauggauuccugacaugcgucccgaauggcgcuuccagcgggccucagcaacugcccaucaacggcguguuuguguucguuuccugggucucuagauuuuaucagcucaagccugugggaaccgccagcuccgcgcgguga

SEQ ID NO: 30574 - RNA, 1572 nt, Artificial Sequence
  derived and/or modified sequence opt5 from VP1__Norovirus_and/or_Norovirus-like__KF039729
augaugauggccagcaaggacgcuaccuccucuguggauggcgccagcggggcgggacagcugguccccgagguuaacgcuuccgacccucucgccauggauccgguggccggcucuagcacagcuguggccacggcugggcaagucaaucccaucgacccuuggauuaucaacaauuucgugcaggcgccccagggagaauuuaccauuuccccuaacaauacacccggcgauguucuguucgaccuuucucuggggccucaccucaacccguuucugcuucaucugagccagauguacaauggaugggugggcaacaugagaguccggaucaugcucgccggcaaugccuucaccgcugggaaaauuaucguguccugcauucccccuggauuuggcagccacaaccugacaaucgcccaagcuacccuguucccccauguuaucgccgaugugcgcacacucgacccuauugaggucccccuggaagaugugagaaaugugcuuuuucacaacaaugaccggaaccagcagaccaugcgccuggucuguaugcucuauacgccgcugagaaccgggggaggcacaggggauucuuucguuguggcgggacgggugaugaccugcccuucccccgacuuuaauuuccuuuuucuggucccucccacaguggagcagaagacccgccccuucacgcucccuaaccugccgcugagcucucucuccaacagcagagcuccccugccuaucucuuccaugggcauuagccccgauaauguucaauccgugcaguuucagaacggccgguguacacuugacgggcgccuggucggaaccacaccugugucucucagccauguugccaaaaucagaggcaccuccaaugggaccgugauuaaccugacagaacuugacggaacgcccuuccacccguucgagggcccugcccccaucggguuuccugaucugggaggcugcgacuggcacaucaauaugacccaguucggccauagcucucaaacacaguacgaugucgacaccacacccgauaccuuugugccucaccucggguccauucaggcuaacggagucggcagcgggaauuaugugggaguucugucuuggaucagcccgcccucccauccuucuggcagccaaguggaccuguggaagauucccaacuacggguccagcaucacggaggccacacaccucgcccccucugucuauccuccgggcuucggagaagugcugguguuuuucauguccaaaaugcccggcccuggggcuuacaaucuucccugucugcucccucaggaguauauuagccaccuggcgucugaacaggcccccaccguuggagaggcugcccuucugcauuacgucgauccugacaccggccggaaccucggggaguuuaaggccuaccccgauggauuccugacaugcgugccgaauggcgcuuccagcgggccucagcaacugcccaucaacggcguguuuguuuucgucuccugggugucucgcuuuuaucagcucaagccugugggaaccgccagcuccgcgagauga

SEQ ID NO: 30575 - RNA, 1572 nt, Artificial Sequence
  derived and/or modified sequence opt5 from VP1__Norovirus_and/or_Norovirus-like__KF039737
augaugauggccagcaaggacgcuaccuccucuguggauggcgccagcggggcgggacagcugguccccgagguuaacgcuuccgacccucucgccauggauccgguggccggcucuagcacagcuguggccacggcugggcaagucaaucccaucgacccuuggauuaucaacaauuucgugcaggcgccccagggagaauuuaccauuuccccuaacaauacacccggcgauguucuguucgaccuuucucuggggccucaccucaacccguuucugcuucaucugagccagauguacaauggaugggugggcaacaugagaguccggaucaugcucgccggcaaugccuucaccgcugggaaaauuaucguguccugcauucccccuggauuuggcagccacaaccugacaaucgcccaagcuacccuguucccccauguuaucgccgaugugcgcacacucgacccuauugaggucccccuggaagaugugagaaaugugcuuuuucacaacaaugaccggaaccagcagaccaugcgccuggucuguaugcucuauacgccgcugagaaccgggggaggcacaggggauucuuucguuguggcgggacgggugaugaccugcccuucccccgacuuuaauuuccuuuuucuggucccucccacaguggagcagaagacccgccccuucacgcucccuaaccugccgcugagcucucucuccaacagcagagcuccccugccuaucucuuccaugggcauuagccccgauaauguucaauccgugcaguuucagaacggccgguguacacuugacgggcgccuggucggaaccacaccugugucucucagccauguugccaaaaucagaggcaccuccaaugggaccgugauuaaccugacagaacuugacggaacgcccuuccacccguucgagggcccugcccccaucggguuuccugaucugggaggcugcgacuggcacaucaauaugacccaguucggccauagcucucaaacacaguacgaugucaacaccacacccgacaccuuugugccucaccucggguccauucaggcuaauggaaucggcagcgggaacuaugucggagugcugucuuggauuagcccgcccucccauccuucuggcagccaaguugaucuguggaagauccccaauuacggguccagcauuacggaggccacacaccucgcccccucuguguauccuccgggcuucggagaaguccugguguuuuucauguccaaaaugcccggcccuggggcuuacaaccuucccugucugcucccucaggaguauaucagccaccuggcgucugaacaggcccccaccguuggagaggcugcccuucugcauuacguggacccugauaccggccggaaucucggggaguuuaaggccuaccccgacggauuccugacaugcgucccgaacggcgcuuccagcgggccucagcaacugcccaucaauggcguguuuguguucguuuccugggucucucgcuuuuaucagcucaagccugugggaaccgccagcuccgcgagauga

SEQ ID NO: 30576 - RNA, 1572 nt, Artificial Sequence
  derived and/or modified sequence opt5 from VP1__Norovirus_and/or_Norovirus-like__KF039731
augaugauggccagcaaggacgcuaccuccucuguggauggcgccagcggggcgggacagcugguccccgagguuaacgcuuccgacccucucgccauggauccgguggccggcucuagcacagcuguggccacggcugggcaagucaaucccaucgacccuuggauuaucaacaauuucgugcaggcgccccagggagaauuuaccauuuccccuaacaauacacccggcgauguucuguucgaccuuucucuggggccucaccucaacccguuucugcuucaucugagccagauguacaauggaugggugggcaacaugagaguccggaucaugcucgccggcaaugccuucaccgcugggaaaauuaucguguccugcauucccccuggauuuggcagccacaaccugacaaucgcccaagcuacccuguucccccauguuaucgccgaugugcgcacacucgacccuauugaggucccccuggaagaugugagaaaugugcuuuuucacaacaaugaccggaaccagcagaccaugcgccuggucuguaugcucuauacgccgcugagaaccgggggaggcacaggggauucuuucguuguggcgggacgggugaugaccugcccuucccccgacuuuaauuuccuuuuucuggucccucccacaguggagcagaagacccgccccuucacgcucccuaaccugccgcugagcucucucuccaacagcagagcuccccugccuaucucuuccaugggcauuagccccgauaauguucaauccgugcaguuucagaacggccgguguacacuugacgggcgccuggucggaaccacaccugugucucucagccauguugccaaaaucagaggcaccuccaaugggaccgugauuaaccugacagaacuugacggaacgcccuuccacccguucgagggcccugcccccaucggguuuccugaucugggaggcugcgacuggcacaucaauaugacccaguucggccauagcucucaaacacaguacgaugucgacaccacacccgauauuuuugugccucaccucggguccauccaggcuaacggaauuggcagcgggaauuaugucggagugcugucuuggaucagcccgcccucccauccuucuggcagccaaguugaccuguggaagauucccaacuacggguccagcaucaccgaggccacgcaccucgcccccucuguguauccuccgggcuucggagaaguccugguguuuuucauguccaaaaugcccggcccuggggcuuacaaucuucccugucugcucccucaggaguauaucagccaccuggcgucugaacaggcccccacaguuggagaggcugcccuucugcauuacguggauccugacaccggccggaaccucggggaguuuaaggccuaccccgauggauuccugaccugcgucccgaauggcgcuuccagcgggccucagcaacugcccauuaacggcguguuuguguucguuuccugggucucucgcuuuuaucagcucaagccugugggaacagccagcuccgcgagauga

SEQ ID NO: 30577 - RNA, 1563 nt, Artificial Sequence
  derived and/or modified sequence opt5 from VP1__Norovirus_and/or_Norovirus-like__KT732279
augaugauggccagcaaggacgcuaccuccucuguggauggcgccagcggggcgggacagcugguccccgagguuaacgcuuccgacccucucgccauggauccgguggccggcucuagcacagcuguggccacggcugggcaagucaaucccaucgacccuuggauuaucaacaauuucgugcaggcgccccagggagaauuuaccauuuccccuaacaauacacccggcgauguucuguucgaccuuucucuggggccucaccucaacccguuucugcuucaucugagccagauguacaauggaugggugggcaacaugagaguccggaucaugcucgccggcaaugccuucaccgcugggaaaauuaucguguccugcauucccccuggauuuggcagccacaaccugacaaucgcccaagcuacccuguucccccauguuaucgccgaugugcgcacacucgacccuauugaggucccccuggaagaugugagaaaugugcuuuuucacaacaaugaccggaaccagcagaccaugcgccuggucuguaugcucuauacgccgcugagaaccgggggaggcacaggggauucucuuguuguggcgggacgggugaugaccugcccuucccccgacuucaauuuucuguuccucgucccucccacaguggagcagaagacccgccccuuuacgcugccuaaccugccgcucagcucucuguccaacagcagagcuccccuuccuaucucuggcaugggcauuucccccgauaauguucaaagcgugcaguuccagaacgggcgguguacacuggacggacgccucgucggcaccacaccugugucccugucucauguugccaaaaucagagggaccagcaauggaaccgugauuaaccuuacagaacuggacggcacgcccuuucacccguucgaggggccugcccccaucggauucccugaucucggcggcugcgacuggcacaucaauaugacccaguuugggcauuccagccaaacacaguacgaugucgacaccacacccgauaccuucgugccucaccugggaucuauucaggcuaacggcaucaauuccgggaacuauauuggaguccugagcugggugucucccccgagccauccuuccggcucucaaguugaccucuggaagauccccaauuacgggagcuccauuacggaggccacacaccuggcccccagcguguuuccuccgggcuucggagaaguccuuguguuuuucaugucuaaaauccccggcccuggggcuuauucccugcccugucuccugccucaggaguacaucagccaccuugcgucugaacaggcccccaccguuggagaggcugcccugcuccauuauguggauccugacaccggccggaaccugggggaguuuaaggccuaccccgauggauuccugacaugcgucccgaauggcgcuuccagcgggccucagcaacuccccauuaacggcguguuuguguucguuuccugggucucucgcuuuuaccagcugaagccugugggaaccgccagcuga

SEQ ID NO: 30578 - RNA, 1563 nt, Artificial Sequence
  derived and/or modified sequence opt5 from VP1__Norovirus_and/or_Norovirus-like__FJ384783
augaugauggccagcaaggacgcuaccuccucuguggauggcgccagcggggcgggacagcugguccccgagguuaacgcuuccgacccucucgccauggauccgguggccggcucuagcacagcuguggccacggcugggcaagucaaucccaucgacccuuggauuaucaacaauuucgugcaggcgccccagggagaauuuaccauuuccccuaacaauacacccggcgauguucuguucgaccuuucucuggggccucaccucaacccguuucugcuucaucugagccagauguacaauggaugggugggcaacaugagaguccggaucaugcucgccggcaaugccuucaccgcugggaaaauuaucguguccugcauucccccuggauuuggcagccacaaccugacaaucgcccaagcuacccuguucccccauguuaucgccgaugugcgcacacucgacccuauugaggucccccuggaagaugugagaaaugugcuuuuucacaacaaugaccggaaccagcagaccaugcgccuggucuguaugcucuauacgccgcugagaaccgggggaggcacaggggauucuuucguuguggcgggacgggugaugaccugcccuucccccgacuuuaauuuccuuuuucuggucccucccacaguggagcagaagacccgccccuucacgcucccuaaccugccgcugagcucucucuccaacagcagagcuccccugccuaucucuggcaugggcauuucccccgauaauguucaaagcgugcaguuucagaacgggcgguguacacuugacggacgccuggucggcaccacaccugugucccucucucauguugccaaaaucagagggaccagcaauggaaccgugauuaaccugacagaacuugacggcacgcccuuccacccguucgaggggccugcccccaucggauuuccugaucugggcggcugcgacuggcacaucaauaugacccaguucgggcauuccagccaaacacaguacgaugucgacaccacacccgauaccuuugugccucaccucggaucuauucaggcuaacggcaucaauuccgggaacuauauuggaguccugagcugggugucucccccgagccauccuuccggcucucaaguugaccuguggaagauccccaauuacgggagcuccauuacggaggccacacaccucgcccccagcguguucccuccgggcuuuggagaaguccugguguucuuuaugucuaaaauccccggcccuggggcuuauucccuucccugucugcucccucaggaguacaucagccaccuggcgucugaacaggcccccaccguuggagaggcugcccuucugcauuauguggauccugacaccggccggaaccucggggaguucaaggccuaccccgauggauuucugacaugcgucccgaauggcgcuuccagcgggccucagcaacugcccauuaacggcguguucguguuuguuuccugggucucucgcuucuaccagcucaagccugugggaaccgccagcuga

SEQ ID NO: 30579 - RNA, 1563 nt, Artificial Sequence
  derived and/or modified sequence opt5 from VP1__Norovirus_and/or_Norovirus-like__EU085522
augaugauggccagcaaggacgcuaccuccucuguggauggcgccagcggggcgggacagcugguccccgagguuaacgcuuccgacccucucgccauggauccgguggccggcucuagcacagcuguggccacggcugggcaagucaaucccaucgacccuuggauuaucaacaauuucgugcaggcgccccagggagaauuuaccauuuccccuaacaauacacccggcgauguucuguucgaccuuucucuggggccucaccucaacccguuucugcuucaucugagccagauguacaauggaugggugggcaacaugagaguccggaucaugcucgccggcaaugccuucaccgcugggaaaauuaucguguccugcauucccccuggauuuggcagccacaaccugacaaucgcccaagcuacccuguucccccauguuaucgccgaugugcgcacacucgacccuauugaggucccccuggaagaugugagaaaugugcuuuuucacaacaaugaccggaaccagcagaccaugcgccuggucuguaugcucuauacgccgcugagaaccgggucuggaacaggcgauuccuucguuguggcggggcgggugaugaccugcccuagccccgacuuuaauuuccuuuuucuggucccucccacaguggagcagaagacccgccccuucacgcucccuaaccugccgcugucuucccucagcaacucuagagcuccccugccuaucuccggaaugggcauuagccccgauaauguucaauccgugcaguuucagaacggccgguguacacuugacgggcgccuggucggaaccacaccugugucucucagccauguugccaaaaucagaggcaccuccaaugggaccgugauuaaccugacagaacuugacggaacgcccuuccacccguucgagggcccugcccccaucggguuuccugaucugggaggcugcgacuggcacaucaauaugacccaguucggccauagcucucaaacacaguacgaugucgacaccacacccgauaccuuugugccucaccucggguccauucaggcuaacggaaucaauagcggcaacuauauugggguccugucuugggugagcccgcccucccauccuucuggaagccaaguugaccuguggaagauccccaauuacggcuccagcauuacggaggccacacaccucgcccccucuguguucccuccgggguuuggcgaaguccugguguucuuuauguccaaaauccccggaccuggcgcuuauagccuucccugucugcucccucaggaguacaucucucaccuggcguccgaacaggcccccaccguuggggaggcugcccuucugcauuauguggauccugacaccggacggaaccucggcgaguucaaggccuaccccgauggguuucugacaugcgucccgaauggagcuagcuccggcccucagcaacugcccauuaacgggguguucguguuuguuucuugggucagccgcuucuaccagcucaagccugugggcaccgccuccuga

SEQ ID NO: 30580 - RNA, 1563 nt, Artificial Sequence
  derived and/or modified sequence opt5 from VP1__Norovirus_and/or_Norovirus-like__L23828
augaugauggccagcaaggacgcuaccuccucuguggauggcgccagcgcguccguccagcugguucccgaggugaacgcuucugacccucucgccauggauccgguggccgggagcuccacagcugucgccacggcuggacaagugaaucccaucgacccuuggauuaucaacaauuucguucaggcgccccagggcgaauuuaccauuucuccuaacaauacacccggggaugugcuguucgaccuuagccugggaccucaccucaacccguuucugcuucaucugucccagauguacaauggcugggucgggaacaugagagugcggaucaugcucgccggaaaugccuucaccgcuggcaaaauuaucguuagcugcauucccccuggcuuugggucucaacagcugacaaucgcccaggcuacccuguucccccacgugaucgccgauguccgcacacucgacccuauugaggugccccuggaagaugugagaaacguccuuuuucauaauaacgaccggaaucagcaaaccaugcgccugguuuguaugcucuauacgccgcuguccaccggaggcgggacaggagauagcuucgugguggcgggcagagucaugaccugcccuucucccgacuuuaacuuccuuuuucuggugccucccacaguugagcagaagacccggcccuucacgcucccuaaucugccgcuguccagccucucuaacucccgcgcuccccugccuaucagcgggaugggaauuucccccgauaacgugcagucuguccaguuucaaaauggcagauguacacuugacggccggcugguggggaccacaccuguuagccucucccacguggccaaaauccgcggaaccagcaacggcaccgucauuaaucugacagaacuugacgggacgcccuuccauccguucgagggaccugcccccaucggcuuuccugaucugggcggaugcgacuggcacaucaacaugacccaguucggccacucuucccagacacaauacgauguggacaccacacccgauaccagcgucccucaucucggcucuauucaggcuaaugggaucggaagcggcaacuauauuggggugcuguccuggguuucucccccgagccacccuuccggaagccagguggaccuguggaagauccccaauuacgggucuuccauuacggaggccacacaucucgcccccagcgucuauucuccuggguuuggcgaagugcugguuuucuuuauguccaaaaucccgggacccggcggggauagccuuccuugucugcucccccagggauacaucucccaccuggcuucugagcaagcgccuaccgugggcgaagggccccuucugcacuaugucgacccugauaccgacagaaaccucggagaguucaaggccuaccccgauggcuuucugacaugcgugccgaauggggcuagcuccggcccucagcagcugcccauuaacggaguguucguuuuugucucuugggugagccgguucuaccagcucaagccugugggcaccgccuccuga

SEQ ID NO: 30581 - RNA, 1563 nt, Artificial Sequence
  derived and/or modified sequence opt5 from VP1__Norovirus_and/or_Norovirus-like__KX764843
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagguccuucugaaucucgaacuggggccggaucuuaaccccuaccuggcgcaccucucccgcauguauaauggauacgccggcggcguggagguucaggugcugcuggcugggaacgccuucacagcuggaaagauccucuuugccgcggucccucccaauuucccuguggaguuucugucucccgcccagauuaccaugcuuccgcaucugaucguugacgugagaacacucgaaccuaucaugauuccccugccugauguccggaacaccuucuuucacuauagcaaucagcccaacucccgcaugagacuuguggcuaugcuguacacaccccuccggucuaacggcagcggggacgauguguucaccgucuccugccgcguucugacgagaccuaccccggacuuugaguucacauaucuggugcccccuagcguggaaucuaagaccaaacccuuuucccucccuauccugacacuuagcgagcugaccaauucucgguuccccgucccgauugauucccucuuuacggcccaaaacaaugugcugcagguucagugucagaacggacgcugcacacuugacggcgagcugcaagggaccacacagcuccugccuagcggaaucugugcuuucagaggccgggugaccgcccagauuaaucagcgcgauagauggcauaugcaacugcagaaccucaauggcaccacauacgaccccacggaugacgucccugcuccccuggggaccccugacuucaagggagugguuuuuggcauggugucucagcggaacgucgggaaugaugcccccggauccacacgcgcgcaacaggccugggugagcaccuauuccccgcaguucgucccuaaacuuggcucugugaaccugagaaucagcgacaaugaugacuuucaguuccaacccacaaaguuuacccccguuggggugaacgaugacgaugacggacacccuuuccggcagugggaacucccgaauuacuccggcgagcugacgcuuaacaugaaucuggcucccccugucgcccccaacuuuccuggcgaacagcuccuguucuuucgcagcuucgugcccugcucugggggauacaaccagggcauuaucgauugucugaucccucaagaguggauucagcauuuuuaucaggaauccgcccccagccagucugacguugcucucaucagauacgugaauccggauacagggcggacccuguucgaggccaaacuucacagaagcggauauauuaccgucgcgcacuccggcgacuacccucugguggugcccgcuaacgggcauuuucgcuucgacgccugguga

SEQ ID NO: 30582 - RNA, 1563 nt, Artificial Sequence
  derived and/or modified sequence opt5 from VP1__Norovirus_and/or_Norovirus-like__KX764841
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauagcaaucagcccaacucccgcaugagacuugucgcuaugcuguacacaccccuccggucuaacggcagcggggacgauguguucaccguguccugccgcguccugacgagaccuaccccggacuuugaguucacauaucugguucccccuagcguggaaucuaagaccaaacccuuuucccucccuauucugacacuuagcgagcugaccaauucucgguuccccgugccgaucgauucccucuuuacggcccaaaacaauguccuucaggugcagugucagaacggacgcugcacacuugacggcgagcugcaagggaccacacagcuccugccuagcggaauuugugcuuucagaggccggguuaccgcccagaucaaucagcgcgauagauggcggaugcaacugcagaaccucaauggcaccacauacgaccccacggaugacgugccugcuccccuggggaccccugacuucaagggagucguguuuggcaugguuucucagcgcaacguggggaaugaugcccccggauccacaagagcgcaacaggccugggucagcaccuauuccccgcaguucgugccuaaacuuggcucugucaaccugcggauuagcgacaaugaugacuuucaguuccaacccacaaaguuuacccccguggggguuaacgaugacgaugacggacauccuuucagacagugggaacucccgaauuacuccggcgagcugacgcuuaacaugaaucuggcucccccuguggcccccaacuuuccuggcgaacagcuccuguucuuucgcagcuucguccccugcucugggggauacaaccagggcaucaucgauugucugauuccucaagaguggauccagcacuuuuaucaggaauccgcccccagccagucugacguggcucucauucgguacguuaauccggauacagggagaacccuguucgaggccaagcugcaucgcagcggauauaucaccguggcgcacuccggcggguacccucuggucgugcccgcuaacggccacuuucgguucgagucuugguga

SEQ ID NO: 30583 - RNA, 1563 nt, Artificial Sequence
  derived and/or modified sequence opt5 from VP1__Norovirus_and/or_Norovirus-like__KX764840
augaagauggccagcuccgacgcugcccccucuaacgauggcgcggcugggcuggugccugagggaaauaacgaaacccucccgcuggagcccgucgccggcgccgcuaucgccgcuccuguuacagggcagaauaacauuaucgaccccuggauuagaacgaauuucgugcaagccccuaacggagaauuuaccgugagcccccgcaauuccccuggcgagauccuucugaaccucgaacuggggccggaucuuaaucccuaccuggcgcaccucucucggauguauaacggauacgccggcggcgucgaggugcagguucugcuggcugggaaugccuucacagcuggaaaaauucucuuugccgcggugccucccaacuucccugucgaguuucugagccccgcccagaucaccaugcuuccgcaucugaucguggacguuagaacacucgaaccuauuaugaucccccugccugaugugcggaauaccuucuuucacuauuccaaccagcccaauucucgcaugagacuugucgcuaugcuguacacaccccuccggagcaacggcuccggggacgauguguucaccgugagcugccgcguccugacgagaccuaccccggacuuugaguucacauaucugguucccccuucuguggaauccaagaccaaacccuuuagccucccuauucugacacuuucugagcugaccaacucccgguuccccgugccgaucgauagccucuuuacggcccaaaauaacguccuucaggugcagugucagaauggacgcugcacacuugacggcgagcugcaagggaccacacagcuccugccuucuggaauuugugcuuucagaggccggguuaccgcccagaucaaccagcgcgauagauggcauaugcaacugcagaaucucaacggcaccacauacgaccccacggaugacgugccugcuccccuggggaccccugacuucaagggagucguguuuggcaugguuucccagcggaauguggggaacgaugcccccggaagcacacgcgcgcaacaggccugggucuccaccuauucuccgcaguucgugccuaaacuuggcagcgucaaucugagaauuuccgacaacgaugacuuucaguuccaacccacaaaguuuacccccguggggguuaaugaugacgaugacggacacccuuuccggcagugggaacucccgaacuacagcggcgagcugacgcuuaauaugaaccuggcucccccuguggcccccaauuuuccuggcgaacagcuccuguucuuuagaucuuucguccccugcuccgggggauacaaccagggcaucaucgauugucugauuccucaagaguggauccagcauuuuuaucaggaaagcgcccccucucagagcgacguggcucucauucgcuacguuaacccggauacagggcggacccuguucgaggccaagcugcacagauccggauauaucaccguggcgcacucuggcgacuacccucuggucgugcccgcuaaugggcauuuucgcuucgacagcugguga

SEQ ID NO: 30584 - RNA, 1563 nt, Artificial Sequence
  derived and/or modified sequence opt5 from VP1__Norovirus_and/or_Norovirus-like__KT864687
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauagcaaucagcccaacucccgcaugagacuugucgcuaugcuguacacaccccuccggucuaacggcagcggggacgauguguucaccguguccugccgcguccugacgagaccuaccccggacuuugaguucacauaucugguucccccuagcguggaaucuaagaccaaacccuuuucccucccuauucugacacuuagcgagcugaccaauucucgguuccccgugccgaucgauucccucuuuacggcccaaaacaauguccuucaggugcagugucagaacggacgcugcacacuugacggcgagcugcaagggaccacacagcuccugccuagcggaauuugugcuuucagaggccggguuaccgcccagaucaaucagcgcgauagauggcauaugcaacugcagaaccucaauggcaccacauacgaccccacggaugacgugccugcuccccuggggaccccugacuucaagggagucguguuuggcaugguuucucagcggaacguggggaaugaugcccccggauccacacgcgcgcaacaggccugggucagcaccuauuccccgcaguucgugccuaaacuuggcucugucaaccugagaauuagcgacaaugaugacuuucaguuccaacccacaaaguuuacccccguggggguuaacgaugacgaugacggacacccuuuccggcagugggaacucccgaauuacuccggcgagcugacgcuuaacaugaaucuggcucccccuguggcccccaacuuuccuggcgaacagcuccuguucuuucgcagcuucguccccugcucugggggauacaaccagggcaucaucgauugucugauuccucaagaguggauccagcauuuuuaucaggaauccgcccccagccagucugacguggcucucauuagauacguuaauccggauacagggcggacccuguucgaggccaagcugcacagaagcggauauaucaccguggcgcacuccggcgacuacccucuggucgugcccgcuaacgggcauuuucgcuucgagucuugguga

SEQ ID NO: 30585 - RNA, 1563 nt, Artificial Sequence
  derived and/or modified sequence opt5 from VP1__Norovirus_and/or_Norovirus-like__KX764842
augaagauggccagcaacgacguggcucccuccaaugauggcgccgcggggcuggucccugagggaaacaaugaaacccucccgcuggagcccguugcuggcgccgccaucgcugccccugugacagggcagaacaauauuaucgaccccuggauuagaacgaacuucgugcaagcuccuaauggagaauuuaccgucucuccccggaacagcccuggcgagauccuucugaaucucgaacuggggccggaucuuaaccccuaccuggcccaccucucccgcauguauaauggauacgcgggcggcguggagguucaggugcugcuggccgggaacgcuuucacagccggaaagauucucuuugcugccgucccucccaauuucccuguggaguuucugucucccgcgcagaucaccaugcuuccgcaucugaucguugacgugagaacacucgaaccuauuaugaucccccugccugauguccggaacaccuucuuucacuauagcaaucagcccaacucccgcaugagacuuguggccaugcuguacacaccccuccggucuaacggcagcggggacgauguguucaccgucuccugccgcguucugacgagaccuaccccggacuuugaguucacauaucuggugcccccuagcguggaaucuaagaccaaacccuuuucccucccuauucugacacuuagcgagcugaccaauucucgguuccccgucccgaucgauucccucuuuacggcucaaaacaaugugcugcagguucagugucagaacggacgcugcacacuugacggcgagcugcaagggaccacacagcuccugccuagcggaauuugugccuucagaggccgggugaccgcucagaucaaucagcgcgauagauggcauaugcaacugcagaaccucaauggcaccacauacgaccccacggaugacgucccugcuccccuggggaccccugacuucaagggagugguuuuuggcauggugucucagcggaacgucgggaaugaugcccccggauccacacgcgcccaacaggcgugggugagcaccuauuccccgcaguucgucccuaaacuuggcucugugaaccugagaauuagcgacaaugaugacuuucaguuccaacccacaaaguuuacccccguuggggugaacgaugacgaugacggacacccuuuccggcagugggaacucccgaauuacuccggcgagcugacgcuuaacaugaaucuggcucccccugucgcccccaacuuuccuggcgaacagcuccuguucuuucgcagcuucgugcccugcucugggggauacaaccagggcaucaucgauugucugauuccucaagaguggauccagcauuuuuaucaggaauccgcccccagccagucugacguugcccucauuagauacgugaauccggauacagggcggacccuguucgaggcuaaacuucacagaagcggauauaucaccgucgcccacuccggcgacuacccucugguggugcccgcgaacgggcauuuucgcuucgacgcuugguga

SEQ ID NO: 30586 - RNA, 1563 nt, Artificial Sequence
  derived and/or modified sequence opt5 from VP1__Norovirus_and/or_Norovirus-like__KT864685
augaagauggccagcuccgacgcugcccccucuaacgauggcgcggcugggcuggugccugagggaaauaacgaaacccucccgcuggagcccgucgccggcgccgcuaucgccgcuccuguuacagggcagaauaacauuaucgaccccuggauuagaacgaauuucgugcaagccccuaacggagaauuuaccgugagccccagaaauuccccuggcgagauccuucugaaccucgaacuggggccggaucuuaaucccuaccuggcgcaccucucucgcauguauaacggauacgccggcggcgucgaggugcagguucugcuggcugggaaugccuucacagcuggaaaaauucucuuugccgcggugccucccaacuucccugucgaguuucugagccccgcccagaucaccaugcuuccgcaucugaucguggacguuagaacacucgaaccuauuaugaucccccugccugaugugcggaauaccuucuuucacuauuccaaccagcccaauucucgcaugagacuugucgcuaugcuguacacaccccuccggagcaacggcuccggggacgauguguucaccgugagcugccgcguccugacgagaccuaccccggacuuugaguucacauaucugguucccccuucuguggaauccaagaccaaacccuuuagccucccuauucugacacuuucugagcugaccaacucccgguuccccgugccgaucgauagccucuuuacggcccaaaauaacguccuucaggugcagugucagaauggacgcugcacacuugacggcgagcugcaagggaccacacagcuccugccuucuggaauuugugcuuucagaggccggguuaccgcccagaucaaccagcgcgauagauggcauaugcaacugcagaaucucaacggcaccacauacgaccccacggaugacgugccugcuccccuggggaccccugacuucaagggagucguguuuggcaugguuucccagcggaauguggggaacgaugcccccggaagcacacgcgcgcaacaggccugggucuccaccuauucuccgcaguucgugccuaaacuuggccccgucaaucugagaauuagcgacaacgaugacuuucaguuccaacccacaaaguuuaccccuguggggguuaaugaugacgaugacggacacccguuccggcagugggaacuccccaacuacuccggcgagcugacgcuuaauaugaaccuggcuccucccguggccccuaauuuucccggcgaacagcuccuguucuuucggagcuucgucccuugcucugggggauacaaccagggcaucaucgauugucugauuccccaagaguggauccagcauuuuuaucaggaauccgccccgagccagucugacguggcucucauucgcuacguuaacccugauacagggcggacccuguucgaggccaagcugcacagaagcggauauaucaccguggcgcacuccggcgacuacccccuggucgugccugcuaaugggcauuuucgcuucgacucuugguga

SEQ ID NO: 30587 - RNA, 1563 nt, Artificial Sequence
  derived and/or modified sequence opt5 from VP1__Norovirus_and/or_Norovirus-like__KT864684
augaagauggccagcuccgacgcugcccccucuaacgauggcgcggcugggcuggugccugagggaaauaacgaaacccucccgcuggagcccgucgccggcgccgcuaucgccgcuccuguuacagggcagaauaacauuaucgaccccuggauuagaacgaauuucgugcaagccccuaacggagaauuuaccgugagcccccgcaauuccccuggcgagauccuucugaaccucgaacuggggccggaucuuaaucccuaccuggcgcaccucucucggauguauaacggauacgccggcggcgucgaggugcagguucugcuggcugggaaugccuucacagcuggaaaaauucucuuugccgcggugccucccaacuucccugucgaguuucugagccccgcccagaucaccaugcuuccgcaucugaucguggacguuagaacacucgaaccuauuaugaucccccugccugaugugcggaauaccuucuuucacuauuccaaccagcccaauucucgcaugagacuugucgcuaugcuguacacaccccuccggagcaacggcuccggggacgauguguucaccgugagcugccgcguccugacgagaccuaccccggacuuugaguucacauaucugguucccccuucuguggaauccaagaccaaacccuuuagccucccuauucugacacuuucugagcugaccaacucccgguuccccgugccgaucgauagccucuuuacggcccaaaauaacguccuucaggugcagugucagaauggacgcugcacacuugacggcgagcugcaagggaccacacagcuccugccuucuggaauuugugcuuucagaggccggguuaccgcccagaucaaccagcgcgauagauggcauaugcaacugcagaaucucaacggcaccacauacgaccccacggaugacgugccugcuccccuggggaccccugacuucaagggagucguguuuggcaugguuucccagcggaauguggggaacgaugcccccggaagcacacgcgcgcaacaggccugggucuccaccuauucuccgcaguucgugccuaaacuuggcagcgucaaucugagaauuuccgacaacgaugacuuucaguuccaacccacaaaguuuacccccguggggguuaaugaugacgaugacggacacccuuuccggcagugggaacucccgaacuacagcggcgagcugacgcuuaauaugaaccuggcucccccuguggcccccaauuuuccuggcgaacagcuccuguucuuuagaucuuucguccccugcuccgggggauacaaccagggcaucaucgauugucugauuccucaagaguggauccagcauuuuuaucaggaaagcgcccccucucagagcgacguggcucucauucgcuacguuaacccggauacagggcggacccuguucgaggccaagcugcacagauccggauauaucaccguggcgcacucuggcgacuacccucuggucgugcccgcuaaugggcauuuucgcuucgagagcugguga

SEQ ID NO: 30588 - RNA, 1563 nt, Artificial Sequence
  derived and/or modified sequence opt5 from VP1__Norovirus_and/or_Norovirus-like__KX764836
augaagauggccagcuccgacgcugcccccucuaacgauggcgcggcugggcuggugccugagggaaauaacgaaacccucccgcuggagcccgucgccggcgccgcuaucgccgcuccuguuacagggcagaauaacauuaucgaccccuggauuagaacgaauuucgugcaagccccuaacggagaauuuaccgugagcccccgcaauuccccuggcgagauccuucugaaccucgaacuggggccggaucuuaaucccuaccuggcgcaccucucucggauguauaacggauacgccggcggcgucgaggugcagguucugcuggcugggaaugccuucacagcuggaaaaauucucuuugccgcggugccucccaacuucccugucgaguuucugagccccgcccagaucaccaugcuuccgcaucugaucguggacguuagaacacucgaaccuauuaugaucccccugccugaugugcggaauaccuucuuucacuauuccaaccagcccaauucucgcaugagacuugucgcuaugcuguacacaccccuccggagcaacggcuccggggacgauguguucaccgugagcugccgcguccugacgagaccuaccccggacuuugaguucacauaucugguucccccuucuguggaauccaagaccaaacccuuuagccucccuauucugacacuuucugagcugaccaacucccgguuccccgugccgaucgauagccucuuuacggcccaaaauaacguccuucaggugcagugucagaauggacgcugcacacuugacggcgagcugcaagggaccacacagcuccugccuucuggaauuugugcuuucagaggccggguuaccgcccagaucaaccagcgcgauagauggcauaugcaacugcagaaucucaacggcaccacauacgaccccacggaugacgugccugcuccccuggggaccccugacuucaagggagucguguuuggcaugguuucccagcggaauguggggaacgaugcccccggaagcacacgcgcgcaacaggccugggucuccaccuauucuccgcaguucgugccuaaacuuggcagcgucaaucugagaauuuccgacaacgaugacuuucaguuccaacccacaaaguuuacccccguggggguuaaugaugacgaugacggacacccuuuccggcagugggaacucccgaacuacagcggcgagcugacgcuuaauaugaaccuggcucccccuguggcccccaauuuuccuggcgaacagcuccuguucuuuagaucuuucguccccugcuccgggggauacaaccagggcgugaucgauugucugaucccucaagaguggauucagcauuuuuaucaggaaagcgcccccucucagagcgacguugcucucauccgcuacgugaacccggauacagggcggacccuguucgaggccaagcugcacagauccggauauauuaccgucgcgcacucuggcgacuacccucugguggugcccgcuaaugggcauuuucgcuucgaggccugguga

SEQ ID NO: 30589 - RNA, 1563 nt, Artificial Sequence
  derived and/or modified sequence opt5 from VP1__Norovirus_and/or_Norovirus-like__KX764845
augaagauggccagcuccgacgcugcccccucuaacgauggcgcggcugggcuggugccugagggaaauaacgaaacccucccgcuggagcccgucgccggcgccgcuaucgccgcuccuguuacagggcagaauaacauuaucgaccccuggauuagaacgaauuucgugcaagccccuaacggagaauuuaccgugagcccccgcaauuccccuggcgagauccuucugaaccucgaacuggggccggaucuuaaucccuaccuggcgcaccucucucggauguauaacggauacgccggcggcgucgaggugcagguucugcuggcugggaaugccuucacagcuggaaaaauucucuuugccgcggugccucccaacuucccugucgaguuucugagccccgcccagaucaccaugcuuccgcaucugaucguggacguuagaacacucgaaccuauuaugaucccccugccugaugugcggaauaccuucuuucacuauuccaaccagcccaauucucgcaugagacuugucgcuaugcuguacacaccccuccggagcaacggcuccggggacgauguguucaccgugagcugccgcguccugacgagaccuaccccggacuuugaguucacauaucugguucccccuucuguggaauccaagaccaaacccuuuagccucccuauucugacacuuucugagcugaccaacucccgguuccccgugccgaucgauagccucuuuacggcccaaaauaacguccuucaggugcagugucagaauggacgcugcacacuggacggcgagcugcaagggaccacacagcuccugccuucuggaauuugugcuuucagaggccggguuaccgcccagaucaaccagcgcgauagauggcauaugcaacugcagaaucucaacggcaccacauacgaccccacggaugacgugccugcuccccuggggaccccugacuucaagggagucguguuuggcaugguuucccagcggaauguggggaacgaugcccccggaagcacacgcgcgcaacaggccugggucuccaccuauucucuucaguucgugccgaaacugggcagcgucaaucucagaauuuccgacaacgaugacuuucaguuccaaccuacaaaguuuacccccguggggguuaaugaugacgaugacggacaccccuuccggcagugggaacugccuaacuacagcggcgagcuuacgcugaauaugaaccucgcuccgcccguggccccuaauuuucccggcgaacagcugcuguucuuuagaucuuucgucccuugcuccgggggauacaaccagggcaucaucgauugucucauuccccaagaguggauccagcauuuuuaucaggaaagcgccccuucucagagcgacguggcucugauucgcuacguuaaccccgauacagggcggacccuuuucgaggccaagcugcacagauccggauauaucaccguggcgcacucuggcgacuacccgcucgucgugccugcuaaugggcauuuucgcuucgaggccugguga

SEQ ID NO: 30590 - RNA, 1563 nt, Artificial Sequence
  derived and/or modified sequence opt5 from VP1__Norovirus_and/or_Norovirus-like__KX764837
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauagcaaucagcccaacucccgcaugagacuugucgcuaugcuguacacaccccuccggucuaacggcagcggggacgauguguucaccguguccugccgcguccugacgagaccuaccccggacuuugaguucacauaucugguucccccuagcguggaaucuaagaccaaacccuuuucccucccuauucugacacuuagcgagcugaccaauucucgguuccccgugccgaucgauucccucuuuacggcccaaaacaauguccuucaggugcagugucagaacggacgcugcacacuugacggcgagcugcaaggggcuacccagcuccugccuagcggaauuugugccuucagaggccggguuacagcccagaucaaucagcgcgauagauggcauaugcaacugcagaaccucaauggcaccaccuacgaccccacagaugacgugccugcuccccuggggacgccugacuucaagggagucguguuuggcaugguuucucagcggaacguggggaaugauguccccggauccacccgcgcgcaacaggccugggugagcacauauuccccgcaguucgucccuaaacuuggcucugugaaccugagaauuagcgacaaugaugacuuucaguuccaacccaccaaguuuacacccguuggggugaacgaugacgaugacggacacccuuuccggcagugggaacucccgaauuacuccggcgagcugacccuuaacaugaaucuggcucccccugucgcccccaacuuuccuggcgaacagcuccuguucuuucgcagcuucgugcccugcucugggggauacaaccagggcguuaucgauugucugaucccucaagaguggauucagcauuuuuaucaggaauccgcccccagccagucugacguggcucucaucagauacgucaauccggauacggggcggacacuguucgaggccaagcugcacagaagcggauauauuaccguggcgcacuccggcgacuacccucuggugguucccgcuaacgggcauuuucgcuucgacgccugguga

SEQ ID NO: 30591 - RNA, 1563 nt, Artificial Sequence
  derived and/or modified sequence opt5 from VP1__Norovirus_and/or_Norovirus-like__KX764838
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuucccccuaccuggcgcaccucucucgcauguauaacggauacgccggcggcgucgaggugcagguucugcuggcugggaaugccuucacagcuggaaaaauucucuuugccgcggugccucccaacuucccugucgaguuucugagccccgcccagaucaccaugcuuccgcaucugaucguggacguuagaacacucgaaccuauuaugaucccccugccugaugugcggaauaccuucuuucacuauuccaaccagcccaauucucgcaugagacuugucgcuaugcuguacacaccccuccggagcaacggcuccggggacgauguguucaccgugagcugccgcguccugacgagaccuaccccggacuuugaguucacauaucugguucccccuucuguggaauccaagaccaaacccuuuagccucccuauucugacacuuucugagcugaccaacucccgguuccccgugccgaucgauagccucuuuacggcccaaaauaacguccuucaggugcagugucagaauggacgcugcacacuggacggcgagcugcaagggaccacacagguugugccuucuggaauuugugcuuucagaggccgggucaccgcccagaucaaccagcgcgauagauggcauaugcaacuccagaaucugaacuccaccacauacgaccccacggaugacgugccugcuccccugggcaccccugacuucaaggggguuguguuuggaauggucagccagcggaaugugggcaacgaugcccccggguccacacgcgcgcaacaggccugggucucuaccuauagcccgcaguucgugccuaaacucggauccguuaaucugagaauuagcgacaacgaugacuuucaguuccaacccacaaaguuuacccccgugggcgucaaugaugacgaugacgggcacccuuuccggcagugggaacuuccgaacuacucuggagagcugacgcucaauaugaaccuggcucccccuguggcccccaauuuuccuggcgaacagcuucuguucuuuagauccuucguucccugcagcggcggguacaaccagggaaucaucgauugucucauuccucaagaguggauccagcauuuuuaucaggaaucugcccccagccaguccgacguggcucugauucgcuacgucaacccggauacaggccggacccuguucgaggccaagcuccacagaucuggguauaucgcgguggcucacagcggagacuacccucuggugguucccgccaauggccauuuucgcuucgacuccugguga

SEQ ID NO: 30592 - RNA, 1563 nt, Artificial Sequence
  derived and/or modified sequence opt5 from VP1__Norovirus_and/or_Norovirus-like__KU687016
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaagauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauagcaaucagcccaacucccgcaugagacuugucgcuaugcuguacacaccccuccggucuaacggcagcggggacgauguguucaccguguccuuucgcguccugacgagaccuaccccggacuucgaguuuacauaucugguucccccuagcguggaaucucggaccaagcccuucucccucccuauucugacacuuagcgagcugaccaauucucgcuuucccgugccgaucgauucccucuucacggcccaaaacaauguccuucaggugcagugccagaacggaagauguacacuugacggcgagcugcaagggaccacacagcuccugccuagcggaauuugcgcuuuccggggccagguuaccgcccagaucaaucaacgcgauagauggcauaugcagcugcagaaccucaauggcaccacauacgaccccacggaugacgugccugcuccccuggggaccccugacuuuaaaggagucguguucggcaugguuucucaacggaacguggggaaugaugcccccggauccacacgcgcgcagcaggccugggucagcaccuauuccccgcaguuugugccuaagcugggcucuauuaaccugagaaucagcgacaaugaugacuuccaauuucagcccacaaaauucacccccgucggggugaacgaugacgaugacggacacccuuuucggcagugggaacucccgaauuacuccggcgagcugacgcuuaacaugaaucuggcucccccuguugcccccaacuucccuggcgaacagcuccuguuuuuccgcagcuuugugcccuguucugggggauacaaccaaggcaucauugauugccugaucccucaggaguggauucagcauuucuaucaggaauccgcccccagccaaucugacgucgcucucaucagauacgugaauccggauacagggcggacccuguuugaggccaaacuucacagaagcggauauauuaccguugcgcacuccggcgacuacccucuggugguccccgcuaacgggcauuuccgcuucgacgccugguga

SEQ ID NO: 30593 - RNA, 1563 nt, Artificial Sequence
  derived and/or modified sequence opt5 from VP1__Norovirus_and/or_Norovirus-like__KU687015
augaagauggccagcuccgacgcugcccccucuaacgauggcgcggcugggcuggugccugagggaaauaacgaaacccucccgcuggagcccgucgccggcgccgcuaucgccgcuccuguuacagggcagaauaacauuaucgaccccuggauuagaacgaauuucgugcaagccccuaacggagaauuuaccgugagccccagaaauuccccuggcgagauccuucugaaccucgaacuggggccggaucuuaaucccuaccuggcgcaccucucucgcauguauaacggauacgccggcggcgucgaggugcagguucugcuggcugggaaugccuucacagcuggaaaaauucucuuugccgcggugcugccuaacuuccccgucgaguuucuuagcccugcccagaucaccaugcugccccaucucaucguggacguuagaacacuggaaccgauuaugaucccucuucccgaugugcggaauaccuucuuucacuauuccaaccagccuaauucucgcaugagacuggucgcuaugcucuacacaccccugcggagcaacggcuccggggacgauguguucaccgugagcugccgcguccugacgagacccaccccugacuuugaguucacauaucucguuccgcccucuguggaauccaagaccaaaccuuuuagccugcccauucuuacacugucugagcucaccaacucccgguucccugugcccaucgauccgcuguuuacggcccaaaauaacguccuucaggugcagugucagaauggacgcugcacacuggacggcgagcuccaagggaccacacagcugcugccuagcggaauuugugcuuucagaggccggguuaccgcccagaucaaccagcgcgauagauggcauauucaacuccagaaucugaacggcaccacauacgaccccacggaugacgugccugcuccccuugggaccccugacuucaagggagucguguuuggcaugguuucucagcggaauguggggaacgaugcccccggauccacacgcgcgcaacaggccugggucagcaccuauuccccgcaguucgugccuaaacugggcucuaucaaucucagaaucagcgacaacgaugacuuucaguuccaacccacaaaguuuacccccgucggggugaaugaugacgaugacggacacccuuuccggcagugggaacugccgaacuacuccggcgagcuuacgcugaauaugaaccucgcucccccuguugcccccaauuuuccuggcgaacagcugcuguucuuucggagcuucgugcccugcucugggggauacaaccagggcauuaucgauugucucauuccucaagaguggauccagcauuuuuaucaggaauccgcccccagccagucugacgucgcucugauucgcuacgugaacccggauacagggcggacccuuuucgaggccaagcugcacagaagcggauauaucaccguugcgcacuccggcgacuacccucucgugguccccgcuaaugggcauuuucgcuucgacgccugguga

SEQ ID NO: 30594 - RNA, 1563 nt, Artificial Sequence
  derived and/or modified sequence opt5 from VP1__Norovirus_and/or_Norovirus-like__KU687013
augaagauggccagcuccgacgcugcccccucuaacgauggcgcggcugggcuggugccugagggaaauaacgaaacccucccgcuggagcccgucgccggcgccgcuaucgccgcuccuguuacagggcagaauaacauuaucgaccccuggauuagaacgaauuucgugcaagccccuaacggagaauuuaccgugagcccccgcaauuccccuggcgagauccuucugaaccucgaacuggggccggaucuuaaucccuaccuggcgcaccucucucggauguauaacggauacgccggcggcgucgaggugcagguucugcuggcugggaaugccuucacagcuggaaaaauucucuuugccgcggugccucccaacuucccugucgaguuucugagccccgcccagaucaccaugcuuccgcaucugaucguggacguuagaacacucgaaccuauuaugaucccccugccugaugugcggaauaccuucuuucacuauuccaaccagcccaauucucgcaugagacuugucgcuaugcuguacacaccccuccggagcaacggcuccgggggagacguguucaccgugagcugccgcguccugacgagaccuaccccggauuuugaguucacauaucugguucccccuucugugaaguccaaaaccaagcccuuuagccucccuauucugacacuuucugaacugaccaacucccgguuccccgugccgaucgacagccucuuuacggcccaaaauaacguccuucaggugcagugucagaauggccgcugcacacuugauggggagcugcaaggaaccacacagcuccugccuucuggcauuugugcuuucagaggccggguuaccgcccagaucaaccagcgcgacagauggcauaugcaacugcagaaucucaacgggaccacauacgaucccacggacgaugugccugcuccccugggaaccccugacuucaaaggcgucguguuugggaugguuucccagcggaaugugggaaacgacgcccccggcagcacacgcgcgcaacaggccugggucuccaccuauucuccgcaguucgugccuaagcuggggagcauuaaucugagaaucuccgauaacgacgauuuucaguuccaacccacaaaguuuacccccgucggagugaaugacgaugacgauggccacccuuuccggcagugggagcucccgaacuacagcggcgaacugacgcuuaauaugaaccuggcucccccuguugcccccaauuuuccuggggagcagcuccuguucuuuagaucuuucgugcccugcuccggaggcuacaaccaggggaucauugacugucugaucccucaagaauggauucagcauuuuuaucaggagagcgcccccucucagagcgaugucgcucucauccgcuacgugaacccggacacaggacggacccuguucgaagccaaacuucacagauccggcuauauuaccguugcgcacucuggggauuacccucuggugguccccgcuaauggccauuuucgcuucgagagcugguga

SEQ ID NO: 30595 - RNA, 1563 nt, Artificial Sequence
  derived and/or modified sequence opt5 from VP1__Norovirus_and/or_Norovirus-like__KX764839
augaagauggccagcuccgacgcugcccccucuaacgauggcgcggcugggcuggugccugagggaaauaacgaaacccucccgcuggagcccgucgccggcacagccaucgcugccccuguuacggggcagaauaacauuaucgaccccuggauuagaaccaauuucgugcaagcuccuaacggagaauuuacagugagcccccgcaauuccccuggcgagauccuucugaaccucgaacuggggccggaucuuaaucccuaccuggcccaccucucucggauguauaacggauacgcgggcggcgucgaggugcagguucugcuggccgggaaugcuuucaccgccggaaaaauucucuuugcugccgugccucccaacuucccugucgaguuucugagccccgcgcagaucacaaugcuuccgcaucugaucguggacguuagaacccucggcccuauuaugaucccccugccugaugugcggaauacauucuuucacuauuccaaccagcccaauucucgcaugagacuugucgccaugcuguacacgccccuccggagcaacggguccggagacgauguguucaccgugagcugccgcguccugaccagaccuacaccggacuuugaguucaccuaucugguucccccuucuguggaauccaagacaaaacccuuuagccucccuauucugacccuuucugaacugacgaacucccgguuccccgugccgaucgauagccucuuuacagcucaaaauaacguccuucaggugcagugucagaauggccgcugcacccuugacggggagcugcaaggaacaacccagcuccugccuucuggcauuugugccuucagaggccggguuaccgcucagaucaaccagcgcgauagauggcauaugcaacugcagaaucucaacgggacaacguacgaccccaccgaugacgugccugcuccccugggaacaccugacuucaagggcgucguguuugggaugguuucccagcggaaugugggaaacgaugcccccggcagcacccgcgcccaacaggcgugggucuccacauauucuccgcaguucgugccuaaacuugggagcgucaaucugagaauuuccgacaacgaugacuuucaguuccaacccaccaaguuuacgcccgugggaguuaaugaugacgaugacggccacccuuuccggcagugggagcucccgaacuacagcggcgaacugacacuuaauaugaaccuggcucccccuguggcccccaauuuuccuggggagcagcuccuguucuuuagaucuuucguccccugcuccggaggcuacaaccaggggaucaucgauugucugauuccucaagaauggauccagcauuuuuaucaggagagcgcccccucucagagcgacguggcccucauucgcuacguuaacccggauaccggacggacccuguucgaagcuaagcugcacagauccggcuauaucacaguggcccacucuggggacuacccucuggucgugcccgcgaauggccauuuucgcuucgaggcuugguga

SEQ ID NO: 30596 - RNA, 1563 nt, Artificial Sequence
  derived and/or modified sequence opt5 from VP1__Norovirus_and/or_Norovirus-like__KX764844
augaagauggccagcaacgacgcugcccccuccaaugauggcgcggcugggcuggugccugagggaaacaauggcacccucccgcuggaacccgucgccggggccgcuaucgccgcuccuguuacaggacagaacaauauuaucgaccccuggauuagaaucaacuucgugcaagccccuaauggcgaguuuacggugucuccccggaacagcccuggggaaauucuucugaaucucgagcugggaccggaucuuaaccccuaccuggcgcaccucucccgcauguauaauggcuacgccggcggggucgaagugcagguucugcuggcuggaaacgccuucaccgcuggcaaaauccucuuugccgcggugccucccaauuucccugucgaguuucugucucccgcccagaucacaaugcuuccgcaucugauuguggacguuagaacccucgagccuaucaugauuccccugccugaugugcggaacacauucuuucacuauagcaaucagcccaacucccgcauggggcuugucgcuaugcuguacacaccccucagaucuaacggaagcggcgacgauguguucaccguguccugccggguccugacccgcccuacgccggacuuugaguucaccuaucugguucccccuagcguggaaucuaagacaaaacccuuuucccucccuauccugacccuuagcgaacugacaaauucuagauuccccgugccgauugauucccucuuuaccgcccaaaacaauguccuucaggugcagugucagaacgggcggugcacgcuugacggagagcugcaaggcacaacccagcuccugccuagcggcaucugugcuuuccgcgggagaguuacagcccagauuaaucagcgggaucgcuggcauaugcaacugcagaaccucaauggaaccaccuacgaccccacagaugacgugccugcuccccugggcacgccugacuucaagggggucguguuuggaaugguuucucagagaaacgugggcaaugaugcccccggguccacccgggcgcaacaggccugggucagcacauauuccccgcaguucgugccuaaacuuggaucugucaaccugcgcaucagcgacaaugaugacuuucaguuccaacccaccaaguuuacacccgugggcguuaacgaugacgaugacggccacccuuucagacagugggagcucccgaauuacuccggggaacugacccuuaacaugaaucuggcucccccuguggcccccaacuuuccuggagagcagcuccuguucuuucggagcuucguccccugcucuggcggguacaaccagggaaucauugauugucugaucccucaagaauggauucagcauuuuuaucaggaguccgcccccagccagucugacguggcucucaucagauacguuaauccggauacgggccgcacacuguucgaagccaagcugcaccggagcggguauauuaccguggcgcacuccggcgacuacccucuggucgugcccgcuaacggacauuuuagauucgagucuugguga

SEQ ID NO: 30597 - RNA, 1563 nt, Artificial Sequence
  derived and/or modified sequence opt5 from VP1__Norovirus_and/or_Norovirus-like__KT864686
augaagauggccagcuccgacgcugcccccucuaacgauggcgcggcugggcuggugccugagggaaauaacgaaacccucccgcuggagcccgucguuggcgccgccaucgcugccccugugacagggcagaauaacauuaucgaccccuggauuagaacgaauuucgugcaagcuccuaacggagaauuuaccgucagcccccgcaauuccccuggcgagauccuucugaaccucgaacuggggccggaucuuaaucccuaccuggcccaccucucucggauguauaacggauacgcgggcggcguggagguucaggugcugcuggccgggaaugcuuucacagccggaaagauucucuuugcugccgucccucccaacuucccuguggaguuucugagccccgcgcagaucaccaugcuuccgcaucugaucguugacgugagaacacucgaaccuauuaugaucccccugccugauguccggaauaccuucuuucacuauuccaaccagcccaauucucgcaugagacuuguggccaugcuguacacaccccuccggagcgacggcuccggggaugacguguucaccgucagcugccgcguucugacgagaccuaccccggauuuugaguucacauaucuggugcccccuucuguggaauccaagaccaaacccuuuagccucccuauucugacacuuucugagcugaccaacucccgguuccccgucccgaucgacagccucuuuacggcucaaaacaaugugcugcagguucagugucagaacggacgcugcacacuugauggcgagcugcaagggaccacacagcuccugccuucuggaauuugugccuucagaggccgggugaccgcucagaucaaucagcgcgacagauggcauaugcaacugcagaaccucaauggcaccacauacgaucccacggacgacgucccugcuccccuggggaccccugauuucaagggagugguuuuuggcauggugucccagcggaacgucgggaaugacgcccccggaagcacacgcgcccaacaggcguggguguccaccuauucuccgcaguucgucccuaaacuuggcagcgugaaccugagaauuuccgauaaugacgauuuucaguuccaacccacaaaguuuacccccguuggggugaacgacgaugacgauggacacccuuuccggcagugggaacucccgaauuacagcggcgagcugacgcuuaacaugaaucuggcucccccugucgcccccaacuuuccuggcgggcagcuccuguucuuuagaucuuucgugcccugcuccggaggcuacaaucaggggaucaucgacugucugauuccucaagaauggauccagcauuuuuaucaggagagcgcccccucucagagcgauguugcccucauucgcuacgugaacccggacacaggacggacccuguucgaagcuaaacuucacagauccggcuauaucaccgucgcccacucuggggacuacccucugguggugcccgcgaacggccauuuucgcuucgagagcugguga

SEQ ID NO: 30598 - RNA, 1563 nt, Artificial Sequence
  derived and/or modified sequence opt5 from VP1__Norovirus_and/or_Norovirus-like__KU687012
augaagauggccagcuccgacgcugcccccucuaacgauggcgcggcugggcuggugccugagaucaauaccgaaacacucccgcuggagcccgucgccggagccgcuauugccgcuccuguuacgggccagaacaauaucauugaccccuggaucagaaacaauuucgugcaagccccuaacggggaauuuaccgugagcccccgcaauuccccuggagagauucuuaugaaccuggaacucggcccggaucugaaucccuaccuugcgcaccugucucggauguauaacggguacgccggaggcgucgaggugcagguucuccuggcuggcaaugccuucacagcugggaaaauccuguuugccgcggugccucccaacuucccugucgacaugcucagccccgcccagaucaccaugcugccgcaucuuacaguggauguuagaacccuggagccuauuaugaucccccucccugacgugcggaaugucuuuuaucacuucaacaaucagcccgcuccccgcaugagacugguggccaugcuuuacacaccucugcgguccaacggaucuggcgaugacguguuuaccgucagcugccgcguucucacgagaccgacccccgauuucgaauuuacauaucuggugccucccuccguggagagcaagaccaaaccuuucacacugcccauucucaccaucggggaacugacgaacucucgguuuccggcuccuauugaccaacuuuacacaucccccaauaccgauauccugguccagccucagaacggacgcuguacacucgacggcgagcugcaggggaccacccaacuucugacaacggccauuugcagcuauagaggaaccacaucuaaucccaccuccgauuacugggacgaccaucuccugcaccuggugcauccuaacggcgccacauacgaucccaccgaggacguuccggcuccuuucggcacgcaggauuuucgggggauccucuauggagugcugacacagaauacccagagcccccgcgacgaagucucuaacuccagaggcaucuacauuagcuccaccucugauaaguucacacccaaacuugggaccaucggacugcaccaagugcagggcgacacagcgagcaaucagcaauccaaguucacgccuguugggauugccgugaaccagaauaccccguuuaagcagugggagcuccccaacuauagcggagcucugacacuuaauaccaaccuggccccugccgucggccccaauuucccuggcgaacagauccucuuuuuccggucuaacgugcccuccguccaagggacacacccuacccaggagauugauugucugaucccccaggaauggaucagccauuuuuaccaggagucugcuccgagccaauccgacguggcccugguucgcuaugugaauccugauacgggaagaaccauuuucgaggcgaaacuccaccggcagggcuuuaucacaauugcugccaccgggucuaaccccgucgugguuccucccaacggauacuucagauuugacagcugguga

SEQ ID NO: 30599 - RNA, 1563 nt, Artificial Sequence
  derived and/or modified sequence opt5 from VP1__Norovirus_and/or_Norovirus-like__KU687018
augaagauggccagcaacgacgcugcccccuccaaugauggcgcggcugggcuggugccugagaucaacaccgaaacacucccgcuggagcccgucgccggagccgcuauugccgcuccuguuacgggccagaauaacaucauugaccccuggaucagaaauaacuucgugcaagccccuaauggggaauuuaccgugucuccccggaacagcccuggagagauucuuaugaaucuggaacucggcccggaucugaaccccuaccuugcgcaccugucccgcauguauaauggguacgccagaggagucgaggugcagguucuccuggcuggcaacgccuucacagcuggcaaaauccuguuugccgcggugccucccaauuucccugucgacaugcucucucccgcccagaucaccaugcugccgcaucuuauuguggauguucggacacuggagccuaucaugauuccccucccugacgugcgcaacgucuuuuaucacuucaauaaccagcccgcucccagaaugcggcugguggccaugcuuuacaccccucugcgcagcaacggguccggagaugacguguuuacagucucuugcagaguucucacccggccgacgcccgauuucgaauuuaccuaucuggugccucccagcguggaguccaagacaaaaccuuucacccugcccauccucacaauuggcgaacugaccaauagccgcuuuccggcuccuaucgaccaacuuuacacgucucccaacgccgaugucgugguucagccucagaaugggagauguacacuggacggagagcuccagggcaccacacaacugcuuaccaccgccauuugcuccuaucgggggacaacgagcaaccccaccucugauuacugggacgaccaucugcuccaccuggugcauccuaauggagcuacauacgaucccaccgaggacgucccggcgccuuucggcacacaggauuuucgcggcauccuguauggggugcucacccagaacacgcagaaucccagagacgaaguuuccaacagccggggaaucuacauuucuuccacaagcgauaaguucacccccaaacugggcaccaucgggcuucaccaagugcagggagacacagccuccaaucagcaaucuaaguucaccccugucggcauugcugugaaccagaauacaccguuuaagcagugggagcugcccaacuauagcggggcccucacgcugaauaccaaccuugccccugcugucggacccaauuucccuggcgaacagauccuguuuuuccgcuccaacgugcccagcguucaaggcaaccacccuacacaggagauugauugucucaucccccaggaaugggugucucauuuuuaccaggaguccgccccgagccaaucugacgucgcgcuggugagauauguuaauccugauaccgggcggacaaucuucgaggcuaaacugcacagacagggauuuauuaccaucgccgccacgggcagcaaccccguggucgugccucccaauggguacuuccgcuuugaauccugguga

SEQ ID NO: 30600 - RNA, 1563 nt, Artificial Sequence
  derived and/or modified sequence opt5 from VP1__Norovirus_and/or_Norovirus-like__KU687021
augaagauggccagcaacgacgcuacccccuccaaugauggcgccgcggggcuggugccugagaucaacacagaaacgcucccgcuggagcccgucgcuggagccgccauugcugccccuguuaccggccagaauaacaucauugaccccuggaucagaaauaacuucgugcaagcuccuaauggggaauuuacagugucuccccggaacagcccuggagagauucuuaugaaucuggaacucggcccggaucugaaccccuaccuugcccaccugucccgcauguauaauggguacgcgggaggcgucgaggugcagguucuccuggccggcaacgcuuucaccgccgggaaaauccuguuugcugccgugccucccaauuucccugucgacaugcucucucccgcgcagaucacaaugcugccgcaucuuauuguggauguuagaacccuggagccuaucaugauuccccucccugacgugcggaacgucuuuuaucacuucaauaaccagcccgcuccccgcaugagacugguggccaugcuuuacacaccucugcggagcaacggauccggcgaugacguguuuaccgucucuugccgcguucucacgagaccgacccccgauuucgaauuuacauaucuggugccucccagcguggaguccaagaccaaaccuuucacacugcccauccucaccauuggggaacugacgaauagccgguuuccggccccuaucgaccaacuuuacacaucucccaacgcugaugucgugguucagccucagaauggacgcuguacccuggacggcgagcuccaggggacaacccaacugcuuaccacagccauuugcuccuauagaggaacgaccagcaaccccacaucugauuacugggacgaccaucugcuccaccuggugcauccuaauggcgccaccuacgaucccacagaggacgucccggcuccuuucggcacccaggauuuucgggggauccuguauggagugcucacgcagaacacacagaauccccgcgacaagguuuccaacagcagaggcaucuacauuucuuccaccagcgauaaauucacccccaagcuggggacaaucggacuucaccaagugcagggcgacaccgcguccaaucagcaaucuaaguucacaccugucgggauugccgugaaccagaauacgccguuuaaacagugggaacugcccaacuauagcggagcucucacccugaauacaaaccuugccccugccgucggccccaauuucccuggcgagcagauccuguuuuuccgguccaacgugcccagcguucaagggaaccacccuacccaggaaauugauugucucaucccccaggagugggugucucauuuuuaccaggaauccgcuccgagccaaucugacgucgcccuggugcgcuauguuaauccugauacaggaagaaccaucuucgaggcgaagcugcaccggcagggcuuuauuaucauugcugccacggggagcaaccccguggucgugccucccaauggauacuucagauuugaguccugguga

SEQ ID NO: 30601 - RNA, 1563 nt, Artificial Sequence
  derived and/or modified sequence opt5 from VP1__Norovirus_and/or_Norovirus-like__KU687020
augaagauggccagcuccgacgcugcccccucuaacgauggcgcggcugggcuggugccugagaucaauaccgaaacacucccgcuggagcccgucgccggagccgcuauugccgcuccuguuacgggccagaacaauaucauugaccccuggaucagaaacaauuucgugcaagccccuaacggggaauuuaccgugagcccccgcaauuccccuggagagauucuuaugaaccuggaacucggcccggaucugaaucccuaccuugcgcaccugucucggauguauaacggguacgccggaggcgucgaggugcagguucuccuggcuggcaaugccuucacagcugggaaaauccuguuugccgcggugccucccaacuucccugucgacaugcucagccccgcccagaucaccaugcugccgcaucuuauuguggauguuagaacacuggagccuaucaugauuccccucccugacgugcggaaugucuuuuaucacuucaacaaucagcccgcuccccgcaugagacugguggccaugcuuuacaccccucugcgguccaacggaucuggcgaugacguguuuacagucagcugccgcguucucaccagaccgacgcccgauuucgaauuuaccuaucuggugccucccuccguggagagcaagacaaaaccuuucacccugcccauccucacaauuggggaacugaccaacucucgguuuccggcuccuaucgaccaacuuuacgccucccccaaugccgaugucgugguucagccucagaacggacgcuguacgcuggacggcgagcuccaggggacaacccaacugcuuacaaccgcuauuugcagcuauagaggaaccacaucuaaucccacguccgauuacugggacgaccaucugcuccaccuggugcauccuaacggcgcgaccuacgaucccacagaggacgucccggccccuuucggcacccaggauuuucgggggauccuguauggagugcucacacagaauacccagaacccccgcgacgaaguuagcaauucuagaggcaucuacauuuccagcacguccgauaaguucacacccaaacuggggaccaucggacuucaccaagugcagggcgacaccgcuucuaaccagcaaagcaaguucacaccugucgggauugccgugaaucagaacaccccguuuaagcagugggagcugcccaauuauuccggagcccucacacugaacacgaaucuugcuccugccgucggccccaacuucccuggcgaacagauccuguuuuuccggagcaaugugcccucuguucaagggaaccacccuacccaggagauugauugucucaucccccaggaaugggugucccauuuuuaccaggagagcgcgccgucucaaagcgacgucgcucuggugcgcuauguuaacccugauacaggaagaaccaucuucgaggccaaacugcaccggcagggcuuuauuacaaucgccgcuaccggguccaaucccguggucgugccucccaacggauacuucagauuugacgccugguga

SEQ ID NO: 30602 - RNA, 1563 nt, Artificial Sequence
  derived and/or modified sequence opt5 from VP1__Norovirus_and/or_Norovirus-like__KU687014
augaagauggccagcaacgacgcugcccccuccaaugauggcgcggcugggcuggugccugagaucaacaccgaaacacucccgcuggagcccgucgccggagccgcuauugccgcuccuguuacgggccagaauaacaucauugaccccuggaucagaaauaacuucgugcaagccccuaauggggaauuuaccgugucuccccggaacagcccuggagagauucuuaugaaucuggaacucggcccggaucugaaccccuaccuugcgcaccugucccgcauguauaauggguacgccggaggcgucgaggugcagguucuccuggcuggcaacgccuucacagcugggaaaauccuguuugccgcggugccucccaauuucccugucgacaugcucauccccgcccagauuaccaugcugccgcaucuuaucguggauguuagaacacuggagccuauuaugaucccccucccugacgugcggaacgucuuuuaucacuucaauaaccagcccgcuccccgcaugagacugguggccaugcuuuacaccccucugcggucuaacggaagcggcgaugacguguuuacagucuccugccgcguucucaccagaccgacgcccgauuucgaauuuaccuaucuggugccucccucuguggagagcaagacaaaaccuuucacccugcccauucucacaaucggggaacugaccaauucccgguuuccggcuccuauugaccaacuuuacacgagccccaacgccgaugucgugguucagccucagaauggacgcuguacacuggacggcgagcuccaggggaccacacaacugcuuaccaccgccaucugcucuuauagaggaacaacguccaaccccaccagcgauuacugggacgaccaucugcuccaccuggugcauccuaauggcgcuacauacggccccaccgaggaugucccggcgccuuucgggacacaggacuuucggggaauccuguauggcgugcucacccagaacacgcagaauccccgcgaugaaguuucuaacuccagagggauuuacaucagcucuacauccgacaaguucacccccaaacugggaaccauuggccuucaccaagugcagggggauacagccagcaaucagcaauccaaguucaccccugucggaaucgcugugaaccagaauacaccguuuaagcagugggagcugcccaacuauucuggcgcccucacgcugaauaccaaccuugccccugcugucggccccaauuucccuggggaacagauucuguuuuuccggagcaacgugcccuccguucaaggaacacacccuacccaggagaucgacugucucaucccccaggaauggauuagccauuuuuaccaggagucugccccgucccaaagcgauguggcgcugguccgcuaugugaacccugacacaggcagaaccaucuucgaggcuaaacugcaccggcagggguuuauuacgaucgccgccaccggaucuaaucccguuguggucccucccaacggcuacuucagauuugaugcuugguga

SEQ ID NO: 30603 - RNA, 1563 nt, Artificial Sequence
  derived and/or modified sequence opt5 from VP1__Norovirus_and/or_Norovirus-like__KU687019
augaagauggccagcaacgacgcugcccccuccaaugauggcgcggcugggcuggugccugagaucaacaccgaaacacucccgcuggagcccgucgccggagccgcuauugccgcuccuguuacgggccagaauaacaucauugaccccuggaucagaaauaacuucgugcaagccccuaauggggaauuuaccgugucuccccggaacagcccuggagagauucuuaugaaucuggaacucggcccggaucugaaccccuaccuugcgcaccugucccgcauguauaauggguacgccggaggcgucgaggugcagguucuccuggcuggcaacgccuucacagcugggaaaauccuguuugccgcggugccucccaauuucccugucgacaugcucucucccgcccagaucaccaugcugccgcaucuuauuguggauguuagaacacuggagccuaucaugauuccccucccugacgugcggaacgucuuuuaucacuucaauaaccagcccgcuccccgcaugagacugguggccaugcuuuacaccccucugcggagcaacggauccggcgaugacguguuuacagucucuugccgcguucucaccagaccgacgcccgauuucgaauuuaccuaucuggugccucccagcguggaguccaagacaaaaccuagcacccugcccauccucacaauuggggaacugaccaauucucgguucccggcuccuaucgaccaacuuuacacgucccccaacgccgaugucgugguucagccucagaauggacgcuguacacuggacggcgagcuccaggggaccacacaacugcuuaccaccgccauuugcagcuauagaggaacaacgucuaaccccaccuccgauuacugggacgaccaucugcuccaccuggugcauccuaauggcgcuacauacgaucccaccgaggacgucccggcgccuuuuggcacacaggauuuccgggggauccuguauggagugcucacccagaacacgcagaauccccgcgacgaaguuagcaacucuagaggcaucuacauuuccagcacauccgauaaguuuacccccaaacuggggaccaucggacuucaccaagugcagggcgacacagccucuaaucagcaaagcaaguucaccccugucgggauugcugugaaccagaauacaccguucaagcagugggagcugcccaacuauuccggagcccucacgcugaauaccgaucuugccccugcugucggccccaacuuuccuggcgaacagauccuguucuuucggagcaaugugcccucuguucaagggaaccacccuacacaggagauugacugucucaucccccaggaaugggugucccauuucuaccaggagagcgccccgucucaaagcgaugucgcgcuggugcgcuauguuaacccugacaccggaagaacaaucuuugaggcuaaacugcaccggcagggcuucaccacgauugccgccaccggguccaaucccguggucgugccucccaacggauacuuuagauucgaaucuugguga

SEQ ID NO: 30604 - RNA, 1563 nt, Artificial Sequence
  derived and/or modified sequence opt5 from VP1__Norovirus_and/or_Norovirus-like__KU687017
augaagauggccagcuccgacgcugcccccucuaacgauggcgcggcugggcuggugccugagaucaauaccgaaacacucccgcuggagcccgucgccggagccgcuauugccgcuccuguuacgggccagaacaauaucauugaccccuggaucagaaacaauuucgugcaagccccuaacggggaauuuaccgugagcccccgcaauuccccuggagagauucuuaugaaccuggaacucggcccggaucugaaucccuaccuugcgcaccugucucggauguauaacggguacgccggaggcgucgaggugcagguucuccuggcuggcaaugccuucacagcugggaaaauccuguuugccgcggugccucccaacuucccugucgacaugcucagccccgcccagaucaccaugcugccgcaucuuauuguggauguuagaacacuggagccuaucaugauuccccucccugacgugcggaaugucuuuuaucacuucaacaaucagcccgcuccccgcaugagacugguggccgugcuuuacaccccucugcgguccaacggaucuggcgaugacgucuuuacaguuagcugccgcgugcucaccagaccgacgcccgauuucgaauuuaccuaucuggugccucccuccgucgagagcaagacaaaaccuuucacccugcccauccucacaauuggggaacugaccaacucucgguuuccggcuccuaucgaccaacuuuacacgucccccaaugccgaugugguugugcagccucagaacggacgcuguacacuggacggcgagcuccaggggaccacacaacugcuuaccaccgccauuugcagcuauagaggaacaacgucuaaucccaccuccgauuacugggacgaccaucugcuccaccugguccauccuaacggcgcuacauacgaucccaccgaggacgugccggcgccuuucggcacacaggauuuucgggggauccuguauggaguucucacccaggacacgcagaauccccgcgaugaagugagcaacucuagaggcaucuacauuuccagcacauccgacaaguucacccccaaacuggggaccaucggacuucaccaaguccagggcgauacagccucuaaucagcaaagcaaguucaccccuguggggauugcugucaaccagaauacaccguuuaagcagugggagcugcccaacuauuccggagcccucacgcugaauaccaaccuugccccugcugugggccccaauuucccuggcgaacagauccuguuuuuccggagcaacguucccucugugcaagggaaucacccuacacaggagauugacugucucaucccccaggaaugggucucccauuuuuaccaggagagcgccccgucucaaagcgauguggcgcugguucgcuaugugaacccugacgcuggaagaaccaucuucgaggccaaacugcaccggcagggcuuuauuacaaucgccgcuaccggguccaaccccgucguggugccucccaauggauacuucagauuugaagccugguga

SEQ ID NO: 30605 - RNA, 1563 nt, Artificial Sequence
  derived and/or modified sequence opt5 from VP1__Norovirus_and/or_Norovirus-like__KU687024
augaagauggccagcuccgacgcugcccccucuaacgauggcgcggcugggcuggugccugaaaucaauaccgaaacacucccgcuggagcccgucgccggagccgcuauugccgcuccuguuacgggccagaacaauaucauugaccccuggaucagaaacaauuucgugcaagccccuaacggggaaagcaccgugucuccccgcaauuccccuggagagauucuuaugaaccuggaacucggcccggaucugaaucccuaccuugcgcaccugagccggauguauaacggguacgccggaggcgucgaggugcagguucuccuggcuggcaaugccuuuacagcugggaaaauccuguucgccgcggugccucccaacuuuccugucgacaugcucucccccgcccagaucaccaugcugccgcaucuuauuguggauguuagaacacuggagccuaucaugauuccccucccugacgugcggaaugucuucuaucacuuuaacaaucagcccgcuccccgcaugagacugguggccaugcuuuacaccccucugcggucuaacggagcuggcgaugacguguucacagucagcugccgcguucucaccagaccgacgcccgauuuugaguucaccuaucuggugccucccuccguggaaagcaagacaaaaccuuuuacccugcccauccucacaauuggggaacugaccaacucucgguucccggccccuaucgaccaacuuuacacgucccccaauacagauauucugguccagccucagaacggacgcuguacccucgacggcgagcugcaggggacaacccaacuucugaccacagccaucugcagcuauagaggaacgaccucuaaucccacauccgauuacugggacgaccaucuccugcaccuggugcauccuaacggcgcuaccuacgaucccacagaggacguuccggcgccuuuuggcacccaggauuuccgggggauccucuauggagugcugacgcagaauacacagaacccccgcgacgaagucagcaauucuagaggcauuuacaucuccagcaccuccgauaaguuuacccccaaacuugggacaauuggacugcaccaagugcagggcgacaccgccucuaaccagcaaagcaaguucacaccuguugggaucgcugugaaucagaacacgccguucaagcagugggagcuccccaauuauuccggagcccugacccuuaacacaaaucuggccccugcugucggccccaacuuuccuggcgaacagauucucuucuuucggagcaaugugcccucuguccaagggacccacccuacacaggagaucgauugucugaucccccaggaauggauuucccauuucuaccaggagagcgccccgucucaaagcgacguggcgcugguucgcuaugugaacccugauaccggaagaacgaucuuugaggcuaaacuccaccggcagggcuucauuaccaucgccgccacaggguccaaccccgucgugguuccucccaauggauacuuuagauucgaggcuugguga

SEQ ID NO: 30606 - RNA, 1563 nt, Artificial Sequence
  derived and/or modified sequence opt5 from VP1__Norovirus_and/or_Norovirus-like__KU687022
augaagauggccagcaacgacgcugcccccuccaaugauggcgcggcugggcuggugccugagaucaacaccgaaacacucccgcuggagcccgucgccggagccgcuauugccgcuccuguuacgggccagaauaacaucauugaccccuggaucagaaauaacuucgugcaagccccuaauggggaauuuaccgugucuccccggaacagcccuggagagauucuuaugaaucuggaacucggcccggaucugaaccccuaccuugcgcacccuucccgcauguauaauggguacgccggaggcgucgaggugcagguucugcucgcuggcaacgccuucacagcugggaaaauccuguuugccgcggugcccccuaauuuccccgucgacaugcugucuccgacccagaucacaaugcucccucaucugaccguggauguuagaacacuugagcccauuaugaucccucugcccgacgugcggaacgucuuuuaucacuucaauaaccagcccgccccucgcaugagacucguggcuaugcuguacaccccgcuucggagcaacggauccggcgaugacgugcugacggucucuugccgcguucucaccagacccacaccugauuuugaguucaccuaucuggugcccccuagcguggaauccaagacaaaacccuuuacccugccgauucucacgaucggggaacugacaaauagccgguucccugcccccauugaccaacuuuacaccucuccuaacgcugaugucgugguucagccccagaauggacgcuguacacuggacggcgagcuccaggggaccacccaacugcuuacaacggccaucugcuccuauagaggaaccacaagcaacccuaccucugauuacugggacgaccaucugcuccaccuggugcaucccaauggcgccacauacgauccgaccgaggacgucccugcucccuuuggcacgcaggauuuccgggggauucuguauggagugcucacacagaacacccagaauccccgcgacgaaguuuccaacagcagaggcaucuacaucucuuccaccagcgauaaguuuacaccuaaacuggggaccauuggacuucaccaagugcagggcgacacagcguccaaucagcaaucuaaguucacgccggucgggaucgccgugaaccagaauacccccuucaagcagugggagcugccuaacuauagcggagcucucacacugaauaccaaccuugcccccgccgucggcccuaauuuucccggcgaacagauucuguucuuucgguccaacgugccuagcguucaagggaaccaccccacacaggagaucgauugucucauuccgcaggaaugggugucucauuucuaccaggaguccgcuccuagccaaucugacgucgcccuggugcgcuauguuaaucccgauaccggaagaacgaucuuugaggcgaaacugcaccggcagggcuucaucaccauugcugccacagggagcaacccuguggucgugcccccgaauggauacuuuagauucgaauccugguga

SEQ ID NO: 30607 - RNA, 1563 nt, Artificial Sequence
  derived and/or modified sequence opt5 from VP1__Norovirus_and/or_Norovirus-like__KU687023
augaagauggccagcuccgacgcugcccccucuaacgauggcgcggcugggcuggugccugaaaucaauaccgaaacacucccgcuggagcccgucgccggagccgcuauugccgcuccuguuacgggccagaacaauaucauugaccccuggaucagaaacaauuucgugcaagccccuaacggggaauuuaccgugagcccccgcaauuccccuggagagauucuuaugaaccuggaacucggcccggaucugaaucccuaccuugcgcaccugucucggauguauaacggguacgccggaggcgucgaggugcagguucuccuggcuggcaaugccuucacagcugggaaaauccuguuugccgcggugccucccaacuucccugucgacaugcucagccccgcccagaucaccaugcugccgcaucuuauuguggauguuagaacacuggagccuaucaugauuccccucccugacgugcggaaugucuuuuaucacuucaacaaucagcccgcuccccgcaugagacugguggccaugcuuuacaccccucugcgguccaacggaucuggcgaugacguguuuacagucagcugccgcguucucaccagaccgacgcccgauuucgaauuuaccuaucuggugccucccuccguggagagcaagacaaaaccuuucacccugcccauccucacaauuggggaacugaccaacucucgguuuccggcuccuaucgaccaacuuuacacgucccccaauacagauauucugguccagccucagaacggacgcuguacccucgacggcgagcugcaggggacaacccaacuucugaccacagccaucugcagcuauagaggaacgaccucuaaucccacauccgauuacugggacggccaucuccugcaccuggugcauccuaacggcgccaccuacgaccccacagaggauguuccggcuccuuucgggacccaggacuuucggggaauccucuauggcgugcugacgcagaauacacagaacccccgcgaugaagucagcaauucuagagggauuuacaucuccagcaccuccgacaaguucacccccaaacuuggaacaauuggccugcaccaagugcagggggauaccgcgucuaaccagcaaagcaaguucacaccuguuggaaucgccgugaaucagaacacgccguuuaagcagugggagcuccccaauuauuccggcgcucugacccuuaacacaaaucuggccccugccgucggccccaacuucccuggggaacagauucucuuuuuccggagcaaugugcccucuguccaaggaacccacccuacacaggagaucgacugucugaucccccaggaauggauuucccauuuuuaccaggagagcgcuccgucucaaagcgauguggcccugguucgcuaugugaacccugacaccggcagaacgaucuucgaggcgaaacuccaccggcagggguuuauugcuaucgccgccaccggauccaaccccgucgugguuccucccaauggcuacuucagauuugaggcuugguga

SEQ ID NO: 30608 - RNA, 1563 nt, Artificial Sequence
  derived and/or modified sequence opt5 from VP1__Norovirus_and/or_Norovirus-like__KX764847
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaguuauuuucgccgcugugccucccaacuuuccuacggagggacugagccccucccaggucaccauguucccgcauaucgugguggacgucagacaacucgagccuguucugaucccccugccugaugugcggaauaacuuuuaucacuacaaucagucuaacgaccccacaauuaagcucaucgccaugcuguauacaccccuucgcgcuaacaaugccggcgaugacguguucaccgucagcugcagagugcugacccggccuuccccggauuuugacuucauuuuucucguucccccuacaguggaaagccgcaccaaacccuucucugucccugugcugacgguugaggaaaugaccaacuccagauuucccaucccgcuugagaagcuguucacagggccuagcucugccuucgugguccagccccagaauggacgguguaccacagauggcgugcuccuggggaccacgcaacuguccccugucaacauuugcacauuucgcggagacgugacccauaucacaggcagcucuaauuacaccaugaaccucgcuucccagaauuggagcaacuaugaucccaccgaggaaauuccugcgccccugggcacaccggacuucguugggaaaauccagggaaugcuuacgcagaccacaagaaccgacggcuccacacgggggcacaaggccaccguguacacgggaucugcugauuuugccccuaagcugggccgcguccaauucgagacagacaccgaucaugacuuugaagccaaucagaacaccaaauucacacccguggggguuauccaggauggaagcaccacacacagaaaugagccccaacagugggugcucccuuccuacagcggccggaacacgccgaauguccaccuggcucccgccguggcgccuaccuuucccggcgaacagcuucuguucuuucgcucuacaaugccuggguguuccggauaucccaacauggaccucgauugccugcugccucaggagugggugcaauacuucuaucaggaggcugcccccgcccagagcgacguugcucuccugagauuugucaauccggauaccggccgggugcuuuucgaauguaagcugcauaaaucuggguacgugacagucgcccacaccggacagcaugaccucgugauuccucccaacggcuauuuuagauucgaggcuugguga

SEQ ID NO: 30609 - RNA, 1563 nt, Artificial Sequence
  derived and/or modified sequence opt5 from VP1__Norovirus_and/or_Norovirus-like__KX764846
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaguuauuuucgccgcugugccucccaacuuuccuacggagggacugagccccucccaggucaccauguucccgcauaucgugguggacgucagacaacucgagccuguucugaucccccugccugaugugcggaauaacuuuuaucacuacaaucagucuaacgacccucccauuaagcucaucgccaugcuguauacaccccuucgcgcuaacaaugccggcgaugacguguucaccgucagcugcagagugcugacacggccgucccccgauuuugacuucauuuuucucguuccucccaccguggaaagccgcacaaaaccuuucucuguccccgugcugaccguugaggaaaugacgaacuccagauuuccgaucccucuugagaagcuguucaccgggcccagcucugccuucgugguccagccucagaauggacgguguacaaccgauggcgugcuccuggggacaacccaacugucccccgucaacauuugcacguuucgcggagacgugacacauaucaccggcagcagaaauuacacaaugaaccucgcuucucagaauugguccaacuaugauccuaccgaggaaauucccgcgccgcugggcaccccugacuucguugggaaaauccagggaaugcuuacacagacgacccggacagacggcagcacccgcgggcacaaggccacaguguacaccggauccgcugauuuugcccccaagcugggcagaguccaauucgagacggacacagaucaugacuuugaagccaaucagaacaccaaauucacccccguggggguuauccaggauggaucuacaacccaccggaaugagccucaacagugggugcucccgagcuacuccggccgcaacacacccaauguccaccuggcuccugccguggcgcccacguuuccuggcgaacagcuucuguucuuuagaagcaccaugcccggguguucuggauauccuaacauggaccucgauugccugcugccccaggagugggugcaauacuucuaucaggaggcugccccggcccaguccgacguugcucuccugcgguuugucaauccugauacaggcagagugcuuuucgaauguaagcugcauaaaagcggguacgugaccgucgcccacacaggacagcaugaccucgugauucccccuaacggcuauuuucgcuucgaugcuugguga

SEQ ID NO: 30610 - RNA, 1563 nt, Artificial Sequence
  derived and/or modified sequence opt5 from VP1__Norovirus_and/or_Norovirus-like__KX764833
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaugacguuuucaccgugagcugcagagugcugacccggcccucuccugauuuugacuucauuuuucucgucccgcccacaguggaaucccgcaccaaaccuuucagcguucccgugcugacggucgaggaaaugaccaauucuagauuuccuaucccccuugagaagcuguucacagggccguccagcgccuucgugguucagccucagaacggacgguguaccacagauggcgugcuccuggggaccacgcaacugucucccgucaauauuugcacauuucgcggagacgugacccauaucacaggcuccagaaacuacaccaugaaucucgcuagccagaacuggaauaacuaugauccuaccgaggaaauccccgcgccucugggcacacccgacuucgucgggaaaauucagggaaugcuuacgcagaccacacggaccgacggcuccacacgcgggcacagagccaccguguacacgggaucugcugauuuugccccgaagcugggccggguucaauucgagacagacaccgaucaugacuuugaagccaaucagaacaccaaguucacaccugugggggucauccaggauggaagcaccacacaccgcaaugagccccaacagugggugcuccccuccuacagcggcagaaacacgcacaauguucaucuggcuccugccguggcgccgaccuuucccggcgaacagcuucuguucuuucggucuacaaugccuggguguuccggauaucccaacauggaccucgauugccugcugccucaggaguggguccaauacuucuaucaggaggcugcccccgcccagagcgacguggcucuccugagauuugugaauccugauaccggccgcguucuuuucgaauguaaacugcacaagucuggguacgucacaguggcccauaccggacagcacgaccucgugauucccccgaacggcuauuuucgguucgaugcuugguga

SEQ ID NO: 30611 - RNA, 1563 nt, Artificial Sequence
  derived and/or modified sequence opt5 from VP1__Norovirus_and/or_Norovirus-like__KX764834
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaugacguuuucaccgugagcugcagagugcugacccggcccucuccugauuuugacuucauuuuucucgucccgcccacaguggaaucccgcaccaaaccuuucagcguucccgugcugacggucgaggaaaugaccaauucuagauuuccuaucccccuugagaagcuguucacagggccguccagcgccuucgugguucagccucagaacggacgguguaccacagauggcgugcuccuggacaccacgcaacugucucccgucaauauuugcacauuucgcggggaugugacccauaucacaggauccagaaacuacaccaugaaucucgcuagccagaacuggaauaacuaugacccuaccgaggaaauccccgcgccucugggcacacccgacuucgucggcaaaauucaggggaugcuuacgcagaccacacggaccgauggauccacacgcggccacaaggccaccguguacacggggucugcugacuuugccccgaagcugggaagaguucaauucgagacagauaccgaccaugauuuugaagccaaucagaacaccaaauucacaccugugggcgucauccaggacgggagcaccacacaccggaaugagccccaacagugggugcuccccuccuacagcggacgcaacacgcacaauguucaucuggcuccugccguggcgccgaccuuucccggcgaacagcuucuguucuuuagaucuacaaugccuggcuguuccggguaucccaacauggaucucgacugccugcugccucaggaguggguccaauacuucuaucaggaggcugcccccgcccagagcgauguggcucuccugcgguuugugaauccugacaccggaagaguucuuuucgaauguaagcugcacaaaucuggcuacgucacaguggcccauaccgggcagcacgaucucgugauucccccgaacggauauuuucgcuucgacagcugguga

SEQ ID NO: 30612 - RNA, 1563 nt, Artificial Sequence
  derived and/or modified sequence opt5 from VP1__Norovirus_and/or_Norovirus-like__KU687027
augaagauggccagcaacgacgcuaaucccuccgauggcucugccgcgaaccuggugccugaggucaauaacgaaguuauggcucucgagccgguggugggggccgccaucgcugcccuggucgcuggacagcaaaaugugauugaccccuggaucagaaacaauuucguucaggccccuggcggggaauuuaccgugagcccccggaacgcgccuggagagauucuuugguccgcuccccugggcccugaucucaauccguaccugucucaccuugcccgcauguauaacggguacgccggaggcuucgaaguccaggugauccuggcuggcaaugccuuuacagcggggaaaguuauuuucgccgcugugcccccuaacuuucccacggagggacucagcccuucccaggucaccauguucccccauaucgugguggacgucagacaacuggagccgguucugaucccucuccccgaugugcggaauaacuuuuaucacuacaaucagucuaacgacccuacaauuaagcugaucgccaugcuuuauacaccccugcgcgcuaacaaugccggcgaagauguguucaccgucagcugcagagugcucacccggcccuccccugacuuugauuucauuuuucugguuccgcccacaguggagagccgcaccaaaccuuucucuguccccgugcuuacgguugaagagaugaccaacuccagauuuccuaucccccuggagaagcuguucacagggccgagcucugccuucgugguccagccucagaauggacgguguaccacagacggcgugcugcuggggaccauucaacucucccccgucaacaucugcacguuucgcggagaugugacacauauuaccggcagcagaaauuacacaaugaaccuggcuucucagaauuggaacgacuaugauccuaccgaagagauccccgcgccucuuggcacccccgacuucguugggaaaauccagggaaugcugacacagacgacccggacagacggcuccacccgcgggcacaaggccacaguguacaccggaagcgcugauuuugccccgaagcucggcagaguccaauucgaaacggacacagaucaugacuuugaggccaaucagaacaccaaauucaccccuguggggguuauucaggauggauccacaacccaccggaaugaaccccaacagugggugcugcccucuuacagcggccgcaacacaccuaauguccaccuugcuccggccguggcgcccacguuuccuggcgagcagcuccucuucuuuagauccaccacacccggguguagcggauauccuaacauggaccuggauugccugcucccccaggagugggugcaauacuucuaucaggaagcugccccugcccagucugacguugcucugcuucgguuugucaaucccgauaccggcagagugcuguucgaguguaagcuccauaaauccggguacgugacagucgcccacaccggacagcaugaccuggugaucccgccuaacggcuauuuucgcuucgaaagcugguga

SEQ ID NO: 30613 - RNA, 1563 nt, Artificial Sequence
  derived and/or modified sequence opt5 from VP1__Norovirus_and/or_Norovirus-like__KX764835
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauaccccuccccgcgcuaacaaugccggcgaugacguuuucacaguguccugcagagugcuuacccggcccagcccggauuuugacuucauuuuucuggugcccccuacagucgaaucucgcaccaaacccuucuccguuccugugcucacggucgaggaaaugaccaacagcagauuucccaucccgcuggagaaacuuuucacagggccuucuuccgccuucgugguucagccccagaauggacgguguaccacagauggcgugcugcucgggaccacgcaacugagcccugucaacauuugcacauuucgcggagacgugacccauaucacaggcucuagaaauuacaccaugaaccuggcuucccagaauuggaacaauuaugaucccaccgaggaaaucccugcgccccucggcacaccggacuucgucgggaagauucagggaaugcugacgcagaccacacggaccgacggcagcacacgcgggcacaaggccaccguguacacgggauccgcugauuuugccccuaaacuuggcagaguucaauucgagacagacaccgaucaugacuuugaagccaaccagaauaccaaguucacacccgugggggucauccaggauggaucuaccacacaccggaacgagccccaacagugggugcugccuagcuacuccggccgcaauacgcacaacguucaucucgcuccggccguggcgcccaccuuuccuggcgaacagcugcuuuucuuuagaagcacaaugcccggguguucuggauauccuaauauggaccuggauugccuccugccccaggaguggguccaauacuucuaucaggaggcugccccugcccaguccgacguggcucugcuccgguuugugaaccccgauaccggcagaguucuguucgaauguaaguuucacaaaagcggguacgucacaguggcccauaccggacagcacgaccuugugauuccgccuaacggcuauuuccgcuucgagucuugguga

SEQ ID NO: 30614 - RNA, 1563 nt, Artificial Sequence
  derived and/or modified sequence opt5 from VP1__Norovirus_and/or_Norovirus-like__KX764832
augaagauggccagcaacgacgugaaucccuccgauggcucugcugccaaccuggucccugagguuaauaacgaagugauggcgcucgagccgguggucggggcugccaucgccgcucccguggccggacagcaaaauguuauugacccuuggaucagaaacaauuucgugcaggcucccggcggggaauuuaccgucagcccucggaacgcccccggagagauucugugguccgcgccucuuggcccggaucugaaucccuaccucucucaccuggcccgcauguauaacggguacgcuggaggcuucgaagugcagguuauccuugccggcaaugcuuuuacagccgggaaaauuaucuucgcggccgugccucccaacuuuccuacggagggacugagccccucccaggucaccauguucccgcauaucauuguggacgugagacaacucgagccuguccugaucccccugccugauguucggaauaacuuuuaucacuacaaucagucuaacgacagcacaauuaagcucaucgcuaugcuguauacaccccuucgcgccaacaaugcuggcgaugacguguucaccguguccugcagaguccugacccggcccagcccugauuuugacuucauuuuucucgugccgcccacaguugaaucucgcaccaaaccuuucuccgugcccguccugacgguggaggaaaugaccaacagcagauuuccuaucccccuugagaagcuguucacagggccgucuuccgccuucguugugcagccucagaauggacgguguaccacagauggcguccuccuggggaccacgcaacugagccccgugaacauuugcacauuucgcggagacgucacccauaucacaggcucuagaaauuacaccaugaaccucgccucccagaauuggaacaauuaugauccuaccgaggaaauccccgcuccucugggcacacccgacuucguggggaaaauucagggaaugcuuacgcagaccacacggaccgacggcagcacacgcgggcacaaggcgaccguuuacacgggauccgccgauuuugcuccgaagcugggcagagugcaauucgagacagacaccgaucaugacuuugaagccaaccagaauaccaaauucacaccugucggggugauccaggauggaucuaccacacaccggaacgagccccaacagugggcccuccccagcuacuccggccgcaauacgcacaacguucaucuggcuccugccguggcgccgaccuuucccggcgaacagcuucuguucuuuagaagcacaaugccuggguguucuggauaucccaauauggaccucgauugccugcugccucaggaguggguccaauacuucuaucaggaggcugcccccgcccaguccgacguggcucuccugcgguuugugaacccuaacaccggcagaguucuuuucgaauguaagcugcacaaaagcgggcaugucacaguggcccacaccggacagcacgaucucgugauucccccgaauggcuacuuucgcuucgacucuugguga

SEQ ID NO: 30615 - RNA, 1563 nt, Artificial Sequence
  derived and/or modified sequence opt5 from VP1__Norovirus_and/or_Norovirus-like__KU687025
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugguucuugcuggcaaugccuuuacagcggggaaagugaucuucgccgcugucccucccaacuuuccuacggaggaccugagccccucccaggugaccauguucccgcauauuguggucgauguuagacaacucgagccugugcugaucccccugccugacgugcggaauaacuuuuaucacuacaaucagucuaacgaucccacaaucaagcucauugccaugcuguauacaccccuucgcgcuaacaaugccggagaagacgucuucaccgugagcugcagaguucugacccggccuuccccggauuuugacuucaucuuucucgugcccccuacagucgagagccgcaccaaacccuucucugugccuguucugacgguggaagagaugaccaacuccagauuucccauuccgcuugagaagcuguucacaggcccuagcucugccuucgucgugcagccccagaaugggcgguguaccacagauggaguccuccugggcaccauccaacuguccccugugaacauuugcacguuucgcggggacguuacacauaucaccggaagcagaaauuacacaaugaaccucgcuucucagaauuggaacaauuaugaucccaccgaagagauuccugcgccccugggcaccccggacuucgugggcaaaauccaggggaugcuuacacagacgacccggacagacggauccacccgcggccacaaggccacagucuacaccgggagcgcugauuuugccccuaagcugggcagagcccaauucgaaacggacacagaucaugacuuugaggcuaaccagaauaccaaauucacccccgugggaguuauccaggauggguccacaacccaccggaacgaaccccaacagugggugcucccuucuuacagcggacgcaauacaccgaacguccaccuggcccccgcgguggcuccuacguuucccggcgagcagcuucuguucuuuagauccaccacaccuggcuguagcggguaucccaauauggaccucgauugccugcugccucaggagugggugcaauacuucuaucaggaagccgcccccgcucagucugacguugcccuccugcgguuugucaacccggauaccggaagagugcuuuucgaguguaagcugcauaaauccggcuacgugacagucgcucacgccgggcagcaugaccucgugauuccucccaacggauauuuucgcuucgaagcgugguga

SEQ ID NO: 30616 - RNA, 1563 nt, Artificial Sequence
  derived and/or modified sequence opt5 from VP1__Norovirus_and/or_Norovirus-like__KU687026
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaagauguguucaccgucuccugcaaagugcugaccagaccuagcccggacuuugauuucauuuuucucguucccccuacaguggagucucggaccaagcccuucuccgucccugugcugacgguugaagagaugaccaauagccgcuuucccaucccgcuugagaaacuguucacagggccuucuuccgccuucgugguccagccccagaacggaagauguaccacagacggcgugcuccuggggaccauucaacugagcccugucaauaucugcacguuucggggagaugugacacauauuaccggcucucgcaacuacacaaugaaucucgcuucccagaacuggaauaacugugaccccaccgaagagaucccugcgccccugggcaccccggauuucguugggaagauccagggaaugcuuacacagacgaccagaacagacggcagcacccgggggcacaaggccacaguguauaccggauccgcugacuuugccccuaaacugggccgcguccaauucgaaacggauacagaccaugauuuugaggccaaucagaacaccaaguucacccccguggggguuauucaggacggaucuacaacccacagaaaugaaccccaacagugggugcucccuagcuacuccggccggaacacaccgaauguccaccuggcucccgccguggcgccuacguuucccggcgagcagcuucuguucuuucgcagcaccacaccugggugcucuggauaccccaacauggaucucgacugucugcugccucaggagugggugcaauauuucuaccaggaagcugcccccgcccaguccgauguugcucuccugagauuugucaauccggacaccggccgggugcuuuucgagugcaaacugcauaagagcggguaugugacagucgcccacaccggacagcaugaucucgugaucccucccaacggcuacuuuagauucgacgcuugguga

SEQ ID NO: 30617 - RNA, 1563 nt, Artificial Sequence
  derived and/or modified sequence opt5 from VP1__Norovirus_and/or_Norovirus-like__KU687028
augaagauggccagcaacgacgcuaaucccuccgauggcucugccgcgaaccuggugccugaggucaauaacgaaguuauggcucucgagccggccgugggggccgcuaucgccgcucccguggccggacagcaaaaugucaucgacccuuggaucagaaacaauuucgugcaggcgcccggcggggaauuuaccguuagcccucggaacgcccccggagagauucugugguccgcuccucuuggcccggaucugaaucccuaccucucucaccuggcccgcauguauaacggguacgcuggaggcuucgaagugcaggucauccuugccggcaaugcguuugccgcugggaaagugauuuucgccgcuguuccucccaacuuuccuacagagggacugagccccucccaggugacgauguucccgcauaucgucguggacgugagacaacucgagccuguccugaucccccugccugauguucggaauaacuuuuaucacuacaaucagucuaacgaccccaccauuaagcucaucgccaugcuguauacaccccuucgcgccaacaaugcuggcgaagauguguucaccgugagcugcagaguccugacacggccuuccccggacuuugauuucauuuuucucgugcccccuaccguugagagccgcacaaaacccuucucugugccuguccugaccguggaagagaugacgaacuccagauuucccaucccgcuugagaagcuguucaccgggccuagcucugcguucguugugcagccccagaauggacgguguacaaccgacggcguccuccuggggacaauucaacuguccccugugaacaucugcaccuuucgcggagaugucacgcauauuacaggcagcagaaauuacaccaugaaccucgccucucagaauuggaacaauuaugaccccacagaagagaucccugcuccccugggcaccccggauuucguggggaaaauccagggaaugcuuacccagacaacgcggaccgacggcuccacacgcgggcacaaggccaccguuuacacaggaagcgccgacuuugcuccuaagcugggcagagugcaauucgaaaccgauacggaccaugauuuugaggccaaccagaauacaaaauucacccccgucggggugauucaggacggauccaccacacaccggaacgaaccccaacaguggguucucccuucuuacagcggccgcaauaccccgaacgugcaccuggcgcccgcugucccucccacauuuccuggcgagcagcuucuguucuuuagauccacgacccccggguguagcggauauccuaauauggaucucgacugccugcugccccaggagugggugcaauacuucuaucaggaagccgccccggcucagucugauguggcccuccugcgguuuguuaacccugacacaggcagaguccuuuucgaguguaagcugcauaaauccggguacgugaccguggcucacacaggacagcaugaucucgucauucccccuaacggcuauuuucgcuucgaaagcugguga

SEQ ID NO: 30618 - RNA, 1563 nt, Artificial Sequence
  derived and/or modified sequence opt5 from VP1__Norovirus_and/or_Norovirus-like__KX764831
augaagauggccagcuccgacgugaaccccucugauggcagcgcugccaaucuggucccugagguuaacaaugaagugauggcgcucgagccgguggucggggcugccaucgccgcucccguggccggacagcaaaacguuauugacccuuggaucagaaauaacuucgugcaggcucccggcggggaauuuaccgucuccccucggaaugcccccggagagauucuguggucugcgccucuuggcccggaucugaaccccuaccucagccaccuggcccgcauguauaauggguacgcuggaggcuucgaagugcagguuauccuugccggcaacgcuuuuacagccgggaaaauuaucuucgcggccgugccucccaauuuuccuacgggaggccugucccccucucaggucaccauguucccgcauaucauuguggacgugagacaacucgagccuguccugaucccccugccugauguucggaacaauuuuuaucacuacaaccagagcaaugacuccacaauuaagcucaucgcuaugcuguauacaccccuucgcgccaacaacgcuggggaugacguguucaccgugagcugcagaguccugacccggcccucuccugauuuugacuucauuuuucucgugccgcccacaguugagucccgcaccaaaccuuucagcgugcccguccugacgguggaagagaugaccaauucuagauuuccuaucccccuugaaaagcuguucacaggaccguccagcgccuucguugugcagccucagaacggccgguguaccacagaugggguccuccugggaaccacgcaacugucucccgugaauauuugcacauuucgcggcgacgucacccauaucacaggcuccagaaacuacaccaugaaucucgccagccagaacuggaauaacuaugauccuaccgaggagauccccgcuccucuggggacacccgacuucgugggaaaaauucagggcaugcuuacgcagaccacacggaccgacgggccgacacgcggacacaaggcgaccguuuacacgggcuccgccgauuuugcuccuaagcuggggagagugcaauucgaaacagacaccgaucaugacuuugaggccaaucagaacaccaaauucacacccgucggagugauccaggauggcucuaccacacaccggaaugaaccccaacaguggguucucccuagcuacuccggccgcaacacgcacaaugugcaucuggccccggcugucgcccccaccuuuccuggggagcagcuucuguucuuuagaagcacaaugcccggauguucuggcuauccuaacauggaccucgauugccugcugccccaggaaugggugcaauacuucuaucaggaggcggcuccugcccaguccgacguggcccuccugcgguuuguuaaucccgauaccgggagaguccuuuucgaguguaagcugcacaaaagcggauacgugacaguggcucauaccggccagcacgaccucgucauuccgccuaacggguauuuucgcuucgaagccugguga

SEQ ID NO: 30619 - RNA, 1560 nt, Artificial Sequence
  derived and/or modified sequence opt5 from VP1__Norovirus_and/or_Norovirus-like__JN222366
augaugauggccagcaaggacgcucccaccuccccugauggcgccucuggggcgggacagcuggugccggaggcuaacacagccgaacaaaucagcauggaccccgucgccggcgcuuccacggccguugcuaccgccgggcaggucaauaugauugauccuuggaucuucaacaauuuugugcaggcgccccagggagaguucacaauuucuccuaacaauacccccggcgacauccucuuugaucugcaacuugggccucaccugaacccguuccucgcccaucugagccagauguacaauggaugggucggcaacaugagagugcggauucuucuggcuggcaaugccuuuacagcugggaaaaucaucauuugcuguguucccccuggauucgacgcccgcauccucaccauugcgcaggccacacuguuuccccaccugaucgcugaugugagaacccucgaaccugucgagcugccccuugaagacgugcggaacguucuguaucauaauuccucucagccgcaaccuacgaugcgccucguggccaugcuguacacaccccuuagaaccggcgggggaagcggcgggaccgaugcuuucgucguggccggacgggugcugacaugcccugcccccgacuuuuccuuccucuuucuggugcccccuagcguugagcagaagacccgcguguucucugugccgaacauuccccugaaagaucucuccaauagcagagucccugugcccauccagggcauguuuaugucuccugacguuaaccaguccgugcaauuccagaauggccggugucagauugaugggcaacugcagggaacgacacccgucagccuuucucagcugugcaagauccgcggcaaaaccuccagcaacgcuagagugcucaaccuguccgagguugacgggacaccguucaucccucuugaaucucccgcgccugugggauuucccgaccugggcgggugugauuggcacgucaauuucaccuuucaggcccaaaaccaggacccuagccaguccgugaccuucgcuacaaaugaugccagcuuuguccccuaucucggaucuauuuccccgcauaacggcggcgacuuccacgccggggauaucauuggaagccugggcuggaucucugcuccuagcgacaauucccagcugaacguguggacgauucccaaguacgggucuagccuccccgauguuacccaccuggccccugcgguguuuccgcccggauucggcgaggucauccuuuauuuuuacuccacauucccugggagcggccaacccucucagcuucaggugccuugccuccugccccaggaauuuaucacccauuucuguaaugagcaagcuccuauugccggagaggccgcucugcugcacuauguugaccccgauacaggccggaaccucggggaauuuaagcuguacccggacggauucaugaccugcgugccuaauuccgucagcucuggcccccagacgcugccuaucaacgggguguucguguuuguuuccugggucagccgcuga

SEQ ID NO: 30620 - RNA, 1557 nt, Artificial Sequence
  derived and/or modified sequence opt5 from VP1__Norovirus_and/or_Norovirus-like__KM386679
augaagauggccagcaacgacgcuacccccuccaaugauggcgccgcggggcuggugccugagucuaacaaugaagcuauggcccucgagccggucguuggagccagccuggcugcccccgugacaggccagacgaacaucauugacccuuggaucagaaccaauuucgugcaagcucccaacggggaauuuacagucuccccucgcaauucucccggagagauucuugugaaccuggaacucggcccugagcugaauccguaccuugcccaccuggcgcggauguauaacggguacgccggaggcauggagguucaggugaugcucgcuggcaaugccuucaccgcugggaaaaucauuuuugccgcggugcccccuuauuuccccgucgaaaaccugagcccuucccagaucacaauguuuccccauguuaucauugaugugagaacccuggagccgguccuccugccuaugcccgacgugcggucuacacuuuuccacuuuaaucagaaggaugaaccuaaaaugcgccugguggccaugcucuacacgccccugagaagcaacggauccggcgacgaugucuucaccguuagcugccggauccuuacccgccccucuccugaguuugacuucacauaucuggugccgcccaccguggaguccaagacaaaaccuuuuacccuccccguccugacgcugggggaacucagcaauucuagauucccucuguccauugaugagauggugacaagccccaacgaaucuaucguugugcaaccgcagaacggacgggucacccuugacggcgagcugcucgggacaacccagcugcaggcuuguaauauuugcuccauccgcggaaaggugaccggccaaguuccuaacgaacagcauauguggaaucuugagauuacaaaccugaauggcacgcaguuugaucccaccgacgaugugccugcuccccucggggucccugacuucgccggagagguguucggcguccugagccagagaaaccgcggggaauccaaucccgccaaccgggcccacgacgcugugguugcgacauacucugauaaguauaccccgaaacugggacucgugcaaaucggcacauggaauaccaacgacgucgagaaucagccuacgaaguuuacacccaucgggcugaacgaaguggccaauggacauagauucgagcaguggacccuuccccgguacagcggcgcucugacccucaacaugaaucuggccccugccguugcuccgcuuuuucccggcgaacgccuccuguucuuuagauccuacgugccucugaaagggggauucggcaaccccgccauugauugucuggucccucaagagugggugcagcacuuuuaucaggagagcgcgcccucucucggggacguggcucugguucgguacgucaacccugauacaggaagagugcuuuucgaagccaagcugcacaaaggcggguuucucaccguguccagcacaucuacgggccccgucgugguuccggccaauggauauuuccgcuuugacuga

SEQ ID NO: 30621 - RNA, 1551 nt, Artificial Sequence
  derived and/or modified sequence opt5 from VP1__Norovirus_and/or_Norovirus-like__AY549156
augaagaugaccgacagagauacaguggacagcgcccccgcucugggccagguccucccuccggagguugaagccuccgugcccguggagccuacggcgggggcucccgucgccgccccuaccgcuggacaagugaaccccaucgauccuuggauuuucgccaauuuuguucaggcuccgcagggcgaguucacaaucucucccaacaauaacccuggggagauucuguuugaacuugagcugggacccgaccucaauccuuaccuggcccaccuucggcgcauguauaacggcuggaccgggagcaugagagugcggguccugcucgcgggaaaugccuucuccgcuggcaaagugguuguguuuugcgugcccccgggcuucgauacaucuuaccugaccccuagccaggccacacaauuuccccauguccugaucgacgugcgcgcuccugagcccgucgaaaugccccucgaggauguuagaaacauucuguuccaccaggggccugacucccggaugcgccuuaugggaaugcuguauaccccgcucagagccaauucuggcgcggaucccuuuguggugacggggcggguccugaccuguccuagccccaacuucuccuuuuucuuucuugugccucccacaguugaagaacgcgagccgccuuucacccugcccaaucucccugugaacaaucugagccauucuagagucauggaacccaucgcccagaugauguccagccggaacuucccugcuucugugcaguuucaaaauggacgcugcacacuguccggcgaccuccuggggaccacgcccagcucuccggccgaucuuggagcuuucguuggccugagagccgagccuggcucccggguggucgaacucagccagcccaaccaggaggacuuucacgccggguccgcucccgcgccuuucggauuuccggauuucucugacuguagcgugacauuugucguggccuccgcuaccacaguuggcgaacgcaccgugaacaccagaagccugcagaauuucacacccgcccuugggcauaucacguuugacgaggaggccccugcugaucuguuccgggcccacuuuagaaaccucugggaacccaccgagcacucuuucuggcgcauuccugacuaccgggcggauguccugggauccgacuuugcucccagcgugucugccccuggcguuggggaaacacuccuguucuucaugugcaaugugcccagacugaacggagccaauccgaacccuugucccugccuucugccucaagaguggaucacccauuuugucagcgaacgcgcugcccuccaguccgauguggcucugcuuaauuaugugaaccccaauacaggccggguucuguucgaggccaagcucuacgcgaacggcuuucugaccgucaaucugggggccccggaccaggcuacgcucccuguggauggaauuuucaaauuugugucuugggucagcuccuauuaccaacugagacccgugggcaacgccagcgcugggcgccggcuuuga

SEQ ID NO: 30622 - RNA, 1551 nt, Artificial Sequence
  derived and/or modified sequence opt5 from VP1__Norovirus_and/or_Norovirus-like__AY549163
augaagaugaccgacagagauacaaucgacagcgcccccgcucugggccaggugcucccuccggaggucgaagccuccguucccguggagccuacggcgggggcucccguggccgccccuaccgcuggacaagucaaccccauugauccuuggaucuucgccaauuuugugcaggcuccgcagggcgaguucacaauuucucccaacaauaacccuggggagauccuguuugaacuugagcugggacccgaccucaauccuuaccuggcccaccuucggcgcauguauaacggcuggaccgggagcaugagaguucgggugcugcucgcgggaaaugccuucuccgcuggcaaagucgugguuuucugcgugcccccgggcuucgauacaucuuaccugaccccuagccaggccacacaauuuccccauguccugauugacgugcgcgcuccugagcccguggaaaugccccucgaggaugucagaaacauccuguuccaccaggggccugacucccggaugcgccuuaugggaaugcuguauaccccgcucagagccaauuacggcgcggaucccuuuguugugacggggcgggugcugaccuguccuucucccaacuucagcuuuuucuuucuugucccucccacaguggaagaacgcgagaccccguucacacugccuaaucuccccguuaacaaucugucccauagcagagugauggaaccuaucgcccagaugaugucuucccggaacuuccccgcuagcguccaguuucaaaauggacgcugcacccugucuggcgaccuccuggggacgacaccuuccagccccgccgaucuuggagcuuucgugggccugagagccgagccgggcucucggguuguggaacucucccagccuaaccaggaggacuuucacgccgggagcgcucccgcgcccuucggauuuccugauuucuccgacuguucugucaccuuuguggucgccagcgcuacaaccgugggcgaacgcaccguuaacacaagaucccugcagaauuucacgccggcccuugggcauauuaccuuugacgaggaggcccccgcugaucuguuccgggcccacuuuagaaaccucugggaaccuacagagcacagcuucuggcgcauccccgacuaucgggcggaugugcugggaucugacuuugcuccuuccgucagcgcccccggcgugggggaaacccugcucuuuuucaugugcaauguuccuagacugaacggagccaaucccaacccguguccuugccuucugccccaagaguggauuacacauuuugugucugaacgcgcugcccuccagagcgaugucgcucugcuuaauuacgugaacccuaauaccggccgggugcuguucgaggccaagcucuaugcgaacggcuuucugacgguuaaucugggggccuccgaccaggcuauccuccccgucgauggaauuuucaaauuugugucuugggugagcuucuacuaccaacugagaccggucggcaacgccuccguggggcgccggcuuuga

SEQ ID NO: 30623 - RNA, 1551 nt, Artificial Sequence
  derived and/or modified sequence opt5 from VP1__Norovirus_and/or_Norovirus-like__AY549159
augaagaugaccgacagagauacaguggacagcgcccccgcucugggccagguccucccuccggagguugaagccuccgugcccguggagccuacggcgggggcucccgucgccgccccuaccgcuggacaagugaaccccaucgauccuuggauuuucgccaauuuuguucaggcuccgcagggcgaguucacaaucucucccaacaauaacccuggggagauucuguuugaacuugagcugggacccgaccucaauccuuaccuggcccaccuucggcgcauguauaacggcuggaccgggagcaugagagugcggguccugcucgcgggaaaugccuucuccgcuggcaaagugguuguguuuugcgugcccccgggcuucgauacaucuuaccugaccccuagccaggccacacaauuuccccauguccugaucgacgugcgcgcuccugagcccgucgaaaugccccucgaggauguuagaaacauucuguuccaccaggggccugacucccggaugcgccuuaugggaaugcuguauaccccgcucagagccaauucuggcgcggaucccuuuguggugacggggcggguccugaccuguccuagccccaacuucuccuuuuucuuucuugugccucccacaguugaagaacgcgagaccccguucacacugccuaaucuccccgugaacaaucugagccauucuagagucauggaaccuaucgcccagaugauguccagccggaacuuccccgcuucugugcaguuucaaaauggacgcugcacccuguccggcgaccuccuggggacgacaccuagcucucccgccgaucuuggagcuuucguuggccugagagccgagccgggcucccggguggucgaacucagccagccuaaccaggaggacuuucacgccggguccgcucccgcgcccuucggauuuccugauuucucugacuguagcgugaccuuugucguggccuccgcuacaaccguuggcgaacgcaccgugaacgccagaagccugcagaauuucacaccggcccuugggcauaucacguuugacgaggaggcucccgccgaucuguuccgggcgcaccucagaaaccugugggaaccuaccgagcacucuuuuuggcgcauucccgacuaccgggcugauguccugggauccgacuucgccccuagcgugucugcccccggcguuggggaaacacuccuguuuuucaugugcaaugugccuagacuuaacggagcuaaucccaacccguguccuugccugcucccccaagaguggaucacccauuucgucagcgaacgcgccgcucugcaguccgauguggcccuucugaauuaugugucuccuaacacaggccggguucucuuugaggcgaagcuguacgccaauggcuuccugaccgucaaccucggggcuagcgaccaggccacgcugcccguggauggaauuuuuaaauucguguccugggucagcuuuuauuaccaacuuagaccggugggcaaugcuucuguugggcgccggcuguga

SEQ ID NO: 30624 - RNA, 1551 nt, Artificial Sequence
  derived and/or modified sequence opt5 from VP1__Norovirus_and/or_Norovirus-like__AY549166
augaagaugaccgacagagauacaguggacagcgcccccgcucugggccagguccucccuccggagguugaagccuccgugcccguggagccuacggcgggggcucccgucgccgccccuaccgcuggacaagugaaccccaucgauccuuggauuuucgccaauuuuguucaggcuccgcagggcgaguucacaaucucucccaacaauaacccuggggagauucuguuugaacuugagcugggacccgaccucaauccuuaccuggcccaccuucggcgcauguauaacggcuggaccgggagcaugagagugcggguccugcucgcgggaaaugccuucuccgcuggcaaagugguuguguuuugcgugcccccgggcuucgauacaucuuaccugaccccuagccaggccacacaauuuccccauguccugaucgacgugcgcgcuccugagcccgucgaaaugccccucgaggauguuagaaacauucuguuccaccaggggccugacucccggaugcgccuuaugggaaugcuguauaccccgcucagagccaauucuggcgcggaucccuuuguggugacggggcggguccugaccuguccuagccccaacuucuccuuuuucuuucuugugccucccacaguugaagaacgcgagaccccguucacacugccuaaucuccccgugaacaaucugagccauucuagagucauggaaccuaucgcccagaugauguccagccggaacuuccccgcuucugugcaguuucaaaauggacgcugcacccuguccggcgaccuccuggggacgacaccuagcucucccgccgaucuuggagcuuucguuggccugagagccgagccgggcucccggguggucgaacucagccagccuaaccaggaggacuuucacgccggguccgcucccgcgcccuucggauuuccugauuucucugacuguagcgugaccuuugucguggccuccgcuacaaccguuggcgaacgcaccgugaacacaagaagccugcagaauuucacgccggcccuugggcauaucaccuuugacgaggaggcccccgcugaucuguuccgggcccacuuuagaaaccucugggaaccuacagagcacucuuucuggcgcauucccgacuaccgggcggauguccugggauccgacuuugcuccuagcgugucugcccccggcguuggggaaacccuccuguucuucaugugcaaugugccuagacugaacggagccaaucccaacccguguccuugccuucugccccaagaguggaucacacauuuugucagcgaacgcgcugcccuccaguccgauguggcucugcuuaauuaugugaacccuaauaccggccggguucugcucgaggccaagcugugugcgaacggcuuccugacggucaaucucggggccucugaccaggcuacacugcccguggauggaauuuuuaaauucgugagcugggucuccuuuuacuaucaacuuagaccggugggcaacgccagcguugggcgccggcuguga

SEQ ID NO: 30625 - RNA, 1551 nt, Artificial Sequence
  derived and/or modified sequence opt5 from VP1__Norovirus_and/or_Norovirus-like__AF320113
augaagaugaccgacagagauaucauugacagcgcccccgcucugggccaggugcucccuccggaggucgaagccuccguucccguggagccuacagcgggggcucccguggccgccccuacggcuggacaagucaaccccaucgauccuuggauuuucgccaauuuugugcaggcuccgcagggcgaguucaccaucucucccaacaauaacccuggggagauucuguuugaacuugagcugggacccgaccucaauccuuaccuggcccaccuucggcgcauguauaacggcuggacagggagcaugagaguucgggugcugcucgcgggaaaugccuucuccgcuggcaaagucguggucuuuugcgugcccccgggcuucgauaccucuuaccugacaccuagccaggccacccaauuuccccauguccugaucgacgugcgcgcuccugagcccguggaaaugccccucgaggaugucagaaacauccuguuccaccaggggccugacucccggaugcgccuuaugggaaugcuguauacaccgcucagagccaauucuggcgcggaucccuuuguugugaccgggcgggugcugccuugucccagcccuaacuucuccuuuuucuuucuuguucccccgacgguggaagaacgcgagccucccuucacccugccuaaucuccccguuaacaaucugagccauucuagagugauggaaccuauugcccagaugauguccagccggacauuccccgcuucuguccaguuucaaaacggacgcugcacccuguccggcgaccuccuggggacaaccccgagcucuccuuccgaucuuggagccuucgugggccugaucgcugagcccggcagcagaguuguggaacucuuucagcccaaucaggaggacuuccacgccggguccgccccugcuccgcugggauuucccgauuucucugacuguagccuuacguuugucguggcguccgccacaaccgucggcgaacggacagugaacgcucgcagccugcagaacuucaccccugcccucgggcauauuaccuuugacgaggaggcccccgcugaucuguucagagcccaucugcggaaucucugggacccuacagaacacucuuuuuggagaauccccgauuaccgcgcggacguucugggauccgagcuugcuccuagcgugucugcccccggcgucggggaaacgcuccucuucuuuaccugcaacgugccgcggcugaauggagccaacccuaaucccuguccuugccuucugccccaagaguggauuacacacuucguuagcgaaagagcugcccuccaguccgauguggcucugcugaacuaugucaauccgaacaccggccgcgugcuguucgaggccaagcuguacgugaauggcuuucuuacaguuaaccugggggcgucugaccaggccacccucccugucgauggaaucuucaaauuugugagcuggguguccuucuauuaccaacugcggcccgucggcaaugcuagcguggggagacgccuguga

SEQ ID NO: 30626 - RNA, 1551 nt, Artificial Sequence
  derived and/or modified sequence opt5 from VP1__Norovirus_and/or_Norovirus-like__AY549153
augaagaugaccgacagagauacaguggacagcgcccccgcucugggccagguccucccuccggagguugaagccuccgugcccguggagccuacggcgggggcucccgucgccgccccuaccgcuggacaagugaaccccaucgauccuuggauuuucgccaauuuuguucaggcuccgcagggcgaguucacaaucucucccaacaauaacccuggggagauucuguuugaacuugagcugggacccgaccucaauccuuaccuggcccaccuucggcgcauguauaacggcuggaccgggagcaugagagugcggguccugcucgcgggaaaugccuucuccgcuggcaaagugguuguguuuugcgugcccccgggcuucgauacaucuuaccugaccccuagccaggccacacaauuuccccauguccugaucgacgugcgcgcuccugagcccgucgaaaugccccucgaggauguuagaaacauucuguuccaccaggggccugacucccggaugcgccuuaugggaaugcuguauaccccgcucagagccaauucuggcgcggaucccuuuguggugacggggcggguccugaccuguccuagccccaacuucuccuuuuucuuucuugugccucccacaguugaagaacgcgagccgccuuucacccugcccaaucucccugugaacaaucugagccauucuagagucauggaacccaucgcccagaugauguccagccggucuuccccugcuagcauccaguuccaaaacggacgcugcacacugucuggcgaccuccuggggaccacgcccuccagcccggccgaucuuggagcuuuugugggccugagagccgagccuggcucccacguuguggaacucucucagcccaaucaggaggacuuccaugccgggagcgcucccgcgccuuuuggauucccggauuuuuccgacuguagcgucacauucguggucgccucugcuaccauuguggaacagcggacaguuaacgcccgcucccugcaaaacuuuacccccgcccuuggccacaucaccuucgacgaggaggcuccugccgaucuguuuagagcgcgguucagaaaugugugggaccccacagaacacagcuuuuggcgcauuccugauuaccgggcugacguccucgggucugauuucgcccccagcguguccgccccuggaguuggcgagacgcugcuguuuuucaugugcaacgugccccauucuaauggggcuaacccgaauccuugucccugccuccugccucaggaauggaucacccacuucgucagcgagagagccgcccuucagggagacguggcucugcucaacuauauuaaucccaacacaggccgcguguccuuugaagcgaagcuguacgccaauggcuuccuuaccguuaaccugggggcuagcgaucggacaacccucccggucgacggaaucuuuaaauucgugucuuggguguccuuuuauuaccaacugagaccugucggcaaugccagcguggggcgccggcuguga

SEQ ID NO: 30627 - RNA, 1551 nt, Artificial Sequence
  derived and/or modified sequence opt5 from VP1__Norovirus_and/or_Norovirus-like__AY549157
augaagaugaccgacagagauacaguggacagcgcccccgcucugggccagguccucccuccggagguugaagccuccgugcccguggagccuacggcgggggcucccgucgccgccccuaccgcuggacaagugaaccccaucgauccuuggauuuucgccaauuuuguucaggcuccgcagggcgaguucacaaucucucccaacaauaacccuggggagauucuguuugaacuugagcugggacccgaccucaauccuuaccuggcccaccuucggcgcauguauaacggcuggaccgggagcaugagagugcggguccugcucgcgggaaaugccuucuccgcuggcaaagugguuguguuuugcgugcccccgggcuucgauacaucuuaccugaccccuagccaggccacacaauuuccccauguccugaucgacgugcgcgcuccugagcccgucgaaaugccccucgaggauguuagaaacauucuguuccaccaggggccugacucccggaugcgccuuaugggaaugcuguauaccccgcucagagccaauucuggcgcggaucccuuuguggugacggggcggguccugaccuguccuagccccaacuucuccuuuuucuuucuugugccucccacaguugaagaacgcgagccgccuuucacccugcccaaucucccugugaacaaucugagccauucuagagucauggaacccaucgcccagaugauguccagccggaacuucccugcuucugugcaguuucaaaauggacgcagaacacuguccggcgaccuccuggggaccacgcccagcucuccggccgaucuuggagcuuucguuggccugcgggccgagccuggcucccgcguggucgaacucagccagcccaaccaggaggacuuucacgccggguccgcucccgcgccuuucggauuuccggauuucucugacugcagcgugacauuugucguggccuccgcuaccacaguuggcgaaagaaccgugaacacccggagccugcagaauuucacacccgcccuugggcauaucacguuugacgaggaggccccugcugaucuguucagagcccacuuucgcaaccucugggaacccaccgagcacucuuucuggcggauuccugacuacagagcggauguccugggauccgacuuugcucccagcgugucugccccuggcguuggggaaacacuccuguucuucauguguaaugugccccgccugaacggagccaauccgaacccuugccccugucuucugccucaagaguggaucacccauuuugucagcgaacgggcugcccuccaguccgauguggcucugcuuaauuaugugaaccccaauacaggcagaguucuguucgaggccaagcucuacgcgaacggcuuucugaccgucaaucugggggccucugaccaggcuacgcucccgguggauggaauuuucaaauuugugagcugggucuccuucuauuaccaacugcgcccugugggcaacgccagcguugggcggagacuuuga

SEQ ID NO: 30628 - RNA, 1551 nt, Artificial Sequence
  derived and/or modified sequence opt5 from VP1__Norovirus_and/or_Norovirus-like__AY549158
augaagaugaccgacagagaugccguggacagcgcucccgcccugggccagguccucccuccggagguugaagcguccgugcccguggagccuacagcuggggcccccgucgccgcuccuacggccggacaagugaaccccaucgauccuuggauuuucgcuaauuuuguucaggccccgcagggcgaguucaccaucucucccaacaauaacccuggggagauucuguuugaacuugagcugggacccgaccucaauccuuaccuggcgcaccuucggcgcauguauaacggcuggacagggagcaugagagugcggguccugcucgccggaaaugcuuucuccgccggcaaagugguuguguuuugcgugcccccgggcuucgauaccucuuaccugacaccuagccaggcuacccaauuuccccauguccugaucgacgugcgcgccccugagcccgucgaaaugccccucgaggauguuagaaacauucuguuccaccaggggccugacucccggaugcgccuuaugggaaugcuguauacaccgcucagagccaauucuggcgcggaucccuuuguggugaccgggcggguccugacguguccuagccccaacuucuccuuuuucuuucuugugccucccaccguugaagaacgcgagccgccuuucacacugcccaaucucccugugaacaaucccagccauucuagagucauggaaccuaucgcucagaugauguccagccggaacuuccccgccucugugcaguuucaaaauggacgcugcacccuguccggcgaccugcucgggacaaccccgagcucuccugcugaucugggagccuucguuggccuuagagccgagcccggcucccggguggucgaacugagccagcccaaccaggaggacuuucacgcuggguccgcgccugccccguucggauuucccgauuucucugacuguagcgugacguuugucguggcuuccgccacaaccguuggcgaacgcacagugaacaccagaagccuccagaauuucaccccugcccuggggcauaucacauuugacgaggaggcucccgccgaucuuuuccgggcgcacuuuagaaaccugugggaaccuacggagcacucuuucuggcgcauucccgacuaccgggcugauguccucggauccgacuuugccccuagcgugucugcccccggcguuggggaaacccugcuguucuucaugugcaaugugccgagacucaacggagcuaauccuaaccccuguccuugccugcuuccccaagaguggaucacacauuuugucagcgaacgcgccgcucugcaguccgauguggcccuccugaauuaugugaacccgaauaccggccggguucuuuucgaggcgaagcuguacgccaacggcucucucacagucaaucugggggcuagcgaccaggccacccugccuguggauggaauuuuuaaauucguguccugggucagcuuuuauuaccaacucagacccgugggcaacgcuucuguugggcgccggcuguga

SEQ ID NO: 30629 - RNA, 1551 nt, Artificial Sequence
  derived and/or modified sequence opt5 from VP1__Norovirus_and/or_Norovirus-like__AY549165
augaagaugaccgacagagauacaguggacagcgcccccgcucugggccagguccucccuccggagguugaagccuccgugcccguggagccuacggcgggggcucccgucgccgccccuaccgcuggacaagugaaccccaucgauccuuggauuuucgccaauuuuguucaggcuccgcagggcgaguucacaaucucucccaacaauaacccuggggagauucuguuugaacuugagcugggacccgaccucaauccuuaccuggcccaccuucggcgcauguauaacggcuggaccgggagcaugagagugcggguccugcucgcgggaaaugccuucuccgcuggcaaagugguuguguuuugcgugcccccgggcuucgaugccucuuaccugacaccuagccaggcuacccaauuuccccauguccugaucgacgugcgcgccccugagcccgucgaaaugccccucgaggauguuagaaacauucuguuccaccaggggccugacucccggaugcgccuuaugggaaugcuguauacaccgcucagagccaauucuggcgcggaucccuuuguggugaccgggcggguccugacguguccuagccccaacuucuccuuuuucuuucuuggaccucccaccguggaagaacgcgagccgcuguucacacucccuaaucugcccguuaacaaucugagccauucuagagugauggaaccuaucgcucagaugauguccagccggucuuuccccgccuccguccaguuucaaaacggccgcugcacccucagcggggaccugcuuggaacaaccccuucuucccccgcugaucugggcgccuucgugggccucagagccgagccggggagccacguuguggaacugucccagccuaaucaggaggacuuucaugcuggaucugcgcccgcccccuucggcuuuccugauuucagcggguguuccgucacguuuguggucgcuagcgccacaaucguggaacagcggaccguuaacacacgcucucuucaaaacuucaccccggcccugggacacauuaccuuugacgaggaggcucccgccgaccucuucagagcgcgguuuagaaaugugugggauccuacagaacacuccuucuggcgcauccccgacuaccgggcugauguccugggcagcgacuuugccccuucugugagcgcccccgggggaggcgagacgcuccuguucuucaugugcaacguuccucauuccaauggcgcuaaccccaauccguguccuugccugcuuccccaggaauggauuacccacuuugugucugagagagccgcucugcagggggaugucgcccuccugaacuauaucaauccuaacacaggacgcgugcuuuucgaagcgaagcuguacgccaauggcuuucucaccgugaaccugggggcuagcgaccaagccgcucugcccguugauggaauuuucaaauuugucuccugggugagcuucuauuaccagcuccggccggugggcaaugccucugucgggagacgccuguga

SEQ ID NO: 30630 - RNA, 1551 nt, Artificial Sequence
  derived and/or modified sequence opt5 from VP1__Norovirus_and/or_Norovirus-like__AY549167
augaagaugaccgacagagauacaguggacagcgcccccgcucugggccagguccucccuccggagguugaagccuccgugcccguggagccuacggcgggggcucccgucgccgccccuaccgcuggacaagugaaccccaucgauccuuggauuuucgccaauuuuguucaggcuccgcagggcgaguucacaaucucucccaacaauaacccuggggagauucuguuugaacuugagcugggacccgaccucaauccuuaccuggcccaccuucggcgcauguauaacggcuggaccgggagcaugagagugcggguccugcucgcgggaaaugccuucuccgcuggcaaagugguuguguuuugcgugcccccgggcuucgauacaucuuaccugaccccuagccaggccacacaauuuccccauguccugaucgacgugcgcgcuccugagcccgucgaaaugccccucgaggauguuagaaacauucuguuccaccaggggccugacucccggaugcgccuuaugggaaugcuguauaccccgcucagagccaauucuggcgcggaucccuuuguggugacggggcggguccugaccuguccuagccccaacuucuccuuuuucuuucuugugccucccacaguugaagaacgcgagccgcuguucacccucccuaaucugcccgugaacaaucugagccauucuagagucauggaaccuaucgcccagaugauguccagccggggauuccccgcuucugugcaguuucaaaacggccgcugcacacucuccggggaccugcuuggaaccacgccuagcucucccgccgaucugggcgcuuucguuggccucagagccgagccggggucccacguggucgaacugagccagccuaaucaggaggacuuucaugccggauccgcucccgcgcccuucggcuuuccugauuucucugacuguagcgugacauuugucguggccuccgcuaccaucguugaacagcggacagugaacgcccgcagccuucaaaacuucaccccggcccuggggcacauuaccuuugacgaggaggcucccgccgaucucuucagagcgcgguuuagaaaugucugggacccuacagaacacucuuucuggcgcauccccgauuaccgggcugacgugcugggauccgauuuugccccuagcguuucugcccccggcgugggggagacgcuccuguucuucaugugcaacgucccucauagcuccggagcuaaucccaacccguguccuugccugcuuccccaggaauggauuacccacuuugugucugagagagccgcucugcagggcgacguggcccuccugaauuauaucaacccuaauacaggccgcguucuuuucgaagcgaagcuguacgccaacggguuucucaccgucaaucugggagcuagcgaucaagccacacugcccguggacggcauuuucaaauuuguguccugggucagcuucuauuaccagcuccggccgguggggaacgcuucuguuggaagacgccuguga

SEQ ID NO: 30631 - RNA, 1551 nt, Artificial Sequence
  derived and/or modified sequence opt5 from VP1__Norovirus_and/or_Norovirus-like__AY549154
augaagaugaccgacagagauacaguggaccccgccccugcucugggccagguccucccgcccgagguugaagccagcgugccuguggagcccacggcgggggcuccugucgccgcccccaccgcuggacaagugaacccuaucgauccguggauuuucgccaauuuuguucaggcuccccagggcgaguucacaaucuccccuaacaauaaccccggggagauucuguuugaacuugagcugggaccugaccucaaucccuaccuggcccaccuucggcauauguauaacggcuggaccgggucuaugcgcgugagaguccugcucgcgggaaaugccuucagcgcuggcaaagugguuguguuuugcgucccgccuggcuucgauacauccuaccugacccccucucaggccacacaauuuccucacgugcugaucgacgugcgggcucccgagcccgucgaaaugccucucgaggauguucgcaacauucuguuccaucaggggccggacagcagaaugcggcuuaugggaaugcuguauacaccccuccgcgccaauuccucugcggauccuuuuguggugacgggcagaguccugaccugucccaacccuaauuucagcuuuuucuuucuugugcccccgacaguugaagaacgggagccucccuucacccugccuaaccuccccgugaauaaccugucccacagccgcgucauggaaccuaucgcccagaugaugucuuccagaaauuuccccgcuagcgugcaguuucaaaacgggcggugcacacugucuggagaccuccugggcaccacgccguccagcccugccgaucuuggggcuuucguuggacugcgcgccgagcccggcucuagaguggucgaacucucccagcccaaccaggaggacuuucaugccggcagcgcuccugcgccguucggguuucccgauuucuccgacuguucugugacauuugucguggccagcgcuaccacaguuggagaacggaccgugaauacccgcucccugcagaacuucaccccugcccuuggccacaucacguuugacgaggaggcccccgcugaucuguucagagcccacuuucggaaucucugggaaccuaccgagcauagcuucuggcgcauucccgacuacagagcggauguccuggggucugacuuugcuccuuccgugagcgcccccggaguuggcgaaacacuccuguucuucaugugcaacgugccgcggcugaauggggccaacccuaaucccuguccuugccuucugccccaagaguggaucacccacuuugucucugaaagagcugcccuccagagcgauguggcucugcuuaacuaugugaauccgaacacaggacgcguucuguucgaggccaagcucuacgcgaauggcuuucugaccgucaaccugggcgccuccgaccaggcuacgcucccuguggaugggauuuucaaauuugugucuugggucagcuucuauuaccaacugcggcccgugggaaaugccuccguuggcagacgccuuuga

SEQ ID NO: 30632 - RNA, 1551 nt, Artificial Sequence
  derived and/or modified sequence opt5 from VP1__Norovirus_and/or_Norovirus-like__AY549155
augaagaugaccgacagagauacaguggacagcgcccccgcucugggccagguccucccuccggagguugaagccuccgugcccguggagccuacggcgggggcucccgucgccgccccuaccgcuggacaagugaaccccaucgauccuuggauuuucgccaauuuuguucaggcuccgcagggcgaguucacaaucucucccaacaauaacccuggggagauucuguuugaacuugagcugggacccgaccucaauccuuaccuggcccaccuucggcgcguguauaacggcuggaccgggagcaugagaguccgggugcugcucgcgggaaaugccuucuccgcuggcaaaguuguggucuuuugcgugcccccgggcuucgauacaucuuaccugaccccuagccaggccacacaauuuccccaugugcugaucgacguccgcgcuccugagcccguugaaaugccccucgaggaugugagaaacauucuguuccaccaggggccugacucccggaugaagcugaugggaaugcuguauaccccgcuccgcgccaauucuagcgcgaaccccuuuguggucacgggcagagugcugaccuguccuucccccaauuucagcuuuuucuuucuuguuccucccacaguggaagaacgggagccgccuuucacccugcccaaccucccugucaauaaccugucucauucccaggugauggaacccaucgcccagaugaugagcucucgcaauuucccugcuuccguucaauuucagaacgggagaugcacacugagcggagaucuccugggcaccacgcccucuuccccggccgaccuuggggcuuucgugggacugcgggccgagccuggcagccgcgucguggaacucucccagcccaaccaggaggauuuucacgccggcucugcucccgcgccuuucggguuuccggacuucagcgauuguuccgucacauuugugguugccagcgcuaccacagugggagaaagaaccgucaaugcccggacccugcaaaacuucacacccgcccuuggccauaucacguuugacgaggaggcuccugccgaccuguuccgcgcgcacuuuagaaaucucugggaacccaccgagcacucuuucuggcggauuccugauuacagagcugacgugcugggguccgauuuugcccccagcguuucugccccuggagugggcgaaacacuucucuucuucaugugcaacgucccccgccugaauggggcuaacccgaauccuugucccugccuucugccucaggaguggaucacccauuuugugagcgaacgggccgcucuccaguccgacguggcccugcuuaacuauguuaaucccaacacaggaagaguccuguucgaggcgaaacucuacgccaauggcuuucugaccgugaaccugggcgcuucugaucaagccacgcucccgguggacgggauuuucaaguuugucagcuggguguccuucuauuaccagcugcgcccuguuggaaaugcuagcgugggccggagacuuuga

SEQ ID NO: 30633 - RNA, 1551 nt, Artificial Sequence
  derived and/or modified sequence opt5 from VP1__Norovirus_and/or_Norovirus-like__AF320625
augaagaugaccgacagagauaucauugacagcgcccccgcucugggccaggugcucccuccggaggucgaagccuccguucccguggagccuacagcgggggcucccguggccgccccuacggcuggacaagucaaccccaucgauccuuggauuuucgccaauuuugugcaggcuccgcagggcguuuucaccaucucucccaacaauaacccuggggaaauucuguuugagcuugaacugggacccgaccucaauccuuaccuggcccaccuucggcgcauguauaacggcuggacagggagcaugagagugcggguccugcucgcgggaaaugccuucuccgcuggcaaagugguuguguuuugcgugcccccgggcuucgauaccucuuaccugacaccuagccaggccacccaauuuccccauguccugaucgacgugcgcgcuccugagcccgucgagaugccccucgaagauguuagaaacauccuguuccaccaggggccugacucccggaugcgccuuaugggaaugcuguauacaccgcucagagccaauucuggcgcggaucccuuuguggugaccgggcggguccugacguguccuagccccaacuucuccuuuuucuuucuugugccucccaccguugaggaacgcgagccgagcuucacacugccuaaucuccccgugaacaaucugucucauuccagagucauggagccuauugcccagaugaugagcucucggaccuuccccgcuuccgugcaguuucaaaacggacgcugcacacugagcggcgaccuccuggggaccacgccuucuucccccagcgaucuuggagccuucguuggccugaucgcugaaccgggcuccagaauuguggagcucucucagccuaaucaggaagacuuucacgccgggagcgcccccgcucccuucggauuuccugauuucuccgacuguagccugacauuugucguggcgucugccaccacagucggcgagcggaccgugaacgcucgcucccuucagaacuucaccccggcccuggggcauaucacauuugacgaagaggcccccgcugaucucuucagagcccaccugagaaaucugugggacccuacggagcacagcuuuuggcggauucccgauuaccgcgcggacguucucggaucugaauuugcuccuagcguguccgcccccggcgucggggagacccugcuuuucuucaugugcaacgugccucggcugaauggagccaaccccaauccguguccuugccuccugccccaagaauggaucacacauuucguuucugagagagcugcccuucagagcgauguggcucugcucaacuaugucaauccuaacaccggccgcgugcuguuugaagccaagcuguacgcgaauggcuuccucacagugaaccugggggccuccgaccaggcuacccuucccguugauggaauuuuuaaauucgucagcugggugucuuuuuauuaccaacugcggccggugggcaaugccuccgucgggagacgccucuga

SEQ ID NO: 30634 - RNA, 1551 nt, Artificial Sequence
  derived and/or modified sequence opt5 from VP1__Norovirus_and/or_Norovirus-like__AY274820
augaagaugaccgacagagauacaguggacagcgcccccgcucugggccagguccucccuccggagguugaagccuccgugcccguggagccuacggcgggggcucccgucgccgccccuaccgcuggacaagugaaccccaucgauccuuggauuuucgccaauuuuguucaggcuccgcacggcgaguucacaaucucucccaacaauaacccuggggaggugcuguuugaacuuaaacugggacccgaccucaauccuuaccuggcccaucuucggcgcauguauaacggcuggaccgggagcaugagaguccgggugcugcucgcgggaaaugccuucuccgcuggcaagguuguggucuuuugcgugcccccgggcuucgauacaucuuaccugaccccuagccaggccacacaguuuccccacgugcugauugacguccgcgcuccuaaacccguugagaugccccucgaggaugugagaaacauccuguuccaucaagggccugacucccggaugcgccuuaugggaaugcuguauaccccgcucagagccaauucuggcgcggaucccuuuguggucacggggcgggugcugaccuguccuagccccaacuucuccuuuuucuuucuuguuccucccacaguggaagaacgcgaaccgccuuucacccugcccaaucucccugucaacaaucugagccacucuagagugauggagcccauugcccagaugauguccagccggaacuucccugcuucuguucaguuucagaauggacgcugcacacuguccggcgaccuccuggggaccacgcccagcucuccggccgaucuuggagcuuucgugggccugagagccgagccuggcucccgggucguggaacucagccaacccaaccaggaggacuuucaugccggguccgcucccgcgccuuucggauuuccggauuucucugaauguagcgucacauuuaugguggccuccgcuaccacaguuggcgagcgcaccgugaacaccagaagccugcagaauuucacacccgcccuugggcacaucacguuugacgaagaggccccugcugaccuguuccgggccagauuucgcaaccucugggagcccaccgaacacucuuucuggcggaucccugauuacagagcggacguccugggauccgaguuugcucccagcgugucugccccuggcguuggggaaacacuccuguucuucaugugcaaugugccccgccugaacggagccaauccgaacccuugucccugccuucugccucaggaguggauuacccauuuugucagcgaacgggcugcccuccaauccgauguggcucugcuuaauuaugugaaccccaauacaggcagaguucuguucgaggccaagcucuacgcgaacggcuuucugaccgucaaucugggggccucugaccaggcuagccucccgguggauggaaucuucaaauuuguguccugggucagcuucuauuaccagcugcgcccugugggcaacgccucuguugggcggagacuuuga

SEQ ID NO: 30635 - RNA, 1551 nt, Artificial Sequence
  derived and/or modified sequence opt5 from VP1__Norovirus_and/or_Norovirus-like__AF542083
augaagaugaccgacagagauacaguggacagcgcccccgcucugggccagguccucccuccggagguugaagccuccgugcccguggagccuacggcgggggcucccgucgccgccccuaccgcuggacaagugaaccccaucgauccuuggauuuucgccaauuuuguucaggcuccgcagggcgaguucacaaucucucccaacaauaacccuggggaggugcuguuugaacuugagcugggacccgaccucaauccuuaccuggcccaccuucggcgcauguauaacggcuggaccgggagcaugagaguccgggugcugcucgcgggaaaugccuucuccgcuggcaaaguuguggucuuuugcgugcccccgggcuucgauacaucuuaccugaccccuagccaggccacacaauuuccccaugugcugauugacguccgcgcuccugagcccguugaaaugccccucgaggaugugagaaacauccuguuccaccaggggccugacucccggaugcgccuuaugggaaugcuguauaccccgcucagagccaauucuggcgcggaucccuuuguggucacggggcgggugcugaccuguccuagccccaacuucuccuuuuucuuucuuguuccucccacaguggaagaacgcgagccgccuuucacccugcccaaucucccugucaacaaucugagccauucuagagugauggaacccauugcccagaugauguccagccggaacuucccugcuucuguucaguuucaaaauggacgcugcacacuguccggcgaccuccuggggaccacgcccagcucuccggccgaucuuggagcuuucgugggccugagagccgagccuggcucccgggucguggaacucagccagcccaaccaggaggacuuucacgucggguccgcccccgcuccucugggauucccggauuuuucugacuguagcgugacauucguuguggcguccgccaccacagucggcgaacgcaccgugaacaccagaagccuucagaauuuuacacccgcucuggggcauaucacguucgacgaggaggccccugccgaucucuuucgggcucacuucagaaaccugugggaacccaccgagcacucuuuuuggcgcaucccugacuaccgggccgauguucugggauccgacuucgcgcccagcgugucugcuccuggcgucggggaaacacuccuguuuuucaugugcaaugugcccagacuuaacggagccaauccgaacccuugucccugccugcucccucaagaguggauuacccauuucgugagcgaacgcgccgcucugcaguccgauguugcccuucugaauuaugucaaccccaauacaggccgggugcucuuugaggcuaaccuguacgccaauggcuuccugaccgugaaccucggggcgucugaccaggccacgcugccggucgauggaaucuuuaaguucgugagcuggguuuccuuuuauuaccaacuuagaccugugggcaaugcuagcgucgggcgccggcuguga

SEQ ID NO: 30636 - RNA, 1551 nt, Artificial Sequence
  derived and/or modified sequence opt5 from VP1__Norovirus_and/or_Norovirus-like__EU794907
augaagaugaccgacagagaugugacagacagcgcccccgcucugggccagguccucccuccggagguugaagccuccgugcccguggagccuacggcgggggcucccgucgccgccccuaccgcuggacaagugaaccccaucgauccuuggauuuucgccaauuuuguucaggcuccgcagggcgaguucacaaucucucccaacaauaacccuggggagauucuguuugaacuugagcugggacccgaccucaauccuuaccuggcccaccuucggcgcauguauaacggcuggaccgggagcaugagagugcggguccugcucgcgggaaaugccuucuccgcuggcaaagugguuguguuuugcgugcccccgggcuucgauacaucuuaccugaccccuagccaggccacacaauuuccccauguccugaucgacgugcgcgcuccugagcccgucgaaaugccccucgaggauguuagaaacauucuguuccaccaggggccugacucccggaugcgccuuaugggaaugcuguauaccccgcucagagccaauucuggcgcggaucccuuuguggugacggggcggguccugaccuguccuagccccaacuucuccuuuuucuuucuugugccucccacaguugaagaacgcgagccgccuuucacccugcccaaucucccugugaacaaucugagccauucuagagucauggaacccaucgcccagaugauguccagccggaacuucccugcuucugugcaguuucaaaauggacgcugcacacuguccggcgaccuccuggggaccacgcccagcucuccguccgaucuuggagccuucguuggccugaucgcugagccuggcagcagaguggucgaacucucccagcccaaccaggaggacuuucacgccgggucugcccccgcuccuuucggauuuccggauuucagcgacuguucccugacauuuguggucgcgagcgccaccacagugggcgaacggaccguuaacgcucgcucuccccagaauuucaccccugcccuugggcauauuacauuugacgaggaggcccccgcugaucuguucagagcccaccuccggaaccugugggacccuacggaacacuccuuuuggagaauccccgauuaccgcgcggacgugcugggaagcgaguucgcuccuucugucagcgcccccggcgugggggaaacccuccuguuuuucaugugcaauguuccgcggcuuaacggagccaauccuaaccccuguccuugccugcucccccaagaguggauuacacauuucguguccgaaagagcugcccugcagucugaugucgcccuucugaauuaugugaacccgaauaccggccgcgugcucuuugaggcuaagcuguacgcgaacggcuuccugacaguuaaucucggggccagcgaccaggcuacccugccugucgauggaaucuuuaaauucguguccugggugagcuuuuauuaccaacuucggcccgucggcaacgccucuguggggagacgccuguga

SEQ ID NO: 30637 - RNA, 1551 nt, Artificial Sequence
  derived and/or modified sequence opt5 from VP1__Norovirus_and/or_Norovirus-like__AY126474
augaagaugaccgacagagauacaaucgacagcgcccccgcucugggccaggugcucccuccggaggucgaagccuccguucccguggagccuacggcgggggcucccguggccgccccuaccgcuggacaagucaaccccauugauccuuggaucuucgccaauuuugugcaggcuccgcagggcgaauuuacaauuucucccaacaauaacccuggggagauccuguuugaacuugagcugggacccgaccucaauccuuaccuggcccaccuucggcgcauguauaacggcuggaccgggagcaugagaguucgggugcugcucgcgggaaaugccuucuccgcuggcaaagucgugguuuucugcgugcccccgggcuucgauacaucuuaccugaccccuagccaggccacacaauuuccccauguccugauugacgugcgcgcuccugagcccguggaaaugccccucgaggaugucagaaacauccuguuccaccaggggccugacucccggaugcgccuuaugggaaugcuguauaccccgcucagagccaauucuggcgcggaucccuuuguugugacggggcgggugcugaccuguccuagccccaacuucuccuuuuucuuucuugucccucccacaguggaggaacgcgagccgccuuucacccugcccaaucucccuguuaacaaucugagccauucuagagugauggaacccaucgcccagaugauguccagccggaacuucccugcuucuguccaguuucaaaauggacgcugcacacuguccggcgaccuccuggggaccacgcccagcucuccggccgaucuuggagcuuucgugggccugauugccgagccuggcuccagaguuguggaacucagccagcccaaccaggaggacuuucacgccggguccgcucccgcgccuuucggauuuccggauuucucugaauguagccugacauuugucguggccuccgcuaccacagucggcgagcggaccgugaacacccgcagccuucagaauuucacacccgcccuggggcauaucacguuugacgaggaagccccugcugaccucuucagagcccaucugcggaaccugugggaucccaccgagcacucuuuuuggcgcauuccugacuacagagcggauguucucggauccgaauuugcucccagcgugucugccccuggcgucggggagacacugcuuuucuucaugugcaaugugccccggcugaacggagccaauccgggccucuguccuugccugcuuccccaagaauggaucacccacuucguuagcgagagagcugcccugcaguccgacguggcucuccugaacuaugucaauccuaacacaggccgcgugcuguuugaguguaagcucuacgccaauggguuccugaccgugaaccuuggagcgucugaucaggccacgcugcccguugacggcauuuuuaaauucgucagcuggguguccuuuuauuaccaacuccggccgguggggaaugcuagcgucggaagacgccuguga

SEQ ID NO: 30638 - RNA, 1551 nt, Artificial Sequence
  derived and/or modified sequence opt5 from VP1__Norovirus_and/or_Norovirus-like__JX145650
augaagaugaccgacagagauaucguggacagcgcccccgcucugggccagguccucccuccggagguugaagccuccgugcccguggagccuacagcgggggcucccgucgccgccucuacggcuggacgggugaacccuauugaucccuggaucuucgccaauuuuguucaagcuccucagggcgaguucaccauuagcccgaacaauaaccccggggaaauccuguuugaacuugagcugggaccugaccucaaucccuaccuggcccaccuucgcagaauguauaacggcuggacaggguccaugcgggugcgcguccugcucgcgggaaaugccuucucugcuggcaaagugguuguguuuugcgucccucccggcuucgauaccagcuaccugacaccgucccaggccacccaguuuccucaugugcugauugacgugagagcucccgagccugucgauaugccccucgaagacguucggaacauccuguuccaccaagggcccgauucucgcaugagacuuaugggaaugcuguauacaccucuccgggccaauagcggcgcggacccguuuguggugaccgggcgcguccugacgugucccuccccuaacuucagcuuuuucuuucuugugcccccuaccguugaggaaagagagcccccguucacacugccuaaucuccccgugaacucucugucccauagccgggucauggagccuaucgcccagaugaugucuucccgcagcuuccccgcuucugugcaguuucagaauggaagaugcacccuguccggcgaucuccuggggacaaccccuagcucccccgccgaccuuggagcuuucguuggccugauugccgaaccgggcucucggguggucgagcucagccaaccuaaccaggaagauuuucacgccggguccgcucccgcgcccuucggauuuccugacuucagcgaguguucugugacguuugucguggccuccgcuacaaccguuggcgaacgcacagugaaugccagaaacccgcagaacuucacccccgcccuggggcauaucaccuuugacgaggaggcuccugccgaucuuuuccgggcgagauuucgcaaucugugggaacccacagagcacagcuucuggcggauuccugacuacagagcugauguccucggaucugacuuugcccccagcguguccgccccuggcguuggggaaacgcugcuguucuucaugugcaacgugccccgccucaauggagcuaacccgaauccuugucccugccugcuuccucaggaguggaucacccacuuugucucugaacgggccgcucugcaaagcgauguggcccuccugaacuaugugaaucccaacacaggcagaguucuuuucgaggcgaagcuguacgccaauggcuuucucaccgucaaccugggggcuuccgaccaggccauucugccgguggauggaaucuucaaauuugugagcugggucucuuucuauuaccagcuccgcccugugggcaauauuuccguugggcggagacuguga

SEQ ID NO: 30639 - RNA, 1548 nt, Artificial Sequence
  derived and/or modified sequence opt5 from VP1__Norovirus_and/or_Norovirus-like__AY549161
augaagaugaccgacagagauacaacggacagcgcccccgcucugggccaggugcucccuccggaggucgaagccuccguucccguggagccuaccgcgggggcucccguggccgccgcuacagccggacaagucaacccuaucgaucccuggauuuucgcuaauuuugugcaggccccucagggcgaguucaccaucucuccgaacaauaaccccggggagauucuguuugaacuugagcugggaccugaccucaaucccuaccuggcgcaccuucggcgcauguauaacggcuggacagggagcaugagaguucgggugcugcucgccggaaaugcuuucuccgccggcaaagucguggucuuuugcgugccucccggcuucgaugcuucuuaccugaccccgagccaggccacacaauuuccucauguccugaucgacgugcgcgcgcccgagccuguggaaaugccccucgaggaugucagaaacauucuguuccaccaggggcccgacucccggaugaaacuuaugggaaugcuguauaccccucuccgcgccaauucuggcgcugauccguuuguugugacggggagagugcugaccugucccagcccuaacuucuccuuuuucuuucuuguucccccuacaguggaagaacgggaggcccccuucacccugccgaaucucccuguuaacagccugucucauucccgcuacgugggacccaucaugcagaugaugagcucuagaacauucccugcuuccguccaguuucaaaauggccggugcacccugagcggggaccuccugggaacgacacccucuuccagcgccgaucuuggcgccuucgugggccugaucgcugaagcggggucccgcguuguggagcucucucagccuaaccaggaagacuuucacgccggaagcgcucccgccccgcugggcuucccugauuuuuccgacuguagccuuaccuucgucguggccucucugacaaccgucggggagagaaccgugaaugcucggucccuccagaacuuuacacccgcccugggacauguuacguucgacgaagaggcgcccgcugaucuguuucgcgccagacuccggaaccugugggacccuaccgagcacagcguguggcgcauuccggauuauagagccgacguccuuggcucugaguucgcucccagcguguccgccccugggguuggagaaacacugcucuuuuucaugugcaaugugccccaccaaaccggcgcuaacccuaaucccuguccuugccugcuuccccaggaauggaucacacauuuugucucugagcgggccgcgcugcagagcgaaguggcccuccugaacuacgugaauccgaacaccggcagaguucuguucgaguguaagcucuaugcuaauggguuccugacggucaaccuuggagccuccgaucaagugagccugccuguggacggcauuuuuaaguucgucucuuggguguccuuuuacuaccagcuccgccccguugggaauacaggagugggccggagauga

SEQ ID NO: 30640 - RNA, 1548 nt, Artificial Sequence
  derived and/or modified sequence opt5 from VP1__Norovirus_and/or_Norovirus-like__AY549164
augaagaugaccgacagagaugccguggacagcgcucccgcccugggccagguccucccuccggagguugaagcguccgugcccguggagccuacagcuggggcccccgucgccgcuccuacggccggacaagugaaccccaucgauccuuggauuuucgcuaauuuuguucaggccccgcagggcgaguucaccaucucucccaacaauaacccuggggagauucuguuugaacuugagcugggacccgaccucaauccuuaccuggcgcaccuucggcgcauguauaacggcuggacagggagcaugagagugcggguccugcucgccggaaaugcuuucuccgccggcaaagugguuguguuuugcgugcccccgggcuucgauaccucuuaccugacaccuagccaggcuacccaauuuccccauguccugaucgacgugcgcgccccugagcccgucgaaaugccccucgaggauguuagaaacauucuguuccaccaggggccugacucccggaugcgccuuaugggaaugcuguauacaccgcucagagccaauucuggcgcggaucccuuuguggugaccgggcggguccugacguguccuagccccaacuucuccuuuuucuuucuuggaccucccaccguggaagaacgcgagccgcuguucacacucccuaaucugcccguuaacaaucugagccauucuagagugauggaaccuaucgcucagaugauguccagccggucuuuccccgccuccguccaguuucaaaacggccgcugcacccucagcggggaccugcuuggaacaaccccuucuucccccgcugaucugggcgccuucgugggccucagagccgagccggggagccggguuguggaacugucccagccuaaucaggaggacuuucacgcuggaucugcgcccgcccccuucggcuuuccugauuucagcgacuguuccgucacguuuguggucgcuaacgccacaaccgugcaggaaugcacaguuaacacccgcaauccgcaaaacuucacccccgcccuugggcauaucacauuugacgaggaggcuccugccgaucuguucagagcgcgguuuagaaaucucugggaccccacggaacacagcuucuggcgcauuccugauuaccgggcugaggugcugggaucugacuuugcccccuccgucagcgccccuggcgugggggaaacccuccuguucuucauguguaacguucccagaucuaauggagcuaacccgaauccuugccccugucugcuuccucaggaguggaucacacacuuugugagcgaacgcgccgcucugcaguccgaugucgcccuccugaacuaugugaaucccaacaccggccgggugcuuuucgaggcgaagcuguacgccaauggcuuucucacaguuaaccugggggcuucugaccaagccacccugccggucgauggaauuuucaaauuugugagcuggguguccuucuauuaccagcucagaccugucggcaauacgagcguggggcgccgguga

SEQ ID NO: 30641 - RNA, 1548 nt, Artificial Sequence
  derived and/or modified sequence opt5 from VP1__Norovirus_and/or_Norovirus-like__AY126476
augaagaugaccgacagagauacaguggacagcgcccccgcucugggccagguccucccuccggagguugaagccuccgugcccguggagccuacggcgggggcucccgucgccgccccuaccgcuggacaagugaaccccaucgauccuuggauuuucgccaauuuuguucaggcuccgcagggcgaguucacaaucucucccaacaauaacccuggggagauucuguuugaacuugagcugggacccgaccucaauccuuaccuggcccaccuucggcgcauguauaacggcuggaccgggagcaugagagugcggguccugcucgcgggaaaugccuucuccgcuggcaaagugguuguguuuugcgugcccccgggcuucgauacaucuuaccugaccccuagccaggccacacaauuuccccauguccugaucgacgugcgcgcuccugagcccgucgaaaugccccucgaggauguuagaaacauucuguuccaccaggggccugacucccggaugcgccuuaugggaaugcuguauaccccgcucagagccaauucuggcgcggaucccuuuguggugacggggcggguccugaccuguccuagccccaacuucuccuuuuucuuucuugugccucccacaguugaagaacgcgagccgccuuucacccugcccaaucucccugugaacaaucugagccauucuagagucauggaacccaucgcccagaugauguccagccggucuuucccugcuuccgugcaguuucaaaacggacgcugcacacugagcggcgaccuccuggggaccacgcccucuuccccggccgaucuuggagcuuucguuggccugagagccgagccuggcagccggguggucgaacucucccagcccaaucaggaggacuuucacgccgggucugcucccgcgccuuucggauuuccggauuucagcgacuguuccgugacauuugucguggccagcgcuaccacaguucaggaaugcaccgugaacacccgcaaccugcaaaauuucacacccgcccuuggccauaucacguuugacgaggaggccccugcugaucuguucagagcccgguuuagaaaccucugggaccccaccgaacacucucuguggcgcauuccugauuaccgggcggagguccugggguccgacuucgcucccagcgugucugccccuggaguuggcgaaacacuccuguuuuucauguguaaugugcccagaagcaacggggccaauccgaacccuugccccugucuucugccucaggaguggaucacccacuucgucuccgaacgcgcugcccuccagucugauguggcucugcuuaauuaugugaaccccaauacaggacggguucuguuugaggccaagcucuacgcgagcggcuuccugaccgucaaccugggcgccuccgaccaagcuacgcucccgguggaugggauuuuuaaauucgugagcugggucucuuuuuauuaccagcugagaccugugggaaauacauccguuggccgccgguga

SEQ ID NO: 30642 - RNA, 1548 nt, Artificial Sequence
  derived and/or modified sequence opt5 from VP1__Norovirus_and/or_Norovirus-like__EU794905
augaagaugaccgacagagauacaaucgacagcgcccccgcucugggccaggugcucccuccggaggucgaagccuccguucccguggagccuacggcgggggcucccguggccgccccuaccgcuggacaagucaaccccauugauccuuggaucuucgccaauuuugugcaggcuccgcagggcgaauuuacaauuucucccaacaauaacccuggggagauccuguuugaacuugagcugggacccgaccucaauccuuaccuggcccaccuucggcgcauguauaacggcuggaccgggagcaugagaguucgggugcugcucgcgggaaaugccuucuccgcuggcaaagucgugguuuucugcgugcccccgggcuucgauacaucuuaccugaccccuagccaggccacacaauuuccccauguccugauugacgugcgcgcuccugagcccguggaaaugccccucgaggaugucagaaacauccuguuccaccaggggccugacucccggaugcgccuuaugggaaugcuguauaccccgcucagagccaauucuggcgcggaucccuuuguugugacggggcgggugcugaccuguccuagccccaacuucuccuuuuucuuucuugucccucccacaguggaggaacgcgagaccccguucacacugccuaaucuccccguuaacagccugucucauuccagagccauggaaccuaucgcucagaugaugagcucucggaauuuccccgccuccgugcaguuucaaaacggacgcugcacccugagcggcgaccuccuggggacgacaccuucuucccccgcugaugucggaaccuucgugggccuuauugccgagccgggcagccacguuguggaacugucccagccuaaucaggaggacuuucaugccgggucugcucccgcgcccuucggauuuccugauuucagcgacuguucccucacauuugucguggccagcgcuucuaccgucggcgaaagaaccgugaacacacgguccccgcagaacuucacgcccgcccuggggcacaucaccuuugacgaggaggccccugcugaucuuuuccgcgcccaccugagaaaucucugggaccccacagaacauagcuuuuggcggauuccugauuacagagcggacguucugggaggcgaguucgcucccucugugagcgccccuggggucggagaaacccugcucuuuuucaugugcaacgugccccgcuccaauggcgccaacccgaauccuugucccugccugcuuccucaagaguggaucacacacuucguuucugaacgggcugcccugcagagcgauguggcucuccugaacuauauuaaucccaacaccggcagaguccuuuuugaguguaagcuguacgccaauggguuccucacggugaaccugggagcguccgaccaggccacacugccgguggauggcaucuuuaaauucguuagcugggucucuuuuuauuaccaacuccgcccuguggggaauauuggagugggccggagauga

SEQ ID NO: 30643 - RNA, 1548 nt, Artificial Sequence
  derived and/or modified sequence opt5 from VP1__Norovirus_and/or_Norovirus-like__EU794906
augaagaugaccgacagagauacaaucgacagcgcccccgcucugggccaggugcucccuccggaggucgaagccuccguucccguggagccuacggcgggggcucccguggccgccccuaccgcuggacaagucaaccccauugauccuuggaucuucgccaauuuugugcaggcuccgcagggcgaauuuacaauuucucccaacaauaacccuggggagauccuguuugaacuugagcugggacccgaccucaauccuuaccuggcccaccuucggcgcauguauaacggcuggaccgggagcaugagaguucgggugcugcucgcgggaaaugccuucuccgcuggcaaagucgugguuuucugcgugcccccgggcuucgauacaucuuaccugaccccuagccaggccacacaauuuccccauguccugauugacgugcgcgcuccugagcccguggaaaugccccucgaggaugucagaaacauccuguuccaccaggggccugacucccggaugcgccuuaugggaaugcuguauaccccgcucagagccaauucuggcgcggaucccuuuguugugacggggcgggugcugaccuguccuagccccaacuucuccuuuuucuuucuugucccucccacaguggaggaacgcgagaccccguucacacugccuaaucuccccguuaacagccugucucauuccagagugauggaaccuaucgcccagaugaugagcucucggaauuuccccgcuuccguccaguuucaaaacggacgcugcacccugagcggcgaccuccuggggacgacaccuucuucccccgccgaucuuggaaccuucgugggccugauugcugagccgggcagccacguugccgaacucucccagccuaaucaggaggacuuucaugccgggucugcucccgcgcccuucggauuuccugauuucagcgaauguucccugacauuuguggucgccagcgcuucuaccgugggcgagagaaccgucaacacacggucccuucagaacuucacgccggcccuggggcacaucaccuuugacgaggaagcccccgcugaccucuuccgcgcccaccugagaaaucugugggauccuacagagcauagcuuuuggcggauucccgacuacagagcggaugugcucggaggcgaauuugcuccuucuguuagcgcccccggggugggagagacccugcuuuucuucaugugcaacgucccucgccugaauggcgccaaccccaauccguguccuugccuccugccccaagaauggaucacacacuucguguccgagcgggcugcccuucagucugacguugcucugcucaacuauauuaauccuaacaccggcagagugcuguuugaguguaagcuguacgucaauggguuccucacggugaaccugggagccagcgaucaggcgacacuucccguggacggcaucuuuaaauucguuuccugggucagcuuuuauuaccaacugcgcccgguggggaauauuggagugggccggagauga

SEQ ID NO: 30644 - RNA, 1548 nt, Artificial Sequence
  derived and/or modified sequence opt5 from VP1__Norovirus_and/or_Norovirus-like__AY126475
augaagaugaccgacagagauacagccgaccccgcuccugcccugggccaggugcucccgcccgaggucgaagcgagcguuccuguggagcccacggcuggggccccuguggccgcucccaccgccggacaagucaacccuaucgauccguggauuuucgcuaauuuugugcaggcgccccagggcgaauuuacaaucuccccuaacaauaaccccggggagauucuguuugaacuugagcugggaccugaccucaaucccuaccuggcccaccuucggcgcauguauaacggcuggaccgggucuaugagaguucgggugcugcucgccggaaaugcuuucagcgccggcaaagucgugguuuucugcgugccgccuggcuucgauacauccuaccugacccccucucaggcuacacaauuuccucauguccugaucgacgugcgcgugcccgagcccgucgaaaugccucucgaggauguuagaaacauucuguuccaccaggggccggacagccggaugcgccuuaugggaaugcuguauacgccccucagagccaauuccggcgcggauccuuuuguggugaccgggcggguccugaccugucccucuccuaacuucagcuuuuucuuucuugugcccccgacaguugaggaacgcgagccucccuucacccugccuaaucuccccgugaacaaucugucccauagcagagucauggaaccuaucgcccagaugaugucuucccggagcuuccccgcuucugugcaguuucaaaacggacgcugcacacuguccggcgaccuccuggggaccacgccgagcucuccugccgaucuuggagcuuucguuggccugaucgccgagcccggcuccagaguggucgaacucuuucagcccaaucaggaggacuuccacgccgggagcgcuccugcgccguuuggauuccccgauuuuuccgaauguucugugacauucgucgugagcuccgccaccacaguuggcgagcggaccgugaacgcucgcaaccagcaaaauuuuaccccugcccuggggcauauuacauucgacgaggaagcccccgcugaccuuuuuagagccugcuuccggaaccugugggagccuacggaacacagcuuuuggagaauccccgauuaccgcgcggacguccucggaucugauuucgcuccuuccgugagcgcccccggcguuggggagacccugcuguucuuuauguguaaugugccgcggcucaacggagucaauccuggccccugcccuugucugcuuccccaggaauggauuacacacuucgugucugagagagccgcucugcagagcgacguggcccuccugaacuauguuaauccgaacaccggccgcguccuuuuugaggcuaagcuguacgccaauggguuccucacagugaaccugggagcguccgaucaagccacccugccuguggacggcaucuuuaaauucgucucuugggugagcuuuuauuaccagcuccggcccguugggaauacguccgugggaagacgcuga

SEQ ID NO: 30645 - RNA, 1548 nt, Artificial Sequence
  derived and/or modified sequence opt5 from VP1__Norovirus_and/or_Norovirus-like__AF542084
augaagaugaccgacagagauacaguggacagcgcccccgcucugggccagguccucccuccggagguugaagccuccgugcccguggagccuacggcgggggcucccgucgccgccccuaccgcuggacaagugaaccccaucgauccuuggauuuucgccaauuuuguucaggcuccgcagggcgaguucacaaucucucccaacaauaacccuggggagauucuguuugaacuugagcugggacccgaccucaauccuuaccuggcccaccuucggcgcauguauaacggcuggaccgggagcaugagagugcggguccugcucgcgggaaaugccuucuccgcuggcaaagugguuguguuuugcgugcccccgggcuucgauacaucuuaccugaccccuagccaggccacacaauuuccccauguccugaucgacgugcgcgcuccugagcccgucgaaaugccccucgaggauguuagaaacauucuguuccaccaggggccugacucccggaugcgccuuaugggaaugcuguauaccccgcucagagccaauucuggcgcggaucccuuuguggugacggggcggguccugaccuguccuagccccaacuucuccuuuuucuuucuugugccucccacaguugaagaacgcgagccgcuguucacccucccuaaucugcccgugaacaaucugagccauucuagagucauggaaccuaucgcccagaugauguccagccggaacuuccccgcuucugugcaguuucaaaauggacgcugcacacucuccggcgaccugcuugggaccacgccuagcucucccgccgaucugggagcuuucguuggccucagagccgagccgggcucccggguggucgaacugagccagccuaaccaggaggacuuucacgccggguccgcucccgcgccccuuggauucccugauuuuucugacuguagcgugacauucgucguggccaacgcuaccacaguucaggaaugcaccgugaauacccgcaacccgcaaaauuuuacacccgcccugggccauaucacguucgacgaggaggccccugcugaucucuuuagagcccacuuccggaaccugugggaccccaccgaacacuccuuuuggcgcauuccugauuacagagcggagguccuggggagcgacuucgcucccucuguguccgccccuggaguuggcgaaacacuccuguuuuucauguguaaugugccccggagcaacggggccaauccgaacccuugccccugucuucugccucaggaguggaucacccauuucgucucugaaagagcugcccuccagagcgauguggcucugcuuaauuaugugaaccccaauacaggacgcguucuguuugaggccaagcucuacgcgaacggcuuccugaccgucaaucugggcgccuccgaccaagcuacgcucccgguggaugggauuuuuaaauucgugucuugggucagcuuuuauuaccagcugcggccugugggaaacacauccguuggcagacgcuga

SEQ ID NO: 30646 - RNA, 1536 nt, Artificial Sequence
  derived and/or modified sequence opt5 from VP1__Norovirus_and/or_Norovirus-like__KC695807
auggcccuggagcccguggucggcgcugccaucgcggcuccuguugccgggcagcaaaacgugauugacccguggaucagaaauaacuucgugcaggcccccggaggcgaauuuaccgucagcccucggaaugcucccggggagauucucugguccgccccucugggacccgaucuuaacccuuaccugucucaccucgcucgcauguauaauggcuacgccgggggauucgaagugcagguuauccuggcgggcaacgccuuuacagcuggcaaggugauuuucgccgcugucccgcccaauuuuccuacggaggggcuuagccccucccaggugaccauguucccucauaucguuguggacgucagacaacuggaacccgugcucaucccgcugccugaugugcggaacaauuuuuaucacuacaaccagucuaaugaccccacaauuaaacugaucgccaugcucuauaccccucugcgcgcgaacaaugccggagaugacgucuucacaguuagcugcagagugcuuacccggcccucccccgauuuugacuucauuuuucuggugccuccgacagucgagucucgcaccaagcccuucagcgugccuguucucacgguggaggaaaugaccaacuccagauuucccaucccucuggagaaacuuuucacaggccccagcucugcuuucgucgugcagccgcagaaugggcgguguaccacagauggaguucugcucggcaccacgcaacuguccccugugaacauuugcacauuucgcggggacgucacccauaucacaggaagcagaaacuacaccaugaaucuggccucucagaacuggaauaacuaugaucccaccgaagagauuccugcuccccucggcgccccugacuucgugggcaagauccaggggaugcugacacagacgacccgggccgauggauccacacgcggccacaaagcuaccgucuacacagggagcgcggacuuugcccccaagcugggaagagugcaauucgagaccgacacggaucaugacuuugaagcuaaucagaacacaaaguucaccccgguuggcgugauccaggaugggucuaccacacaccggaaugagccucaacaguggguccuucccuccuacagcggacgcaacacccacaaugugcaucucgcccccgccguugcuccuacauuuccgggcgaacagcugcuuuucuuuagauccacgaugcccggcuguucuggguauccuaacauggaccuggauugccuccugccccaggagugggugcaauacuucuaucaggaagccgcgccugcucagagcgacgucgcccugcuccgguuugugaaucccgauaccggaagagugcuguucgaguguaaacuucacaaguccggcuacguuacagucgcccauaccgggcagcacgaccuggugauuccucccaacggauauuuucgcuucgauagcugggugaaucaauucuacacacucgcuccgaugggcaacgggaccggccggagauga

SEQ ID NO: 30647 - RNA, 807 nt, Artificial Sequence
  derived and/or modified sequence opt5 from VP2_capsid_protein__Norovirus__AGL98415
auggccggcgcuuucuuugccgggcuggcgagcgacgugcucggauccggccuggggucucuuaucaacgcuggagccggcgccauuaaucagaaggucgaguucgaaaacaauagaaaacugcaacaggcuagcuuucaguucuccucuaaccuccagcaagccagcuuucagcacgauaaggagaugcugcaggcucagaucgacgccacccauaaacuucaacaggggcugaugcagauuaagcaggcgguucuccuggaaggaggcuucuccgccgcugaugccgcucggggcgccaucaaugcgcccaugacaaaagcccuggacuggucugggacgcgcuacugggcuccugaggccagagugaccacauauaacgcuggacacuuuagcccgucccaacccagccgggccccuucuggccgcauuaauuccgggacccccaccccugccagaaacagccucaauucucccgcuaccuccagcguggcgacaucuguccauuccaaccagaccgccagcacgcggaucggauccucugcuggcagcgggaccuccgugagcucucugccuuccacaagccgcaccagaaauuggguugaagaucagaaccggucugugagcccguucaugcgcggagcccuuaauacauccuuugucacacccccuucuagcagauccagcaaccaaucuacgguguccacaguucccaaggagauccuggacagcuggaccggcgccuucaauacacggcgccagccucucuuugcucacauuagacggcgcggcgagucuagaguguga

SEQ ID NO: 30648 - RNA, 792 nt, Artificial Sequence
  derived and/or modified sequence opt5 from VP2_capsid_protein__Norovirus__AGL98417
auggccggcgcuuucuuugccgggcuggcgagcgacgugcucggaaccggccuggggucccuuaucggagcuggcgccggggccauuaaccagaaggucgaguacgaaaauaacagaaaacugcaacaggcuucuuuccaguuuagcuccgaucuccagcaagccucuuuccagcacgacaaggauaugcugcaggcucagaucaaagccacacaaaaacuucagcaugaccugaugcggguuaagcaggcggugcuccuggagggaggcuuuagccccacggaugccgcucgcggcgccauuaaugcuccuaugaccaaggugcuggacugguccgggacaagauauugggccccgggagcgcgggucaccacaucuaacgccggccaguucagcuuuucccaacccauccgcgaaccuagcgggagaaccgcucccgcccggucuccugcuaaucgcgccuccagcgugucugcccccuccagcacacucucuaaccagaccacguccaccagacugggaacaagcgcuggcuccggggcgucuguuagcggauccagcucugccucccgggugcgcagcugggucgagggccagaauagaucucuuagcccuuucauggauggcgcucugcacaccuccuuugugacaccgcccucuagcaaguccagcucucaagggaccguuuccacggugccuaaagaaguccucgacagcuggacaggagccuucaacacccaucggcagccccuguuugcccacgugcgcagacagggcgagucucggguguga

SEQ ID NO: 30649 - RNA, 648 nt, Artificial Sequence
  derived and/or modified sequence opt5 from capsid_protein_VP2__Norovirus__AFI08232
auggcccaggcugugcugggcgccaucgcggcuaccgccgccgggagcgcugucggagccggcauucaagcugggacagaggccgcgcuccagcaccagagauuccagcaagaccugacgcuucaguccaacaccuuuaagcaugauaaagaaaugcuggccaugcagguugaggcuucuacaagccuccugcaaaauucccuuaacacccgguacaaucugcucacacaggccggacugaccucugcugacgccgcgcgcgccguggcuggcgcccccgugacaagagucguggauuggaacgggacccggaucgcugccccucugagcacggccaccacacuccgcuccggaggcuucaugucuauuccgguuauguauagaggcgcuaagaccgaacagcagaaacugacaggguuuagcaaucccaacuacgagaccggauccagcgugucucggacgucccagugggucagcucucaaaauuccaugcgcagcucuguggcgccuuuccaccccgacgcccuuagaacaaccuggguuacaccucccggcuccagcuccaccucuaccgugagcuccgcuagcucuaucccucgguuuuucaacacagaacgccugccgcucuuugccaauaacaagagauga

SEQ ID NO: 30650 - RNA, 807 nt, Artificial Sequence
  derived and/or modified sequence opt5 from capsid_protein_VP2__Norovirus__AFI08235
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaaggcccuggacuggucuggcacccgcuacugggcgccugaugccagaacaaccacauauaacgcugggcgguuuagcaccccgcagcccuccggagcccugccuggccgcauuaaucccagaacaccuacccccgcucgggggucuagcuccacgagcucuaacgccuccaccgccacaagcauccauucuaaucaaaccguuuccacacgccucggaagcaccgcuggcuccgggacgaacgugucuagccugccuuccacagcgagaacccggagcuggguggaggaccagaaucgcaaccuuucuccguucaugagaggagcccacaauaucuccuuugucacacccccuagcucucggagcuccucucagggcaccgugagcaccguucccaaagaggugcugaacuccuggacaggcgcuuucaauacgcgcagacaaccucucuuugcccauauucggcgccagggggaaagcagagucuga

SEQ ID NO: 30651 - RNA, 807 nt, Artificial Sequence
  derived and/or modified sequence opt5 from capsid_protein_VP2__Norovirus__AFI08238
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaagguucuggacuggucuggcacccgcuacugggccccugaugcgagaacaaccacauauaacgccgggcgguuuagcaccccgcagcccuccggaacacugccuggccgcauuaaucccagaaccccuacgcccgcucgggggucuagcuccaccagcucuaacgccuccacagcuaccagcauccauucuaaucaaacaguguccacccgccucggaagcacggccggcuccggggccaacgugucuagccugccuuccacagcuagaacccggagcugggucgaggaccagaaucgcaaccuuucuccguucaugagaggagcgcacaauaucuccuuugugacacccccuagcucucggagcuccucucagggcaccguuagcaccgugcccaaagagguccuggauuccugggccggcgcuuucaacacacgcagacaaccucucuuugcccauauucggcgcagaggggaaagccggguguga

SEQ ID NO: 30652 - RNA, 807 nt, Artificial Sequence
  derived and/or modified sequence opt5 from capsid_protein_VP2__Norovirus__AFI08241
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaagguucuggacuggucuggcacccgcuacugggccccugaugcgagaacaaccacauauaacgccgggcgguuuagcaccccgcagcccuccggaacacugccuggccgcaccaaucccagaacgccuacccccgcucgggggucuagcuccgccagcucuaacgcuuccacagccaccagcauucucucuaaucaaacagccuccacccgccugggaagcacggcuggcuccgggacaaacgugucuagccuuccuuccaccgcgagaacacggagcuggguggaggaccagaaucgcaaccugucuccguucaugagaggagcccauaauaucuccuuugucacacccccuagcucucggagcuccucucagggcaccgugagcaccguucccaaagaggugcucgauuccuggacgggcgcuuucaacacccgcagacaaccucuguuugcccacauccggcgcagaggggaaagccgggucuga

SEQ ID NO: 30653 - RNA, 807 nt, Artificial Sequence
  derived and/or modified sequence opt5 from capsid_protein_VP2__Norovirus__AFI08244
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaagguucuggacuggucuggcacccgcuacugggccccugaugcgagaacaaccacacauaacgccgggcgguuuagcaccccgcagcccuccggaacacugccuggccgcauuaaucccagaaccccuacgcccgcucgggggagcucuaacaccuccagcaaugccucuacagcuaccuccauccacagcaaccaaacagugucuacccgccucggauccacggccggcagcgggacaaauguguccucucugccuagcaccgccagaacacgguccugggucgaggaccagaaccgcaaucuuagcccguucaugagaggagcucauaacaucucuuuugugacacccccuuccagccggucuagcucccagggcaccguuucuaccgugcccaaagagguccuggauagcuggacgggcgcguucaauacccgcagacaaccucucuuugcccacauucggcgcagaggggaaucccggguguga

SEQ ID NO: 30654 - RNA, 807 nt, Artificial Sequence
  derived and/or modified sequence opt5 from capsid_protein_VP2__Norovirus__AFJ38520
auggccggccccuucuuugcugggcuggccagcgacgugcucggauccggccuggggucucuuaucaacgcgggagcuggcgccauuaaucagaaggucgaguucgaaaacaauagaaaacugcaacaggccagcuuucaguucuccucuaaccuccagcaagcuagcuuucagcacgauaaggagaugcugcaggcccagaucgaagcuacccaaaaacuucagcaggggcugaugaagguuaaacaggccgugcuccuggagggaggcuucuccacaacggacgcggcccggggcgcuauuaaugccccuaugaccaaggcucuggauuggucugggacacgcuacugggccccggacgcgagagccaccacauauaacgcuggacgguuuagcacaccccaaccucucggcgcccugcccgggcgcaucaauccuagagugcccgcuccugcccgguccagcccgucuucccuuagcaacgcccccaccgcuaccucugucuacuccaaucagacggugagcacccgccugggaucuuccgcgggcagcggggccggaguuuccucucucccuagcacagcuagaacccgguccuggguggaagaucagaaccgcaaucugagccccuucaugagaggcgcccuuaacacaucuuuugucaccccucccuccagccggucuagcaaucaaggcacgguguccacaguuccgaaggagauucuggacucuuggaccggggccuucaacacacgcagacagccucucuuugcucauauccggaaacgcggagagagcagaguguga

SEQ ID NO: 30655 - RNA, 765 nt, Artificial Sequence
  derived and/or modified sequence opt5 from capsid_protein_VP2__Norovirus__AFX71657
auggccggcgcuuucaucgccgggcuggcgggagacaugcucaccagcacagugggcucccuggucaacgcuggggccucugccauuaaucagaagguugauuuugagaacaauaaauaccuucaaaacgcuagcuucaaucacgacaaggaaaugcugaacgcccagaucgaggcuacgaaaagacuccaggccgauaugauugcgaucaagcagggagugcugaccgccggcggguuuucccccacagacgcugcccggggagcuauuaaugccccuaucacccgcgugcuugauuggucuggcacaagauauugggcgccgaacgccaccagcacaaccuccaugucuggcggguucacgagccaaaccguccaucggacaacccccaauuuuaaaacaaaccaggcuccuaaguccacccccagcucuggauccagcgugcgcucuaauuccacgcagcugacaagccucucuucccacagcuccggcucuagcagauccagcgggucuaccguuguguccagccugccuucuagcaaccggacacgcgacugggucaaucagcaaaacuucaaucuggaaccccauaugccuggaucccucagaaccgccuuugugaccccgcccucuagcacagcuuccaacagcgauacgguuucuaccgugccuaaguccguccuggacagcuggacaucugccuucaacacccggcgccagccccuuuuugcccaccugagacggcgcggcgaguccaauguguga

SEQ ID NO: 30656 - RNA, 780 nt, Artificial Sequence
  derived and/or modified sequence opt5 from capsid_protein_VP2__Norovirus__AFX71660
auggccggcgcuuucguggccgggcuggcgggagacguccucagcaacggccuguccucucuuaucaaugcuggggccaacgccauuaaucagagagcugaguuugauuucaaccaacggcugcagcagaauagcuuuaaccacgacaaggaaaugcuccaggcccaaauccaggcuaccaaacagcugcaggccgauaugauggcgauuaagcaaggaguucuuacagccggcggguucucccccacggacgcugcccgcggagcugugaaugccccuaugacccaggcgcuggauuggaacggcacaagauacugggccccgggcucuaugcggaccacaagcuauuccgggcgcuuuaccucuacagcucccgccagacaggcugacuuccagcacacccaaaaucggccuagcuccggaagcucuguguccagcuacacgacccagucuucccgccccacacucaccacaaccacgggcagcucucacgggacaaccuccagcaacuccacaagaucuaccaaucugagccaguccaccgucagccgggccacaucucgcacguccgagugggugagagaucaaaaccggaaucuggaaccuuauaugcauggagcccuccagaccgcuuuuguuacacccccuagcucucgcgcgagcgacggcaccguguccacagucccgaaaggggugcuggauucuuggacccccgccuucaacacgagacggcagccucuuuuugcucaucugcgcaagagaggagagagccggguuuga

SEQ ID NO: 30657 - RNA, 780 nt, Artificial Sequence
  derived and/or modified sequence opt5 from capsid_protein_VP2__Norovirus__AFX71666
auggccggcgcuuucuuugccgggcuggcgggagacguggucagcaacggcaucgggucccucauuaaugcuggagccaacgccguuaaucagaagguggaguacgauuucaacaaacaacugcagauggcuucuuuuaagcacgacaaagaaaugcuucagagccaggugcuggccaccaagcaacuccagcaggagaugaugaauaucagacagggcguccugacagcugggggauucucccccgccgaugcggcccggggcgcugugaacgccccuaugacgaaaauucuugacuggaauggcacccgcuauugggcuccgaacucuaugaagacaaccagcuacuccgggcaauuuucuagcucccccguucauagaccucccgccgcgccucagcacacagcucccccuaagagcaaacugcagggagauucuguguccgucuauagcucuccguccaccgugagcucucaguccacacauagcaccguucucuccgccggcacggggucuagccgguccaccagcacaucuaccgccgcuuccacacugagccgcaccucugacugggugagaggacaaaaugaacggcugagccccuucauggauggcgcccuccagacgacauuugucaccccucccuccucuaaggccagcuccaacgggacagugagcaccgugccuaaagcuguccuggacucuuggacccccacauucaauacgcaccgccagccgcuuuuugcgcaucugagacggcgcggagagucccaaaucuga

SEQ ID NO: 30658 - RNA, 807 nt, Artificial Sequence
  derived and/or modified sequence opt5 from capsid_protein_VP2__Norovirus__AFX71669
auggccggcgcuuucuuugccgggcuggcgagcgacgugcucggauccggccuggggucucuuaucaacgcuggagccggcgucauuaaucagaagguugauuucgagaacaauagaaaacugcaacaggccagcuuucaguucuccucuaaccagcaacaggcuagcuuucagcacgacaaggaaaugcuccaggcccaaaucgaggcuaccaaaaagcugcagcaggaaaugaugcgggugaaacaggccaugcuucuggaagggggauucuccgagacagaugcggcccgcggcgcuauuaaugcccccaugacgaaggcucucgacuggucuggcaccagauacugggccccugaugcgcggacaaccacauauaacgccgggcgcuuuagcaccccgcaacccuccggagcuagcccuggcagagccaaucugcgggcuacagugcccgcccgcgggucuuccagcaccucuuccaacagcucuaucgccacguccgucuacagcaaucagaccacauccaccagacugggaucuacagcuggcagcgggaccuccgugagcucucucccuuccacggcgcggacaaugagcuggguugaggaccagaaccgcaaucugucucccuucaugagaggagcccauaacauuagcuuugugaccccuccguccucucggagcuccagccaaggcacagucucuaccgugcccaaggagguucuugauuccuggaccggcgcuuucaauacacgcagacagccucuguuugcccacauccggaaacgcggggaaagcagaguguga

SEQ ID NO: 30659 - RNA, 807 nt, Artificial Sequence
  derived and/or modified sequence opt5 from capsid_protein_VP2__Norovirus__AFX81122
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaagguucuggacuggucuggcacccgcuacugggccccugaugcgagaacaaccacauauaacgccgggcgguuuagcaccccgcagcccuccggaacacugccuggccgcaccaaucccagaacgccuacccccgcucgggggucuagcuccacaagcucuaacgccuccaccgcuacaagcauucucucuaaucaaaccgccuccacgcgccugggaagcacagccggcuccgggaccaacgugucuagccuuccuuccacagcuagaacccggagcuggguggaggaccagaaucgcaaccugucuccguucaugagaggagcgcauaauaucuccuuugucacacccccuagcucucggagcuccucucagggcaccgugagcacgguucccaaagaggugcucgauuccuggaccggcgccuucaacacacgcagacaaccucuguuugcucacauccggcgcagaggggaaagccgggucuga

SEQ ID NO: 30660 - RNA, 807 nt, Artificial Sequence
  derived and/or modified sequence opt5 from capsid_protein_VP2__Norovirus__AFX81125
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaucaugaaagcgaagcaggccaugcuucucgaagggggauucuccgagacagaugcugcccggggcgcuauuaaugcccccaugacgaagguccuggacuggucuggcacccgcuacugggcgccugaugccagaacagcuaccuauaacgccgggcgguuuagcacaccgcagcccuccggaacccugccuggccgcaucaaucccagaacaccuacccccgcucgggggucuagcuccacgagcucuaacgccuccaccgccacaagcauccauucuaaucaaaccguuuccacacgccucggaagcaccgcuggcuccgggacgaacgugucuagccugccuuccacagcgagaacccggagcuggguggaggaccagaaucgcaaccuuucuccguucaugagaggagcccacaauauuuccuuugucacacccccuagcucucggagcuccucucagggcaccgugagcaccguucccaaagaggugcuggauuccuggacaggcgcuuucaacacgcgcagacaaccucucuuugcccauauccggcgcagaggggaaagccgggucuga

SEQ ID NO: 30661 - RNA, 807 nt, Artificial Sequence
  derived and/or modified sequence opt5 from capsid_protein_VP2__Norovirus__AFX81131
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaagucaugaaaguuaagcaggcgaugcuucucgaagggggauucuccgagacagaugccgcucggggcgccaucaaugcucccaugacgaaggugcuggacuggucuggcacccgcuacugggccccugaugcgagaacaaccacauauaacgccgggcgguuuagcaccccgcagcccuccggaacacugccuggccgcauuaaucccagaaccccuacgcccgcucgggggucuagcuccaccagcucuaacgccuccacagcuaccagcauccauucuaaucaaacaguguccacccgccucggaagcacggccggcuccgggacaaacgucucuagccugccuuccaccgccagaacacggagcuggguggaggaccagaaucgcaaccuuucuccguucaugagaggagcucacaauaucuccuuuguuacacccccuagcucucggagcuccucucagggcaccgugagcaccguccccaaagaggugcuggauuccuggacgggcgcguucaacacccgcagacaaccucucuuugcccauauucggcgcagaggggaaagccggguuuga

SEQ ID NO: 30662 - RNA, 807 nt, Artificial Sequence
  derived and/or modified sequence opt5 from capsid_protein_VP2__Norovirus__AFX81134
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaagguucuggacuggucuggcacccgcuacugggccccugaugcgagaacaaccacauauaacgccgggcgguuuagcaccccgcagcccuccggaacacugccuggccgcauuaaucccagaaccccuacgcccgcucgggggucuagcuccaccagcucuaacgccuccacagcuaccagcauccauucuaaucaaacaguguccacccgccucggaagcacggccggcuccgggacaaacgugucuagccugccuuccaccgccagaacacggagcugggucgaggaccagaaucgcaaccuuucuccguucaugagaggagcucacaauaucuccuuugugacacccccuagcucucggagcuccucucagggcaccguuagcaccgugcccaaagagguccuggauuccuggacgggcgcguucaacacccgcagacaaccucucuuugcccauauucggcgcagaggggaaagccggguguga

SEQ ID NO: 30663 - RNA, 807 nt, Artificial Sequence; identical to SEQ ID NO: 30662
  derived and/or modified sequence opt5 from capsid_protein_VP2__Norovirus__AFX81137

SEQ ID NO: 30664 - RNA, 807 nt, Artificial Sequence
  derived and/or modified sequence opt5 from capsid_protein_VP2__Norovirus__AFX81140
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaagguucuggacuggucuggcacccgcuacugggccccugaugcgagaacaaccacauauaacgccgggcgguuuagcaccccgcagcccuccggaacacugccuggccgcauuaaucccagaaccccuacgcccgcucgggggagcagcuccaccucuucuuccgccagcacagcuaccucuauccauuccaaccaaacagugagcacccgccucggauccacggccggcucugggacaaaugugagcucccugccuagcaccgccagaacacggucuugggucgaggaccagaaccgcaaucuuuccccguucaugagaggagcucacaacaucagcuuugugacacccccuucuagccgguccucuagccagggcaccguuuccaccgugcccaaagagguccuggauagcuggacgggcgcguucaauacccgcagacaaccucucuuugcccauauucggcgcagaggggaaucucggguguga

SEQ ID NO: 30665 - RNA, 807 nt, Artificial Sequence
  derived and/or modified sequence opt5 from capsid_protein_VP2__Norovirus__AFX81143
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaagguucuggacuggucuggcacccgcuacugggccccugaugcgagaacaaccacauauaacgccgggcgguuuagcaccccgcagcccuccggaacacugccuggccgcauuaaucccagaaucccuacccccgcucgggggucuagcuccacgagcucuaacgccuccaccgcuacaagcaucuacucuaaucaaaccguguccacacgccucggaagcaccgccggcuccgggacgaacgugucuagccugccuuccacagccagaacccggagcugggucgaggaccagaaucgcaaccuuucuccguucaugagaggagcucauaauauuuccuuugugacacccccuagcucucggagcuccucucagggcaccguuagcaccgugcccaaagagguccuggauuccuggacaggcgcguucaacacgcgcagacaaccucucuuugcccacauccggcgcagaggggaaagccggguguga

SEQ ID NO: 30666 - RNA, 807 nt, Artificial Sequence; identical to SEQ ID NO: 30662
  derived and/or modified sequence opt5 from capsid_protein_VP2__Norovirus__AFX81149

SEQ ID NO: 30667 - RNA, 807 nt, Artificial Sequence
  derived and/or modified sequence opt5 from capsid_protein_VP2__Norovirus__AFX81152
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggggaugaugaaagucaagcaggcgaugcuucucgaaggaggcuucuccgagacagaugccgcucggggcgccaucaaugcucccaugacgaagguucuggacuggucugggacccgcuacugggccccugaugcgagaacaaccacauauaacgccggacgguuuagcaccccgcagcccuccggcacacugccugggcgcauuaaucccagaaccccuacgcccgcucggggaucuagcuccaccagcucuaacgccuccacagcuaccagcauccauucuaaucaaacaguguccacccgccucggcagcacggccggguccggaacaaacgugucuagccugccuuccaccgccagaacacggagcugggucgaagaccagaaucgcaaccuuucuccguucaugagaggcgcucacaauaucuccuuugugacacccccuagcucucggagcuccucucagggcaccguuagcaccgugcccaaagagguccuggauuccuggacgggggcguucaacacccgcagacaaccucucuuugcccauauucggcgcagaggagagagccggguguga

SEQ ID NO: 30668 - RNA, 807 nt, Artificial Sequence
  derived and/or modified sequence opt5 from capsid_protein_VP2__Norovirus__AFX81155
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaagguucuggacuggucuggcacccgcuacugggccccugaugcgagaacaaccacauauaacgccgggcgguuuagcaccccgcagcccuccggaacacugccuggccgcauuaaucccagaaccccuacgcccgcucgggggucuagcuccaccagcucuaacgccuccacagcuaccagcauccauucuaaucaaacaguguccacccgccucggaagcacggccggcuccgggacaaacgugccuucucugccgagcaccgccagaacacgguccugggucgaggaccagaaucgcaaccuuagccccuucaugagaggagcucagaauaucucuuuugugaccccucccuccagccggucuagcucccaaggcaccguuucuacagugccuaaagagguccuggauagcuggacgggcgcguucaacacccgcagacagccccucuuugcccacauucggcgcagaggggaaucccggguguga

SEQ ID NO: 30669 - RNA, 807 nt, Artificial Sequence
  derived and/or modified sequence opt5 from capsid_protein_VP2__Norovirus__AFX81158
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaagguucuggacuggucuggcacccgcuacugggccccugaugcgagaacaaccacauauaacgccgggcgguuuagcaccccgcagcccuccggaacacugccuggccgcauuaaucccagaacccucacgccugcucgggggucuagcuccaccagcucuaacgccuccacagcuaccagcauccauucuaaucaaacaguguccacccgccugggaagcacggccggcuccgggacaaacgugucuagccuucccuccaccgccagaacacggagcugggucgaggaccagaaucgcaaccugucuccuuucaugagaggagcucacaauaucuccuuugugaccccgcccagcucucggagcuccucucagggcaccguuagcacagugccuaaagagguccucgauuccuggacgggcgcguucaacacccgcagacaaccccuguuugcccauauucggcgcagaggggaaagccggguguga

SEQ ID NO: 30670 - RNA, 807 nt, Artificial Sequence
  derived and/or modified sequence opt5 from capsid_protein_VP2__Norovirus__AFX81164
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaagguucuggacuggucuggcacccgcuacugggccccugaugcgagaacaaccacauauaacgccgggcgguuuagcaccccgcagcccuccggaacacugccuggccgcauuaaucccagaaccccuacgcccgcucgggggucuagcuccaccagcucuaacgccuccacagcuaccagcaucuacucuaaucaaacaguguccacccgccucggaagcacggccggcuccgggacaaacgugucuagccugccuuccaccgccagaacacggagcugggucgaggaccagaaucgcaaccuuucuccguucaugagaggagcucauaauaucuccuuugugacacccccuagcucucggagcuccucucagggcaccguuagcaccgugcccaaagagguccuggauuccuggacgggcgcguucaacacccgcagacaaccucucuuugcccacauucggcgcagaggggaaagccggguguga

SEQ ID NO: 30671 - RNA, 807 nt, Artificial Sequence; identical to SEQ ID NO: 30662
  derived and/or modified sequence opt5 from capsid_protein_VP2__Norovirus__AFX81173

SEQ ID NO: 30672 - RNA, 807 nt, Artificial Sequence; identical to SEQ ID NO: 30662
  derived and/or modified sequence opt5 from capsid_protein_VP2__Norovirus__AFX81179

SEQ ID NO: 30673 - RNA, 807 nt, Artificial Sequence; identical to SEQ ID NO: 30670
  derived and/or modified sequence opt5 from capsid_protein_VP2__Norovirus__AFX81182

SEQ ID NO: 30674 - RNA, 807 nt, Artificial Sequence
  derived and/or modified sequence opt5 from capsid_protein_VP2__Norovirus__AFX81185
auggccggcgcuuucuuugccgggcuggcgagcgacgugcucggauccggccuggggucucuuaucaacgcuggagccggcgccauuaaucagaaggucgauuucgagaacaauagaaaacugcaacaggcuagcuuucaguucuccucuaaccuccagcaagccagcuuucagcacgacaaggaaaugcugcaggcucagaucgaggccaccaaaaagcugcaacaggaaaugaugaaaguuaagcaggcgaugcuucucgaagggggauucuccgagacagaugccgcucggggcgccauuaaugcucccaugacgaaggugcuggacuggucuggcacccgcuacugggccccugaugcgagaacaaccacauauaacgccgggcgguuuagcaccccgcagcccuccggaacacugccuggccgcaucaaucccagaaccccuacgcccgcucgggggucuagcuccaccagcucuaacgccuccacagcuaccagcauucauucuaaucaaacaguguccacccgccucggaagcacggccggcuccgggacaaacgucucuagccugccuuccaccgccagaacacggagcuggguggaggaccagaaucgcaaccuuucuccguucaugagaggagcucacaauaucuccuuuguuacacccccuagcucucggagcuccucucagggcaccgugagcaccguccccaaagaggugcuggauuccuggacgggcgcguucaacacccgcagacaaccucucuuugcccauauccggcgcagaggggaaagccggguuuga

SEQ ID NO: 30675 - RNA, 807 nt, Artificial Sequence; identical to SEQ ID NO: 30662
  derived and/or modified sequence opt5 from capsid_protein_VP2__Norovirus__AFX81188

SEQ ID NO: 30676 - RNA, 807 nt, Artificial Sequence; identical to SEQ ID NO: 30662
  derived and/or modified sequence opt5 from capsid_protein_VP2__Norovirus__AFX81191

SEQ ID NO: 30677 - RNA, 807 nt, Artificial Sequence
  derived and/or modified sequence opt5 from capsid_protein_VP2__Norovirus__AFX81194
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaagguucuggacuggucuggcacccgcuacugggccccugaugcgagaacaaccacauauaacgccgggcgguuuagcaccccgcagcccuccggaacacugccuggccgcgugaaucccagaaccccuacgcccgcucgggggucuagcuccaccagcucuaacgccuccauugcuacaagcaucuacucuaaucaaaccguguccacacgccucggaagcaccgccggcuccgggacgaacgucucuagccugccuuccacagccagaacccggagcuggguggaggaccagaaucgcaaccuuucuccguucaugagaggagcucauaauaucuccuuuguuacacccccuagcucucggagcuccucucagggcaccgugagcaccguccccaaagaggugcuggauuccuggacaggcgcguucaacacgcgcagacaaccucucuuugcccacauucggcgcagaggggaaagccggguuuga

SEQ ID NO: 30678 - RNA, 807 nt, Artificial Sequence; identical to SEQ ID NO: 30662
  derived and/or modified sequence opt5 from capsid_protein_VP2__Norovirus__AFX81197

SEQ ID NO: 30679 - RNA, 807 nt, Artificial Sequence
  derived and/or modified sequence opt5 from capsid_protein_VP2__Norovirus__AFX81200
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaagguucuggacuggucuggcacccgcuacugggccccugaugcgagaacaaccacauauaacgccgggcgguuuagcaccccgcagcccuccggaacacugccuggccgcauuaaucccagaaccccuacgcccgcucgggggucuagcuccaccagcucuaacguguccacagccaccagcaucuaccucaaucaaacagugucuacccgccugggauccacggcuggcagcgggacaaacgucuccucucuuccuagcaccgccagaacacgguccuggguggaggaccagaaucgcaaccugagcccguucaugagaggagcccauaauaucucuuuuguuacacccccuuccagccggucuagcucccagggcaccgugucuaccguccccaaagaggugcucgauagcuggacgggcgcuuucaacacccgcagacaaccucuguuugcgcacauucggcgcagaggggaaucccggguuuga

SEQ ID NO: 30680 - RNA, 807 nt, Artificial Sequence; identical to SEQ ID NO: 30670
  derived and/or modified sequence opt5 from capsid_protein_VP2__Norovirus__AFX81203

SEQ ID NO: 30681 - RNA, 807 nt, Artificial Sequence
  derived and/or modified sequence opt5 from capsid_protein_VP2__Norovirus__AFX81206
auggccggcgcuuucuuugccgggcuggcgagcgacgugcucggauccggccugucuagccuuaucaacgcuggggccggagccauuaaucagaagaucgauuucgagaacaauagaaaacugcaacaggcuuccuuucaguucucuagcaaccuccagcaagccuccuuucagcacgacaaggaaaugcugcaggcucagauugaggccaccaaaaagcugcaacaggaaaugaugaaagucaagcaggcgaugcuucucgagggcggguucucugaaacagaugccgcucggggagccguuaaugcucccaugacgaaggugcuggacuggagcggcacccgcuacugggccccugaugcgagaacaaccacauauaacgccggccgguuuuccaccccgcagcccagcgggacacugccuggacgcaucaaucccagaaccccuacgcccgcucgggggucuuccagcaccucuuccaacgccagcacagcuaccucuauuuacuccaaucaaacagugagcacccgccucggcuccacggccggaucuggcacaaacgucagcucccugccuagcaccgccagaacacggucuuggguggaggaccagaaucgcaaccuuuccccguucaugagaggggcucauaauaucagcuuuguuacacccccuucuagccgguccucuagccagggaaccguguccaccguccccaaagaggugcuggauagcuggacgggcgcguucaacacccgcagacaaccucucuuugcccacauccggcgcagaggcgaaucucggguuuga

SEQ ID NO: 30682 - RNA, 807 nt, Artificial Sequence; identical to SEQ ID NO: 30670
  derived and/or modified sequence opt5 from capsid_protein_VP2__Norovirus__AFX81209

SEQ ID NO: 30683 - RNA, 807 nt, Artificial Sequence
  derived and/or modified sequence opt5 from capsid_protein_VP2__Norovirus__AFX81212
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaagguucuggacuggucuggcacccgcuacugggccccugaugcgagaacaaccacauauaacgccgggcgguuuagcaccccgcagcccuccggaacacugccuggccgcauuaaucccagaaccccuacgcccgcucgggggucuagcuccaccacaagcaacgccucuaccgcuacauccauccauagcaaucaaaccgugucuacgcgccucggauccacagccggcagcgggaccaacguguccucucugccuagcacagccagaacccgguccugggucgaggaccagaaucgcaaccuuagcccguucaugagaggagcucacaauaucucuuuugugacacccccuuccagccggucuagcucccagggcaccguuucuacggugcccaaagagguccuggauagcuggaccggcgcguucaacacacgcagacaaccucucuuugcccauauucggcgcagaggggaaucccggguguga

SEQ ID NO: 30684 - RNA, 807 nt, Artificial Sequence
  derived and/or modified sequence opt5 from capsid_protein_VP2__Norovirus__AFX81215
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccguuaaugcucccaugacgaaggugcuggacuggucuggcacccgcuacugggccccugaugcgagaacaaccacauauaacgccgggcgguuuagcaccccgcagcccuccggaacacugccuggccgcaucaaucccagaaccccuacgcccgcucgggggucuagcuccaccagcucuaacgccccuauugcuacauccaucuacagcaaucaaaccgugucuacacgccucggauccaccgccggcagcgggacgaacgucuccucucugccgagcacagccagaacccgguccuggguggaggaccagaaucgcaaccuuagccccuucaugagaggagcucauaauaucucuuuuguuacaccucccuccagccggucuagcucccagggcaccgugucuaccgucccuaaagaggugcuggauagcuggacaggcgcguucaacacgcgcagacaaccccucuuugcccacauucggcgcagaggggaaucccggguuuga

SEQ ID NO: 30685 - RNA, 807 nt, Artificial Sequence; identical to SEQ ID NO: 30670
  derived and/or modified sequence opt5 from capsid_protein_VP2__Norovirus__AFX81218

SEQ ID NO: 30686 - RNA, 807 nt, Artificial Sequence
  derived and/or modified sequence opt5 from capsid_protein_VP2__Norovirus__AFX81221
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaagguucuggacuggucuggcacccgcuacugggccccugaugcgagaacaaccacauauaacgccgggcgguuuagcaccccgcagcccuccggaacacugccuggccgcauuaaucccagaaccccuacgcccgcucgggggagcccuucuaccuccagcaacgccucuacagcuaccuccaucuacagcaaucaaacagugucuacccgccucggauccacggccggcagcgggacaaacguguccucucugccgagcaccgccagaacacgguccugggucgaggaccagaaucgcaaccuuagccccuucaugagaggagcucauaauaucucuuuugugaccccucccuccagccggucuagcucccagggcaccguuucuacagugccuaaagagguccuggauagcuggacgggcgcguucaacacccgcagacaaccccucuuugcccacauucggcgcagaggggaaucccggguguga

SEQ ID NO: 30687 - RNA, 807 nt, Artificial Sequence; identical to SEQ ID NO: 30670
  derived and/or modified sequence opt5 from capsid_protein_VP2__Norovirus__AFX81224

SEQ ID NO: 30688 - RNA, 807 nt, Artificial Sequence; identical to SEQ ID NO: 30670
  derived and/or modified sequence opt5 from capsid_protein_VP2__Norovirus__AFX81227

SEQ ID NO: 30689 - RNA, 807 nt, Artificial Sequence
  derived and/or modified sequence opt5 from capsid_protein_VP2__Norovirus__AFX81230
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucugaccuccagcaagccagcuuucagcacgauaaggaaaugcugcaggcucagauugaggccaccaaaaagcugcaacaggaaaugaugaaagucaagcaggcgaugcuucucgaagggggauucuccgagacagacgccgcucggggcgccaucaacgcucccaugacgaagguucuggauuggucuggcacccgcuacugggccccugacgcgagaacaaccacauauaaugccgggcgguuuagcaccccgcagcccuccggaacacugccuggccgcauuaaccccagaaccccugcucccgcccgggggucuagcuccacgagcucuaaugcuuccaccgccacaagcaucuacucuaaccaaaccguguccacacgccucggaagcaccgccggcuccgggacgaaugugucuagccugccuuccacagcuagaacccggagcugggucgaggaucagaaccgcaaucuuucuccguucaugagaggagcgcauaacaucuccuuugugacacccccuagcucucggagcuccucucagggcaccguuagcaccgugcccaaagagguccuggacuccuggacaggcgccuucaauacgcgcagacaaccucucuuugcucacauucggcgcagaggggaaagccggguguga

SEQ ID NO: 30690 - RNA, 807 nt, Artificial Sequence
  derived and/or modified sequence opt5 from capsid_protein_VP2__Norovirus__AFX81233
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugcgggucaaacaggcgaugcuucucgaagggggauucuccgagacagaugccgcucgcggcgccaucaaugcucccaugacgaagguucuggacuggucuggcaccagauacugggccccugaugcgcggacaaccacauauaacgccgggcgcuuuagcaccccgcagcccuccggaacacugccuggcagaauuaauccccggaccccuacgcccgcucgcgggucuagcuccaccagcucuaacguguccacagccaccagcaucuacucuaaucaaacauucuccaccagacucggaagcacggcuggcuccgggacaaacgugucuagccugccuuccaccgcccggacacgcagcugggucgaggaccagaauagaaaccuuucuccguuuaugcggggagcccauaauaucuccuucgugacacccccuagcucucgcagcuccucucagggcaccguuagcaccgugcccaaggagguccuggauuccuggacgggcgcuuuuaacaccagacggcaaccucucuucgcgcacauucgcagaagaggggaaagccggguguga

SEQ ID NO: 30691 - RNA, 807 nt, Artificial Sequence
  derived and/or modified sequence opt5 from capsid_protein_VP2__Norovirus__AFX81239
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaagguucuggacuggucuggcacccgcuacugggccccugaugcgagaacaaccacauauaacgccgggcgguuuagcaccccgcagcccuccggaacacugccuggccgcauuaaucccagaaccccuacgcccgcucgggggucuagcuccaccagcucuaacguguccacagccaccagcaucuacucuaaucaaacagcuuccacccgccucggaagcacggccggcuccgggacaaacgugucuagccugccuuccaccgccagaacacggagcugggucgaggaccagaaucgcaaccuuucuccguucaugagaggagcucauaauaucuccuuugugacacccccuagcucucggagcuccucucagggcaccguuagcaccgugcccaaagagguccuggauuccuggacgggcgcguucaacacccgcagacaaccucucuuugcccacauucggcgcagaggggaaagccggguguga

SEQ ID NO: 30692 - RNA, 807 nt, Artificial Sequence
  derived and/or modified sequence opt5 from capsid_protein_VP2__Norovirus__AFX81242
auggccggcgcuuucuuugccgggcuggcgagcgacgugcucggauccggccuggggucucuuaucaacgcuggagccggcgccauuaaucagaaggucgaguucgaaaacaauagaaaacugcaacaggcuagcuuucaguucuccucuaaccuccagcaagccagcuuucagcacgauaaggagaugcugcaggcucagaucgaagccaccaaaaagcugcaacaggagaugaugcggguuaaacaggcgaugcuucucgaagggggauucuccgagacagacgccgcucgcggcgccauuaaugcucccaugacgaagacccuggauuggacaggcaccagauacugggccccugacgcgcggacaaccacauauaacgccgggcgcuuuucuaccccgcagcccagcggagcucugccuggcagagccaaucuccgggcuacggugcccgcccgcggguccagcucuaccuucuccaacagcucuaucgccacauccguguacagcaaucaaaccacaucuaccagacugggauccacggcuggcagcgggacauccgucucuagccuuccuuccaccgcgcggacacgcagcuggguggaggaucagaacagaaaucugucucccuuuaugcggggagcccauaacauuuccuucguuaccccuccgagcucucgcagcuccucucagggcaccgugagcacaguccccaaggaagugcucgacuccuggacgggcgcuuuuaauaccagacggcaaccucuguucgcccacauccgcaaaagaggggagagccggguuuga

SEQ ID NO: 30693 - RNA, 807 nt, Artificial Sequence
  derived and/or modified sequence opt5 from capsid_protein_VP2__Norovirus__AFX81245
auggccggcgcuuucuuugccgggcuggcgagcgacgugcucggauccggccuggggucucuuaucaacgcuggagccggcgccauuaaucagaaggucgaguucgaaaacaauagaaaacugcaacaggcuagcuuucaguucuccucuagccuccagcaagccuccuuucagcacgauaaggagaugcugcaggcucagaucgaagccaccaaaaagcugcaacaggagaugaugcggguuaaacaggcgaugcuucucgaagggggauucucugagacagacgccgcucgcggcgccauuaacgcucccaugacgaagacccuggauuggagcggcacaagauacugggccccugacgcgcggaccacaaccuauaaugccgggcgcuuuuccacaccgcagcccagcggagcucugccuggcagagccaaccuccgggcuaccgugcccgcccgcgggucuuccagcacgucuuccaauagcucuaucgccaccuccguguacagcaaccaaacaaccuccacaagacugggaucuaccgcuggcagcgggacguccgucagcucucuuccuuccacagcgcggacccgcagcuggguggaggaucagaauagaaaccugucucccuucaugcggggagcccauaauauuagcuuuguuacaccuccguccucucgcagcuccagccagggcaccgugucuaccguccccaaggaagugcucgacuccuggacaggcgcuuucaacacgagacggcaaccucuguuugcccacauccgcaaaagaggggagagccggguuuga

SEQ ID NO: 30694 - RNA, 807 nt, Artificial Sequence
  derived and/or modified sequence opt5 from capsid_protein_VP2__Norovirus__AFX81248
auggccggcgcuuucuuugccgggcuggcgagcgacgugcucggauccggccuggggucucuuaucaacgcuggagccggcgccauuaaucagaaggucgaguucgaaaacaauagaaaacugcaacaggcuagcuuucaguucuccucuaaccuccagcaagccagcuuucagcacgauaaggagaugcugcaggcucagaucgaagccacccggaaacuucaacaggagaugaugcgcguuaagcaggcgaugcugcucgaagggggauucuccgagacagacgccgcuagaggcgccauuaaugcucccaugacgaaaacccuggauuggucuggcacacgguacugggccccugacgcgcgcaccacaaccuauaacgccgggagauuuagcacaccgcagcccuccggagcucugccuggccgggccaaucuccgcgcuaccgugcccgccagagggucuagcuccacguucagcaacucuuccaucgccaccagcguguacucuaaucaaacaaccuccacacggcugggaagcaccgcuggcuccgggacgucugucagcucccuuccuagcacagcgcgcaccagaucuuggguggaggaucagaaccggaaucugucccccuuuaugcgcggagcccauaacauuagcuucguuacaccuccgucuagcagauccucuagccagggcaccguguccaccguccccaaggaagugcucgacagcuggacaggcgcuuuuaauacgcggcgccaaccucuguucgcccacaucagaaagagaggggagucucggguuuga

SEQ ID NO: 30695 - RNA, 807 nt, Artificial Sequence
  derived and/or modified sequence opt5 from capsid_protein_VP2__Norovirus__AFX81251
auggccggcgcuuucuuugccgggcuggcgagcgacgugcucggauccggccuggggucucuuaucaacgcuggagccggcgccauuaaucagaaggucgaguucgaaaacaauagaaaacugcaacaggcuagcuuucaguucuccucuaaccuccagcaagccagcuuucagcacgauaaggagaugcugcaggcucagaucgaagccaccaaaaagcugcaacaggagaugaugcggguuaaacaggcgaugcuucucgaagggggauucuccgagacagacgccgcucgcggcgccauuaaugcucccaugacgaagacccuggauuggucuggcacaagauacugggccccugacgcgcggaccacaaccuauaacgccgggcgcuuuagcacaccgcagcccuccggagcucugccuggcagagccaaucuccgggcuaccgugcccgcccgcgggucuagcuccacguucagcaacucuuccaucgccaccagcguguacucuaaucaaacaaccuccacaagacugggaagcaccgcuggcuccggggcgucugucagcucccuuccuagcacggcccggacacgcucuuggguggaggaucagaacagaaaucugucccccuuuaugcggggagcucauaacauuagcuucguuaccccuccgucuagccgcuccucuagccagggcacaguguccaccguccccaaggaagugcucgacagcuggaccggcgccuuuaauacaagacggcaaccucuguucgcccacauccgcaaaagaggggagucucggguuuga

SEQ ID NO: 30696 - RNA, 807 nt, Artificial Sequence
  derived and/or modified sequence opt5 from capsid_protein_VP2__Norovirus__AFX81254
auggccggcgcuuucuuugccgggcuggcgagcgacgugcucggauccggccuggggucucuuaucaacgcuggagccggcgccauuaaucagaccgucgaguucgaaaacaauagaaagcugcaacaggcuagcuuucaguucuccucuaaccuccagcaagccagcuuucagcacgauaaagagaugcugcaggcucagaucgaagccacaaagaaacuucaacaggagaugaugcggguuaagcaggcgaugcugcucgaagggggauucuccgagacggacgccgcucgcggcgccauuaaugcucccaugaccaaaacacuggauuggaccggcacaagauacugggccccugacgcgcggaccacaaccuauaacgccgggcgcuuuucuacgccgcagcccagcggagcucugccuggcagagccaaucuccgggcuaccgugcccgcccgcggguccagcucuacauucuccaacagcucuaucgccaccuccguguacagcaaucaaacaaccucuacgagacugggauccacagcuggcagcgggaccuccgucucuagccuuccuuccacagcgcggacccgcagcuggguggaggaucagaacagaaaucugucucccuuuaugcggggagcccauaacauuuccuucguuaccccuccgagcucucgcagcuccucucagggcacagugagcacgguccccaaggaagugcucgacuccuggaccggcgcuuuuaauacaagacggcaaccucuguucgcccacauccgcaagagaggggagagccggguuuga

SEQ ID NO: 30697 - RNA, 807 nt, Artificial Sequence
  derived and/or modified sequence opt5 from capsid_protein_VP2__Norovirus__AFX81257
auggccggcgcuuucuuugccgggcuggcgagcgacgugcucggauccggccuggggucucuuaucaacgcuggagccggcgccauuaaucagaaggucgaguucgaaaacaauagaaaacugcaacaggcuagcuuucaguucuccucuagccuccagcaagccuccuuucagcacgauaaggagaugcugcaggcucagaucgaagccaccaaaaagcugcaacaggagaugaugcggguuaaacaggcgaugcuucucgaagggggauucucugagacagacgccgcucgcggcgccauuaacgcucccaugacgaagacccuggauuggagcggcacaagauacugggccccugacgcgcggaccacaaccuauaaugccgggcgcuuuuccacaccgcagcccagcggagcucugccuggcagagccaaccuccgggcuaccgugcccgcccgcgggucuuccagcacgucuuccaauagcucuaucgccaccuccguguacagcaaccaaacaaccuccacaagacugggaucuaccgcuggcagcgggacguccgucagcucucauccuuccacagcgcggacccgcagcuggguggaggaucagaauagaaaccuuucucccuucaugcggggagcccacaauauuagcuuuguuacaccuccguccucucgcagcuccagccagggcaccgugucuaccguccccaaggaagugcuggacuccuggacaggcgcuuucaacacgagacggcaaccucucuuugcccauauccgcaaaagaggggagagccggguuuga

SEQ ID NO: 30698 - RNA, 807 nt, Artificial Sequence
  derived and/or modified sequence opt5 from capsid_protein_VP2__Norovirus__AFX81260
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaagguucuggacuggucuggcacccgcuacugggccccugaugcgagaacaaccacauauaacgccgggcgguuuagcaccccgcagcccuccggaacacugccuggccgcauuaaucccagaaccccuacgcccgcucgggggucuagcuccaccagcucuaacgccuccacagcuaccagcauccauucuaaucaaacaguguccacccgccucggaagcacggccggcuccgggacaaacgugucuagccugccuuccaccgccagaacacggagcugggucgaggaccagaaucgcaaccuuucuccguucaugagaggagcucacaauaucuccuuugugacacccccuagcucucggagcuccucucagggcaccguuagcaccgugcccaaagagguccuggauuccuggacgggcgcguucaacacccgcagacaaccucucuuugcccauacacggcgcagaggggaaagccggguguga

SEQ ID NO: 30699 - RNA, 807 nt, Artificial Sequence; identical to SEQ ID NO: 30670
  derived and/or modified sequence opt5 from capsid_protein_VP2__Norovirus__AFX81263

SEQ ID NO: 30700 - RNA, 807 nt, Artificial Sequence; identical to SEQ ID NO: 30670
  derived and/or modified sequence opt5 from capsid_protein_VP2__Norovirus__AFX81269

SEQ ID NO: 30701 - RNA, 807 nt, Artificial Sequence; identical to SEQ ID NO: 30662
  derived and/or modified sequence opt5 from capsid_protein_VP2__Norovirus__AFX81272

SEQ ID NO: 30702 - RNA, 807 nt, Artificial Sequence; identical to SEQ ID NO: 30670
  derived and/or modified sequence opt5 from capsid_protein_VP2__Norovirus__AFX81275

SEQ ID NO: 30703 - RNA, 807 nt, Artificial Sequence; identical to SEQ ID NO: 30670
  derived and/or modified sequence opt5 from capsid_protein_VP2__Norovirus__AFX81278

SEQ ID NO: 30704 - RNA, 807 nt, Artificial Sequence
  derived and/or modified sequence opt5 from capsid_protein_VP2__Norovirus__AFX81281
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaagguucuggacuggucuggcacccgcuacugggccccugaugcgagaacaaccacauauaacgccgggcgguuuagcaccccgcagcccuccggagcucugccuggccgcauuaaucccagaacaccuacccccgcccgggggucuagcuccacgagcucuaacgcuuccaccgccacaagcauccauucuaaucaaaccguguccacacgccucggaagcaccgccggcuccgggacgaacgugucuagccugccuuccacagcuagaacccggagcugggucgaggaccagaaucgcaaccuuucuccguucaugagaggagcgcacaauaucuccuuugugacacccccuagcucucggagcuccucucagggcaccguuagcaccgugcccaaagagguccuggauuccuggacaggcgccuucaacacgcgcagacaaccucucuuugcucauauucggcgcagaggggaaagccggguguga

SEQ ID NO: 30705 - RNA, 807 nt, Artificial Sequence; identical to SEQ ID NO: 30670
  derived and/or modified sequence opt5 from capsid_protein_VP2__Norovirus__AFX81284

SEQ ID NO: 30706 - RNA, 807 nt, Artificial Sequence
  derived and/or modified sequence opt5 from capsid_protein_VP2__Norovirus__AFX81287
auggccggcgcuuucuuugccgggcuggcgagcgacgugcucggauccggccugucuagccuuaucaacgcuggggccggagccauuaaucagaagaucgauuucgagaacaauagaaaacugcaacaggcuuccuuucaguucucuagcaaccuccagcaagccuccuuucagcacgacaaggaaaugcugcaggcucagauugaggccaccaaaaagcugcaacaggaaaugaugaaagucaagcaggcgaugcuucucgagggcggguucucugaaacagaugccgcucggggagccaucaaugcucccaugacgaagguucuggacuggagcggcacccgcuacugggccccugaugcgagaacaaccacauauaacgccggccgguuuuccaccccgcagcccagcgggacacugccuggacgcauuaaucccagaaccccuacgcccgcucgggggucuuccagcaccucuuccaacgccccuacagcuaccagcauccauucuaaucaaacaguguccacccgccucggcagcacggccggauccggcacaaacgugucuagccugccguccaccgccagaacacggagcugggucgaggaccagaaucgcaaccuuucucccuucaugagaggggcucacaauaucuccuuugugaccccucccagcucucggagcuccucucagggaaccguuagcacagugccuaaagagguccuggauuccuggacgggcgcguucaacacccgcagacaaccccucuuugcccauauucggcgcagaggcgaaagccggguguga

SEQ ID NO: 30707 - RNA, 807 nt, Artificial Sequence; identical to SEQ ID NO: 30670
  derived and/or modified sequence opt5 from capsid_protein_VP2__Norovirus__AFX81290

SEQ ID NO: 30708 - RNA, 807 nt, Artificial Sequence; identical to SEQ ID NO: 30662
  derived and/or modified sequence opt5 from capsid_protein_VP2__Norovirus__AFX81293

SEQ ID NO: 30709 - RNA, 807 nt, Artificial Sequence
  derived and/or modified sequence opt5 from capsid_protein_VP2__Norovirus__AFX81296
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaagguucuggacuggucuggcacccgcuacugggccccugaugcgagaacaaccacauauaacgccgggcgguuuagcaccccgcagcccuccggaacacugccuggccgcgugaaucccagaaccccuacgcccgcucgggggucuagcuccaccagcucuaacgccuccacagcuaccagcauucauucuaaucaaacaguguccacccgccucggaagcacggccggcuccgggacaaacgucucuagccugccuuccaccgccagaacacggagcuggguggaggaccagaaucgcaaccuuucuccguucaugagaggagcucacaauaucuccuuuguuacacccccuagcucucggagcuccucucagggcaccgugagcaccguccccaaagaggugcuggauuccuggacgggcgcguucaacacccgcagacaaccucucuuugcccauauccggcgcagaggggaaagccggguuuga

SEQ ID NO: 30710 - RNA, 807 nt, Artificial Sequence
  derived and/or modified sequence opt5 from capsid_protein_VP2__Norovirus__AFX81299
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaagguucuggacuggucuggcacccgcuacuggacaccugaugccagaaccacaaccuauaacgcggggcgguuuagcacaccgcagcccuccggaacccugccuggccgcauuaaucccagaacgccuacccccgcccgggggucuagcuccacaagcucuaacgcuuccaccgccacaagcauccauucuaaucaaaccguguccacgcgccucggaagcacagcuggcuccgggaccaacgugucuagccugccuuccacagccagaacccggagcugggucgaggaccagaaucgcaaccuuucuccguucaugagaggagcccacaauaucuccuuugugacacccccuagcucucggagcuccucucagggcaccguuagcacggugcccaaagagguccuggauuccuggaccggcgcuuucaacacacgcagacaaccucucuuugcgcauauucggcgcagaggggaaagccggguguga

SEQ ID NO: 30711 - RNA, 807 nt, Artificial Sequence
  derived and/or modified sequence opt5 from capsid_protein_VP2__Norovirus__AFX81302
auggccggcgcuuucuuugccgggcuggcgagcgacgugcucuccucuggacugggcagccuuaucaacgcuggggccggagccauuaaucagaagaucgauuucgagaacaauagaaaacugcaacaggcuuccuuucaguucucuagcaaccuccagcaagccuccuuucagcacgacaaggaaaugcugcaggcucagauugaggccaccaaaaagcugcaacaggaaaugaugaaagucaagcaggcgaugcuucucgagggcggguucucugaaacagaugccgcucggggagccaucaaugcucccaugacgaaggcccuggacuggagcggcacccgcuacugggcgccugaugccagaacaaccacauauuccgcuggccgguuuagcaccccgcagcccucuggggcccugccuggacgcacaaaccccagagcuccuauucccgcccggggcuccccuagcaccucuuccggggccagcacggcuaccucuaucuacuccaaucaaacaguuagcacccgccucggauccacagcgggcucugggaccaacgugagcucccugccgagcacggccagaacacggucuuggguggaggaccagaaucgcaaccuuucccccuucaugagaggagcucauaauaucagcuuugucaccccucccucuagccgguccucuagccagggcacaguguccaccguuccuaaagaggugcuggauagcuggaccggcgccuucaacacacgcagacaaccccucuuugcccacauucggcgcagaggggaaucucgggucuga

SEQ ID NO: 30712 - RNA, 807 nt, Artificial Sequence
  derived and/or modified sequence opt5 from capsid_protein_VP2__Norovirus__AFX81305
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucugaccuccagcaagccagcuuucagcacgauaaggaaaugcugcaggcucagauugaggccaccaaaaagcugcaacaggaaaugaugaaagucaagcaggcgaugcuucucgaagggggauucuccgagacagacgccgcucggggcgccaucaacgcucccaugacgaagguucuggauuggucuggcacccgcuacugggccccugacgcgagaacaaccacauauagcgccgggcgguuuuccaccccgcagcccagcggaacacugccuggccgcaccaaucccagaacgccuacccccgcucgggggucuuccagcacaucuuccaacgccagcaccgcuacaucuauucauuccaaucaaaccgugagcacgcgccucggauccacagccggcucugggaccaacgugagcucccugccuagcacagccagaacccggucuugggucgaggaucagaaucgcaaccuuuccccguucaugagaggagcucacaauaucagcuuugugacacccccuucuagccgguccucuagccagggcaccguuuccacggugcccaaagagguccuggacagcuggaccggcgcguucaacacacgcagacaaccucucuuugcccauauccggcgcagaggggaaucucggguguga

SEQ ID NO: 30713 - RNA, 807 nt, Artificial Sequence; identical to SEQ ID NO: 30662
  derived and/or modified sequence opt5 from capsid_protein_VP2__Norovirus__AFX81308

SEQ ID NO: 30714 - RNA, 807 nt, Artificial Sequence; identical to SEQ ID NO: 30670
  derived and/or modified sequence opt5 from capsid_protein_VP2__Norovirus__AFX81311

SEQ ID NO: 30715 - RNA, 807 nt, Artificial Sequence; identical to SEQ ID NO: 30662
  derived and/or modified sequence opt5 from capsid_protein_VP2__Norovirus__AFX81314

SEQ ID NO: 30716 - RNA, 807 nt, Artificial Sequence; identical to SEQ ID NO: 30662
  derived and/or modified sequence opt5 from capsid_protein_VP2__Norovirus__AFX81317

SEQ ID NO: 30717 - RNA, 807 nt, Artificial Sequence; identical to SEQ ID NO: 30662
  derived and/or modified sequence opt5 from capsid_protein_VP2__Norovirus__AFX81320

SEQ ID NO: 30718 - RNA, 807 nt, Artificial Sequence
  derived and/or modified sequence opt5 from capsid_protein_VP2__Norovirus__AFX81323
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaagguucuggacuggucuggcacccgcuacugggccccugaugcgagaacaaccacauauagcgccgggcgguuuuccaccccgcagcccagcggaacacugccuggccgcauuaaccccagaaccccuacgcccgcucgggggucuuccagcaccucuuccaaugccagcacagcuaccucuauccauuccaaccaaacagugagcacccgccucggauccacggccggcucugggacaaaugugagcucccugccuagcaccgccagaacacggucuugggucgaggaccagaaccgcaaucuuuccccguucaugagaggagcucacaacaucagcuuugugacacccccuucuagccgguccucuagccagggcaccguuuccaccgugcccaaagagguccuggauagcuggacgggcgcguucaauacccgcagacaaccucucuuugcccauauucggcgcagaggggaaucucggguguga

SEQ ID NO: 30719 - RNA, 807 nt, Artificial Sequence; identical to SEQ ID NO: 30670
  derived and/or modified sequence opt5 from capsid_protein_VP2__Norovirus__AFX81326

SEQ ID NO: 30720 - RNA, 807 nt, Artificial Sequence; identical to SEQ ID NO: 30662
  derived and/or modified sequence opt5 from capsid_protein_VP2__Norovirus__AGE89434

SEQ ID NO: 30721 - RNA, 807 nt, Artificial Sequence; identical to SEQ ID NO: 30662
  derived and/or modified sequence opt5 from capsid_protein_VP2__Norovirus__AGE89437

SEQ ID NO: 30722 - RNA, 807 nt, Artificial Sequence
  derived and/or modified sequence opt5 from capsid_protein_VP2__Norovirus__AGE89440
auggccggcgcuuucuuugccgggcuggcgagcgacgugcucggauccggccuggggucucuuaucagcgcuggagccggcgccauuaaccagaaggucgaguucgaaaauaacagaaaacugcaacaggcuuccuuucaguucucuagcaaucuccagcaagccuccuuucagcacgauaaggagaugcugcaggcucagaucgaagccaccaaaaagcugcaacaggagaugaugcggguuaaacaggcgaugcuucucgaagggggauucucugagacagacgccgcucgcggcgccauuaacgcucccaugacgaagacccuggauuggagcggcacaagauacugggccccugacgcgcggaccacaaccuauaaugccgggcgcuuuuccacaccgcagcccagcggagcucugccuggcagagccaaccuccgggcuaccgugcccgcccgcgggucuuccagcacguucucuaauuccagcaucgccaccucuguguacuccaaccaaacaaccagcacaagacugggauccaccgcuggcucugggacgagcgucuccagccuuccuucuacagcgcggacccgcuccuggguggaggaucagaauagaaaccugagccccuuuaugcggggagcccauaauauuucuuucguuacaccuccgagcucccgcucuagcucccagggcaccgugagcaccguccccaaggaagugcucgacucuuggacaggcgcuuuuaacacgagacggcaaccucuguucgcccacauccgcaaaagaggggagucccggguuuga

SEQ ID NO: 30723 - RNA, 807 nt, Artificial Sequence
  derived and/or modified sequence opt5 from capsid_protein_VP2__Norovirus__AGE89443
auggccggcgcuuucuuugccgggcuggcgagcgacgugcucggauccggccuggggucucuuaucaacgcuggagccggcgccauuaaucagaaggucgaguucgaaaacaauagaaaacugcaacaggcuagcuuucaguucuccucuaaccuccagcaagccagcuuucagcacgauaaggagaugcugcaggcucagaucgaagccaccaaaaagcugcaacaggagaugaugcggguuaaacaggcgaugcuucucgaagggggauucuccgagacagacgccgcucgcggcgccauuaaugcucccaugacgaagacccuggauuggucuggcacaagauacugggccccugacgcgcggaccacaaccuauaacgccgggcgcuuuagcacaccgcagcccuccggagcucugccuggcagagccaaucuccgggcuaccgugcccgcccgcgggucuagcuccacgagcucuaacgccuccaucgcuaccagcguguacucuaaucaaacaaccuccacaagacugggaagcaccgcgggcuccgggacgucugucagcucccuuccuagcacagcccggacccgcucuuggguggaggaucagaacagaaaucugucccccuucaugcggggagcucauaacauuagcuuuguuacaccuccgucuagccgcuccucuagccagggcaccguguccaccguccccaaggaagugcucgacagcuggacaggcgccuucaauacgagacggcaaccucuguuugcccacauccgcaaaagaggggagucucggguuuga

SEQ ID NO: 30724 - RNA, 807 nt, Artificial Sequence
  derived and/or modified sequence opt5 from capsid_protein_VP2__Norovirus__AGE89449
auggccggcgcuuucuuugccgggcuggcgagcgacgugcucggauccggccuggggucucuuaucaacgcuggagccggcgccauuaaucagaaggucgaguucgaaaacaauagaaaacugcaacaggcuagcuuucaguucuccucuaaccuccagcaagccagcuuucagcacgauaaggagaugcugcaggcucagaucgaagccaccaaaaagcugcaacaggagaugaugcggguuaaacaggcgaugcuucucgaagggggauucuccgagacagacgccgcucgcggcgccauuaaugcucccaugacgaagacccuggauuggucuggcacaagauacugggccccugacgcgcggaccacaaccuauaacgccgggcgcuuuagcacaccgcagcccuccggagugcugccuggcagagcuaaucuccgggccaccgugcccgcucgcgggucuagcuccacguucagcaacucuuccaucgccaccagcgucuacucuaaucaaacaaccuccacaagacugggaagcaccgccggcuccgggacgucugugagcucccuuccuagcacagcucggacccgcucuuggguugaggaucagaacagaaaucugucccccuuuaugcggggagcgcauaacauuagcuucgugacaccuccgucuagccgcuccucuagccagggcaccgucuccaccgugcccaaggaaguucucgacagcuggacaggcgccuuuaauacgagacggcaaccucuguucgcucacauccgcaaaagaggggagucucggguguga

SEQ ID NO: 30725 - RNA, 807 nt, Artificial Sequence; identical to SEQ ID NO: 30704
  derived and/or modified sequence opt5 from capsid_protein_VP2__Norovirus__AGE89455

SEQ ID NO: 30726 - RNA, 807 nt, Artificial Sequence; identical to SEQ ID NO: 30662
  derived and/or modified sequence opt5 from capsid_protein_VP2__Norovirus__AGE89458

SEQ ID NO: 30727 - RNA, 807 nt, Artificial Sequence; identical to SEQ ID NO: 30670
  derived and/or modified sequence opt5 from capsid_protein_VP2__Norovirus__AGE89461

SEQ ID NO: 30728 - RNA, 807 nt, Artificial Sequence
  derived and/or modified sequence opt5 from capsid_protein_VP2__Norovirus__AGE89464
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaagguucuggacuggucuggcacccgcuacugggccccugaugcgagaacaaccacauauaacgccgggcgguuuagcaccccgcagcccuccggaacacugccuggccgcauuaaucccagaaccccuacgcccgcucgggggucuagcuccaccccuagcaacgccucuacagcuaccuccauccauagcaaucaaacagugucuacccgccucggauccacggccggcagcgggacaaacguguccucucugccgagcaccgccagaacacgguccugggucgaggaccagaaucgcaaccuuagccccuucaugagaggagcucacaauaucucuuuugugaccccucccuccagccggucuagcucccagggcaccguuucuacagugccuaaagagguccuggauagcuggacgggcgcguucaacacccgcagacaaccccucuuugcccauauucggcgcagaggggaaucccggguguga

SEQ ID NO: 30729 - RNA, 807 nt, Artificial Sequence; identical to SEQ ID NO: 30662
  derived and/or modified sequence opt5 from capsid_protein_VP2__Norovirus__AGE89467

SEQ ID NO: 30730 - RNA, 807 nt, Artificial Sequence
  derived and/or modified sequence opt5 from capsid_protein_VP2__Norovirus__AGE89470
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaagguucuggacuggucuggcacccgcuacugggccccugaugcgagagccacaaccuauaacgcugggcgguuuagcacaccgcagcccuccggaacccugccuggccgcauuaaucccagaacaccuacccccgcccgggggagcccuucuacguccagcaacgcuucuaccgccacauccaucuacagcaaucaaaccgugucuacacgccucggauccaccgccggcagcgggacgaacguguccucucugccgagcacagcuagaacccgguccugggucgaggaccagaaucgcaaccuuagccccuucaugagaggagcgcauaauaucucuuuugugacaccucccuccagccggucuagcucccagggcaccguuucuaccgugccuaaagagguccuggauagcuggacaggcgccuucaacacgcgcagacaaccccucuuugcucacauucggcgcagaggggaaucccggguguga

SEQ ID NO: 30731 - RNA, 807 nt, Artificial Sequence
  derived and/or modified sequence opt5 from capsid_protein_VP2__Norovirus__AGE89473
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaagguucuggacuggucuggcacccgcuacugggccccugaugcgagaacaaccacauauaacgccgggcgguuuagcaccccgcagcccuccggagcucugccuggccgcauuaaucccagaacaccuacccccgcccgggggucuagcuccacgagcucuaacgcuuccaucgccaccagcauccauucuaaucaaacaguguccacccgccucggaagcacagccggcuccgggaccaacgugucuagccugccuuccacggcuagaacacggagcugggucgaggaccagaaucgcaaccuuucuccguucaugagaggagcgcacaauauuuccuuugugacacccccuagcucucggagcuccucucagggcaccguuagcaccgugcccaaagagguccuggauuccuggaccggcgccuucaacacacgcagacaaccucucuuugcucauauccggcgcagaggggaaagccggguguga

SEQ ID NO: 30732 - RNA, 807 nt, Artificial Sequence
  derived and/or modified sequence opt5 from capsid_protein_VP2__Norovirus__AGE89476
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaagguucuggacuggucuggcacccgcuacugggccccugaugcgagaacaaccacauauaacgccgggcgguuuagcaccccgcagcccuccggaacacugccuggccgcauuaaucccagaaccccuacgcccgcucgggggucuagcuccaccagcuucaacgccucuacagcuaccuccauccauagcaaucaaacagugucuacccgccucggauccacggccggcagcgggacaaacguguccucucugccuagcaccgccagaacacgguccugggucgaggaccagaaucgcaaccuuagcccguuuaugagaggagcucacaauaucucuuucgugacacccccuuccagccggucuagcucccagggcaccguuucuaccgugcccaaagagguccuggauagcuggacgggcgcguuuaacacccgcagacaaccucucuucgcccauauucggcgcagaggggaaucccggguguga

SEQ ID NO: 30733 - RNA, 807 nt, Artificial Sequence
  derived and/or modified sequence opt5 from capsid_protein_VP2__Norovirus__AGE89479
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaagguucuggacuggucuggcacccgcuacugggccccugaugcgagaacaaccacauauaacgccgggcgguuuagcaccccgcaguccagcggaacacugcccggccgcauuaauccuagaacccccacgccugcucgggggucuuccagcaccucuuccaacgccagcacagcuaccucuauccauuccaaucaaacagugagcacccgccucggauccacggccggcucugggacaaacgugagcucccaccccagcaccgccagaacacggucuugggucgaggaccagaaucgcaaccuguccccuuucaugagaggagcucauaauaucagcuuugugaccccgcccucuagccgguccucuagccagggcaccguuuccacagugccuaaagagguccuugauagcuggacgggcgcguucaacacccgcagacaaccccuguuugcccacauucggcgcagaggggaaucucggguguga

SEQ ID NO: 30734 - RNA, 807 nt, Artificial Sequence; identical to SEQ ID NO: 30670
  derived and/or modified sequence opt5 from capsid_protein_VP2__Norovirus__AGE89482

SEQ ID NO: 30735 - RNA, 807 nt, Artificial Sequence
  derived and/or modified sequence opt5 from capsid_protein_VP2__Norovirus__AGE89485
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaagguucuggacuggucuggcacccgcuacugggccccugaugcgagaacaaccacauauaacgccgggcgguuuagcaccccgcagcccuccggaacacugccuggccgcauuaaucccagaaccccuacgcccgcucgggggucuagcuccaccagcucuaacgccuccacagcuaccagcauccauucuaaucaaacaguguccacccgccucggaagcacggccggcuccgggacaaacgugucuagccugccuuccaccgccagaacacggagcugggucgaggaccagaaucgcaaccuuucuccguucaugagaggagcucggaauaucuccuuugugacacccccuagcucucgcagcuccucucagggcaccguuagcaccgugcccaaagagguccuggauuccuggacgggcgcguucaacaccagacggcaaccucucuuugcccacauucgcagaagaggggaaagccggguguga

SEQ ID NO: 30736 - RNA, 807 nt, Artificial Sequence
  derived and/or modified sequence opt5 from capsid_protein_VP2__Norovirus__AGE89488
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaagguucuggacuggucuggcacccgcuacugggccccugaugcgagaacaaccacauauaacgccgggcgguuuagcgcuccgcagcccuccggaagccugccuggccgcauuaaucccagagccccuacccccgcucgggugucuuccagcacaucuuccaacgccagcaccgugacgucuaucuacuccaaucaaaccgucagcacacgccucggguccaccgccggaucuggcacaaacgugagcucccugccuagcaccgcuagaacgcggucuuggguugaggaccagaaucgcaaccuuuccccguucaugagaggggcgcauaauaucagcuuugugacacccccuucuagccgguccucuagccagggaaccgucuccacagugcccaaagagguucuggauagcuggaccggcgccuucaacacccgcagacaaccucucuuugcucacauucggcgcagaggcgaaucucggguguga

SEQ ID NO: 30737 - RNA, 807 nt, Artificial Sequence; identical to SEQ ID NO: 30662
  derived and/or modified sequence opt5 from capsid_protein_VP2__Norovirus__AGE89491

SEQ ID NO: 30738 - RNA, 807 nt, Artificial Sequence
  derived and/or modified sequence opt5 from capsid_protein_VP2__Norovirus__AGE89494
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaagguucuggacuggucuggcacccgcuacugggccccugaugcgagaacaauuaccuauaacgccgggcgguuuagcacaccgcagcccuccggaacccugccuggccgcaucaaucccagagcuccuacacccgcccgggggucuagcuccaccagcucuaacgcuuccacggccaccagcaucuacucuaaucaaacaguguccacccgccucggaagcacagccggcuccgggaccaacgugucuagccugccuuccacggcuagaacacggagcugggucgaggaccagaaucgcaaccuuucuccguucaugagaggagcgcauaauauuuccuuugugacacccccuagcucucggagcuccucucagggcaccguuagcaccgugcccaaagagguccuggauuccuggaccggcgccuucaacacacgcagacaaccucucuuugcucacauccggcgcagaggggaaagccggguguga

SEQ ID NO: 30739 - RNA, 807 nt, Artificial Sequence
  derived and/or modified sequence opt5 from capsid_protein_VP2__Norovirus__AGE89497
auggccggcgcuuucuuugccgggcuggcgagcgacgugcucggauccggccuggggucucuuaucagcgcuggagccggcgccauuaaccagaagaucgauuucgagaauaacagaaaacugcaacaggcuuccuuucaguucucuagcaaucuccagcaagccuccuuucagcacgacaaggaaaugcugcaggcucagauugaggccaccaaaaagcugcaacaggaaaugaugaaagucaagcaggcgaugcuucucgaagggggauucucugagacagaugccgcucggggcgccaucaacgcucccaugacgaagguucuggacuggagcggcacccgcuacugggccccugaugcgagaacaaccacauauaaugccgggcgguuuuccaccccgcagcccagcggaacacugccuggccgcauuaaccccagaaccccuacgcccgcucgggggucuuccagcaccucuuccaaugccagcacagcuaccucuaucuacuccaaccaaacagugagcacccgccucggauccacggccggcucugggacaaaugugagcucccugccuagcaccgccagaacacggucuugggucgaggaccagaaccgcaaucuuuccccguucaugagaggagcucauaacaucagcuuugugacacccccuucuagccgguccucuagccagggcaccguuuccaccgugcccaaagagguccuggauagcuggacgggcgcguucaauacccgcagacaaccucucuuugcccacauucggcgcagaggggaaucucggguguga

SEQ ID NO: 30740 - RNA, 807 nt, Artificial Sequence; identical to SEQ ID NO: 30662
  derived and/or modified sequence opt5 from capsid_protein_VP2__Norovirus__AGE89500

SEQ ID NO: 30741 - RNA, 807 nt, Artificial Sequence; identical to SEQ ID NO: 30662
  derived and/or modified sequence opt5 from capsid_protein_VP2__Norovirus__AGE89503

SEQ ID NO: 30742 - RNA, 807 nt, Artificial Sequence
  derived and/or modified sequence opt5 from capsid_protein_VP2__Norovirus__AGE89506
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaagguucuggacuggucuggcacccgcuacugggccccugaugcgagaacaaccacauauaacgccgggcgguuuagcaccccgcagcccuccggaacacugccuggccgcauuaaucccagaaccccuacgcccgcucgggggucuagcuccaccagcucuaacgccuccacagcuaccagcaugcauucuaaucaaacaguguccacccgccucggaagcacggccggcuccgggacaaacgugucuagccugccuuccaccgccagaacacggagcugggucgaggaccagaaucgcaaccuuucuccguucaugagaggagcucacaauaucuccuuugugacacccccuagcucucggagcuccucucagggcaccguuagcaccgugcccaaagagguccuggauuccuggacgggcgcguucaacacccgcagacaaccucucuuugcccauauccggcgcagaggggaaagccggguguga

SEQ ID NO: 30743 - RNA, 807 nt, Artificial Sequence
  derived and/or modified sequence opt5 from capsid_protein_VP2__Norovirus__AGE89509
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaagguucuggacuggucuggcacccgcuacugggccccugaugcgagaacaaccacauauaacgccgggcgguuuagcaccccgcagcccuccggaagccugccuggccgcauuaaucccagagcuccuacacccgcccgggcuucuuccagcaucucuuccaacgccagcaccgugacgucuaucuacuccaaucaaaccgugagcacacgccucggguccaccgccggaucuggcacaaacgucagcucccugccuagcaccgcuagaacgcggucuuggguggaggaccagaaucgcaaccuuuccccguucaugagaggggcgcauaauauuagcuuuguuacacccccuucuagccgguccucuagccagggaaccguguccacaguccccaaagaggugcuggauagcuggaccggcgccuucaacacccgcagacaaccucucuuugcucacauccggcgcagaggcgaaucucggguuuga

SEQ ID NO: 30744 - RNA, 807 nt, Artificial Sequence; identical to SEQ ID NO: 30662
  derived and/or modified sequence opt5 from capsid_protein_VP2__Norovirus__AGE89512

SEQ ID NO: 30745 - RNA, 807 nt, Artificial Sequence; identical to SEQ ID NO: 30670
  derived and/or modified sequence opt5 from capsid_protein_VP2__Norovirus__AGE89515

SEQ ID NO: 30746 - RNA, 807 nt, Artificial Sequence
  derived and/or modified sequence opt5 from capsid_protein_VP2__Norovirus__AGE89518
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcagacaaugcuucucgaagggggauucuccgagacggaugcggcccggggcgcuaucaaugcccccaugaccaagguucuggacuggucuggcacacgcuacugggcuccugaugccagaaccacaaccuauaacgcggggcgguuuagcacaccgcagcccuccggaacccugccuggccgcauuaaucccagaacgccuacccccgcccgggggucuagcuccacaagcucuaacgcuuccaccgccacaagcauccauucuaaucaaaccguguccacgcgccucggaagcacagcuggcuccgggaccaacgugucuagccugccuuccacagccagaacccggagcugggucgaggaccagaaucgcaaccuuucuccguucaugagaggagcccacaauaucuccuuugugacacccccuagcucucggagcuccucucagggcaccguuagcacggugcccaaagagguccuggauuccuggaccggcgcuuucaacacacgcagacaaccucucuuugcgcauauucggcgcagaggggaaagccggguguga

SEQ ID NO: 30747 - RNA, 807 nt, Artificial Sequence
  derived and/or modified sequence opt5 from capsid_protein_VP2__Norovirus__AGE89521
auggccggcgcuuucuuugccgggcuggcgagcgacgugcucggauccggccuggggucucuuaucaacgcuggagccggcgccauuaaucagaagaucgauuucgagaacaauagaaaacugcaacaggucagcuuucaguucuccucuaaccuccagcaagcuagcuuucagcacgacaaggaaaugcugcaggcccagauugaggcuaccaaaaagcugcaacaggaaaugaugaaaguuaagcaggccaugcuucucgaagggggauucuccgagacagaugcggcccggggcgcuaucaaugcccccaugacgaaggugcuggacuggucuggcacccgcuacugggcuccugaugccagaacaaccacauauaacgcggggcgguuuagcaccccgcagcccuccggaacacugccuggccgcauuaaucccagaaccccuacgcccgcccgggggucuagcuccaccagcucuaacgcuuccacagccaccagcauccauucuaaucaaacaguguccacccgccucggaagcacggcuggcuccgggacaaacgucucuagccugccuuccaccgccagaacacggagcuggguggaggaccagaaucgcaaccuuucuccguucaugagaggagcccacaauaucuccuuuguuacacccccuagcucucggagcuccucucagggcaccgugagcaccguccccaaagaggugcuggauuccuggacgggcgcuuucaacacccgcagacaaccucucuuugcgcauauucggcgcagaggggaaagccggguuuga

SEQ ID NO: 30748 - RNA, 807 nt, Artificial Sequence; identical to SEQ ID NO: 30662
  derived and/or modified sequence opt5 from capsid_protein_VP2__Norovirus__AGE89524

SEQ ID NO: 30749 - RNA, 807 nt, Artificial Sequence
  derived and/or modified sequence opt5 from capsid_protein_VP2__Norovirus__AGE89530
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaagguucuggacuggucuggcacccgcuacugggccccugaugcgagaacaaccacauauaacgccgggcgguuuagcaccccgcagcccuccggaacacugccuggccgcaccaaucccagaacgccuacccccgcucgggggucuagcuccacaagcucuaacgccuccaccgcuacaagcauuuacucuaaucaaaccguguccacgcgccucggaagcacagccggcuccgggaccaacgugucuagccugccuuccacagccagaacccggagcugggucgaggaccagaaucgcaaccuuucuccguucaugagaggagcucauaauaucuccuuugugacacccccuagcucucggagcuccucucagggcaccguuagcacggugcccaaagagguccuggauuccuggaccggcgcguucaacacacgcagacaaccucucuuugcccacauccggcgcagaggggaaagccggguguga

SEQ ID NO: 30750 - RNA, 807 nt, Artificial Sequence
  derived and/or modified sequence opt5 from capsid_protein_VP2__Norovirus__AGE89533
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaucaugaaagucaagcaggcgaugcuucucgaagggggauucuccgagacagaugccgcucggggcgccauuaaugcucccaugacgaagguucuggacuggucuggcacccgcuacugggccccugaugcgagaacaaccacauauagcgccgggcgguuuuccaccccgcagcccagcggaacacugccuggccgcaucaaccccagaaccccuacgcccgcucgggggucuuccagcaccuucucuaaugccuccacagcuaccagcauccauucuaaccaaacaguguccacccgccucggaagcacggccggcuccgggacaaaugugucuagccugccuuccaccgccagaacacggagcugggucgaggaccagaaccgcaaucuuucuccguuuaugagaggagcucacaacauuuccuucgugacacccccuagcucucggagcuccucucagggcaccguuagcaccgugcccaaagagguccuggauuccuggacgggcgcguuuaauacccgcagacaaccucucuucgcccauauccggcgcagaggggaaagccggguguga

SEQ ID NO: 30751 - RNA, 807 nt, Artificial Sequence; identical to SEQ ID NO: 30670
  derived and/or modified sequence opt5 from capsid_protein_VP2__Norovirus__AGE89536

SEQ ID NO: 30752 - RNA, 807 nt, Artificial Sequence; identical to SEQ ID NO: 30670
  derived and/or modified sequence opt5 from capsid_protein_VP2__Norovirus__AGE89539

SEQ ID NO: 30753 - RNA, 807 nt, Artificial Sequence; identical to SEQ ID NO: 30670
  derived and/or modified sequence opt5 from capsid_protein_VP2__Norovirus__AGE89542

SEQ ID NO: 30754 - RNA, 807 nt, Artificial Sequence; identical to SEQ ID NO: 30670
  derived and/or modified sequence opt5 from capsid_protein_VP2__Norovirus__AGE89545

SEQ ID NO: 30755 - RNA, 807 nt, Artificial Sequence
  derived and/or modified sequence opt5 from capsid_protein_VP2__Norovirus__AGE89548
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaagguucuggacuggucuggcacccgcuacugggccccugaugcgagaauuacaaccuauaacgccgggcgguuuagcacaccgcagcccuccggaacccugccuggccgcaucaaucccagaacaccuacccccgcucgggggucuagcuccacgagcucuaacgccuccaccgcuacaagcauccauucuaaucaaaccguguccacacgccucggaagcaccgccggcuccgggacgaacgugucuagccugccuuccacagccagaacccggagcugggucgaggaccagaaucgcaaccuuucuccguucaugagaggagcucacaauauuuccuuugugacacccccuagcucucggagcuccucucagggcaccguuagcaccgugcccaaagagguccuggauuccuggacaggcgcguucaacacgcgcagacaaccucucuuugcccauauccggcgcagaggggaaagccggguguga

SEQ ID NO: 30756 - RNA, 807 nt, Artificial Sequence; identical to SEQ ID NO: 30662
  derived and/or modified sequence opt5 from capsid_protein_VP2__Norovirus__AGE89551

SEQ ID NO: 30757 - RNA, 807 nt, Artificial Sequence
  derived and/or modified sequence opt5 from capsid_protein_VP2__Norovirus__AGE89554
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaagguucuggacuggucuggcacccgcuacugggccccugaugcgagaacaaccacauauaacgccgggcgguuuagcgcuccgcagcccuccggaagccugccuggccgcauuaaucccagagccccuacccccgcucgggugucuuccagcacaucuuccaacgccagcaccgugacgucuaucuacuccaaucaaaccgucagcacacgccucggguccaccgccggaucuggcacaaacgugagcucccugccuagcaccgcuagaacgcggucuuggguugaggaccagaaucgcaaccuuuccccguucaugagaggggcgcauaauaucagcuuugugacacccccuucuagccgguccucuagccagggaaccgucuccacagugcccaaagagguucuggauagcuggaccggcgccuucaacacccgcagacaaccucucuuugcucacgugcggcgcagaggcgaaucucgggucuga

SEQ ID NO: 30758 - RNA, 807 nt, Artificial Sequence; identical to SEQ ID NO: 30670
  derived and/or modified sequence opt5 from capsid_protein_VP2__Norovirus__AGE89557

SEQ ID NO: 30759 - RNA, 807 nt, Artificial Sequence
  derived and/or modified sequence opt5 from capsid_protein_VP2__Norovirus__AGE89560
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaagguucuggacuggucuggcacccgcuacugggccccugaugcgagaacaaccacauauaacgccgggcgguuuagcaccccgcagcccuccggaacacugccuggccgcauuaauagcagaacccccacgccugcucgggggucuuccagcaccucuuccaacgccagcacagcuaccucuaucuacuccaaucaaacagugagcacccgccucggauccacggccggcucugggacaaacgugagcucccugcccagcaccgccagaacacggucuugggucgaggaccagaaucgcaaccuuuccccuuucaugagaggagcucauaauaucagcuuugugaccccgcccucuagccgguccucuagccagggcaccguuuccacagugccuaaagagguccuggauagcuggacgggcgcguucaacacccgcagacaaccccucuuugcccacauucggcgcagaggggaaucucggguguga

SEQ ID NO: 30760 - RNA, 807 nt, Artificial Sequence
  derived and/or modified sequence opt5 from capsid_protein_VP2__Norovirus__AGE89563
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaagguucuggacuggucuggcacccgcuacugggccccugaugcgagaacaaccacauauaacgccgggcgguuuagcaccccgcagcccuccggaaugcugccuggccgcauuaaucccagaacaccuacccccgcucgggggucuagcuccacgagcucuaacgccuccaccgcuacaagcauccauucuaaucaaaccguguccacacgccucggaagcaccgccggcuccgggacgaacgugucuagccugccuuccacagccagaacccggagcugggucgaggaccagaaucgcaaccuuucuccguucaugagaggagcucacaauaucuccuuugugacacccccuagcucucggagcuccucucagggcaccguuagcaccgugcccaaagagguccuggauuccuggacaggcgcguucaacacgcgcagacaaccucucuuugcccauauucggcgcagaggggaaagccggguguga

SEQ ID NO: 30761 - RNA, 807 nt, Artificial Sequence
  derived and/or modified sequence opt5 from capsid_protein_VP2__Norovirus__AGE89566
auggccggcgcuuucuuugccgggcuggcgagcgacgugcucuccucuggacugggcagccuuaucaacgcuggggccggagccauuaaucagaagaucgauuucgagaacaauagaaaacugcaacaggcuuccuuucaguucucuagcaaccuccagcaagccuccuuucagcacgacaaggaaaugcugcaggcucagauugaggccaccaaaaagcugcaacaggaaaugaugaaagucaagcaggcgaugcuucucgagggcggguucucugaaacagaugccgcucggggagccaucaaugcucccaugacgaagguucuggacuggagcggcacccgcuacugggccccugaugcgagaacaaccacauauaacgccggccgguuuuccaccccgcagcccagcgggacacugccuggacgcauuaaucccagaaucccuacccccgcucgggggucuuccagcacgucuuccaacgccagcaccgcuacaucuaucuacuccaaucaaaccgugagcacacgccucggcuccaccgccggaucuggcacgaacgugagcucccugccuagcacagccagaacccggucuugggucgaggaccagaaucgcaaccuuuccccguucaugagaggggcucauaauauuagcuuugugacacccccuucuagccgguccucuagccagggaaccguuuccaccgugcccaaagagguccuggauagcuggacaggcgcguucaacacgcgcagacaaccucucuuugcccacauccggcgcagaggcgaaucucggguguga

SEQ ID NO: 30762 - RNA, 807 nt, Artificial Sequence; identical to SEQ ID NO: 30670
  derived and/or modified sequence opt5 from capsid_protein_VP2__Norovirus__AGE89569

SEQ ID NO: 30763 - RNA, 807 nt, Artificial Sequence; identical to SEQ ID NO: 30670
  derived and/or modified sequence opt5 from capsid_protein_VP2__Norovirus__AGE89572

SEQ ID NO: 30764 - RNA, 807 nt, Artificial Sequence
  derived and/or modified sequence opt5 from capsid_protein_VP2__Norovirus__AGE89578
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaagguucuggacuggucuggcacccgcuacugggccccugaugcgagaacaaccacauauaacgccgggcgguuuagcaccccgcagcccuccggaacacugcucgagcgcgugaauccuagaacccccacgccugcucggggcucuagcuccaccagcucuaacgccuccacagcuaccagcauucauucuaaucaaacaguguccacccgccuggggagcacggccggauccggcacaaacgucucuagccuucccuccaccgccagaacacggagcuggguggaggaccagaaucgcaaccugucuccuuucaugagaggggcucacaauaucuccuuuguuaccccgcccagcucucggagcuccucucagggaaccgugagcacagucccuaaagaagugcucgauuccuggacgggcgcguucaacacccgcagacaaccccuguuugcccauauccggcgcagaggcgagagccggguuuga

SEQ ID NO: 30765 - RNA, 807 nt, Artificial Sequence
  derived and/or modified sequence opt5 from capsid_protein_VP2__Norovirus__AGE89581
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaagucaugaaaguuaagcaggcgaugcuucucgaagggggauucuccgagacagaugccgcucggggcgccaucaaugcucccaugacgaaggugcuggacuggucuggcacccgcuacugggccccugaugcgagaacaaccacauauaacgccgggcgguuuagcaccccgcagcccuccggaacacugccuggccgcauuaaucccagaaccccuacgcccgcucgggggucuagcuccaccagcucuaacgccuccacagcuaccagcaucuacucuaaucaaacaguguccacccgccucggaagcacggccggcuccgggacaaacgucucuagccugccuuccaccgccagaacacggagcuggguggaggaccagaaucgcaaccuuucuccguucaugagaggagcucauaauaucuccuuuguuacacccccuagcucucggagcuccucucagggcaccgugagcaccguccccaaagaggugcuggauuccuggacgggcgcguucaacacccgcagacaaccucucuuugcccacauucggcgcagaggggaaagccggguuuga

SEQ ID NO: 30766 - RNA, 807 nt, Artificial Sequence; identical to SEQ ID NO: 30760
  derived and/or modified sequence opt5 from capsid_protein_VP2__Norovirus__AGE89587

SEQ ID NO: 30767 - RNA, 807 nt, Artificial Sequence
  derived and/or modified sequence opt5 from capsid_protein_VP2__Norovirus__AGE89590
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaagguucuggacuggucuggcacccgcuacugggccccugaugcgagaacaaccacauauaacgccgggcgguuuagcaccccgcagcccuccggaacacugccugagcgcgugaaucccagaaccccuacgcccgcucggggcucuagcuccaccagcucuaacgccuccacagcuaccagcauucauucuaaucaaacaguguccacccgccucgggagcacggccggauccggcacaaacgucucuagccugccuuccaccgccagaacacggagcuggguggaggaccagaaucgcaaccuuucuccguucaugagaggggcucacaauaucuccuuuguuacacccccuagcucucggagcuccucucagggaaccgugagcaccguccccaaagaagugcuggauuccuggacgggcgcguucaacacccgcagacaaccucucuuugcccauauccggcgcagaggcgagagccggguuuga

SEQ ID NO: 30768 - RNA, 807 nt, Artificial Sequence; identical to SEQ ID NO: 30662
  derived and/or modified sequence opt5 from capsid_protein_VP2__Norovirus__AGE89593

SEQ ID NO: 30769 - RNA, 807 nt, Artificial Sequence
  derived and/or modified sequence opt5 from capsid_protein_VP2__Norovirus__AGE89596
auggccggcgcuuucuuugccgggcuggcgagcgacgugcucggauccggccuggggucucuuaucaacgcuggagccggcgccauuaaucagaaggucgaguucgaaaacaauagaaaacugcaacaggcuagcuuucaguucuccucuaaccuccagcaagccagcuuucagcacgauaaggagaugcugcaggcucagaucgaagccaccaaaaagcugcaacaggagaugaugcggguuaaacaggcgaugcuucucgaagggggauucuccgagacagacgccgcucgcggcgccauuaaugcucccaugacgaagacccuggauuggucuggcacaagauacugggccccugacgcgcggaccacaaccuauaacgccgggcgcuuuagcacaccgcagcccuccggagcucugccuggcagagccaaucuccgggcuaccgugcccgcccgcgggucuagcuccacgagcucuaacuccagcaucgccaccucuguguacuccaaucaaacaaccagcacaagacugggauccaccgcuggcucugggacgagcgucuccagccuuccuucuacagcgcggacccgcuccuggguggaggaucagaacagaaaucugagccccuucaugcggggagcccauaacauuucuuuuguuacaccuccgagcucccgcucuagcucccagggcaccgugagcaccguccccaaggaagugcucgacucuuggacaggcgcuuucaauacgagacggcaaccucuguuugcccacauccgcaaaagaggggagucccggguuuga

SEQ ID NO: 30770 - RNA, 807 nt, Artificial Sequence
  derived and/or modified sequence opt5 from capsid_protein_VP2__Norovirus__AGE89599
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaagguucuggacuggucuggcacccgcuacugggccccugaugcgagaacaaccacauauaacgccgggcgguuuagcaccccgcagcccuccggaacacugccuggccgcaccaaucccagaacgccuacccccgcucgggggucuagcuccauuagcucuaacgccuccacagcuaccagcauccauucuaaucaaacaguguccacccgccucggaagcacggccggcuccgggacaaacgugucuagccugccuuccaccgccagaacacggagcugggucgaggaccagaaucgcaaccuuucuccguucaugagaggagcucacaauaucuccuuugugacacccccuagcucucggagcuccucucagggcaccguuagcaccgugcccaaagagguccuggauuccuggacgggcgcguucaacacccgcagacaaccucucuuugcccauauucggcgcagaggggaaagccggguguga

SEQ ID NO: 30771 - RNA, 807 nt, Artificial Sequence
  derived and/or modified sequence opt5 from capsid_protein_VP2__Norovirus__AGE89602
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaagguucuggacuggucuggcacccgcuacugggccccugaugcgagaacaaccacauauaacgccgggcgguuuagcaccccgcagcccuccggaacacugccuggccgcauuaaucccagaaccccuacgcccgcucgggggucuagcuccaccagcucuaacgccuccacagcuaccagcauccauucuaaucaaacagccuccacccgccucggaagcacggccggcuccgggacaaacgugucuagccugccuuccaccgcuagaacacggagcuggguggaggaccagaaucgcaaccuuucuccguucaugagaggagcgcacaauaucuccuuugucacacccccuagcucucggagcuccucucagggcaccgugagcaccguucccaaagaggugcuggauuccuggacgggcgccuucaacacccgcagacaaccucucuuugcucauauucggcgcagaggggaaagccgggucuga

SEQ ID NO: 30772 - RNA, 807 nt, Artificial Sequence
  derived and/or modified sequence opt5 from capsid_protein_VP2__Norovirus__AGE89605
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaagguucuggacuggucuggcacccgcuacugggccccugaugcgagaacaaccacauauaacgccgggcgguuuagcaccccgcagcccuccggaacacugccuggccgcauuaaucccagaaccccuacgcccgcucgggggucuagcuccaccagcucuaacgccuccacagcuaccagcauccauucuaaucaaacaguguccacccgccucggaagcacggccggcuccgggacaaacgugucuagccugccuuccaccgccagaacacggagcugggucgaggaccagaaucgcucucuuuccccguucaugagaggagcucacaacaucagcuuugugacacccccuucuagccgguccucuagccagggcaccguuuccaccgugcccaaagagguccuggauagcuggacgggcgcguucaauacccgcagacaaccucucuuugcccauauucggcgcagaggggaaucucggguguga

SEQ ID NO: 30773 - RNA, 807 nt, Artificial Sequence
  derived and/or modified sequence opt5 from capsid_protein_VP2__Norovirus__AGE89608
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaagguucuggacuggucuggcacccgcuacugggccccugaugcgagaacaaccacauauaacgccgggcgguuuagcaccccgcagcccuccggaacacugccuggccgcauuaaucccagaaccccuacgcccgcucgggggucuagcuccaccagcucuaacgccuccacagcuaccagcauccauucuaaucaaacaguguccacccgccucggauacacggccggcagcgggacaaacguguccucucugccuagcaccgccagaacacgguccugggucgaggaccagaaucgcagccuuucuccguucaugagaggagcucacaacaucuccuuugugacacccccuagcucucggagcuccucucagggcaccguuagcaccgugcccaaagagguccuggauuccuggacgggcgcguucaauacccgcagacaaccucucuuugcccauauucggcgcagaggggaaagccggguguga

SEQ ID NO: 30774 - RNA, 807 nt, Artificial Sequence
  derived and/or modified sequence opt5 from capsid_protein_VP2__Norovirus__AGE89611
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucucugcucccaugacgaagguucuggacuggagcggcacccgcuacugggccccugaugcgagaacaaccacauauaaugccgggcgguuuuccaccccgcagcccagcggaacacugccuggccgcauuaaccccagaaccccuacgcccgcucgggggucuuccagcaccucuuccaaugccccuacagcuaccagcaucuacucuaaccaaacaguguccacccgccucggaagcacggccggcuccgggacaaaugugucuagccugccguccaccgccagaacacggagcugggucgaggaccagaaccgcaaucuuucucccuucaugagaggagcucauaacaucuccuuugugaccccucccagcucucggagcuccucucagggcaccguuagcacagugccuaaagagguccuggauuccuggacgggcgcguucaauacccgcagacaaccccucuuugcccacauucggcgcagaggggaaagccggguguga

SEQ ID NO: 30775 - RNA, 807 nt, Artificial Sequence
  derived and/or modified sequence opt5 from capsid_protein_VP2__Norovirus__AGE89614
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaagguucuggacuggucuggcacccgcuacugggccccugaugcgagaacaaccacauauaacgccgggcgguuuagcaccccgcagcccuccgagacacugccuggacgcauuaaucccagaaccccuacgcccgcucggggcucuagcuccaccagcucuaacgccuccacagcuaccagcauccauucuaaucaaacaguguccacccgccucgggagcacggccggauccggcacaaacgugucuagccugccuuccaccgccagaacacggagcugggucgaggaccagaaucgcucucuuuccccguucaugagaggggcucacaacaucagcuuugugacacccccuucuagccgguccucuagccagggaaccguuuccaccgugcccaaagaaguccuggauagcuggacgggcgcguucaauacccgcagacaaccucucuuugcccauauucggcgcagaggcgagucucggguguga

SEQ ID NO: 30776 - RNA, 807 nt, Artificial Sequence; identical to SEQ ID NO: 30769
  derived and/or modified sequence opt5 from capsid_protein_VP2__Norovirus__AGE89617

SEQ ID NO: 30777 - RNA, 807 nt, Artificial Sequence; identical to SEQ ID NO: 30677
  derived and/or modified sequence opt5 from capsid_protein_VP2__Norovirus__AGE89620

SEQ ID NO: 30778 - RNA, 807 nt, Artificial Sequence
  derived and/or modified sequence opt5 from capsid_protein_VP2__Norovirus__AGE89623
auggccggcgcuuucuuugccgggcuggcgagcgacgugcucggauccggccuggggucucuuaucaacgcuggagccggcgccauuaaucagaaggucgaguucgaaaacaauagaaaacugcaacaggcuagcuuucaguucuccucuaaccuccagcaagccagcuuucagcacgauaaggagaugcugcaggcucagaucgaagccaccaaaaagcugcaacaggagaugaugcggguuaaacaggcgaugcuucucgaagggggauucuccgagacagacgccgcucgcggcgccauuaaugcucccaugacgaagacccuggauuggucuggcacaagauacugggccccugacgcgcggaccacaaccuauaacgccgggcgcuuuagcacaccgcagcccuccggagcucugccuggcagagccaaucuccgggcuaccgugcccgcccgcgggucuagcuccacguucagcaacucuuccaucgccaccagcguguacucuaaucaaacaaccuccacaagacugggaagcaccgcuggcuccgggacgucugucagcucccuuccuagcacagcgcggacccgcucuuggguggaggaucagaacagaaaucugucccccuuuaugcggggagcccauaacauuagcuauguuacaccuccgucuagccgcuccucuagccagggcaccguguccaccguccccaaggaagugcucgacagcuggacaggcgcuuucaauacgagacggcaaccucuguuugcccacauccgcaaaagaggggagucucggguuuga

SEQ ID NO: 30779 - RNA, 807 nt, Artificial Sequence
  derived and/or modified sequence opt5 from capsid_protein_VP2__Norovirus__AGE89626
auggccggcgcuuucuuugccgggcuggcgagcgacgugcucggauccggccuggggucucuuaucaacgcuggagccggcgccauuaaucagaaggucgaguucgaaaacaauagaaaacugcaacaggcuagcuuucaguucuccucuaaccuccagcaagccagcuuucagcacgauaaggagaugcugcaggcucagaucgaagccaccaaaaagcugcaacaggagaugaugcggguuaaacaggcgaugcuucucgaagggggauucuccgagacagacgccgcucgcggcgccauuaaugcucccaugacgaagacccuggauuggucuggcacaagauacugggccccugacgcgcggaccacaaccuauaacgccgggcgcuuuagcacaccgcagcccuccggagcucugccuggcagagccaaucuccgggcuaccgugcccgcccgcgggucuagcuccacguucagcaacucuuccaucgccaccagcguguacucuaaucaaacaaccuccacaagacugggaagcaccgcuggcuccgggacgucugucagcucccuuccuagcacagcgcggacccgcucuuggguggaggaucagaacagaaaucugucccccuuuaugcggggagcccauaacauuagcuucguuacaccuccgucuagccgcuccucuagccagggcaccguguccaccguccccaaggaagugcucgacagcuggacaggcgcuuuuaauacgagacggcaaccucuguucgcccacauccgcaaaagaggggagucucggguuuga

SEQ ID NO: 30780 - RNA, 807 nt, Artificial Sequence
  derived and/or modified sequence opt5 from capsid_protein_VP2__Norovirus__AGE89629
auggccggcgcuuucuuugccgggcuggcgagcgacgugcucggauccggccuggggucucuuaucaacgcuggagccggcgccauuaaucagaaggucgaguucgaaaacaauagaaaacugcaacaggcuagcuuucaguucuccucuaaccuccagcaagccagcuuucagcacgauaaggagaugcugcaggcucagaucgaagccaccaaaaagcugcaacaggagaugaugcggguuaaacaggcgaugcuucucgaagggggauucuccgagacagacgccgcucgcggcgccauuaaugcucccaugacgaagacccuggauuggucuggcacaagauacugggccccugacgcgcggaccacaaccuauaacgccgggcgcuuuagcacaccgcagcccuccggagcucugccuggcggggccaaucucagagcuaccgugcccgcccggggaucuagcuccacguucagcaacucuuccaucgccaccagcguguacucuaaucaaacaaccuccacacgccugggcagcaccgcuggguccggaacgucugucagcucccuuccuagcacagcgagaacccggucuuggguggaggaucagaaccgcaaucugucccccuuuaugagaggcgcccauaacauuagcuucguuacaccuccgucuagccgguccucuagccagggcaccguguccaccguccccaaggaagugcucgacagcuggacaggggcuuuuaauacgcgcagacaaccucuguucgcccacauccggaaacgcggagagucuagaguuuga

SEQ ID NO: 30781 - RNA, 807 nt, Artificial Sequence; identical to SEQ ID NO: 30662
  derived and/or modified sequence opt5 from capsid_protein_VP2__Norovirus__AGE89635

SEQ ID NO: 30782 - RNA, 807 nt, Artificial Sequence
  derived and/or modified sequence opt5 from capsid_protein_VP2__Norovirus__AGE89638
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaagguucuggacuggucuggcacccgcuacugggccccugaugcgagaacaaccacauauaacgccgggcgguuuagcaccccgcagcccuccggaacacugccuggccgcauuaaucccagaaccccuacgcccgcucgggggucuagcuccaccagcucuaacgccuccacagcuaccagcauccaucucaaucaaacagugucuacccgccugggauccacggccggcagcgggacaaacguguccucucuuccuagcaccgccagaacacgguccugggucgaggaccagaaucgcaaccugagcccguucaugagaggagcucacaauaucucuuuugugacacccccuuccagccggucuagcucccagggcaccguuucuaccgugcccaaagagguccucgauagcuggacgggcgcguucaacacccgcagacaaccucuguuugcccauauucggcgcagaggggaaucccggguguga

SEQ ID NO: 30783 - RNA, 807 nt, Artificial Sequence
  derived and/or modified sequence opt5 from capsid_protein_VP2__Norovirus__AGE89641
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaagguucuggacuggucuggcacccgcuacugggccccugaugcgagaacaaccacauauaacgccgggcgguuuagcaccccgcagcccuccggaacacugccuggccgcauuaaucccagaaccccuacgcccgcucgggggucuagcuccaccagcucuaacguguccacagccaccagcaucuacucuaaucaaacaguguccacccgccucggaagcacggcuggcuccgggacaaacgucucuagccugccuuccaccgccagaacacggagcuggguggaggaccagaaucgcaaccuuucuccguucaugagaggagcccauaauaucuccuuuguuacacccccuagcucucggagcuccucucagggcaccgugagcaccguccccaaagaggugcuggauuccuggacgggcgcuuucaacacccgcagacaaccucucuuugcgcacauucggcgcagaggggaaagccggguuuga

SEQ ID NO: 30784 - RNA, 807 nt, Artificial Sequence
  derived and/or modified sequence opt5 from capsid_protein_VP2__Norovirus__AGE89644
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaagguucuggacuggucuggcacccgcuacugggccccugaugcgagaacaaccacauauaacgccgggcgguuuagcaccccgcagcccuccggagcucugccuggccgcauuaaucccagaacaccuacccccgcccgggggucuagcuccacgagcucuaacgcuuccaccgccacaagcauccauucuaaucaaaccguguccacacgccucggaagcaccgccggcuccgggacgaacgugucuggacugccuagcacagcuagaacccgguccugggucgaggaccagaaucgcaaccuuagcccguucaugagaggcgcgcacaauaucucuuuugugacacccccuuccagccggucuagcucccagggcaccguuucuaccgugcccaaagagguccuggauagcuggacaggggccuucaacacgcgcagacaaccucucuuugcucauauucggcgcagaggagaaucccggguguga

SEQ ID NO: 30785 - RNA, 807 nt, Artificial Sequence
  derived and/or modified sequence opt5 from capsid_protein_VP2__Norovirus__AGE89647
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaagguucuggacuggucuggcacccgcuacugggccccugaugcgagaacaaccacauauaacgccgggcgguuuagcaccccgcagcccuccggaacacugccuggccgcauuaaucccagaaccccuacgcccgcucgggggucuagcuccaucagcucuaacgccuccaccgcuacaagcauccauucuaaucaaaccguguccacacgccucggaagcaccgccggcuccgggacgaacgugucuagcuucccuuccacagccagaacccggagcugggucgaggaccagaaucgcaaccugucuccguuuaugagaggagcucacaauauuuccuucgugacacccccuagcucucggagcuccucucagggcaccguuagcaccgugcccaaagagguccuugauuccuggacaggcgcguuuaacacgcgcagacaaccucuguucgcccauauccggcgcagaggggaaagccggguguga

SEQ ID NO: 30786 - RNA, 807 nt, Artificial Sequence; identical to SEQ ID NO: 30760
  derived and/or modified sequence opt5 from capsid_protein_VP2__Norovirus__AGE89650

SEQ ID NO: 30787 - RNA, 807 nt, Artificial Sequence
  derived and/or modified sequence opt5 from capsid_protein_VP2__Norovirus__AGE89653
auggccggcgcuuucuuugccgggcuggcgagcgacgugcucggauccggccuggggucucuuaucaacgcuggagccggcgccauuaaucagaaggucgaguucgaaaacaauagaaaacugcaacaggcuagcuuucaguucuccucuaaccuccagcaagccagcuuucagcacgauaaggagaugcugcaggcucagaucgaagccaccaaaaagcugcaacaggagaugaugcggguuaaacaggcgaugcuucucgaagggggauucuccgagacagacgccgcucgcggcgccauuaaugcucccaugacgaaggcccuggauuggucuggcaccagauacugggcgccugacgcccggacaaccacauauaacgcugggcauuuuagcaccccgcaguccagcggagcccugcccggccgcgcuaaucucagagccgccgugccugcucgggggucuuccagcacaucuuccaacagcucuaccgcgacguccguguacagcaaucaaaccaucuccacacgccugggaucuaccgccggcagcgggacauccgucagcucucuucccuccaccgcuagaacgcggagcuggguggaggaucagaaccgcaaucugucuccuuucaugagaggagcccacaacauuagcuuuguuacacccccuuccucucggccgagcucccagggcaccgugagcacaguccccaaggaagugcucgacucuuggaccggcgccuucaauacccgcagacaaccucuguuugcucauauccggaaacgcggggaguccagagccuga

SEQ ID NO: 30788 - RNA, 807 nt, Artificial Sequence; identical to SEQ ID NO: 30670
  derived and/or modified sequence opt5 from capsid_protein_VP2__Norovirus__AGE89656

SEQ ID NO: 30789 - RNA, 807 nt, Artificial Sequence
  derived and/or modified sequence opt5 from capsid_protein_VP2__Norovirus__AGE89659
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaagguucuggacuggucuggcacccgcuacugggccccugaugcgagaacaaccacauauaacgccgggcgguuuagcaccccgcagcccuccggaacacugccuggccgcauuaaucccagaaucccuacccccgcucgggggucuagcuccacgagcucuaacgccuccaccgcuacaagcaucuacucuaaucaaaccguguccacacgccucggaagcgccgccggcuccgggaccaacgugucuagccugccuuccacggcuagaacacggagcugggucgaggaccagaaucgcaaccuuucuccguucaugagaggagcgcauaauauuuccuuugugacacccccuagcucucggagcuccucucagggcaccguuagcaccgugcccaaagagguccuggauuccuggaccggcgccuucaacacacgcagacaaccucucuuugcucacauccggcgcagaggggaaagccggguguga

SEQ ID NO: 30790 - RNA, 807 nt, Artificial Sequence
  derived and/or modified sequence opt5 from capsid_protein_VP2__Norovirus__AGE89662
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucaaugcucccaugacgaagguucuggacuggucuggcacccgcuacugggccccugaugcgagaacaaccacauauaacgccgggcgguuuagcaccccgcagcccuccggaacacugccuggccgcauuaaucccagaaccccuacgcccgcucgggggagcucuaacaccuccagcaaugccucuacagcuaccuccauccauagcaaccaaacagugucuacccgccucggauccacggccggcagcgggacaaauguguccucucugccuagcaccgccagaacacgguccugggucgaggaccagaaccgcaaucuuagcccguucaugagaggagcucacaacaucucuuuugugacacccccuuccagccggucuagcucccagggcaccguuucuaccgugcccaaagagguccuggauagcuggacgggcgcguucaauacccgcagacaaccucucuuugcccauauucggcgcagaggggaaucccggguguga

SEQ ID NO: 30791 - RNA, 807 nt, Artificial Sequence; identical to SEQ ID NO: 30677
  derived and/or modified sequence opt5 from capsid_protein_VP2__Norovirus__AGE89665

SEQ ID NO: 30792 - RNA, 807 nt, Artificial Sequence; identical to SEQ ID NO: 30790
  derived and/or modified sequence opt5 from capsid_protein_VP2__Norovirus__AGE89668

SEQ ID NO: 30793 - RNA, 807 nt, Artificial Sequence
  derived and/or modified sequence opt5 from capsid_protein_VP2__Norovirus__AGE89671
auggccggcgcuuucuuugccgggcuggcgagcgacgugcucggauccggccuggggucucuuaucaacgcuggagccggcgccauuaaucagaagaucgauuucgagaacaauagaaaacugcaacaggcuagcuuucaguucuccucuaaccuccagcaagccagcuuucagcacgacaaggaaaugcugcaggcucagauugaggccaccaaaaagcugcaacaggaaaugaugaaagucaagcaggcgaugcuucucgaagggggauucuccgagacagaugccgcucggggcgccaucucugcucccaugacgaagguucuggacuggagcggcacccgcuacugggccccugaugcgagaacaaccacauauaauuccgggcgguuuagcaccccgcagcccucuggaacacugccuggccgcauuaaccccagaaccccuacgcccgcccggggguccagcucuaccuccagcaaugcuucuacagccaccuccauccaucucaaccaaacagugagcacccgccugggauccacggcuggcucugggacaaaugugagcucccuuccuagcaccgccagaacacggucuugggucgaggaccagaaccgcaaucuguccccguucaugagaggagcccacaacaucagcuuugugacacccccuucuagccgguccucuagccagggcaccguuuccaccgugcccaaagagauucucgauagcugggcuggcgcguucaauacgcgcagacaaccucuguuugcccauauccggcgcagaggggaaucucgggucuga

SEQ ID NO: 30794 - RNA, 807 nt, Artificial Sequence; identical to SEQ ID NO: 30790
  derived and/or modified sequence opt5 from capsid_protein_VP2__Norovirus__AGE89674

SEQ ID NO: 30795 - RNA, 807 nt, Artificial Sequence
  derived and/or modified sequence opt5 from capsid_protein_VP2__Norovirus__AGE99604
auggccggcgcuuucuuugccgggcuggcgagcgacgugcucuccucuggacugggcagccuuaucaacgcuggggccggagccauuaaucagaagaucgauuucgagaacaauagaaaacugcaacaggcuuccuuucaguucucuagcaaccuccagcaagccuccuuucagcacgacaaggaaaugcugcaggcucagauugaggccaccaaaaagcugcaacaggaacuuaugaaagucaagcagacaauccuccuggagggcggguucucugaaacggaugcggcccggggagcuauuaaugcccccaugaccaaggcucuggacuggagcggcacacgcuacugggccccugaugcgagaaccacaaccuauaacgccggccgguuuuccacaccgcagcccagcggggcucucccuggacgcaucaaucccagaaccccuauccccgcccggggcucuccuuccauuagcucuaacgcuuccacggccaccagcauccauucuaaucaaacagccuccacccgccuggggagcacagcuggauccggcaccaacguuucuagccuuccguccacggcgagaacacggagcuggguggaggaccagaaucgcaaccugucucccuucaugagaggggcccacaauauuuccuuugugaccccucccagcucucggagcuccucucagggaacagucagcaccgugccuaaagauguucucgacuccuggaccggcgcuuucaacacacgcagacaaccccuguuugcccauauccggcgcagaggcgagagccggguguga

SEQ ID NO: 30796 - RNA, 807 nt, Artificial Sequence
  derived and/or modified sequence opt5 from capsid_protein_VP2__Norovirus__AGE99607
auggccggccccuucuuugcugggcuggccagcgacgugcucggauccggccuggggucucuuaucagcgcgggagcuggcgccauuaaccagaaggucgaguucgaaaauaacagaaaacugcaacaggccuccuuucaguucucuagcaaucuccagcaggcuuccuuucaacacgauaaggagaugcugcaggcccagaucgaagcuacccaaaaacuucagcaggagcugaugaagguuaaacaggccgugcuccuggaagggggauucucuacaacggacgcggcccggggcgcuauuaacgccccuaugaccaaggcucuggauuggagcggcacacgcuacugggccccggacgcgagaaucaccacauauaaugccgggcgguuuuccacaccccaaccucucggagcucugcccggccgcaccaacccuagagugcccgccagcgcucggucuuccccuagcucucuuuccaaugccccgaccgccacgagcgucuacucuaaccagaccgcuuccacacgccuggggagcuccgcgggaucuggcgccggggugagcucccuccccagcaccgcuagaacacggucuuggguugaggaucagaauaagaaccuguccccuuucaugaaaggagcccuuaauaccagcuuugugacgcccccuucuagccgcuccucuaaccaaggcacagucagcaccgugcccaaggagauucuggacuccuggacaggcgccuucaauaccagacggcagccgcucuuugcucauauccgcaaaagaggggaaagccggguuuga

SEQ ID NO: 30797 - RNA, 807 nt, Artificial Sequence
  derived and/or modified sequence opt5 from capsid_protein_VP2__Norovirus__AGK36312
auggccggcgcuuucuuugccgggcuggcgagcgacgugcucggauccggccuggggucucuuaucaacgcuggagccggcgccauuaaucagaagaucgauuucgagaacaauagagaacugcaacaggcuagcuuucaguucuccucuaaccuccagcaagccagcuuucagcacgacaaagagaugcugcaggcucagauugaagccaccaagaaacuucaacaggagaugaugaaggucaaacaggcgaugcugcucgaagggggauucuccgagacagaugccgcucggggcgccaucaaugcucccaugacgaagguucuggacuggucuggcacccgcuacugggccccugaugcgagaacaaccacauauaacgccgggcgguuuagcaccccgcagcccuccggaacacugccuggccgcauuaaucccagaaccccuacgcccgcucgggggucuagcuccgccagcucuaacgcuuccaccgccacaagcaucuacucuaaucaaaccguguccacacgccucggaagcaccgccggcuccgggacgaacgugucuagccugccuuccacagcuagaacccggagcugggucgaggaccagaaucgcaaccuuucuccguucaugagaggagcgcauaauaucuccuuugugacacccccuagcucucggagcuccucucagggcaccguuagcaccgugcccaaggaaguccuggauuccuggacaggcgccuucaacacgcgcagacaaccucucuuugcucacauucggcgcagaggggagagccggguguga

SEQ ID NO: 30798 - RNA, 807 nt, Artificial Sequence; identical to SEQ ID NO: 30769
  derived and/or modified sequence opt5 from capsid_protein_VP2__Norovirus__AGK36315

SEQ ID NO: 30799 - RNA, 639 nt, Artificial Sequence
  derived and/or modified sequence opt5 from capsid_protein_VP2__Norovirus__AGM33209
auggcccaggcuaucauuggcgccaucgcggcuagcaccgccggguccgcccugggagcuggcauucaagucgggggagaggccgcucuccagucucagagauaccagcaaaaccugcagcuucaggaaaauagcuucaagcacgaccgggagaugaucggcuaucagguggaagccuccaaccaacugcucgcgaaaaaucuggccacacgcuacucucuucugagagcugggggacucacgagcgccgaugcugcccgguccguugcgggcgcccccgugacccgcauuguggacuggaacggcgucagagugucugcuccugagagcuccgccacaacccugcggagcgggggauuuaugucuguuccgauccccuucgcuuccaagcagaaacaggugcagagcucuggcaucuccaauccuaacuauagccccucuuccauuagccgcacaaccuccugggucgaaucucaaaauagcuccagauuugggaaccugagcccuuaccaugccgaggcccucaauacaguguggcugacgcccccuggaucuaccgcuuccagcacccuuucuagcguuccgcggggcuauuucaacacagaucgccugccccucuuugcgaauaacagacgguga

SEQ ID NO: 30800 - RNA, 639 nt, Artificial Sequence
  derived and/or modified sequence opt5 from capsid_protein_VP2__Norovirus__AGM33215
auggcccaggcuaucauuggcgccaucgcggcuagcaccgccggguccgcccugggagcuggcauucaagucgggggagaggccgcucuccagucucagagauaccagcaaaaccugcagcuucaggaaaauagcuucaagcacgaccgggagaugaucggcuaucagguggaagccuccaaccaacugcucgcgaaaaaucuggccacacgcuacucucuucugagagcugggggacucacgagcgccgaugcugcccgguccguugcgggcgugcccgugacccgcauugucgacuggaacggcgugagaguuucugccccugagagcuccgcuacaacccugcggagcgggggauuuaugucugugccgauccccuucgccuccaagcagaaacagguccagagcucuggcaucuccaauccuaacuauagccccucuuccauuagccgcacaaccuccuggguggaaucucaaaauagcuccagauuugggaaccugagcccuuaccaugcugaggcccucaauacaguuuggcugacgcccccuggaucuaccgccuccagcacccuuucuagcgugccgcggggcuauuucaacacagaucgccugccccucuuugcuaauaacagacgguga

SEQ ID NO: 30801 - RNA, 639 nt, Artificial Sequence; identical to SEQ ID NO: 30799
  derived and/or modified sequence opt5 from capsid_protein_VP2__Norovirus__AGM33218

SEQ ID NO: 30802 - RNA, 639 nt, Artificial Sequence; identical to SEQ ID NO: 30799
  derived and/or modified sequence opt5 from capsid_protein_VP2__Norovirus__AGM33221

SEQ ID NO: 30803 - RNA, 639 nt, Artificial Sequence; identical to SEQ ID NO: 30800
  derived and/or modified sequence opt5 from capsid_protein_VP2__Norovirus__AGM33224

SEQ ID NO: 30804 - RNA, 639 nt, Artificial Sequence; identical to SEQ ID NO: 30799
  derived and/or modified sequence opt5 from capsid_protein_VP2__Norovirus__AGM33227

SEQ ID NO: 30805 - RNA, 639 nt, Artificial Sequence; identical to SEQ ID NO: 30800
  derived and/or modified sequence opt5 from capsid_protein_VP2__Norovirus__AGM33230

SEQ ID NO: 30806 - RNA, 639 nt, Artificial Sequence
  derived and/or modified sequence opt5 from capsid_protein_VP2__Norovirus__AGM33233
auggcccaggcuaucauuggcgccaucgcggcuagcaccgccggguccgcccugggagcuggcauucaagucgggggagaggccgcucuccagucucagagauaccagcaaaaccugcagcuucaggaaaauagcuucaagcacgaccgggagaugaucggcuaucagguggaagccuccaaccaacugcucgcgaaaaaucuggccacacgcuacucucuucugagagcugggggacucacgagcgccgaugcugcccgguccguugcgggcgugcccgugacccgcauugucgacuggaacggcgugagaguuucugccccugagagcuccgcuacaacccugcggagcgggggauuuaugucugugccgauccccuucgccuccaagcagaaacagauccagagcucuggcauuuccaauccuaacuauagccccucuuccaucagccgcacaaccuccugggucgaaucucaaaauagcuccagauuugggaaccugagcccuuaccaugcugaggcccucaauacaguguggcugacgcccccuggaucuaccgccuccagcacccuuucuagcguuccgcggggcuauuucaacacagaucgccugccccucuuugcuaauaacagacgguga

SEQ ID NO: 30807 - RNA, 639 nt, Artificial Sequence; identical to SEQ ID NO: 30799
  derived and/or modified sequence opt5 from capsid_protein_VP2__Norovirus__AGM33236

SEQ ID NO: 30808 - RNA, 639 nt, Artificial Sequence; identical to SEQ ID NO: 30799
  derived and/or modified sequence opt5 from capsid_protein_VP2__Norovirus__AGM33239

SEQ ID NO: 30809 - RNA, 639 nt, Artificial Sequence; identical to SEQ ID NO: 30799
  derived and/or modified sequence opt5 from capsid_protein_VP2__Norovirus__AGM33242

SEQ ID NO: 30810 - RNA, 639 nt, Artificial Sequence; identical to SEQ ID NO: 30800
  derived and/or modified sequence opt5 from capsid_protein_VP2__Norovirus__AGM33245

SEQ ID NO: 30811 - RNA, 639 nt, Artificial Sequence; identical to SEQ ID NO: 30799
  derived and/or modified sequence opt5 from capsid_protein_VP2__Norovirus__AGT17786

SEQ ID NO: 30812 - RNA, 639 nt, Artificial Sequence; identical to SEQ ID NO: 30799
  derived and/or modified sequence opt5 from capsid_protein_VP2__Norovirus__AGT17793

SEQ ID NO: 30813 - RNA, 807 nt, Artificial Sequence
  derived and/or modified sequence opt5 from capsid_protein_VP2__Norovirus__AGT17796
auggccggcgcuuucuuugccgggcuggcgagcgacgugcucggauccggccuggggucucuuaucaacgcuggagccggcgccauuaaucagaaggucgaguucgaaaacaauagaaaacugcaacaggcuagcuuucaguucuccucuaaccuccagcaagccagcuuucagcacgauaucgagaugcugcaggcucagauugaagccaccaagaaacuucaacaggagaugaugcgggcgaagcaggccaugcugcucgaagggggauucuccgagacagacgcugcccgcggcgcuaucaaugcccccaugacgaaaacccuggauuggucuggcacaagauacugggcgccugacgcccggaccacaaccuauaacgcugggcgcuuuagcacaccgcagcccuccggagcccaaccuggcagagcuaaucugcgggccaccguucccgcccgcgggucuagcuccacgagcucuaacuccagcauugcuaccucuguguacuccaaucagacaaccagcacaagacucggauccaccgcgggcucugggacgagcguguccagccugccuucuacagcccggacccgcuccugggucgaggaucagaacagaaaucuuagccccuucaugcggggagcucauaacaucucuuuugugacaccuccgagcucccgcucuagcucccaaggcaccguuagcaccgugcccaaggaaguccuggacucuuggacaggcgccuucaauacgagacggcagccucucuuugcccacauccgcaagagaggggagucccggguguga

SEQ ID NO: 30814 - RNA, 807 nt, Artificial Sequence
  derived and/or modified sequence opt5 from capsid_protein_VP2__Norovirus__AGT17799
auggccggcgcuuucuuugccgggcuggcgagcgacgugcucggauccggccuggggucucuuaucaacgcuggagccggcgccauuaaucagaaggucgaguucgaaaacaauagaaaacugcaacaggauagcuuucaguucuccucuaaccuccagcaagcuagcuuucagcacgacaaggagaugcugcaggcccagaucgaagcuaccaaaaagcugcaacaggagaugaugcggguuaaacaggccaugcuucucgaagggggauucuccgagacagaugcggcccgcggcgcuauuaaugcccccaugacgaaggugcuggacuggucuggcaccagauacugggcuccuggggcccggacaaccacauauaacgcgggauacuuuagcaccccgcagcauuccggcgcccugcccgggcgcgcuaaucucagagccguggucccugcucggggaagcucucgcguguccagcaacucuuccacagccaccagcguuuauucuaaucaaacggccuccaccagacugggcagcacagcuggguccggaaccucugugagcucccuucccagcacagcgcggacccgcucuugggucgaggaucagaacagaaaucuguccccuuucaugcggggcgcccacaacaucagcuuugugacgcccccuucuagccgcuccucuagccagggcacaguuuccaccgugccgaaggaaguccucaauagccaagcugggguguucaacacaagacggcagccccuguuugcccauauucgcagacggggagagucuagagccuga

SEQ ID NO: 30815 - RNA, 639 nt, Artificial Sequence; identical to SEQ ID NO: 30799
  derived and/or modified sequence opt5 from capsid_protein_VP2__Norovirus__AGT17804

SEQ ID NO: 30816 - RNA, 639 nt, Artificial Sequence; identical to SEQ ID NO: 30799
  derived and/or modified sequence opt5 from capsid_protein_VP2__Norovirus__AGT17807

SEQ ID NO: 30817 - RNA, 639 nt, Artificial Sequence; identical to SEQ ID NO: 30799
  derived and/or modified sequence opt5 from capsid_protein_VP2__Norovirus__AGT17810

SEQ ID NO: 30818 - RNA, 807 nt, Artificial Sequence
  derived and/or modified sequence opt5 from capsid_protein_VP2__Norovirus__AGT17814
auggccggcgcuuucuuugccgggcuggcgagcgacgugcucggauccggccuggggucucuuaucaacgcuggagccggcgccauuaaucagaaggucgaguucgaaaacaauagaaaacugcaacaggcuagcuuucaguucuccucuaaccuccagcaagccagcuuucagcacgauaaggagaugcugcagucccagaucgacgcuaccaaaaagcugcaacaggaaaugaugcggguuaaacaggccaugcuucucgaagggggauucucugagacagaugcggcccgcggcgcuauuaaugcccccaugacgaaggugcuggacuggagcggcaccagauacugggcuccugaugcccggacaaccacauauaacgcggggcgcuuuuccaccccgcagcccagcggagccccucccggcagagcuaaucugcgggccgcugugccugcccgcgggucuuccagcacaucuuccaacagcucuaucgccaccuccauguacagcaaucaaacgaccuccacaagacucggaucuaccgcuggcagcgggacauccgucagcucucugcccuccagcgcgcggacccgcucuuggguggaggaccagaacagaaaucuuagcccuuucaugcggggagcccauaacauuuccuuuguuacgccgcccucuagccgcuccagcucucagggcacaguguccaccgucccuaaggaggugcuggauagcuggacaggcgcuuucaauaccagacggcaaccccucuuugcccacauccgcagaagaggggaaucucggguuuga

SEQ ID NO: 30819 - RNA, 807 nt, Artificial Sequence
  derived and/or modified sequence opt5 from capsid_protein_VP2__Norovirus__AGT17820
auggccggcgcuuucuuugccgggcuggcgagcgacgugcucggauccggccuggggucucuuaucaacgcuggagccggcgccauuaaucagaaggucgaguucgaaaacaauagaaaacugcaacaggcuagcuuucaguucuccucuaaccuccagcaagccagcuuucagcacgauaaggagaugcugcaggcucagaucgaagccaccaaaaagcugcaacaggagaugaugcgggcgaaacaggccaugcuucucgaagggggauucuccgagacagacgcugcccgcggcgcuauuaaugcccccaugacgaagacccuggauuggucuggcacaagauacugggcgccugacgcccggaccacaaccuauagcgcugggcgcuuuuccacaccgcagcccagcggagcccugccuggcagagcuaaccuccgggccaccguucccgcccgcgggucuuccagcacgucuuccaauagcucuaucgcuaccuccguguacagcaaccaaacaaccuccacaagacugggaucuaccgcgggcagcgggacguccgugagcucucuuccuuccacagcccggacccgcagcugggucgaggaucagaauagaaaccugucucccuucaugcggggagcucauaauauuagcuuugugacaccuccguccucucgcagcuccagccagggcaccguuucuaccgugcccaaggaaguccucgacuccuggacaggcgccuucaacacgagacggcaaccucuguuugcccacauccgcaaaagaggggagagccggguguga

SEQ ID NO: 30820 - RNA, 807 nt, Artificial Sequence
  derived and/or modified sequence opt5 from capsid_protein_VP2__Norovirus__AGT17824
auggccggcgcuuucuuugccgggcuggcgagcgacgugcucggauccggccuggggucucuuaucaacgcuggagccggcgccauuaaucagaaggucgaguucgaaaacaauagaaaacugcaacaggauagcuuucaguucuccucuaaccuccagcaagcuagcuuucagcacgacaaggagaugcugcaggcccagaucgaagcuaccaaaaagcugcaacaggagaugaugcggguuaaacaggccaugcuucucgaagggggauucuccgagacagaugcggcccgcggcgcuauuaaugcccccaugacgaaggugcuggacuggucuggcaccagauacugggcuccugaugcccggacaaccacauauaacgcggggcauuuuagcaccccgcagcacuccggagcccugcccggccgcgcuaaucucagagccacagugccugcucgggggagcucucgcgccuccagcaacucuuccaccgccacgagcgucuacucuaaucaaaccacauccaccagacugggaagcacagcuggcuccgggaccucugugagcucccuucccagcacggcgcggacacgcucuuggguugaggaccagaacagaaaucuguccccuuucaugcggggagcccauaacaucagcuuugugacacccccuucuagccgcuccucuagccagggcaccgucuccaccgugccgaaggaaguucucaauagcagaaccggcgcuuucaacacacggcgccaaccccuguuugcccacauuagacggcagggggagucuagagccuga

SEQ ID NO: 30821 - RNA, 639 nt, Artificial Sequence; identical to SEQ ID NO: 30799
  derived and/or modified sequence opt5 from capsid_protein_VP2__Norovirus__AGT17827

SEQ ID NO: 30822 - RNA, 807 nt, Artificial Sequence
  derived and/or modified sequence opt5 from capsid_protein_VP2__Norovirus__AGT17831
auggccggcgcuaucauugccgggcuggcgagcgacgugcucuccucuggacugggcagccuuaucaacgcuggggccggagucauuaaucagaagguugauuucgagaacaauaaacaacugcagcagaacuccuuucaguucucuagcaaucuccaacaggccuccuuucagcacgacaaggaaaugcugcaggcucaaaucgaggccaccaaaaagcugcagcaggaaaugaugggcauuaaacaggcugugcuucucaaagggggauucucugagacagaugccgcgagaggcgccgugaacgcucccaugacgaagguccuggacuggagcggcacccgguacugggccccuaaugcuuccacaaccacauauaacgccgggcgcuuuagcaccccgcaacccucuggagcgcugccuggcagaacaaaucuccggaccgccgcucccgcccgcggguccccuagcaucucuuccaacgcuagcacggccaccucuguguacuccaaucagacaguuagcaccagacugggaacauccgccggcucugggaccagcguguccagccuucccucuacggcucggacacgcuccugggucgaagaucagaacagaaaucugagcccuuucaugcggggagcgcauaacaucucuuuugugaccccgcccagcucccgcucuagcucccaaggcacaguuagcaccgugccuaaggagguccucgacucuuggaccggcgccuucaauacaagacggcagccccuguuugcucacauucgcaagagaggggagucccggguguga

SEQ ID NO: 30823 - RNA, 639 nt, Artificial Sequence; identical to SEQ ID NO: 30799
  derived and/or modified sequence opt5 from capsid_protein_VP2__Norovirus__AGT17837

SEQ ID NO: 30824 - RNA, 807 nt, Artificial Sequence
  derived and/or modified sequence opt5 from capsid_protein_VP2__Norovirus__AGT17843
auggccggcgcuuucuuugccgggcuggcgagcgacgugcucggauccggccuggggucucuuaucaacgcuggagccggcgccauuaaucagaaggucgaguucgaaaacaauagaaaacugcaacaggauagcuuucaguucuccucuaaccuccagcaagcuagcuuucagcacgacaaggagaugcugcaggcccagaucgaagcuaccaaaaagcugcaacaggagaugaugcggguuaaacaggccaugcuucucgaagggggauucuccgagacagaugcggcccgcggcgcuauuaaugcccccaugacgaaggugcuggacuggaacggcaccagauacugggcuccuggggcccggacaaccacauauaaugcgggacauuuuucuaccccgcagcacagcggcgcccugcccgggcgcgcuaaccucagagccgcugugccugcccggggauccagccgcgccucuuccaauagcucuacagcuaccuccgucuacagcaaccaaacgaccucuacaagacugggcuccaccgcggggagcggaacauccgugucuagccuucccuccaccgcccggacgcgcagcuggguugaggaucagaauagaaaccugucuccuuucaugcggggcgcucauaauaucuccuuugugacacccccuagcucucgcagcuccucucagggcaccgucagcacagugccgaaggaaguucucaacucccaaaccggggccuucaauaccagacggcagccccuguuugcccacauucgcagacggggagagagcagagcuuga

SEQ ID NO: 30825 - RNA, 807 nt, Artificial Sequence
  derived and/or modified sequence opt5 from capsid_protein_VP2__Norovirus__AGX85887
auggccggcgcuuucuuugccgggcuggcgagcgacgugcucuccucuggacugggcagccuuaucaacgcuggggccggagccauuaaucagaccgucgaguucgaaaacaauagaaagcugcaacaggcuuccuuucaguucucuagcaaccuccagcaagccuccuuucagcacgauaaagagaugcugcagucucagaucgacgcuacaaagaaacuucaacaggaaaugaugcggguuaagcaggccaugcugcucgagggcggguucagcgaaacggaugcggcccgcggagcuauuaaugcccccaugaccaaagugcuggacugguccggcacaagauacugggcuccugaugcccggaccacaaccuauaacgcgggccgcuuuagcacaccgcagucuuccggggcucccccuggcagagccaaucugcgggccgcugugcccgcccaaggaucuagcuccaccagcucuaacuccagcaucgccacguccauguacucuaaucagaccacaagcacccgccucggguccacagcuggaagcggcaccucugucuccagccugccuucuagcgcgagaacgcgguccuggguggaggaccagaaccgcaaucuuucucccuucaugagaggggcccauaacauuagcuuuguuacaccuccguccagccggucuuccagccaaggaaccgugucuacaguccccaaggaggugcuggauuccuggaccggcgcuuucaauacccgcagacagccucucuuugcccacauccggcgcagaggcgaaagccggguuuga

SEQ ID NO: 30826 - RNA, 807 nt, Artificial Sequence
  derived and/or modified sequence opt5 from capsid_protein_VP2__Norovirus__AGX85893
auggccggcgcuuucuuugccgggcuggcgagcgacgugcucggauccggccuggggucucuuaucaacgcuggagccggcgccauuaaucagaaggucgaguucgaaaacaauagaaaacugcaacaggauagcuuucaguucuccucuaaccuccagcaagcuagcuuucagcacgacaaggagaugcugcaggcccagaucgaagcuaccaaaaagcugcaacaggagaugaugcggguuaaacaggccaugcuucucgaagggggauucuccgagacagaugcggcccgcggcgcuauuaaugcccccaugacgaaggugcuggacuggucuggcaccagauacugggcuccuggggcccggacaaccacauauaacgcgggauacuuuagcaccccgcagcauuccggcgcccugcccgggcgcgcuaaucucagagccgcugugccugcccggggaagcucucgcgucuccagcaacucuuccacagccaccagcguguauucuaaucaaacggcuuccaccagacugggcagcacagcgggguccggaaccucuguuagcucccuucccagcacagcccggacccgcucuuggguggaggaucagaacagaaaucuguccccuuucaugcggggcgcucacaacaucagcuuugucacgcccccuucuagccgcuccucuagccagggcacaguguccaccguuccgaaggaagugcucaauagccaaacaggggucuucaacaccagacggcagccccuguuugcccauauucgcagacggggagagucuagagccuga

SEQ ID NO: 30827 - RNA, 807 nt, Artificial Sequence
  derived and/or modified sequence opt5 from capsid_protein_VP2__Norovirus__AGX85896
auggccggcgcuuucuuugccgggcuggcgagcgacgugcucggauccggccuggggucucuuaucaacgcuggagccggcgccauuaaucagaaggucgaguucgaaaacaauagaaaacugcaacaggauagcuuucaguucuccucuaaccuccagcaagcuagcuuucagcacgacaaggagaugcugcaggcccagaucgaagcuaccaaaaagcugcaacaggagaugaugcggguuaaacaggccaugcuucucgaagggggauucuccgagacagaugcggcccgcggcgcuauuaaugcccccaugacgaaggugcuggacuggucuggcaccagauacugggcuccuggggcccggacaaccacauauaacgcgggauacuuuagcaccccgcagcauuccggcgcccugcccgggcgcgcuaaucucagagccgcugugccugcccggggaagcucucgcgucuccagcaacucuuccacagccaccagcguguauucuaaucaaacggcuuccaccagacugggcagcacagcgggguccggaaccucuguuagcucccuucccagcacagcccggacccgcucuuggguggaggaucagaacagaaaucuguccccuuucaugcggggcgcucacaacaucagcuuugucacgcccccuucuagccgcuccucuagccagggcacaguguccaccguuccgaaggaagugcucaauagccaaacaggggccuucaacaccagacggcagccccuguuugcccauauucgcagacggggagagucuagagcuuga

SEQ ID NO: 30828 - RNA, 807 nt, Artificial Sequence
  derived and/or modified sequence opt5 from capsid_protein_VP2__Norovirus__AGX85905
auggccggcgcuuucuuugccgggcuggcgagcgacgugcucuccucuggacugggcagccuuaucaacgcuggggccggagccauuaaucagagaaucgauuucgagaacaaucggaagcugcaacaggcuuccuuucaguucucuagcaaccuccagcaagccuccuuucagcacgacaaagaaaugcugcaggcucagauugaggccaccaagaaacuucaacaggaacugaugaaggucaaacaggcgaugcuccuggagggcggguucucugaaacagaugccgcucgcggagccaucaaugcucccaugacgaaggcccuggacuggagcggcaccagauacugggcgccugaugcccggacaaccacauauaacgcuggccgcuuuuccaccccgcagcccagcggggcccucccuggaagaauuaauccccggacaccuauccccgcucgcggcucuccuuccaucagcucuaacguuuccaccgccaauagcauucauucuaaccaaacggccuccaccagacuggggagcacagcuggauccggcaccgacgugucuagccuuccguccacagcgcggacccgcagcuggguggaggaucagaauagaaaccugucucccuucaugcgcggggcccacaauaucuccuuugucacgccucccagcucucggagcuccucucagggaacagugagcaccguuccuaaggacgugcucgauuccuggacaggcgcuuucaacaccagacggcaaccccuguuugcccauauucgcagacggggcgagagcagagucuga

SEQ ID NO: 30829 - RNA, 807 nt, Artificial Sequence
  derived and/or modified sequence opt5 from capsid_protein_VP2__Norovirus__AGX85914
auggccggcgcuuucuuugccgggcuggcgagcgacgugcucggauccggccuggggucucuuaucaacgcuggagccggcgccauuaaucagaaggucgaguucgaaaacaauagaaaacugcaacaggauagcuuucaguucuccucuaaccuccagcaagcuagcuuucagcacgacaaggagaugcugcaggcccagaucgaagcuaccaaaaagcugcaacaggagaugaugcggguuaaacaggccaugcuucucgaagggggauucuccgagacagaugcggcccgcggcgcuauuaaugcccccaugacgaaggugcuggacuggucuggcaccagauacugggcuccuggggcccggacaaccacauauaacgcgggauacuuuagcaccccgcagcauuccggcgcccugcccgggcgcgcuaaucucagagccguggucccugcucggggaagcucucgcguguccagcaacucuuccacagccaccagcguuuauucuaaucaaacggccuccaccagacugggcagcacagcuggguccggaaccucugugagcucccuucccagcacagcgcggacccgcucuugggucgaggaucagaacagaaaucuguccccuuucaugcggggcgcccacaacaucagcuuugugacgcccccuucuagccgcuccucuagccagggcacaguuuccaccgugccgaaggaaguccucaauagccaaacagggguguucaacaccagacggcagccccuguuugcucauauucgcagacggggagagucuagagccuga

SEQ ID NO: 30830 - RNA, 807 nt, Artificial Sequence; identical to SEQ ID NO: 30825
  derived and/or modified sequence opt5 from capsid_protein_VP2__Norovirus__AGX85917

SEQ ID NO: 30831 - RNA, 807 nt, Artificial Sequence; identical to SEQ ID NO: 30822
  derived and/or modified sequence opt5 from capsid_protein_VP2__Norovirus__AGX85923

SEQ ID NO: 30832 - RNA, 807 nt, Artificial Sequence
  derived and/or modified sequence opt5 from capsid_protein_VP2__Norovirus__AGX85926
auggccggcgcuaucauugccgggcuggcgagcgacgugcucuccucuggacugggcagccuuaucaacgcuggggccggagccauuaaucagaccaucgauuucgagaacaauagaaagcugcaacaggcuuccuuucaguucucuagcaaccuccagcaagccuccuuucagcacgacaaagaaaugcugcaggcucagauugaggccacaaagaaacuucaacaggaaaugaugcgggucaagcaggcgaugcugcucgagggcggguucucugaaacggaugccgcucgcggagccaucaaugcucccaugaccaaaacacuggacuggagcggcaccagauacugggccccugaugcgcggacaaccacauauaacgccggccgcuuuuccaccccgcagcccagcggggcuccucccggcagagccaaucugcgggcuacgaccccugcccgcggaucuuccagcacaucuuccaacagcucuaucgccaccuccguuuacagcaaucaaacaaccuccacgagacucgggucuacagcuggaagcggcaccuccgugagcucucugcccuccacagcgcggacccgcagcuggguggaggaccagaacagaaaucuuucuccuuucaugcgcggggcccauaacauuagcuuugucaccccgcccuccucucggagcuccagccagggaacagugucuacgguuccuaaggaggugcuggauuccuggaccggcgcuuucaauacaagacggcaaccccucuuugcccacauccgcaccagaggcgaaagccgggucuga

SEQ ID NO: 30833 - RNA, 807 nt, Artificial Sequence; identical to SEQ ID NO: 30829
  derived and/or modified sequence opt5 from capsid_protein_VP2__Norovirus__AGX85932

SEQ ID NO: 30834 - RNA, 807 nt, Artificial Sequence; identical to SEQ ID NO: 30829
  derived and/or modified sequence opt5 from capsid_protein_VP2__Norovirus__AGX85935

SEQ ID NO: 30835 - RNA, 780 nt, Artificial Sequence
  derived and/or modified sequence opt5 from capsid_protein_VP2__Norovirus__AHI59155
auggccagcgcuuuccuggccggccucgcgggggacgugaucaccaacggagucggcucccugauuaaugcuggggccaacgccguuaaucagaagguggaguacgauuuuaacaaacaacuucagauggcuucuuucaagcacgacaaagaaaugcugcagagccaggugcucgccacaaagcaacugcagcaggagaugaugaauaucagacagggaguccuuacggcuggcggguuuucccccgccgaugcggcccggggagcugugaacgccccuaugaccaaaauucuggacuggaauggcacacgcuauugggcuccgaacucuaugaagaccacaagcuacuccggccaauucucuagcucccccguucauaagagcccugcccccucucagcacaccgcgcucccuaaauccagacugcagaaugauuuugccagcguguauucuuuccccuccagcgucucuucccagagcacacauuccaccgcucugucugccgggacgggaagcucccggagcaucucuccuuccaccgcuacaccgacccucagccgcacaucugacugggugagaggccaaaacgaacggcugagccccuuuauggauggggcccuucagaccgccuucguuacgccucccuccucuaaggcuagcuccaauggaacagugagcaccgucccuaaagcggugcuggacucuuggacacccauguuuaacacccaccgccagccucucuucgcccauccgagacggcgcggcgagucccaaguguga

SEQ ID NO: 30836 - RNA, 807 nt, Artificial Sequence
  derived and/or modified sequence opt5 from capsid_protein_VP2__Norovirus__AHI59158
auggccggcgcuuucuuugccgggcuggcgagcgacgugcucggauccggccuggggucucuuaucaacgcuggagccggcgccauuaaucagaaggucgaguucgaaaacaauagaaaacugcaacaggcuagcuuucaguucuccucuaaccuccagcaagccagcuuucagcacgauaaggagaugcugcaggcucagaucgaagccaccaaaaagcugcaacaggagaugaugcggguuaaacaggcgaugcuucucgaagggggauucuccgagacagacgccgcucgcggcgccauuaaugcucccaugacgaagacccuggauuggucuggcacaagauacugggccccugacgcgcggaccacaaccuauaacgccgggcgcuuuagcacaccgcagcccuccggagcucugccuggcagagccaaucuccgggcuaccgugcccgcccgcgggagcucuaacacguccucuagcuccagcaucgccaccucuguguacuccaaucaaacaaccagcacaagacugggauccaccgcuggcucugggacgagcgucuccagccuuccuucuacagcgcggacccgcuccuggguggaggaucagaacagaaaucugagccccuucaugcggggagcccauaacauuucuuuuguuacaccuccgagcucccgcucuagcucccagggcaccgugagcaccguccccaaggaagugcucgacucuuggacaggcgcuuucaauacgagacggcaaccucuguuugcccacauccgcaaaagaggggagucccggguuuga

SEQ ID NO: 30837 - RNA, 780 nt, Artificial Sequence
  derived and/or modified sequence opt5 from capsid_protein_VP2__Norovirus__AHI59160
auggccggcgcuuucguggccgggcuggcgggagacguccucagcaacggccuguccucucuuaucaaugcuggggccaacgccauuaaucagagagcugaguuugauuucaaccaaaagcugcagcagaauagcuuuaaccacgacaaagaaaugcuccaggcccaaauccaggcuaccaagcagcugcaggccgauaugauggcgauuaaacaaggaguucuuacagccggcggguucucccccgcugacgccgcucggggagccgugaaugcgccuaugacgcaggcccuggauuggaacggcacccgcuacugggcuccgggcucuaugagaacaaccagcuauuccgggaaguuuacaucuaccgcccccgugcggcaggcugacuuccagcauacacaaagccgcccuuccagcggaucuuccgucagcucuuuugccacccaguccagcagacccacgcucaccacaaccacagggucuucccacggcaccgccagcuccaauucuacgcggagcacaucccugagccagucuaccgugucccgcgcuacaagcagaaccucugaguggguucgggaucaaaaccgcaaucuggaaccuuacaugcauggagcgcuccagaccgccuucgugacacccccuagcuccagagcuucugacggcacggucagcaccgugccgaaagggguucuggauuccuggacacccgccuuuaacacccggcgccagccucuuuucgcccaccugagaaagcggggagagagccaugcuuga

SEQ ID NO: 30838 - RNA, 807 nt, Artificial Sequence
  derived and/or modified sequence opt5 from capsid_protein_VP2__Norovirus__AHI59163
auggccggcgcuuucuuugccgggcuggcgagcgacgugcucggauccggccuggggucucuuaucaacgcuggagccggcgccauuaaucagaaggucgaguucgaaaacaauagaaaacugcaacaggcuagcuuucaguucuccucuaaccuccagcaagccagcuuucagcacgauaaggagaugcugcaggcucagaucgaagccaccaaaaagcugcaacaggagaugaugcggguuaaacaggcgaugcuucucgaagggggauucuccgagacagacgccgcucgcggcgccauuaaugcucccaugacgaagacccuggauuggucuggcacaagauacugggccccugacgcgcggaucaccacauauaacgccgggcgcuuuccgacaccccagcugagcggagcucucccuggcagagccaaucugcgggcuaccgugcccgcccgcggguccccuagcaccucuuccaacagcucuauugccacguccguguacagcaaucaaaccacaucuaccagacuuggauccacagcuggcagcgggaccuccgucucuagccugcccuccacggcgcggacacgcagcuggguggaggaucagaacagaaaucucucuccuuuccugcggggagcccauaacaucuccuuuguuaccccgcccagcucucgcagcuccucucagggcacagugagcaccgucccuaaggaagugcuugacuccuggaccggcgcuuucaauacaagacggcaaccccuguuugcccacauccgcaaaagaggggagagccggguuuga

SEQ ID NO: 30839 - RNA, 807 nt, Artificial Sequence
  derived and/or modified sequence opt5 from capsid_protein_VP2__Norovirus__AHI59166
auggccggcgcuuucuuugccgggcuggcgagcgacgugcucggauccggccuggggucucuuaucaacgcuggagccggcgccauuaaucagaaggucgaguucgaaaacaauagaaaacugcaacaggcuagcuuucaguucuccucuaaccuccagcaagccagcuuucagcacgauaaggagaugcugcaggcucagaucgaagccaccaaaaagcugcaacaggggaugaugaaaguuaagcaggcgaugcuucucgagggaggcuucuccgaaacagacgccgcucggggcgccauuaaugcucccaugacgaaggcccuggauuggucugggacccgcuacugggcgccugacgccagaacaaccacauauaacgcuggacgguuuagcaccccgcagcccuccggcgcccugccugggcgcaauaaccucagagcuacagugcccgcccggggaagcagcuccacccugagcucuaucccuacggccaccuccguguacagcaaucaaacagucucuacccgccuuggcuccagcgcuggguccggaacaucugugagcucccugcccagcaccgcgagaacgcggucuuggguugaggaucagaacaaaaaucucuccccuuucaugcgcggcgcccugaacacaucuuuugugaccccgcccucuagcagauccucuagccagggcacagucuccaccgugccuaaggagauucuugacagcuggaccggggcuuucaauacacggcgccaaccccuguuugcccauguuagaaaacggggagaaucucgcguguga

SEQ ID NO: 30840 - RNA, 807 nt, Artificial Sequence
  derived and/or modified sequence opt5 from capsid_protein_VP2__Norovirus__AHX22026
auggccggcgcuuucuuugccgggcuggcgagcgacgugcucggauccggccuggggucucuuaucaacgcuggagccggcgccauuaaucagaaggucgaguucgaaaacaauagaaaacugcaacaggcuagcuuucaguucuccucuaaccuccagcaagccagcuuucagcacgauaaggagaugcugcaggcucagaucgaagccaccaaaaagcugcaacaggagaugaugcggguuaaacaggugaugcuucucgaagggggauucuccgagacagacgcggcccgcggcgcuauuaaugcccccaugacgaaggcucuggauuggucuggcaccagauacugggccccugacgcgcggacaaccacauauaacgccgggcgcuuuagcaccccgcagcccuccggagcucugccuggcagagccaaucuccgggugacagcucccgcccgcgggucuagcuccaccagcucuaacuccagcaucgccacgucugucuacuccagccaaaccacauccaccagacugggaucuacagcuggcagcgggaccuccgugagcucucuuccuuccacggcgcggacacgcagcuggguugaggaucagaauagaaaccugucucccuucaugcggggagcccauaauauuagcuuugugaccccuccguccucucgcagcuccagccagggcacagucucuaccgugcccaaggaaguucucgacuccuggaccggcgcuuucaacacaagacggcaaccucuguuugcccacauccgcaaaagaggggagagccggguguga

SEQ ID NO: 30841 - RNA, 807 nt, Artificial Sequence
  derived and/or modified sequence opt5 from capsid_protein_VP2__Norovirus__AHX22029
auggccggcgcuuucuuugccgggcuggcgagcgacgugcucggauccggccuggggucucuuaucaacgcuggagccggcgccauuaaucagaaggucgaguucgaaaacaauagaaaacugcaacaggcuagcuuucaguucuccucuaaccuccagcaagccagcuuucagcacgauaaggagaugcugcaggcucagaucgaagccaccaaaaagcugcaacaggagaugaugaaaguuaaacaggugaugcuucucgaagggggauucuccgagacagacgcggcccggggcgcuauuaaugcccccaugacgaaggcucuggauuggucuggcacccgcuacugggccccugacgcgagaacaaccacauauaacgccgggcgguuuagcaccccgcagcccuccggagugcugccuggccgcgcuaaucucagagaugccguccccgcucgggggucuagcuccaagagcucuaacuccuucacagccaccagcguguacucuaaucaaacgaccuccacacgccugggaagcaccgccggcuccgggacaucuguuagcucccuuccuagcaccgcuagaacgcggucuuggguggaggaccagucccgcaacgucagccccuuuaugagaggagcgcauaauaucucuuucgugacaccuccgagcucccggucuagcucccagggcaccguuagcacagugcccaaggaaguccuggauucuuggaccggcgccuuuaacacccgcagacaaccucucuucgcucacauucggaaacgcggggaguccagaguguga

SEQ ID NO: 30842 - RNA, 807 nt, Artificial Sequence
  derived and/or modified sequence opt5 from capsid_protein_VP2__Norovirus__AHX22033
auggccggcgcuuucuuugccgggcuggcgagcgacgugcucggauccggccuggggucucuuaucaacgcuggagccggcgccauuaaucagaaggucgaguucgaaaacaauagaaaacugcaacaggcuagcuuucaguucuccucuaaccuccagcaagccagcuuucagcacgauaaggagaugcugcaggcucagaucgaagccaccaaaaagcugcaacaggagaugaugcggguuaaacaggugaugcuucucgaagggggauucuccgagacagacgcggcccgcggcgcuauuaaugcccccaugacgaaggcucuggauuggucuggcaccagauacugggccccugacgcgcggacaaccacauauaacgccgggcgcuuuagcaccccgcagcccuccggagcucugagcggcagagccaaucuccgggcuacagccccugcccgcgggucuuccagcaccucuuccaacagcucuaucgcuacguccguguacagcaaucaaaccacauccaccagacugggaucuacagcgggcagcgggaccuccgucagcucucccccuuccacggcccggacacgcagcuggguggaggaucagaacagaaaucuuucucccuucaugcggggagcucauaacauuagcuuuguuaccccuccguccucucgcagcuccagccagggcacagugucuaccguccccaaggaagugcuggacuccuggaccggcgccuucaauacaagacggcaaccucucuuugcccacauccgcaaaagaggggagagccggguuuga

SEQ ID NO: 30843 - RNA, 807 nt, Artificial Sequence
  derived and/or modified sequence opt5 from capsid_protein_VP2__Norovirus__AHX22036
auggccggcgcuuucuuugccgggcuggcgagcgacgugcucggauccggccuggggucucuuaucaacgcuggagccggcgccauuaaucagaaggucgaguucgaaaacaauagaaaacugcaacaggcuagcuuucaguucuccucuaaccuccagcaagccagcuuucagcacgauaaggagaugcugcaggcucagaucgaagccaccaaaaagcugcaacaggagaugaugcggguuaaacaggcgaugcuucucgaagggggauucuccgagacagacgccgcucgcggcgccauuaaugcucccaugacgaagacccuggauuggucuggcacaagauacugggccccugacgcgcggaccacaaccuauaacgccgggcgcuuuagcacaccgcagcccuccggagcucugccuggcagagccagccuccgggcuaccgugcccgcccgcgggucuuccagcaugucuuccaauagcucuaucgccacguccguguacagcaaccaaaccacauccaccagacugggaucuacagcuggcagcgggaccuccgucagcucucuuccuuccacggcgcggacacgcagcuggguggaggaucagaauagaaaccugucucccuucaugcggggagcccauaauauuagcuuuguuaccccuccguccucuaucagcuccagccagggcacagugucuaccguccccaaggaagugcucgacuccuggaccggcgcuuucaacacacgcagacaaccucuguuugcccacauccggaaacgcggggagagcagaguuuga

SEQ ID NO: 30844 - RNA, 807 nt, Artificial Sequence
  derived and/or modified sequence opt5 from capsid_protein_VP2__Norovirus__AHX22039
auggccggcgcuuucuuugccgggcuggcgagcgacgugcucggauccggccuggggucucuuaucaacgcuggagccggcgccauuaaucagaaggucgaguucgaaaacaauagaaaacugcaacaggcuagcuuucaguucuccucuaaccuccagcaagccagcuuucagcacgauaaggagaugcugcaggcucagaucgaagccaccaaaaagcugcaacaggagaugaugaaaguuaagcaggcgaugcuucucgaagggggauucuccgagacagacgccgcucggggcgccauuaaugcucccaugacgaaggcccuggauuggucuggcacccgcuacugggcgccugacgccagaacaaccacauauaacgcugggcgguuuagcaccccgcagcccuccggagcccugccuggccgcgcuaaucucagagaugccgugcccgcccgggggucuagcuccaaaagcucuaacuccagcacagcuaccucuguguacuccaaucaaacgaccagcacacgccugggauccaccgcgggcucugggacaagcgucuccagccuuccuucuaccgccagaacgcgguccuggguggaggaccagagccgcaaccugucucccuucaugagaggagcucauaauaucagcuuuguuacaccuccguccucucggagcuccagccagggcaccgugucuacaguccccaaggaagugcucgauuccuggaccggcgccuucaacacccgcagacaaccucuguuugcccacauucggaaacgcggggagagcagaguuuga

SEQ ID NO: 30845 - RNA, 807 nt, Artificial Sequence
  derived and/or modified sequence opt5 from capsid_protein_VP2__Norovirus__AHX22042
auggccggcgcuuucuuugccgggcuggcgagcgacgugcucggauccggccuggggucucuuaucaacgcuggagccggcgccauuaaucagaaggucgaguucgaaaacaauagaaaacugcaacaggcuagcuuucaguucuccucuaaccuccagcaagccagcuuucagcacgauaaggagaugcugcaggcucagaucgaagccaccaaaaagcugcaacaggagaugaugaaaguuaagcaggcgaugcuucucgaagggggauucuccgagacagacgccgcucggggcgccauuaaugcucccaugacgaaggcccuggauuggucuggcacccgcuacugggcgccugacgccagaacaaccacauauaacgcugggcgguuuagcaccccgcagcccuccggagugcugccuggccgcgccaaucucagagaugcugugcccgcccgggggucuagcuccaaaagcucuaacuccuucacagccaccagcgucuacucuaaucaaacgaccuccacacgccugggaagcaccgcuggcuccgggacaucugugagcucccuuccuagcaccgcgagaacgcggucuuggguugaggaccagucccgcaaccugagccccuuuaugagaggagcccauaauaucucuuucgugacaccuccgagcucccggucuagcucccagggcaccgucagcacagugcccaaggaaguucucgauucuuggaccggcgcuuuuaacacccgcagacaaccucuguucgcccacauucggaaacgcggggaguccagaguguga

SEQ ID NO: 30846 - RNA, 807 nt, Artificial Sequence
  derived and/or modified sequence opt5 from capsid_protein_VP2__Norovirus__AHX22048
auggccggcgcuuucuuugccgggcuggcgagcgacgugcucggauccggccugucuagccuuaucaacgcuggggccggagccauuaaucagaaggucgaguucgaaaacaauagaaaacugcaacaggcuuccuuucaguucucuagcaaccuccagcaagccuccuuucagcacgauaaggagaugcugcaggcucagaucgaagccaccaaaaagcugcaacaggagaugaugcggguuaaacaggcgaugcuucucgaaggcggguucucugagacagacgccgcucgcggagccauuaaugcucccaugacgaaggcccuggauuggagcggcaccagauacugggcgccugacgcccggacaaccacauauaacgcuggccgcuuuuccaccccgcagcccagcggggcccugccuggcagagcuaaucuccgggccgccgugcccgcucgcggaucuuccagcaugucuuccaacagcucuacagcgaccuccguguacagcaaucaaacgaccuccacaagacuggggucuaccgccggaagcggcacauccgucagcucucuuccuuccaccgcucggauccgcagcuggguggaggaucagaacagaaaucugucucccuucaugcgcggggcccauaacauuagcuuuguuacgccuccguccucucggagcuccagccagggaacagugucuaccguccccaaggaagugcucgacuccuggacaggcgccuucaauaccagacggcaaccucuguuugcucacauccgcaaaagaggcgagagccgggccuga

SEQ ID NO: 30847 - RNA, 807 nt, Artificial Sequence; identical to SEQ ID NO: 30843
  derived and/or modified sequence opt5 from capsid_protein_VP2__Norovirus__AHX22051

SEQ ID NO: 30848 - RNA, 807 nt, Artificial Sequence
  derived and/or modified sequence opt5 from capsid_protein_VP2__Norovirus__AHX22055
auggccggcgcuuucuuugccgggcuggcgagcgacgugcucggauccggccugucuagccuuaucaacgcuggggccggagccauuaaucagaaggucgaguacgaaaacaauagaaaacugcaacaggcuuccuuccaguuuucuagcaaccuccagcaagccuccuuccagcacgauaaggagaugcugcaggcucagaucgaagccaccaaaaagcugcaacaggagaugaugcggguuaaacaggcgaugcuucucgaaggcggguuuucugagacagacgccgcucgcggagccauuaaugcucccaugacgaagacccuggauuggagcggcacaagauauugggccccugacgcgcggaccacaaccuacaacgccggccgcuucuccacaccgcagcccagcggggcucugccuggcagagccaaucuccgggcuaccgugcccgcccgcggaucuuccagcacgucuuccaacagcucuaucgccaccuccguguauagcaaucaaacaacccugacaagacuuggguccaccgcuggaucuggcacgagcgucuccagccugccuucuacagcgcggacccgcuccuggguggaggaucagaacagaaaucucagccccuuuaugcgcggggcccauaacauuucuuucguuacaccuccgagcucccggucuagcucccagggaaccgugagcaccguccccaaggaagugcuggacucuuggacaggcgcuuuuaauacgagacggcaaccucuuuucgcccacauccgcaaaagaggcgagucccggguuuga

SEQ ID NO: 30849 - RNA, 693 nt, Artificial Sequence
  derived and/or modified sequence opt5 from capsid_protein_VP2__Norovirus__AII02849
auggccggcgcuuucaucgccgggcuggcgggagacaugcucaccaacacagugggcagccuggucaaugcuggggccaacgccauuaaucagacgaucgauuuugagaacaauaaguaccuucaaaacgcuuccuucaaucacgacaaagaaaugcugaacgcccagauugaggcuaccaagagacuccaggccgauaugaucgcgauuaaacagggaguucugacagccggcggguuuucucccaccgacgcugcccggggagcuaucaaugccccuaugacaaaggugcuugauuggaacggcacccgcuauugggcgccgggcgccacaagcaccacguccaugucugggggauucaucaaucaaaccgugcauagaagcacacccaacuuuaaaaccaaucaggcuccuaagcccgccccuuccucuggcagcuccguccggagcaacucuacacagauuaccucccugagcucucacuccagcgggucuucccgcagcuccggaucuacggugguuagcuccauccccagcucuaauagaacacgggacugggugaaccagcaaaacuucaaucucgaaccucauaugccgggcucccugcgcaccgcuuuugucacacccccuagcucuaccgccagcuccucugggaccgugagcacaguucccaagaacgugcuggauuccuga

SEQ ID NO: 30850 - RNA, 804 nt, Artificial Sequence
  derived and/or modified sequence opt5 from capsid_protein_VP2__Norovirus__AKE07101
auggccggcgcuuucuuugccgggcuggcgagcgacgugcucggauccggccuggggucucuuaucaacgcuggagccggcgccauuaaucagaaggucgaguucgaaaacaauagaaaacugcaacaggcuagcuuucaguucuccucuaaccuccagcaagccagcuuucagcacgauaaggagaugcugcaggcucagaucgaagccaccaaaaagcugcaacaggagaugaugaaaguuaagcaggcggugcuucucgaagggggauucuccgagacagacgccgcucggggcgccauuaaugcucccaugacgaaggcccuggauuggucuggcacccgcuacugggcgccugacgccagaacaaccacauauaacgcugggcauuuuagcaccccgcagcccuccggagccccucugggccgggcuaaucuccgcgccgccgugcccacaagagggucuagcuccaccagcucuaacuccagcaucgcuacgucugucuacuccaaucaaaccgcgagcacacggcugggauccaccgccggcucuggggcuagcguguccagccuuccuucuacagcccgcaccagauccuggguugaggaucagcggaaccugagccccuucaugcgcggagcccacaauauuucuuuugugacgccuccgagcuccagaucuagcucccagggcacagucagcaccgugcccaaagaaguucucgacucuuggacaggcgcuuucaacacccggcgccaaccucuguuugcccauaucagaaagcgcggggagucccggguguga

SEQ ID NO: 30851 - RNA, 807 nt, Artificial Sequence
  derived and/or modified sequence opt5 from capsid_protein_VP2__Norovirus__AKE07104
auggccggcgcuuucuuugccgggcuggcgagcgacgugcucggauccggccuggggucucuuaucaacgcuggagccggcgccauuaaucagaaggucgaguucgaaaacaauagaaaacugcaacaggcuagcuuucaguucuccucuaaccuccagcaagccagcuuucagcacgauaaggagaugcugcaggcucagaucgaagccaccaaaaagcugcaacaggagaugaugaaaguuaagcaggcggugcuucucgaagggggauucuccgagacagacgccgcucggggcgccauuaaugcucccaugacgaaggcccuggauuggucuggcacccgcuacugggcgccugacgccagaacaaccacauauaacgcugggcgguuuagcaccccgcagcccuccggaauccugccuggccgcgccaaucucagagauacagugcccgcucgggggucuagcuccaccagcucuaaauccagcauugccacgucucuguacuccaaccaaaccgccacaacccgccuuggaagcacagcuggcuccgggaccucugucagcucccugccuagcacggcgagaacacggucuuggguggaggaccagaaucgcaaccucucccccuucaugagaggagcccauaauaucagcuuuguuaccccuccgucuagccgguccucuagccagggcacaguguccaccguccccaaggaagugcuggauagcuggaccggcgcuuucaacacacgcagacaaccucuuuuugcccacauccggaaacgcggggagucuagaguuuga

SEQ ID NO: 30852 - RNA, 807 nt, Artificial Sequence
  derived and/or modified sequence opt5 from capsid_protein_VP2__Norovirus__AKE07107
auggccggcgcuuucuuugccgggcuggcgagcgacgugcucggauccggccuggggucucuuaucaacgcuggagccggcgccauuaaucagaaggucgaguucgaaaacaauagaaaacugcaacaggcuagcuuucaguucuccucuaaccuccagcaagccagcuuucagcacgauaaggacaugcugcaggcucagaucgaggccaccaaaaagcugcaacaggaaaugaugcggguuaaacaggcgaugcuucucgaagggggauucuccgagacagaugccgcucgcggcgccauuaaugcucccaugacgaaggcccuggacuggucuggcaccagauacugggcgccugaugcccggacaaccacauauaacgcugggcauuuuagcaccccgcagcccuccggagcccugccuggccgcgcuaaucucagagccgccgugcccgcucgggggccuagcucuacauccagcaacucuuccaccgcgacgagcguguacucuaaucaaaccacauccacccgccugggaagcacagccggcuccggggcuucugucagcucccuucccagcaccgccagaacggugaacuggguucgggaccagaaucgcucucuguccccuuucaugagaggagcccacaacaccagcuuugugacaccgcccucuagccgguccucuagccagggcacagucuccaccgugccuaaggagguucucgauagcuggaccggcgcuuucaauacacgcagacaaccccuguuugcccauauccggacgcgcggggagucuagaguguga

SEQ ID NO: 30853 - RNA, 765 nt, Artificial Sequence
  derived and/or modified sequence opt5 from capsid_protein_VP2__Norovirus__ALE30634
auggccggcgcuuucaucgccgggcuggcgggagacaugcucaccaacacagugggcagccuggucaaugcuggggccggagccauuaaccagaagguugauuuugagaauaacaaauaccuucaaaaugcuuccuucaaccacgacaaggaaaugcugaaugcccagaucgaggcuacgaaaagacuccaggccgauaugauugcgaucaagcagggcgugcugaccgccgggggauuuucucccacagacgcugcccggggcgcuauuaacgccccuaucaccaaagugcuugauuggagcggcacacgcuauugggcgccgaaugccaccuccacaaccucuaugagcgggggauucacgggccaagcuguccauagagccacccccaacuuuaagacaaaucaggcuccuaaguccacccccucuagcggguccagcgugcggucuuccagcacacagcugaccaaccucucuucccacagcucuggauccagccgcuccucuggcagcacgaugguuuccagccugccuucuuccagcagaacacgggacugggugaaucagcaaaacuucaaucuggaaccccauaugccugggucucuccgcaccgccuuugucacaccgcccagcuccaccgccucuagccuggauaccguguccacaguuccuaaaagcgugcuugacucuuggacgcccgcuuucaacaccagacggcagccucuguuugcgcaccuccgcagacggggagaguccaacaucuga

SEQ ID NO: 30854 - RNA, 765 nt, Artificial Sequence
  derived and/or modified sequence opt5 from capsid_protein_VP2__Norovirus__ALE30636
auggccggcgcuuucaucgccgggcuggcgggagacaugcucaccaacacagugggcagccuggucaaugcuggggccggagccauuaaccagaagguugauuuugagaauaacaaauaccuucaaaaugcuuccuucaaccacgacaaggaaaugcugaaugcccagaucgaggcuacgaaaagacuccaggccgauaugauugcgaucaagcagggcgugcugaccgccgggggauuuucucccacagacgcugcccggggcgcuauuaacgccccuaucaccaaagugcuugauuggagcggcacacgcuauugggcgccgaaugccaccuccacaaccucuaugagcgggggauucacgggccaagcuguccauagagccacccccaacuuuaagacaaaucaggcuccuaaguccacccccucuagcggguccagcgugcggucuuccagcacacagcugaccaaccucucuucccacagcucuggauccagccgcuccucuggcagcacgaugguuuccagccugccuucuuccagcagaacacgggacugggugaaucagcaaaacuucaaucuggaaccccauaugccugggucucuccgcaccgccuuugucacaccgcccagcuccaccgccucuagccuggauaccguguccacaguuccuaaaagcgugcuugacucuuggacguccgcuuucaacacccacagacagccccuguuugcgcaucuccggaagcgcggagagagcaacgucuga

SEQ ID NO: 30855 - RNA, 780 nt, Artificial Sequence
  derived and/or modified sequence opt5 from capsid_protein_VP2__Norovirus__BAR42290
auggccggcgcuuucaucgccgggcuggcgggagacaugcucaccagcuccgugggcucucuggucaacgcuggggccaaugccauuaaccagaagaucgauuuugagaauaacaaacaacuucagagcgcuuccuuccagcacgacaaggaaaugcugcaggcccaaguuagagcuacaaaacagcuccagucugagaugauugcccugaagcagggagugcuugcggccggcggguuuagccccacggaugcugcccggggauccaucggcgcuccuaugaccaaagugcuggacuggucuggcacacgcuacugggccccgaauagcaccaagacaaccggguauuccggacaauucacaagcucucccguccauauguccagcccuaacgcgccccagucuaagccugccaaacccagaucccucgcuccuucuucuuccagcuccucuguguacagcauguauacccaguccacgcaccugaccagcggcagcuccagcaaugccucuagcgcuuccacaaagcugaccucucucagcuccgggagcucucagaaccggacagccgaauggguuaaucaacagcgcucccugagcccguuuaugucuggagcccuuaacauuucccaugugacgcccccuagcuccagagcuucuagcuccggcaccgucucuacagugcccaaagagguucuggauagcuggaccuccgcguucaauacacaccggcagccucucuuugcccaucugcgcgugagaggggaaagccgggucuga

SEQ ID NO: 30856 - RNA, 780 nt, Artificial Sequence
  derived and/or modified sequence opt5 from capsid_protein_VP2__Norovirus__BAR47617
auggccggcgcuuucaucgccgggcuggcgggagacaugcucaccagcuccgugggcucucuggucaacgcuggggccaaugccauuaaccagaagaucgauuuugagaauaacaaacaacuucagagcgcuuccuuccagcacgacaaggaaaugcugcaggcccaaguuaaagcuacaaagcagcuccagucugagaugauugcccugaaacagggagugcuugcggccggcggguuuagccccacggaugcugccagaggagcuaucggcgccccuaugaccaaggugcuggacugguccggcacacgguacugggcgccgaauagcaccaagacaaccggguauagcggacaauucacauccagccccguccauaugccuucucccaacgccccucaguccaaacccgcuaagccucgcagccucgccccgucuuccucuucuuccagcguguacuccaugucuacccagagcacgcaccugaccuccggcucuagcuccaaugcuagcucugccagcacaaaacugaccaaccucuccucugggagcucccagaauagaacagccgaauggguuaaccaacagcggagccugucucccuuuauguccggagcucuuaauauuagccaugugaccccucccucuucccgcgcgagcuccucuggcacggucagcacagugccuaaggagguucuggauuccuggaccucugccuucaacacacacagacagccccucuuugcucaucugcgggugcgcggggaaagcagagucuga

SEQ ID NO: 30857 - RNA, 780 nt, Artificial Sequence
  derived and/or modified sequence opt5 from capsid_protein_VP2__Norovirus__BAR63716
auggccggcgcuuucaucgccgggcuggcgggagacaugcucaccagcuccgugggcucucuggucaacgcuggggccaaugccauuaaccagaagaucgauuuugagaauaacaaacaacuucagagcgcuuccuuccagcacgacaaggaaaugcugcaggcccaaguuaaagcuacaaagcagcuccagucugagaugauugcccugaaacagggagugcuugcggccggcggguuuagccccacggaugcugccagaggagcuaucggcgccccuaugaccaaggugcuggacugguccggcacacgguacugggcgccgaauagcaccaagacaaccggguauagcggacaauucacauccagccccguccgcaugccuucucccaacgccccucaguccaaacccgcuaagccuagaagccucgccccgucuuccucuucuuccagcguguacuccaugucuacccagagcacgcaccugaccuccggcucuagcuccaaugcuagcucugccagcacaaaacugaccaaccucuccucugggagcucccagaaucggacagccgaauggguuaaccaacagcgcagccugucucccuuuauguccggagcucuuaauauuagccacgugaccccucccucuuccagagcgagcuccucuggcacggucagcacagugccuaaggagguucuggauuccuggaccucugccuucaacacacaucggcagccccucuuugcucaucugcgcgugagaggggaaagccgggucuga

SEQ ID NO: 30858 - RNA, 780 nt, Artificial Sequence; identical to SEQ ID NO: 30856
  derived and/or modified sequence opt5 from capsid_protein_VP2__Norovirus__BAR63719

SEQ ID NO: 30859 - RNA, 780 nt, Artificial Sequence; identical to SEQ ID NO: 30856
  derived and/or modified sequence opt5 from capsid_protein_VP2__Norovirus__BAR63722

SEQ ID NO: 30860 - RNA, 807 nt, Artificial Sequence
  derived and/or modified sequence opt5 from capsid_protein_VP2__Norovirus__BAS02084
auggccggcgcuuucuuugccgggcuggcgagcgacgugcucggauccggccuggggucucuuaucaacgcuggagccggcgccauuaaucagaaggucgaguucgaaaacaauagaaaacugcaacaggcuagcuuucaguucuccucuaaccuccagcaagccagcuuucagcacgauaaggagaugcugcaggcucagaucgaagccaccaaacggcuucaacaggagaugaugaagguuaaacaggcgaugcugcucgaagggggauucuccgagacagacgccgcucgcggcgccauuaaugcucccaugacgaaggcccuggauuggaacggcaccagauacugggcgccugacgcccggacaaccacauauaaugcugggcgcuuuucuaccccgcagcccagcggagcccugccuggcagagcuaaccuccgggaugccgugcccgcccgcggguccagcucuaaguccagcaauucuuccacagcuaccagcguguacucuaaccaaacgaucuccaccagacugggaagcacagcgggcuccgggaccucugucagcuccuucccuagcacagcccggacccgcucuuggguggaggaccaguccagaaaucuuagccccuuuaugcggggagcucauaacauuucuuucguuacgccuccgagcucccgcucuagcucccagggcacagugagcaccguccccagagaaauccuggauucuuggacaggcgccuuuaauacccggcgccaaccucucuucgcccacaucagaaaaagaggggagucccggguguga

SEQ ID NO: 30861 - RNA, 627 nt, Artificial Sequence
  derived and/or modified sequence opt5 from capsid_protein_VP2__Norovirus__CRL46953
auggcccaggcuaucauuggcgccaucgcggcuagcgccgccggguccgcucugggagccggcauucaagcuggggccgaggcggcccuccaggcucagagauaccagcaagaccugacccuucagcagaacucuuucaaucacgauaaggaaaugcugggauaucagguggagaugagcaacaaacuccuggccaagaaucuuaacacacgguacucccugcuccaagcuggcgggcugucucccagcgacgccgcgcgcgccgucgcuggagccccuguuacgagacugguggauuggggcggcgugcgggucgcugccccgcaguccucugccaccacacuccgcagcgggaauuuuauggcugugccccugccugcgcagcccaaacagaagccucuugccuccgaaggauauagcaaccccgcuuacgacccuaugcaaagaaccgccucuuggguucagucccagaauagcucucggaacugguccccguaucaucgccaagcccugcagacagugugggucacacccccuggcagcaccucuuccagcuccgugucuaccgcucccagaggguacuucaauacggaucggcucccucuguuugccaaccuucgcagauga

SEQ ID NO: 30862 - RNA, 630 nt, Artificial Sequence
  derived and/or modified sequence opt5 from capsid_protein_VP2__Norovirus__CRL46956
auggcccaggcugugaucggcgccauugcggcuagcgccgccggguccauccugggagcuggcauucaagccggggcugaggccggacuccaggcgcagagauaccagcaagaccugcagcuucagcagaacucuuucaagcacgauaaagaaaugcugggcuaucaaguccaggccagcaaugcucuccuggccaagaaccuuaauacccgguacgcucugcuccaggccgggggacuguccucugcggacgccgcucgcgccguugcuggcgcccccgugacaagaaucguggauuggaacggcacgcggauugccgcuccugcgagcuccgccaccacacugcgcucugggggauuuauggcugucccgaucccccucagcuccaaaaccaagcagccugugaugagcggccaagacaaucccaacuaugccgccucuuccaucagcagaacagcuucuuggguucagucccagaauagcaugcggucuguguccccuuuccauagcgaugcccugcgcaccgucugggugacacccccuggguccucuagcaccuccagcguucaaucuuccuuuuacggaguguucaacacggacagacuuccgcuguuugcgaaucggcgcuga

SEQ ID NO: 30863 - RNA, 807 nt, Artificial Sequence
  derived and/or modified sequence opt5 from capsid_protein_VP2__Norovirus__CRL46959
auggccggcgcuuucuuugccgggcuggcgagcgacgugcucggauccggccugucuagccuuaucaacgcuggggccggagccauuaaucagaagaucgauuucgagaacaauagaaaacugcaacaggcuuccuuucaguucucuagcaaccuccagcaagccuccuuucagcacgacaaggaaaugcugcaggcucaggucgaggccaccaaaaagcugcaacaggaaaugaugaaaguuaagcaggcgauucuucucgagggcggguucucugccacagaugcugcccggggagcuaucaaugcccccaugacgaaggugcuggacuggaacggcacccgcuacugggcgccugaugccagaacaaccacauauaauaccggccauuuuagcacaccgcaguccagcggggcucugcccggacggaccaacccucgcauucccacgccugccagagcuucuuccagcaccucuuccaaugccagcacagccaccucuaucuccagcaaccaaacaguguccacccggcucggcucuacggcugggagcggaacaaaugucuccagccugcccucuaccgcgcgcacaagauccuggguggaagaccagaaccggaaucuuagcccuuucaugcgcggcgcccacaacaucucuuuuguuaccccgcccagcuccagaucuagcucccaggggaccgugagcacagucccuaaaggagugcuggauucuuggacgggcgcuuucaauacccggcgccaaccccucuuugccuacacacauagacggggcgagucccgcguuuga

SEQ ID NO: 30864 - RNA, 807 nt, Artificial Sequence
  derived and/or modified sequence opt5 from capsid_protein_VP2__Norovirus__CRL46962
auggccggcgcuuucuuugccgggcuggcgagcgacgugcucggauccggccuggggucucuuaucaacgcuggagccggcgccauuaaucagaaggucgaguucgaaaacaauagaaaacugcaacaggcuagcuuucaguucuccucuaaccuccagcaagccagcuuucagcacgauaaggagaugcugcaggcucagaucgaagccaccaaaaagcugcaacaggagaugaugaaaguuaagcaggcgaugcuucucgaagggggauucuccgagacagacgccgcucggggcgccauuaaugcucccaugacgaaggcccuggauuggucuggcacccgcuacugggcgccugacgccagaacaaccacauauaacgcugggcgguuuagcaccccgcagcccuccggagcccugccuggccgcgcuaaucucagagaugccgugcccgcccgggggccuagcucuaaauucuccaacagcucuacagcuaccuccguguacagcaaucaaacgaucucuacccgccugggauccacagcgggcagcgggaccuccgucucuagccuucccuccacagccagaacccggagcuggguggaggaccagucucgcaaccuguccccuuuuaugggaggcgcucauaauauuagcuucguuacgccgcccucuagcagauccucuagccagggcacaguguccaccgucccuaaggaaauccucgauagcuggacaggggccuuuaacacccggcgccaaccccuguucgcccacaucagaaaacggggagagucucgcguguga

SEQ ID NO: 30865 - RNA, 807 nt, Artificial Sequence
  derived and/or modified sequence opt5 from capsid_protein_VP2__Norovirus__CRL46965
auggccggcgcuuucuuugccgggcuggcgagcgacgugcucggauccggccuggggucucuuaucaacgcuggagccggcgccauuaaucagaaggucgaguucgaaaacaauagaaaacugcaacaggcuagcuuucaguucuccucuaaccuccagcaagccagcuuucagcacgauaaggagaugcugcaggcucagaucgaagccaccaaaaagcugcaacaggagaugaugaaaguuaagcaggcggugcuucucgaagggggauucuccgagacagacgccgcucggggcgccauuaaugcucccaugacgaaggcccuggauuggucuggcacccgcuacugggcgccugacgccagaacaaccacauauaacgcugggcgguuuagcaccccgcagcccuccggagcccugccuggccgcgcuaaucucagagaugccgcccccgcucgggggucuagcuccaaaagcucuaacuccuucacagcgaccagcguguacucuaaucaaacgaccuccacacgccugggaagcaccgccggcuccgggacaucugucagcucccuuccuagcaccgcuagaacgcggucuuggguggaggaccagucccgcaaccugagccccuuuaugagaggagcccauaauaucucuuucguuacaccuccgagcucccggucuagcucccagggcaccgugagcacaguccccaaggaagugcucgauucuuggaccggcgccuuuaacacccgcagacaaccucuguucgcucacauucggcgcagaggggagucccggguuuga

SEQ ID NO: 30866 - RNA, 777 nt, Artificial Sequence
  derived and/or modified sequence opt5 from capsid_protein_VP2__Norovirus__CRL46968
auggccggcgcuuuccuggccgggcucgugggagacgcgaucaccagcggcgucgggucccugauuaacgcuggagccaaugccaucaaccagaagguugaguacgauuuuaauaaacaacuucagcuggcuucuuucaagcacgacaaagaaaugcuccagagccaggugcuggccacaaagcaacuucagcaggagaugaugaacauuagacagggcgugcuguccgcugggggauuuucucccacggaugccgcgcggggcgccgucaaugcuccuaugaccaaaauccucgacuggaacggcacacgcuauuucgccccgaauagcaugaagaccacauccuacucugggcaauuuagcuccaaccccgugcauagacagccuaccagcccccggucugauccucccaagauuaaaguuaauuccgacagcgcuucuguguauuccagcgccucuuccgcgccuagccaguccacacacucuaccgcccugacggcuggaagcuccagcucucgcaccacauccagcucugccgcugccagcacccuguccagaacaucugauuggguccggggccagaacgaacgccucagcccguucauggacggggcccugcaaaccacguuugugacacccccuuccagcaaggcuucuuccuacggaagcguuucuaccgugcccaaagcgguccuugauuccuggacaccuauguucaauacccauagacagccccuguuugcccacgugcggcgcagaggcgagagccagaucuga

SEQ ID NO: 30867 - RNA, 765 nt, Artificial Sequence
  derived and/or modified sequence opt5 from capsid_protein_VP2__Norovirus__CRL46971
auggccggcgcuuucaucgccgggcuggcgggagacaugcucaccaacacagugggcagccuggucaaugcuggggccaacgccauuaaucagacgaucgaucuugagaacaauaaguaccugcaaaacgcuuccuuuaaucacgacaaagaaaugcucaacgcccagauugaggcuaccaagaaacugcaggccgauaugaucgcgauuaagcagggaguucuuacagccggcggguucucucccaccgacgcugccagaggagcuaucaaugccccuaugacaaaagugcuggauuggaacggcacccggcauugggcgccgggcgccacaagcaccacguccaugucugggggauuuacccaccaaacagugcaucgcagcacccccaauuucaagacaaaccaggcuccuaaguccacccccucuagcggcuccagcgucagaucuaauuccacgcagaucacaagccucucuucccacagcucuggguccagccgguccucuggaagcaccgugauucgcuccaucccuagcucugacagaacacgggauuggguuaaccagcaaaauuuuaaccuggaaccccauaugccuggcucccugcgcaccgccuucgugaccccgcccagcucuacagcuagcuccucugggacggucagcaccgugccuaaaaacguucucgacuccuggacaagcgccuuuaauaccagacggcagccccuguucgcccaccuucgcagacggggagagucuaacguguga

SEQ ID NO: 30868 - RNA, 771 nt, Artificial Sequence
  derived and/or modified sequence opt5 from capsid_protein_VP2__Norovirus__CRL46974
auggccggcgcuuucguggccgggcuggcgggagacaucgucaccaacagcauuggcucccucguuaaugcuggggccaacgccaucaaucagaagguggauuuugagaacaauaaacaacugcagcaggcuucuuucaaccacgaccaggaaaugcuucaagcccagauucaggcuacaaagcagcugcaagccgauaugaucgcgcucagacagggagugcugacggccggcggguuuagccccaccgacgcugcccggggagcugucaaugccccuaugacacaggugcuugauugguccggcacccgcuacugggcgccgggcgccacaaaaaccacagcuuucucugggggauuuaccagcucccccaacacgagaaccauuguuccuaagaaaacaucugccacccccgcuagcacauccgugagccggccuucuucccuggccagcaccgccucuacgcgcuccacauucgucagcggcaccucuucccucagcuccucuacaagaagcuccuuuaauagccagcccaccucuuccagcucucggaccagcgagugggugcgcucccaaaacagaguucuggaaccuuauaugcgggggucucugcagacagcuuucgugacgccgcccagcucccgcgcgagcucuaauggaaccgucuccacagugccuaaggaggugcucgacagcuggaccucugucuuuaacacacauagacagccccuguucgcccaccuucggcgcagaggcgaaucccaaguuuga

SEQ ID NO: 30869 - RNA, 807 nt, Artificial Sequence
  derived and/or modified sequence opt5 from capsid_protein_VP2__Norovirus__CRL46977
auggccggcgcuuucuuugccgggcuggcgagcgacgugcucggauccggccuggggucucuuaucaacgcuggagccggcgccauuaaucagaaggucgaguucgaaaacaauagaaaacugcaacaggcuagcuuucaguucuccucuagccuccagcaagccuccuuucagcacgauaaggagaugcugcaggcucagaucgaagccaccaaaaagcugcaacaggagaugaugcggguuaaacaggcgaugcuucucgaagggggauucucugagacagacgccgcucgcggcgccauuaacgcucccaugacgaagacccuggauuggagcggcacaagauacugggccccugacgcgcggaccacaaccuauaaugccgggcgcuuuuccacaccgcagcccagcggagcucugccuggcagagccaaccuccgggcuaccgcccccgcccgcgggucuuccagcaugucuuccaauagcucuaucgcuacguccguguacagcaaccaaaccacauccaccagacugggaucuacagcgggcagcgggaccuccgugagcucucuuccuuccacggcccggacacgcagcugggucgaggaucagaauagaaaccugucucccuucaugcggggagcucauaauauuagcuuugugaccccuccguccucucgcagcuccagccagggcacaguuucuaccgugcccaaggaaguccucgacuccuggaccggcgccuucaacacaagacggcaaccucuguuugcccacauccgcaaaagaggggagagccgggcuuga

SEQ ID NO: 30870 - RNA, 807 nt, Artificial Sequence
  derived and/or modified sequence opt5 from capsid_protein_VP2__Norovirus__CRL46980
auggccggcgcuuuccuggccgggcucgcgagcgacgugcugggauccggccuugggucucugaucaacgcuggagccggcgccauuaaucagaaggucgaguuugaaaacaauagaaaacuccaacaggcuagcuuccaguuuuccucuagccugcagcaagccuccuuccagcacgauaaggagaugcuucaggcucagaucgaagccaccaaaaagcugcaacaggagaugaugcggguuaaacaggcgaugcuccuggaagggggauuuucugagacagacgccgcucgcggcgccauuaacgcucccaugacgaagacccuggauuggagcggcacaagauacugggccccugacgcgcggaccacaaccuauaaugccgggcgcuucuccacaccgcagcccagcggagcucucccuggcagagccaaccugcgggcuaccgcccccgcccgcgggucuuccagcaugucuuccaauagcucuaucgcuacguccguguacagcaaccaaaccacauccaccagacuuggaucuacagcgggcagcgggaccuccgugagcucucugccuuccacggcccggacacgcagcugggucgaggaucagaauagaaaccucucucccuuuaugcggggagcucauaauauuagcuucgugaccccuccguccucucgcagcuccagccagggcacaguuucuaccgugcccaaggaaguccuggacuccuggaccggcgccuuuaacacaagacggcaaccucuuuucgcccacauccgcaaaagaggggagagccgggcuuga

SEQ ID NO: 30871 - RNA, 1623 nt, Artificial Sequence
  derived and/or modified sequence opt6 from capsid_protein_VP1__Norovirus__ABY65350
augaaaauggccucaaaugacgcaaacccuucagauggauccgcagccaacuuaguaccagaaguuaauaaugaagugauggcacuagaaccuguugucggagcagcaauagcagccccuguugcaggacaacaaaacguaauagacccauggauaagaaauaacuuuguccaagcaccaggaggugaauuuaccguuucuccacgcaaugccccaggagaaauauuauggucagcaccacuuggaccugaucuaaauccauauuuaucccaucuugcaagaauguauaacggauaugcuggaggauucgaaguacaagucauacuugcuggcaacgcauuuacugcaggaaaaauaauuuucgcagccguccccccaaacuuuccaacagaaggauuaucaccaucacaaguaacuauguucccacacauaaucguugacguacgccaacuagaaccagucuuaauaccccuuccagacguaagaaacaauuucuaucauuacaaccaauccaaugauucuacaauaaaauuaauagcaauguuauacaccccacuuagagccaauaaugcaggagaagacgucuuuacuguauccugcagaguacuaaccagaccuucuccagauuucgauuuuauauuccuagucccccccacaguugaaucaagaacaaaacccuucacaguaccaauacuaacaguagaagaaaugacaaacucaagauucccaauaccacuugaaaaacuauuuacggguccaaguuccgccuucguaguacaaccacaaaauggaagauguacaacugacggagucuuacuagguacaacucaacuaucacccgucaauaucugcacauucagaggugauguaacacauauagcaggaucucgaaacuacacaaugaaccuugcuuccuuaaauuggaacaauuacgauccuacagaagaaauaccagcaccuuuaggcaccccagacuuuguuggaaaaauacaagguguacuaacacaaaccacaaaaggagaugguagcacaagaggacauaaagcaaccguuuacacaggcuccgcaccguuuacaccgaaauuaggcucaguacaaagcuccaccgacacagaaaacgacuucgaaacacaucaaaauacuaaauuuacaccaguuggaguaauacaagauggaucaacaacacauagaaaugaaccacaacaauggguuuuaccuucuuauuccggcagaaacguacauaacguacacuuagccccagcaguagcaccaacauucccaggagaacaauuauuauucuuuagauccacuguuccagguugcucuggauauccaaacauggacuuagauugucuacuaccacaagaauggguccaacauuucuaucaagaagcagcaccagcacaaucugacguugcacuauuaagauucguaaauccagauacaggaagaguucucuucgaaugcaaacuacauaaaucuggcuauguaacaguugcacacacuggacaacacgaucuuguaauacccccaaacggauauuucagauuugauagcuggguaaaucaauuuuauacacucgcaccaaugggaaaugguacaggcagacgacgagcauuauaa

SEQ ID NO: 30872 - RNA, 1623 nt, Artificial Sequence
  derived and/or modified sequence opt6 from capsid_protein_VP1__Norovirus__ACO55068
augaaaauggcuucaaaugaugcaaauccaucagaugguuccaccgcaaaucuaguaccugaaguaaauaaugaaguuauggcacuagaacccguaguaggugccgcaauagcagcaccagucgcaggacaacaaaacguaauugaucccuggauaagaaacaacuucguacaagcaccaggaggagaauuuacaguaucaccaagaaaugcaccaggagaaauacuauggagugcaccuuuagguccugaucugaauccauacuuaucacacuuagccagaauguauaauggauacgcaggcggauucgaaguacaagucauacuugcaggcaaugcauuuaccgcaggcaaaauaauauucgcugccgucccuccaaauuuuccaacugaaggacucucaccaucacaagucacaauguucccccacauaauagucgacgucagacaauuagaacccguauuaauaccauuacccgauguaagaaacaacuucuaccacuacaaucaaucaaaugauccaacaauaaaacuaauagccaugcuuuacacaccucucagagcaaauaaugcuggugaagauguauuuaccguauccugucguguuuuaacuagaccuucaccagacuuugauuuuauauuucuaguaccaccaaccguagaaucucguacuaaacccuucacaguaccuauauuaacaguagaagaaaugacaaacagucgauuuccaaucccccuagaaaaacuuuuuacaggaccauccggagcauuuguuguccaaccacaaaacggaagauguaccacagacggaguacuucuaggaacaacacagcuuucaccuguaaauauaugcacauuucguggagacguaacucacauugcaggaacacacaauuauacaaugaaccuagcaucacaaaacuggaacaacuaugauccagcagaagaaauaccagcaccacuaggaacaccagacuuuguaggaagaauacaaggaguacuaacacaaaccacaagaggagacgguuccacacguggccauaaagcuacaguuuccaccggugacguacauuuuaccccaaaacuuggauccauccaauucaauacagauaccaacaacgauuucgaaacaggacaaaauaccaaauuuacuccaguagguguaguacaagaugguaacggaacacaccaaaaugaaccacaacaauggguacucccaucauauucagguagaacaggccauaacguucaucuagcaccagccguagcucccacauuuccaggagaacaauuacuauuuuucagaucuaccaugccaggaugcucaggauauccaaauaugaauuuagauuguuuauuaccacaagaauggguccaacauuucuaucaagaagcagcuccagcacaaucugacgucgcuuuacuaagauucguaaacccagacacaggaagaguauuauuugaaugcaaacuccauaaauccggauauguuacaguagcucauaccggacaacacgauuuagucauaccaccaaacggauacuuucgcuucgacucauggguuaaccaauuuuacacauuagcacccauggguaacggaacaggacguagaagagcauuauaa

SEQ ID NO: 30873 - RNA, 1623 nt, Artificial Sequence
  derived and/or modified sequence opt6 from capsid_protein_VP1__Norovirus__ADI45808
augaaaauggcaucaaaugacgcaaauccaucagauggaucaacagcaaauuuaguaccagaaguaaacaacgaaguaauggcuuuagaacccguaguaggagcugcaaucgcagcaccaguagcuggacaacaaaauguaauagaccccuggauaagaaauaauuucguacaagcuccaggaggagaauuuacaguaucaccacguaaugccccaggagaaauacuauggagugcaccauuaggccccgaucuaaaccccuaccuaucucaucuugcaagaauguauaauggauaugcaggaggauucgaaguacaaguaauacuagcaggaaaugcauucacagcaggaaaaauaauauuugcagcaguaccacccaacuuuccuacagaagguuuaucaccaagccaaguaacaauguucccuagaauaauaguagaugucagacaacuagaaccaguauuaauaccauuacccgacguaagaaacaauuucuaucacuacaaccaaucaaaugacccaacaauaaaauuaaucgcaaugcuauauacacccuuacgagccaacaacgcaggagacgauguauucacaguuucauguagaguacuaacucgaccaagcccagacuuugauuucauauucuuaguaccaccaacaguugaaucuagaacuaaaccuuucacaguaccaauauuaacaguagaagaaaugacuaauucuagauuuccaauaccacuagaacguuuauacacaggaccuagcuccgcauucguaguacagccucaaaauggaagauguacuacagauggaguuuuacuaggaacaacccaauuauccgcaguaaacaucuguacauuuagaggggauguaacacacauugccggaucuagaaauuauaccaugaaucuagcaagccaaaacuggaacaauuacgaucccacagaagaaauaccagcaccccuuggaacaccagacuuuguaggaaaaauucaaggaaugcuaacgcaaacaacaagaucagaugguucaacaagaggacauaaagccacuguauuaacaggaucagcagacuuugcaccaaaacuaggacgaguacaauuugcuacagacacugauaacgauuucgaaucaggucaaaauacaaaauucacuccaguaggaguaauccaagacggcucaacaacacauagaaaugaaccacaacaauggguacuaccaaacuauucaggaaggacuggacauaacguccauuuagcaccagcagucgccccaacuuacccuggcgaacaacuccuauucuuuagaucaaccaugccaggcugcucagguuauccaaacauggauuuagauugccuaauaccacaagauuggguacaacacuucuaucaagaagcagcucccgcacaaucagacguagcacuccuccgauucgucaacccagacacaggaagaguacuuuuugaaugcaaauugcacaaaucaggauauguaacuguagcacacacaggccaacacgacuuaguuauaccaccaaacggcuauuuuagauucgauucauggguuaaccaauucuacacacuagcuccaaugggcaauggaacaggaagacgaagagcauuauaa

SEQ ID NO: 30874 - RNA, 1623 nt, Artificial Sequence
  derived and/or modified sequence opt6 from capsid_protein_VP1__Norovirus__ADI45811
augaaaauggcaucuuccgacgcaaaccccucagauggcucuacagcuaaccuaguaccugaaguaaauaaugaagucauggcacuugaaccaguaguaggagcagcaauagcugcacccguagcuggucaacaaaauguaauagacccuuggauuagaaauaauuucguacaagcaccaggaggcgaauuuacaguaucaccucgaaaugcacccggagaaauuccaugguccgcuccauuaggucccgauuuaaauccauaucuaucacauuuagcaagaauguauaaugguuacgcugguggcuuugaaguacaaguaauacuagcagguaaugcauucaccgcuggcaaaauaaucuuugcagcaguaccaccaaacuuuccaacagaaggauuaucaccaagccaaguuacaauguuuccucauauuauaguugacguacgacaacuagaaccaguucuuauaccauuaccagacguaagaaauaacuucuaucauuauaaccaaucaaacgacccuacaauaaaacuuauagccaugcuauacacaccucuaagagcaaauaacgcuggcgaugaugucuucacaguuuccuguagaguucuaaccagaccuucaccagauuucgacuuuauauuccuaguuccuccaacuguugaaucaagaacaaaaccauucucaguuccaauauuaacuguagaagaaaugaccaacucaagauucccaauacccuuagaaaaacucuuuaccggaccaucuucagcuuucguuguucaaccucaaaauggacgauguacaacagaugguguacuccuuggaacaacacaauugucaccaguuaauauauguacauuuagaggugacguaacccauauuacaggaucuagaaauuacacaaugaacuuagcaacacaaaauuggaauucauacgauccaacugaagaaauuccagccccauugggaaccccagacuucguaggaaaaauacaaggaguuuuaacacaaacuacacgugcugacggaucuacacgaggucacaaagcaaccguauauaccggaucugcagauuucgcaccaaaacuaggaagaguacaauucgcaaccgauacugacaaugauuucgaugcaaaccaaaauacaaaauuuaccccaguaggaguaauacaagauggagacacagcacauagaaaugaaccucaacaauggguccuuccuucauacucaggacgaaauucacacaauguacaccuugcaccagcaguagcaccaacauuuccaggugaacaacuauuauucuuccgaucaaccaugccuggaugcucaggauacccaaacauggaucuagauugcuuauuaccacaagaauggguacaauauuucuaucaagaagcagcaccagcucaaucagauguagcauuacuccgauucguaaaccccgacaccggaagaguacuauucgaaugcaaacuacacaaaucagguuacguaacaguagcucauacuggccaacaugacuuaguaauaccaccaaacggauacuucagguucgauucguggguaaaucaauucuauacauuggccccaaugggaaacggaacagguagaagaagagcuuuauaa

SEQ ID NO: 30875 - RNA, 1623 nt, Artificial Sequence
  derived and/or modified sequence opt6 from capsid_protein_VP1__Norovirus__ADI45812
augaaaauggcaucaucagacgcuaacccaucugauggaucaacugcaaacuuaguuccagaaguaaacaacgaaguaauggcucuagaaccaguaguaggugcagcuauugcagccccaguagcaggacagcaaaaugucauagacccuuggauaagaaacaacuuuguacaagcaccaggaggcgaauuuacaguaucuccccgcaaugccccaggagaaauuuuauggucugccccacuaggcccagaucuaaauccguauuuaucacaucuugcacgaauguacaauggauaugcuggagguuuugaaguacaaguaauauuagcagguaaugcauuuacagccggaaaaauaauauucgccgcaguaccaccuaacuuccccacugaaggucuaagucccucacaaguaacaauguucccacacauaauaguagauguuagacaauuagaaccaguacugauaccacuaccugauguaagaaacaauuuuuaucauuacaaucaaucaaaugacccaacaauaaaacuaauagcaaugcuuuacacuccacuacgagccaacaaugcaggagacgauguauuuaccgucucauguagaguacuuaccagaccauccccagauuucgacuuuauauuccuaguuccuccuacaguagaaucuaggacaaaaccauuuaguguacccauauuaacaguagaagaaaugacaaacucucgauuuccaauaccauuagaaaaacuauuuaccggaccauccucugccuucguaguucaaccacaaaacggacgauguacaacagacgguguacuuuuaggaacaacacaacuaucuccuguaaauauauguacauuuagaggagauguaacacacauaacagguucacgaaauuauaccaugaaucuugcaacccaaaacuggaauucauacgauccaacagaagaaauaccugcaccacuagggacaccugauuucguaggaaaaauacaaggcguauuaacacaaacaacaagagcagauggcucaacaagaggucacaaagcaacuguuuauaccggauccgcagauuucaccccaaaauuaggaagaguccaauuugcaacagauacugauaacgauuucgacgcuaaucaaaacacaaaauucacccccguagguguuauacaagauggaaacacugcacacagaaaugaaccacaacaauggguacucccaucauauuccgguagaaacucacauaauguacauuuagcaccagccguugcaccuaccuucccuggagaacaguuauuauuuuuucgaucaacaaugcccggauguuccggauauccaaacauggaucuugauuguuuacuaccacaagaauggguacaauauuucuaucaagaagccgcaccagcucaaucugacguagcucugcuaagauucgucaauccagauacuggaagaguacucuucgaauguaaauuacauaaaucaggauauguaacuguagcacacacaggucaacaugauuuaguaauaccuccaaauggauauuuucguuuugacucuuggguaaaucaauuuuauacacuagcaccgaugggaaacggaaccgguagaagaagagcccuauaa

SEQ ID NO: 30876 - RNA, 1623 nt, Artificial Sequence
  derived and/or modified sequence opt6 from capsid_protein_VP1__Norovirus__ADI45814
augaaaauggcauccucagaugccaaucccucugacggcucuacagccaacuuaguaccugaagucaacaacgaaguuauggcacuagaaccaguagucggugcagcaauagcagcaccaguagcuggucaacaaaacguaauagacccuuggaucagaaauaacuucguucaagccccaggaggagaauucacuguuuccccucgcaacgcaccaggagaaauauuauggucagcaccacuaggaccagaccuaaacccuuaucuaucacaccuagcaagaauguauaauggauacgcaggaggauucgaaguacaaguaauucuagcaggaaacgcuuuuacagcaggcaaaaucauuuuugccgccguaccaccaaauuuuccaacagaaggucuaucuccuucucaaguuacaauguuuccacacaucauaguagacguaagacaacuugaaccaguacuaauaccacucccagauguacgcaacaauuucuaccacuauaaucaaucaaacgauccaacaauaaaacuaauagcaaugcuuuacacaccucucagagcaaauaaugcaggugaugauguauucacaguaucauguagaguacuaacccguccuucaccagauuuugauuuuauauuuuuagucccaccaacaguagaaucaagaacuaaaccauuuucaguaccaauacuaacagucgaagaaaugacuaacucaagauucccaauaccauuagaaaaacuauuuacuggaccaucuagugcauucguaguacaaccacaaaacggaagauguacaacagauggaguucuuuuaggcacaacacaacuaucaccgguaaauauuuguacauuuagaggugaugucacacacauagcuggaucaagaaauuacaccaugaauuuagcuacacaaaauuggaauucauacgauccaacagaagaaauaccagcuccccuaggcacuccagacuuugucggaaaaauacaaggaguauuaacucaaacaacucgagcagacgguucuacacgaggacacaaagcaacaguauauacagguucagcugauuucgcaccaaaauuaggucgaguacaauucgcaacugauaccgacaaugauuucgaugccaaucaaaauacaaaauuuaccccagucggaguuauacaagauggugacacagcacacagaaaugaaccacaacaauggguacuuccaucuuauucaggcagaaauucacacaauguacaccuagcacccgcuguagcgccaaccuucccaggugaacaacuuuuauucuuuagauccacaaugcccggaugcagcggcuacccaaauauggaucuagauuguuuacuaccacaagaauggguucaauauuuuuaccaagaagccgcaccagcacaaucagacguugcccuacuacguuucguaaacccagauacaggaagaguauuauucgaaugcaaacuccacaaauccggauauguaacuguagcacauacaggacaacacgacuuaguaauaccaccaaaugguuauuucagauuugacucauggguaaaucaauucuauacauuagcuccaauggguaauggaacagguagacgaagagcacuauaa

SEQ ID NO: 30877 - RNA, 1623 nt, Artificial Sequence
  derived and/or modified sequence opt6 from capsid_protein_VP1__Norovirus__ADI45815
augaaaauggcuucaucagacgcaaacccuuucgacggaucaacagccaaccuaguaccagaaguuaacaaugaaguaauggcucuagaaccaguuguaggagcagcaauagcugcaccagucgcuggacaacaaaauguaaucgauccuuggauaagaaacaauuuuguccaagcaccaggcggcgaauucaccgucucaccacgaaaugccccaggagaaauacuuuggucugcaccacuaggacccgacuuaaacccauauuuaucucaccuagcuagaauguauaauggauacgccgguggauucgaaguacaagucauauuagcaggaaacgccuuuacagcaggcaaaauaauauuugcagccguaccgccaaauuuuccaacagaaggacuaagucccucccaaguaacaauguucccacacauaaucgucgacguaagacaacuagaacccguguuaauaccuuuaccagauguacggaauaauuucuaccacuauaaucaaucaaaugauccuaccaucaaacuaauagcaauguuauauacaccauuaagagccaacaaugcaggugaugauguauucacaguuucaugucgaguacuuaccagaccaucaccugacuucgacuucaucuucuuaguacccccaacaguugaaucaagaacaaaaccauuuuccguaccuauauuaacuguagaagaaaugacuaacagcagauuucccauaccauuagaaaaacuauuuacaggaccaucaucugccuucguaguacaaccacaaaacggaagauguacaacagauggaguacuacuuggaaccacucaacuaucaccagucaacauuuguaccuucagaggagacguuacacacauaacagguucaaggaauuacacuaugaauuuagcaacccaaaacuggaauucauacgacccaaccgaagaaaucccugcuccauuaggcacaccugauuuuguugguaaaauacaaggaguacuuacacaaaccacccgcgcagacggcucaacaagaggacauaaagcaacuguauauacuggaucagccgauuuugcaccaaaauuaggaagaguucaauuugcaacagauaccgauaacgauuuugaugcaaaccaaaauacaaaauuuacgccaguagguguuauacaagaugguaacacagcacacagaaacgaaccacaacaauggguuuuaccaucauauucuggacgaaauucacauaacguacaccuagcaccagccguagcaccaacauuuccaggagaacaacucuuauuuuuuagaucuacaaugccaggcugcucagguuauccaaacauggaucuagauugcuuacuaccacaagaauggguacaauacuucuaucaagaagcagcacccgcacaauccgacguagcacuauuacgauuuguaaauccagauaccggaagaguauuauuugaaugcaaauuacauaaaaguggauacguaacaguugcccauacaggccaacacgauuuaguuauaccaccaaauggauauuuccgauuugauucauggguaaaucaauuuuauacauuagccccuaugggaaacggcacagguagaagaagagcacuauaa

SEQ ID NO: 30878 - RNA, 1623 nt, Artificial Sequence
  derived and/or modified sequence opt6 from capsid_protein_VP1__Norovirus__ADI45816
augaaaauggcuucuaacgaugccaacccaucugacggaucugcugcuaacuuaguaccagaaauaaauaaugaaguaauggcacucgaaccaguaguaggagcugcaauagcagcaccuguagcaggccaacaaaacguaauugacccauggauacgaaauaauuuuguucaagcaccaggaggugaauuuacaguauccccaagaaacgccccaggagaaauucuuuggucagccccuuuaggaccagaucuaaacccauacuuaagucauuuagcaagaauguauaacgguuacgcuggagguuucgaaguacaagucauaccagcaggaaaugcuuuuacagcuggaaaaauaauauucgcagcaguaccaccaaacuuuccaacugaaggucucuccccaagucaaguaacuauguuuccacauauaauagucgacguaagacaauuagaaccaguacucauaccauuacccgauguacgaaacaacuuuuaucauuacaaucaaucaaaugacucuacaauuaaacuaaucgcaauguuauacacaccauuaagagcaaauaaugcaggcgacgauguuuuuacaguaucaugccgcguauuaacucguccuucaccagauuuugacuuuauauuucuaguaccucccaccguugaaucaagaacaaaaccauuuacaguaccaauacuaacaguugaggaaaugacaaauuccagauuuccaauuccacuagaaaaacuauuuaccggaccgucaucugcauuuguaguacaaccccaaaacggacgauguacaacugacggaguauuauuaggaacaacacaauuaucaccaguuaauauuuguacuuuucgaggagacguuacacauauagcugguucacgaaacuacacgaugaaucuagcaucacuaaacuggaacaacuacgauccuacagaagaaauacccgcaccauuaggaacaccagacuuuguagguaaaauacaagguguacuuacacaaacaacaaaagaagauggauccacaagaggacauaaagcaacuguauauaccggcuccgcagauuuuacaccaaaauuaggaaguguacaauucggaacugacacugaaaaugauuuugaaacacaucaaaauacuaaauucacaccugucggaguaauacaagauggaucaacaacacauagaaaugaaccacaacaauggguauuacccucauauucagguagaaauguucacaauguacauuuagcaccagcuguugcaccaaauuuuccaggagaacaacuauuauucuuucgauccacaaugccggguuguuccggcuacccaaacauggaccuagacugcuuauuaccucaagaauggguacaacacuucuaccaagaagcagcaccagcucaaucagaugucgcacuauuaagauucguaaacccagacacaggccgaguacuauuugaaugcaaacuccauaaaucagguuauguaacaguagcucauacaggacaacaugauuuaguuauaccaccaaacggauacuuuagauucgauuccuggguaaaucaauuuuacacauuagcacccaugggaaauggaacgggaagaagaagagcauuauaa

SEQ ID NO: 30879 - RNA, 1623 nt, Artificial Sequence
  derived and/or modified sequence opt6 from capsid_protein_VP1__Norovirus__ADI45817
augaaaauggcauccaaugaugcuaauccuucagacggaucuacagcaaacuuaguaccagaagucaacaaugaaguaauggcucuugaaccaguagucggagcugcaauugcagcaccaguagccggucaacaaaaugucauagacccauggauaagaaauaacuucguccaagccccaggaggagaauucacaguaucaccccguaaugcuccuggagaaauacuuuggucagcaccacuaggaccagauuuaaauccauacuuaucacacuuagcacgaauguauaacgguuacgcuggaggauuugaaguacaaguaauauuagcaggcaacgcguuuacugcaggaaaaaucauauuugccgcaguaccaccaaacuucccaacagaaggucuuucaccaucacaaguaaccauguucccucacauaauaguagauguaagacaacuagaaccaguuuuaauaccucuuccagauguacgaaauaauuuuuaucacuauaaccaaucuaaugacccuacaauaaaacucaucgcaaugcuauacacaccacuaagagcaaacaaugcaggagaugacguauuuacuguuagcugcagaguuuuaacaagacccaguccagacuucgacuucauauucccaguaccaccaaccguagaaucaaggacaaagccauuuacaguaccaauucuaacuguagaagaaaugacaaacucaagauucccaauaccacuagaaagauuauauacaggaccaucaucugcauucguuguacaaccacaaaacggcagaugcacaacagauggcguauuacuaggcaccacacaauuaucagcaguuaacaucuguacauuuagaggagauguaacccauauagccggcucacgcaauuacacuaugaaucucgcaucacaaaacuggaauaauuaugauccaacugaagaaauaccugccccacuaggaacaccagacuuuguaggaaaaauacaaggaauguuaacacaaacaacaagauccgacggcucuacaagaggccacaaagcuacaguauuaacagguucugccgacuuugcuccaaaauuaggcagaguacaauucgcaacagauacagauaaugauuuugaaaguggacaaaauacaaaauucacaccaguuggaguaauacaagauggaucaacaacacauagaaaugaaccgcaacaauggguauuaccaaacuacucaggccgaacaggacacaacguacacuuagcaccugcuguugccccaaccuauccaggagaacaacuauuauucuuuagauccacaaugcccggaugcuccggcuacccaaauauggaucuagacugcuuacucccacaagaauggguacaacacuucuaccaagaagccgcuccagcacaaucagacguagcauuauuacgauuuguuaauccagauacuggacgaguacuauucgaaugcaaauuacauaaaucaggauacguaacaguugcacacacagggcaacaugaucuaguaauaccacccaacggauacuucagauucgauagcuggguaaaccaauuuuacacauuagcuccaaugggcaauggaacaggaagaagacgagcaguauaa

SEQ ID NO: 30880 - RNA, 1623 nt, Artificial Sequence
  derived and/or modified sequence opt6 from capsid_protein_VP1__Norovirus__ADI45818
augaaaauggcaucuucugacgcacacccaucagaugguuccacugcaaaucuuguaccagaaguaaacaaugaaguaauggcucuagaaccaguugucggagccgcaauagcagccccuguagcaggccaacaaaauguaauagaucccuggauuagaaauaacuuuguucaagcaccaggaggcgaauuuaccguuaguccucgaaacgcaccaggcgaaauauuauggucagcuccacuaggccccgaucuaaauccauacuuaucacaucuagcaagaauguauaacgguuacgcaggaggauucgaaguacaaguaauccuagccggcaaugcauuuacugcuggaaaaauuauauucgcagcuguacccccaaacuuuccaaccgaagguuuaucaccaucacaaguaacuauguuuccacacauaauagucgacguacgacaacuugaacccguauuaauaccacuccccgacguaagaaacaacuucuaucacuauaaccaaucuaaugacccuacaaucaaauuaauagcaaugcuuuacacaccauuacgagcaaauaacgcaggagacgaugucuuuacagucucaugucgcguccuaacaagaccaucaccugacuuugacuuuaucuuucuaguuccaccaacuguagaaagcagaacaaagccuuuuuccgucccaguacuaacaguagaagaaaugacuaauucuagauuucccauaccacuagaaaaauuauuuaccggaccauccucagcuuucguaguacagccacaaaacggaagaugcacaacagauggaguacuuuuaggaacaacucaauuauccccuguaaauauauguacauuuagaggcgacguuacacauaucccaggcucuagaaacuacacuaugaaucuagcaagccaaaacuggaacucauacgauccuacagaagaaauaccagcaccacuaggaacaccagacuuuguuggaaaaauacagggcguauuaacacaaacaacucguacuaacggaucuacaagaggccacaaagccaccguauauacaggaucagcagauuuuucaccaaaacuaggaagaguacaguuugcuacagauacagacaacgacuucgaaacaaaucaaaacacaaaauuuacucccgucggaguaauacaagauggcucaacuacuccuagaaaugaaccacaacaauggguauuacccuccuauuccggacguaauauccauaauguucacuuagcaccagcaguugcaccuaccuuuccaggagaacaauuauuauucuucagaucaacaaugccaggcuguucaggauauccaaacauggaucuagauuguuuacugccacaagaauggguccaauacuuuuaucaagaagccgccccagcacaaucugaugucgcacuacuacgauuuguaaauccagauacaggacgaguacucuuugaauguaaacuacauaaaucuggauaugucacaguugcauacaccggacaacacgaucuaguaauaccaccaaacggauacuuucguuucgacucauggguaaaucaauuuuauacauuagcaccaaugggaaauggcacuggcagaagacgagcucuauaa

SEQ ID NO: 30881 - RNA, 1626 nt, Artificial Sequence
  derived and/or modified sequence opt6 from capsid_protein_VP1__Norovirus__AET79296
augagaauguccgauggagccgccccaaaagcaaauggaucagaagcuucaggucaagauuuaguuccuacagcagucgaacaagcaguaccaauacaacccguagcaggagccucauuagcagcaccugcagcaggacaaauaaaucaaauugauccauggaucuuucaaaauuuuguacaauguccauuaggagaauuuuccauaucacccagaaauacaccaggagaaauauuauuugaucucgcccuaggaccaggauuaaauccauaucuugcacaucuaucagcaauguauaccgguugggucggaaacauggaaguacaacuaguacucgcaggaaaugcauuuacagcaggaaaaguaguagucgcauuaguacccccauauuuuccaaaagguucucuaacaacugcacaaauaacauguuuuccacacguaaugugcgauguacgcacauuagaaccaauacaauuaccacuacuugauguaagacguguucuauggcaugccacacaagaucaagaagaaucaaugagauuaguauguaugcuuuauacaccucuaagaaccaauucaccaggagaugaaucauuuguagucagcgggagauuauuaucaaaaccagcagcugacuucaauuucguguauuuaacaccaccaauagaaagaacaauuuacagaaugguagaccuaccaguguugcaaccaagacuaugcacacaugcaagauggccugccccaguauauggucuacuaguagacccaucacuaccuucaaacccucaauggcagaauggaagaguacaugucgaugguacauuauuagguacaacaccaguaucugguucaugggucucaugcuuugcagcagaagcugcauacgaauuucaaucaggcacaggugaaguagcaacauuuaccuuaauagaacaagauggaucugcauauguaccaggugaucgagcugcaccauuaggauauccggacuucagcggacaacuagagauagagguacaaacagaaacuacaaaagcaggagacaaacuaaaaguaacuacauuugaaaugauauuagggccuacuacaaauguagaccaagcaccauaccaaggacguguacaugcaucaaccucuguaacagcaucacuuaaucuaguagauggaagaguaagagcaguaccucgaucaauauauucuuuucaagacguaguacccgaauacaaugacggucuacucguuccuuuagcuccacccauuggaccauuccuaccaggagaaguauuacuaagauuucgaacauacaugagacaaauagauuccagugaugcagcagcagaagcaauagauugugcacucccacaagaauuuauauccugguucgcuaguaaugcauucacaguacaaucagaagccuuacuacuucgauaccguaacacauuaacaggacaauuauuauucgaaugcaaacuauauucagaaggauauauagcacucucauacucaggcucaggaccacuaacauuccccacagaugguuuuuuugaaguaguauccuggguaccaagacuauaucaauuagcuagcguuggaucacucgcaacaggaagaacuuuaaaacaauaa

SEQ ID NO: 30882 - RNA, 1626 nt, Artificial Sequence
  derived and/or modified sequence opt6 from capsid_protein_VP1__Norovirus__AFB18026
augcgaaugucagacggcgcuacaccuaaaccaaacggaucagaagcugcaggccaagaucuugucccaagcucuguugaacaagcaauuccuauucaaccaguagcuggagccgcaguagcugcaccaacagcaggacaaauaaaucaaauagauccauggauauuucaaaauuuuguacaauguccauuaggugaauucucuaucucaccacguaacacaccaggagaaauucuauuugaccuagccuuagguccaggauuaaacccauauuuagcucaccuaucagcuauguauacaggaugggucggaaacauggaaguucaacuaguccuagccgguaaugcauuuacagcaggcaaagucguuguugccuuaguaccuccauauuucccacaaggaucuuuaacaacugcccaaauaacauguuuuccacauguaaugugugauguaagaacauuagaacccauacaauuaccauuauuagauguaagacgaguacucuggcacgcaacccaaaaucaagaagaagcaaugagauuaguuuguauguuauauaccccauuacgaaccaauucuccuggugacgaaucauuuguaguaucaggacgauuacuuucaagaccauccccugauuuuaauuuuguauaucuaacacccccaauagaacgaacaauauacagaaugguagaccuaccaguaguacaaccuagauuauguacucauucacgauggccagcaccaguauaucaaauauuaguagauccaagucuaccauccaauccucaauggcaaaauggaagaguauuaauagauggaacucuuuuaggcacaacaccaauaucuuccuccuggguagcauccuucgcaggaacugcagaauauucuuuccaaucaccacccucugcagaaaucggagaaguauccuuauuugaaauugacggcucagccuauacacccggagacagagcagcaccacuaggcuacccugauuuuagcggaacacuagaaguugaaauacaaacagaaacuacaaaagcuggacaaaaacuagauguacauacauucaauuuagaauugaaaucacaaacaguagaucaagcaccauuucaaggcaaaguauauauggauuuagaagcuucagcuucuuuagauuuagucaacggaagaguaagagccagucccagaucagucgcagcauuuaaagacgaacuuccaucuuacaauucgggucuacuaguuccucuugcaccaccucuaggccccuuucuuccaggagaaguacuucuaagauuuagaaccuuugcacgacaagucgacaccaccgacgcuucugcacaagcaguggauugcgcauuaccccaagaacuaguaucuugguucgcuagcucaaauuuuacaguacaaucagaggcauuacuuuuaagauauagaaauacauuaacuggacaauuauuauucgaaugcaaacuuuacucagaaggauacaucgcacuaucauauacaggaagcaguccacuaacauuuccaacugauggauucuuagaaguaguuucauggguuccuagacuacaccaauuagcaucagucggaucauuagcaacaggaagaucauuaaaacaauaa

SEQ ID NO: 30883 - RNA, 1626 nt, Artificial Sequence
  derived and/or modified sequence opt6 from capsid_protein_VP1__Norovirus__AFB18027
augagaaugucagauggagcaaccccaaaaccaaacgguuccgaagcugcuggacaagauuuaguaccuucaucaguagaacaagcuauaccaauacaacccguagcuggcgcagcuguagcagccccuacagccggccaaauaaaucaaaucgacccauggauauuccaaaauuuuguacaauguccucuaggugaauucagcaucucaccacgaaauacaccaggagaaauccuauucgaucuagcacuaggcccuggacuaaauccauaucuagcacaccuaucagcaauguauacaggauggguaggaaauauggaaguccaauuaguucuagcuggaaacgcauuuacagcaggaaaaguaguaguagcauuagucccaccuuauuuuccuaaaggaucauuaaccacagcccaaauaaccuguuuuccacacguuaugugcgauguaagaacuuuagaaccuauucaauuaccauuacuagauguaagacgaguccuuuggcacgcaacccaagaccaagaagaagccaugcgacuugucuguauguuauauacaccauuaagaacaaauucuccaggugaugaaucuuucguuguauccggcagacuauuaagucgaccagcaucagauuuuaacuuugucuaucuaacuccaccaaucgaaagaacuauauaccgcaugguagaccuuccugucguacaaccuagauuaugcacccauuccagguggccagcaccaguauaucaaauacuuguagauccaucacuaccaucaaauccccaauggcaaaacggacguguucaaguagacggaacacuccuugguacaacaccagucucuggaucauggguagcuucauuugcaggaacagcagaauacucauuucaaacuccaccuucagccgaaaucggaacuauaucucuuuuugaaauagacggaucagcauauguucccggagacagagccgcaccacucggauacccagacucagcuggaacauuagaaguagaaauacaaacagaaacaacaaaagcaggacaaaaauugaauguacacacuuucucauuagaauuaguaucccaaacaguugaucaagcaccauaucaaggucaaauauucgucgauuuagaaacaucaucuuccauggaucuaguaaacggcagagugagagcaucacccagaucuauaucaggauucaaagacgaauuaccaucauauaacaaugguuuauuagucccuuuagcacccccauuagguccauuucuaccaggagaaguacuucuacgauuuagaacuuuugcaggccaagucgaccuuacagacgccgcagcacaaccuguugacugugcauuaccacaagaauuuguaucaugguuugcuagcaauaauuuuacaguccaauccgaagcacuauuauuacgauauagaaacaccuuaacuggucaacuauuauuugaauguaagcuauauucagaaggauacauagcacuaucauauacagguucugguccacucacauuccccaccgauggguucuucgaagucguaucauggguaccacgucuauaucaauuagccaguguaggaucuuuagcaacuggacguucccuaaaacaauga

SEQ ID NO: 30884 - RNA, 1635 nt, Artificial Sequence
  derived and/or modified sequence opt6 from capsid_protein_VP1__Norovirus__AFI08231
augaugauggcaucaaaagacgcacccacaaauauggauggaacaucaggugcaggacaacuaguaccagaagcuaacacugccgaaccuauaucaauggacccuguagcaggagcagccacagcaguugcaacugcaggccaaauaaacaugauagacccauggaucaugagcaauuuuguacaagccccacaaggagaauucacaguuaguccaaauaacacaccaggugacguucuauucgaccuucaacuugguccacaauuaaauccauuccuugcucacuuagcacaaauguacaauggauggguaggaaacaugagaguaaaaguauuacuagcuggcaaugcauuuacagcaggaaaaauaauaaucaguuguauaccaccagguuuuacuucacaaaacauaucaauagcacaaaugacaauguucccacacguuauagccgacguccguguauuagaaccaauagaaauaccucucgaagauguacgaaacgucuuauuucauacaaaugacaacagaccuaccaugagacuugucuguauguuauacacaccauuaagagcaaacggaucaucaucagguacugacccauucguaauagcuggucgaguccuaaccugucccgauucuaauuuuucuuuccuauuucuugucccacccaacguagaacaaaaaacccgaccauuuucaguaccaaauauaccuuuaaauaccuuaucaaauucaagagucccaucacuaaucaaaucaaugacuauaucucgugaucaaaaccaaauaauacaauuucaaaauggaagaguaacucuagacggccaacuccaaggaacaacaccuacaucaguaucacaacuaugcaaaauaagaggaacaacuuaccaugcaacaggagguaacggaauaaauuuaacagaauuaaacggagaaccauaccaugcauuugaaucuccagccccaauuggauuucccgacuuaggcgguugugacuggcacuuaacagcuacaccaacacaagcuuuuaacgauggagcuaaaguuguacgacuaucaguaacacaaggugcagcauucgcaccacaucuuggcacaauucacuauacaacuacagauacagacuauaauccaaacacaaguauaaucuguacuuuagauuggcuaucacaaaccgcaggacagucaaauguugauccauggcaaauaccaacauauggaucaacacuaacagaagcagcacaacuagcuccacccauauucccaccuggcuuuggagaaacacucguauucuuccuuucagacuuuccaauaucaaacggaaagaauggacucucaguaccauguacauuaccccaagaauuuguaacacauuuugucaacgaacaagcaccaauaagaggugaagcagcccuauuacauuacguagauccugauacucauagaaaucucggagaguuuaaacuauacccagaaggauuuaugacauguguaccaaacacaucuggagguggaccacaaacacuacccauaaacggaguauucguguuuguauccuggguaucaagauucuaucaacuuaaaccugucgguacugccggagccgcaagaagauuaggcaucagaagauccuaa

SEQ ID NO: 30885 - RNA, 1623 nt, Artificial Sequence
  derived and/or modified sequence opt6 from capsid_protein_VP1__Norovirus__AFI08240
augaaaauggcaucaaaugacgcuaacccaagugacggaucagcagcuaacuuagucccugaaguaucaaaugaaguaauggcauuagaacccgugguaggagcagcaaucgcagcccccguugcaggacaacaaaacguaauugacccauggaucagaaauaacuuuguccaagccccaggaggagaauucacagucucuccgcgcaacgccccuggagaaauucuauggucagcaccacucggaccagaucuaaaucccuaucuaucgcacuuagcuagaauguacaauggauaugcaggagguuuugaaguacaaguaauacuagcaggaaaugcauuuacagcugguaaaaucauuuucgcugcaguaccaccuaauuuucccaccgaagguuuauccccaucacaaguuacaauguucccacacauaaucgucgacguuagacaacucgaaccagugcuaauaccacuaccagauguaagaaacaauuucuaccacuauaaccaaacaaacgacucaaccauaaaacuaauagcaauguuauauacuccauuaagagcuaacaaugcaggugaagauguauuuaccgucucauguagaguacuaacacgaccaucaccugacuuugacuucaucuuucuagucccaccaacuguugaaucuagaacaaaaccuuucacaguaccuauauuaacaguugaagaaaugaccaauucaagauuucccauaccacuagaaaaacuauucacaggacccucuggugcauucguaguccaaccacaaaauggaagaugcacaacagauggcguccuacuaggaacaacacaauuaucaccuguaaauauaugcacauucagaggagauguuacacauaucgccggaucacguaacuauacaaugaauuuagcaucacuaaacuggaauaauuacgauccaacugaagaaauaccugcacccuuaggaaccccagacuucguaggaaaaauacaagguguccuaacacaaacaacuaaaggcgacggaucuaccagaggacacaaagcuaccguauacacaggaucagcuccauuuacacccaaauugggaucaguccaauuuucaaccgauacagaaaaugauuuugaaacccaucaaaacacuaaauuuacuccaguaggaguaauacaagacgguggaacaacacacagaaaugaaccucaacaauggguauuaccauccuauucaggaagagauguccauaacguucacuuagccccugcagucgcacccacauuuccaggagaacaauuacucuuuuucagaucaacaaugccagguugcucaggcuaucccaauauggacuuagacugcuuacuaccacaagaauggguacaacauuuuuaucaagaagcagccccagcacaaagugauguagcauuacuacgauucguuaacccugacacuggaagaguccuauucgaaugcaaauuacauaaaucaggauauguaacaguagcacauacaggccaacacgaucuaguaauaccgccaaauggcuacuuuagauuugauucuugggucaaucaauucuauacauuagcaccaaugggcaauggaacuggaagaagacgugcauuauaa

SEQ ID NO: 30886 - RNA, 1620 nt, Artificial Sequence
  derived and/or modified sequence opt6 from capsid_protein_VP1__Norovirus__AFS33552
augaaaauggcuuccagugacgcaaauccuucagauggaagugcugcaaacuuaguuccagaaguaaacaaugaaguaauggcauuagaaccaguaguaggagcagccauagcagcacccguagcaggucaacaaaauauaauagaccccuggauuagaaacaauuucguacaagccccaggaggagaauuuacaguaaguccaagaaaugcuccaggagaaauauuauggucagcaccauuaggaccagaccuuaauccauaucuaucacaccuuucacgaauguauaacggauacgcaggaggauucgaaguccaaguaauccuagcuggaaacgccuuuacagcagguaaaguaauuuucgccgcagucccucccaauuuuccaacagaagguuuaucuccaucccaaguuacaauguuuccacauauaauaguugauguaagacagcuagaaccaguacuaaucccucuacccgauguacgaaauaauuuuuaucacuauaaccaaucacacgacucaacauuaaaacuaauagcaauguuauauacacccuuaagagcaaacaacgccggugacgacguauucacaguaucaugucgaguuuuaaccagaccaaguccagacuuugauuucauauuucuuguaccaccaacuguagaaucuagaacgaaacccuucacagucccaauacuuacuguagaagaaaugucaaacaguagauuuccaauaccucuugaaaaacuauacaccgguccaucaucagcuuucgucguacaaccccaaaacggaagauguaccacugacggaguuuuauuaggaacuacacaacuaucagcuguaaacauauguaacuuucgaggggacguuacacacauagucggaucucacgacuauacaaugaaucucgcaucacaaaauuggucaaauuaugauccaacagaagagauaccagcaccacuaggaacuccagauuuuguaggaaaaauacaaggacuccuuacgcaaacaacacgagcugacgguucaacuagagcacacaaagccacaguaucuacaggaucaguucacuuuacacccaaacuaggaucuguacaauuuacaacagauacaaauaacgauuuccaaaccggucaaaauacaaaauucaccccaguaggagucauucaagauggagaucaucaccaaaacgaaccacaacaguggguauuaccaaauuauuccggacguacaggacacaacguacauuuagcaccagcaguagcuccuaccuucccaggugaacaauuauuauuuuuccgaucaacuaugccaggauguuccggauacccaaauaugaaccuagacugucuauuaccacaagaaugggugcuccacuucuaccaagaagccgcaccugcacaaucagaugucgcucucuuaagauuugucaacccugauacaggucgaguuuuauuugaaugcaagcuacacaaauccggauacauaacaguagcacacacaggacccuacgauuuaguaauaccaccaaaugguuauuuuagauuugacucauggguaaaccaauucuauacacuagcaccaaugggaaacggcacaggccgcagaagagcucuauaa

SEQ ID NO: 30887 - RNA, 1608 nt, Artificial Sequence
  derived and/or modified sequence opt6 from capsid_protein_VP1__Norovirus__AFS33555
augaaaauggcaucuaacgaugccgcuccaucaaacgauggagcagcaggcuuaguaccagaaguuaauaacgaaacaauggcuuuagaaccaguagcaggagccuccauugccgcaccuuuaacaggucaaaacaacguuauagauccauggauacgaaugaauuucguacaagcaccaaauggagaauucacuguaucacccagaaacucaccaggugaaauauuacuaaauuuagaauuaggacccgaguuaaacccuuuucuagcucaucuaucccgaauguauaacgguuaugcaggcggaguugaaguacaaguauuauuagcgggcaacgcauuuacagcaggaaaacuaguauucgcagcaaucccaccacauuucccacucgaaaaccuaucaccaggacaaauuacaauguuuccucauguaauuauugauguccgaacauuagaaccuguauuacuucccuuaccugauguuagaaauaauuuuuuccauuacaaccaacaaccagaaccuagaaugagacuaguagcaaugcucuacacuccacuucgaucaaauggcucaggagacgacguauucacuguauccugcagaguauuaacacgacccucacccgauuucgauuuuaauuaucuaguccccccuacuguagaaucuaaaacuaaaccauuuacacucccaauacuaacuauaggagaacuuucaaacaguagauucccuguaccaaucgaugaacuauauacuucaccaaacgaaggaguaaucguucaaccacaaaauggcagaucuacauuagacggagaauuacuuggcacaacacaacuaguaccaucaaacauuugcgcauuaagagguagaauaaaugcccaaguacccgacgaucaccaucaauggaauuuacaaguaaccaauacaaacggaacaccauuugacccuacagaagauguaccagcaccauuaggaaccccugauuuccuagcaaauauauacggaguuacaucucaaagaaacccaaacaauacuugucgcgcccaugacggaguacuagcuacauggucaccaaaauuuacaccaaaacuaggaagcguuauccuuggaacaugggaagaaucagaccuagaccuaaaucaaccaaccagauucacaccaguuggauuauucaacaccgaccacuuugaccaaugggcauuaccaucauauucuggaagauuaacauuaaacaugaaccuugccccuucaguuucaccacucuuuccaggagaacaacuucuauuuuuuagaucccacauuccucuaaaaggagguacaucagauggcgcaauagacugcuuacuuccacaagaauggauacaacauuuuuaucaagaaucagcaccaucaccaacugacguagcccucauaagauacacaaauccagauaccggaagaguuuuauuugaagcaaaacuacacagacaaggauuuauuacagucgcuaacucuggaucaagaccaauaguaguaccaccaaacggauacuucagauucgacucauggguaaaccaauucuauucacuagcuccaaugggaacaggaaauggcagaagacgaguacaauaa

SEQ ID NO: 30888 - RNA, 1623 nt, Artificial Sequence
  derived and/or modified sequence opt6 from capsid_protein_VP1__Norovirus__AFW15938
augaaaauggcauccaacgacgcaaaucccucagacggauccgcagcaaaccuugucccagaaguuaacaaugaaguaauggcacuugaacccguagucggagcagcaauagcagcaccaguugcaggacaacaaaaugucauugauccauggaucagaaacaacuucguacaagcuccaggcggagaauuuacaguauccccacgcaacgcacccggagaaaucuuauggucagcaccacuagguccagauuuaaacccuuaucucucacacuuagcaagaauguacaauggauacgcaggcggauucgaaguccaaguaauucuagcagguaaugccuuuacagcaggcaaaaucauauucgccgcaguaccacccaacuuuccaacagaaggacuaucacccucacaaguaacaauguuuccacauauaauaguagacguaagacaacuagaaccaguacuaaucccauuaccagacguacgcaauaauuucuaucacuacaaccaaucaaacgacucaacuaucaaacuaauagcgauguuauacacuccauuaagagcaaacaacgcaggagaagacguauuuacuguaucuugucgaguacuuacaagaccaucaccagacuuugauuuuauauuucuuguaccaccaacaguagaaucacgcacaaaaccauucaccguaccaauauuaacagucgaagaaaugacuaacucaagauuuccaauacccuuagaaaaacuauuuaccggaccaucaagcgcauuuguaguccaaccacaaaacggacgaugcacaacagacggaguacuauuaggaacuacacaauuaagcccagucaauaucuguacauuucguggugacgucacacauauagcagguaguagaaacuacacaaugaacuuagcaucauuaaauuggaacaacuacgauccaacagaagaaauaccugccccacuaggaacaccagacuucguaggaaaaauacaaggagucuuaacccaaacaacaaaaggagauggaaguacaagaggucauaaagcaacaguauauacuggaucugcuccauuuacuccaaaauuaggaucaguacaauucucaacagauacagaaaaugauuucgaaacucaucaaaacaccaaauucacaccuguaggcguaauacaagacgguucaacgacacauagaaaugaaccccaacaauggguccuuccaucauacucaggacgaaaugcccaaaauguacaucuagcaccagccguugccccaacauuuccaggagaacaauuacucuuuuuuagaucuaccaugccuggcugcucaggauauccuaauauggacuuagacugccucuuaccacaagaauggguccaacauuuuuaccaagaagccgccccugcacaaucagacguagcacuauuaagauucgucaauccagauacagguagaguacucuuugaaugcaaacuacauaaaucaggguacgucacaguagcacauacuggacaacacgaucuaguaauacccccaaauggauauuucagauucgauucaugggucaaucaauuuuacacacuagcuccaauggguaauggcacaggaagaagaagagcauuauaa

SEQ ID NO: 30889 - RNA, 1623 nt, Artificial Sequence
  derived and/or modified sequence opt6 from capsid_protein_VP1__Norovirus__AFW15940
augaaaauggcauccaaugaugcuaaccccagugaugguucugccgcaaaccuuguaccagaaguuaacaacgaaguaauggcauuagaacccguaguuggcgcugcuauagcugcaccaguagcuggacaacaaaacguaauagacccauggauaagaaacaauuuuguucaagcaccaggaggagaauuuaccguaucaccucguaaugcaccaggagaaauauuauggucugcaccacuagguccagaucuaaauccauaucucucacaccucgcacgaauguacaacggauacgcuggagguuuugaaguacaaguuauauuagcaggaaaugccuuuacagcaggaaaaauaaucuuugcagcaguaccaccaaauuuuccaaccgaaggccucucaccaucacaaguaacaauguucccucauauuaucguagacgucagacaacuagaacccguauuaaucccauuacccgauguuagaaacaacuuuuaccacuacaaucaaucaaacgacucaaccauuaaacuaauagcaauguuauauacuccauuaagagcuaauaacgcuggagaagacguauuuacaguaucauguagaguacuaacacgcccaucuccugacuucgacuucauauuuuuaguacccccuacaguugaauccaaaaccaaaccauucacaguaccuauacuaacaguugaagaaaugacuaauagucgauuuccaauaccauuagaaaaauuauucacaggaccaucaucagcauuuguaguucaaccccaaaacggaagaugcacaacugauggcguccuauuaggaaccacccaacucucaccaguaaacauauguacauuuagaggagacguuacacacauagcaggcucaagaaauuacacaaugaaccucgccuccuuaaauuggaauaauuacgaucccacagaagaaauaccagcaccucuagguacaccagacuuuguagguaaaauccaaggaguauuaacucaaaccacuaaaggagauggaucaaccagaggacacaaagccacuguauacacaggaucagcaccauucacaccuaaacuaggaucuguucaauuuucuacagacacugaaaaugauuucgaaacccaccaaaacaccaaauuuacacccgucggaguaauucaagacgguucaacuacacaccgaaaugaaccacaacaauggguacuuccauccuacucaggaagaaaugcucaaaacguucaccuagcaccagcaguugcaccgacauuccccggugaacaauugcuauucuuuagaucaacaaugccaggaugcuccggauauccuaacauggaucucgauugcuuauuaccacaagaauggguacaacauuuuuaucaagaagcugcaccagcacaauccgacguagcauuacuaagauuuguaaauccugauaccggaagaguauuauucgaauguaaacuccacaaaucaggauauguaaccguagcucacacaggacaacacgauuuaguaauaccaccaaauggauauuucagauucgauucauggguaaaucaauuuuauacauuagcuccaaugggaaacggcacuggacgacgacgagcacuauaa

SEQ ID NO: 30890 - RNA, 1623 nt, Artificial Sequence
  derived and/or modified sequence opt6 from capsid_protein_VP1__Norovirus__AFW15941
augaaaauggcaucaaaugacgcaaaucccucagaugguuccgcagcuaacuuaguccccgaaguuaauaacgaaguaauggcucuugaacccgucguaggagcagcaaucgccgccccaguagcuggacaacagaacguaauugacccauggauaagaaauaacuucguacaagcccccggaggagaauuuacaguauccccucgaaacgcaccaggagaaauacuauggucagccccacucggaccagaucuaaacccguauuuaucacacuuagcaagaauguacaauggcuaugcaggcggcuucgaaguucaaguaauauuggcaggaaaugcauuuacagcaggaaaaauaauuuucgcagcaguuccaccaaacuuuccaacagaaggacuaucacccucacaaguaacuauguuuccacacauaauuguugauguaagacaauuagaaccaguacuaauaccccuaccagacguaagaaauaauuuuuaucauuauaaccaaucaaacgacagcacaauaaaauuaauagcaauguuauauacgccacuaagagcaaacaaugcaggugaagacguauucacaguaaguuguagaguauuaacacgccccucuccagacuucgacuuuaucuuucuaguacccccaacaguagaaucuagaacaaaacccuucaccgucccaauauuaacaguagaagaaaugacaaacucaagauuuccuauaccauuagaaaaacuauuuacaggacccucuagcgccuuuguuguacaaccucaaaauggaagaugcacaacagacggaguauuacuagguacuacacaauuaucacccguaaauauaugcacuuuuagaggagacguuacacauauagccgguucccgaaauuacacaaugaaucuagccucauuaaacuggaacaauuacgauccaacagaagaaaucccagcuccucuuggaacaccugacuuuguaggaaaaauacaaggaguacucacacaaaccacaaagggugaugguucaacuagaggucacaaagccacaguauacacagguucugcaccauuuacaccgaaauuaggaucaguucaauucuccacugacaccgaaaacgauuuugaaacacaccaaaacacaaaauucaccccaguaggaguaauacaagauggguccacaacccauagaaaugaaccacaacaauggguacuaccauccuauucaggcagaaacguacaaaacguccaccuagcuccagcaguugcaccuacauucccaggagaacaauuacuauucuuuagaucaacaaugccagguugcagcggauauccaaauauggauuuagauugccuauuaccacaagaauggguacaacauuucuaucaagaagcagcuccagcacaaucagauguagcauuacuaagauucguuaacccagacacaggucguguauuauucgaaugcaaacuccauaaaucaggcuauguaacaguagcacacacaggacaacacgaucuaguaauaccaccaaauggcuauuuuagauuugauucauggguaaaucaauucuacacccuagccccaaugggaaaugguacuggcagaagacgagcauuauaa

SEQ ID NO: 30891 - RNA, 1623 nt, Artificial Sequence
  derived and/or modified sequence opt6 from capsid_protein_VP1__Norovirus__AFW15944
augaaaauggcaucaucagacgcaaaccccuccgacggauccacggcuaaccuaguaccagaaguuaauaacgaaguaauggccuuagaaccaguuguaggagcagcaauagccgcaccaguagcaggacaacaaaacguaauagauccauggauuagaaauaacuuuguacaagccccaggaggagaauuuacaguaagcccaagaaaugccccaggugaaauucuuuggucagcaccuuuaggacccgaucuaaauccauauuuaucucaccuagcuagaauguacaacggauacgcaggagguuucgaaguacaaguaauacuagcaggcaacgcuuucacagcaggaaaaaucauauuugcugcaguaccacccaauuuuccaacagaaggccuaucccccucacaaguaaccauguuuccucauauaauaguagacguaagacaauuagaaccaguucuaauaccccucccagauguaaggaacaauuucuaucacuauaaccaaucaaaugacucaacaauaaaacuaauagccaugcuauauacacccuuaagagcaaauaacgcaggugaugauguuuucacaguaucauguagaguucuuacuagaccaucacccgauuuugacuuuauuuuuuuagucccucccacuguagaaucccgaaccaaacccuuuucaguaccuguacuaacaguagaagaaaugacaaauucaagauucccaauaccacuugaaaaacuauuuacuggaccaagcucagcauucguaguucaaccacaaaacggacgauguaccacagacgggguacuacuaggaacaacacaacuaucaccaguaaauaucuguacauuuagaggagauguaacacacauaccaggaaguagaaauuacacaaugaaucuagcuucccaaaauuggucuucauacgacccaacagaagaaaucccagccccacucggaacaccagauuuuguaggaaaaauacaaggaguauuaacccaaaccacaagaacaaacggaucaacucguggacauaaagccacagucuauacagguucagcugauuucagccccaaacuaggacgaguccaauucgcaacugacacagauaacgauuucgaaacaaaucaaaauaccaaguucaccccaguaggcguuauacaagaugguucaacaacaccaagaaacgaaccucaacaauggguauuacccaguuauuccggcagaaauauccauaacguacacuuagcuccagccguagccccaacauuucccggcgaacaauuguuauuuuuuagaucaacaaugccaggaugcucaggauacccaaacauggauuuagauugccuauuaccucaagaauggguacaauacuucuaucaagaagccgccccugcacaaucagacguagcacuacuacgauucguuaacccagauacuggaagaguacucuucgaauguaaacuucacaaaucaggauauguaacagucgcacauacaggacaacacgaucucguaauaccaccaaacggauauuucagauucgauuccuggguuaaucaauuuuacacccuagcaccaaugggaaaugguacaggaagacgccgagcauuauaa

SEQ ID NO: 30892 - RNA, 1623 nt, Artificial Sequence
  derived and/or modified sequence opt6 from capsid_protein_VP1__Norovirus__AFW15947
augaaaauggcuaguucagaugcuaauccgucagauggcucaacagcaaaccuaguaccagaaguaaacaacgaaguaauggcauuagaaccaguuguaggagcagcaauagcagcaccuguugcaggacaacaaaauguaauagauccauggauaagaaauaauuuuguacaagcaccggguggcgaauucacaguuucaccuagaaaugcacccggagaaauauuaugguccgccccacuaggacccgauuuaaauccauauuuaagccacuuagcaagaauguacaacggauacgcaggaggcuucgaaguacaaguaauacucgcagguaaugcauuuacagcuggaaaaauuauauucgcagccguccccccuaacuuuccaacugaaggacuaaguccaucacaaguaacaauguucccacauauaauugucgauguuagacaauuagaaccaguauuaauaccauuaccugauguuagaaacaauuuuuaucacuauaaccaaucaaaugauucaacaauuaaauuaaucgcuauguuauacacaccacuaagggcaaauaaugcaggagaugacguauuuacuguaucauguagaguauuaacaagaccaucaccagauuucgauuuuauauuuuuaguaccuccuacaguagaaucccgaacaaaaccauucuccguaccuguauuaaccguugaagaaaugacaaauucacgauuccccauaccauuggaaaaauuauuuacagguccaagcucagcauucgugguacaaccacaaaacggaagauguacaacagacggaguauuauuaggcacaacucaauuaucuccaguaaacauauguacuuuuagaggugacguuacacauauaccaggaucacgaaauuacacaaugaaccuagcaucccaaaacuggaacucauacgauccaacugaagaaauaccagcuccacuaggaacaccagacuucguaggaaaaauucaaggcguacuaacacaaacuaccagaacaaacgguagcaccagaggucauaaagcaaccguauauacaggauccgcggacuuuucuccaaaauuaggcagaguacaauuugcuacagauacagauaacgauuucgaaacaaaucaaaauacaaaauucacucccguagguguuauacaagacggaucaacaacaccacguaacgaaccacaacaauggguacuuccaucauacucuggaagaaacauucacaacguccaccuagcaccagcaguagcaccaacauuccccggagaacaacuauuauucuuuagaaguacaaugccugguugcucuggauacccaaacauggauuuagacugccuucuaccacaagaauggguacaauauuuuuaccaagaagcagcacccgcacaaucagaugucgcuuuacuaagauucguaaacccagauacaggacgaguucuauuugaaugcaaacuacauaagucaggcuauguaacaguugcacauacaggucaacaugaccuaguaauccccccaaauggauauuuucgauucgacucauggguaaaccaauuuuauacacuagcuccaaugggaaauggaacugguagaagacgagcuuuauga

SEQ ID NO: 30893 - RNA, 1623 nt, Artificial Sequence
  derived and/or modified sequence opt6 from capsid_protein_VP1__Norovirus__AFW15948
augaaaauggcaucaucugaugcuaauccuucagauggcaguacagcaaacuuaguuccagaagucaacaacgaaguuauggcacuagaaccagucgucggugccgcaauagcagcaccaguugcaggacaacaaaaugucaucgacccauggauuagaaauaacuuuguucaagcaccagguggagaauucaccguaucaccacgaaaugcaccaggugaaauucucuggucagcaccacucgguccugaucuuaauccauaucucucacacuuagcuagaauguauaacgguuacgcaggaggauucgaaguccaaguaauacuagcuggcaaugcauuuacugcaggcaaaauaauauuugcagcaguaccaccaaauuuuccaacagaaggucuaucuccaucccaaguuacaauguucccucacauaauuguugacguacgucaacuugaacccguacuuauuccauuaccagacguaagaaacaacuucuaucauuauaaccaauccaacgacucaacaaucaaacuaauugcaauguuauacacuccacuucgugcuaacaaugcaggagaugaugucuuuacaguuucauguagaguacuuacaaggccaucccccgacuuugauuuuauuuucuuaguaccaccaacaguagaaucaagaacaaaaccauuuucaguacccguacuaaccguagaagaaaugacaaacucaagauuuccaauuccacuagaaaaacuauuuacaggcccuagcaaugccuuugucguacaaccacaaaauggaagauguacaacugacggaguccuacuaggaacaacacaauuaucucccguaaauauaugcaccuuucgcggcgacgucacccauauaccuggaucucgaaacuauacaaugaauuuagcaucccaaaauuggaacucuuacgauccaacagaagaaauaccugccccacuuggaaccccugacuucguuggcaaaauacaaggaguacuuacacaaacaacaagaacuaacgguaguacuagaggacauaaggcaacagucuauacaggcucagcagacuucucaccaaaauuagguagaguccaauucgcaacugauacagauaaugauuuugaaacuaaucaaaauaccaaguucacaccaguaggaguaauucaagaugguucaacaacaccaagaaaugaaccacaacaauggguucuaccaucuuauucuggaagaaauauucacaacguucaccuagcaccagcaguagcacccacauucccuggagaacaauuauuauucuuucgaucaacaaugccaggcugcucagguuacccaaacauggauuuagacugccuauuaccacaagaauggguacaauauuucuaccaagaagcagcuccagcacaaucugaugucgcuuuauuaagauucguuaacccagauacaggaagaguacuauuugaguguaaauuacauaaauccggauauguuacuguagcacacacaggucaacacgaccuaguaauaccaccaaaugguuauuucagguucgauucauggguaaaucaauuuuacacacuagcaccuaugggaaauggaacuggaagaagaagagcauuauaa

SEQ ID NO: 30894 - RNA, 1623 nt, Artificial Sequence
  derived and/or modified sequence opt6 from capsid_protein_VP1__Norovirus__AFW15949
augaagauggcaucaucagaugcaaacccaucagacggaucuacagcaaaccuaguaccagaagugaacaaugaaguuauggcauuagaaccgguuguaggagcagcuauagccgcuccuguugcaggucaacaaaauguaauugaccccuggauaagaaacaacuucguucaagcaccagguggagaauucacugucucuccaagaaaugcccccggagaaauccuuuggucagcaccucuaggaccugaucuaaacccauaccuaucacacuuagcaagaauguauaacggcuaugcagguggauucgaaguucaagucauauuagcuggaaaugcuuuuacagcaggcaaaauuauuuucgcagcaguucccccuaacuucccaacagaaggccuaucaccaucacaaguaacuauguuuccucauauaauaguagacguacgucaacuugaaccaguauuaauaccauuaccagacguacgaaauaauuuuuaccacuauaaucaauccaacgauucaaccauaaaauuaaucgcaauguuauauacaccuuuacgugcaaacaacgcuggugacgauguauucacaguuaguugcagaguauuaacccgaccaucaccugacuuugauuuuauauuucuaguucccccuacaguagaaucuagaaccaaaccauucucaguaccagucuuaaccguagaagaaaugacaaacucaagauuuccuauaccauuagaaaaauuauucaccggaccaucuucagcauucguaguacaaccacaaaacggaagauguacaacagacggaguauuauuaggaacaacccaauuaucaccaguuaauauuuguacuuuuaggggagauguaacacacauaccuggauccagaaauuauacaaugaacuuagcaucacaaaauuggaauucuuaugacccuacugaagaaauaccagccccuuuaggaacaccugacuuuguaggcaaaauucaaggaguauuaacgcaaaccacuagaacuaacggaucaacaagaggacauaaagcaacugucuacacagguucagcagacuuuucacccaaauuaggcagaguacaauucgcaacugacaccgauaaugacuucgaaaccaaccaaaauacuaaauucacaccaguagguguaauucaagacggaucaacaacaccacgaaaugaaccacaacaauggguauuaccuucuuacucagguaggaacauacacaauguacacuuagccccagcaguagcaccaacauuuccaggcgaacaauuauuauucuuuagaucuacaaugccagguugcucaggauacccaaauauggacuuagacuguuuacuaccucaagaauggguucaauauuucuaucaagaagcagcaccagcucaaucagacguagcacuauuaagauuuguaaauccagacacagguagaguuuuauuugaaugcaagcuccauaaaucaggcuauguaacugucgcacacacuggucaacaugauuuaguaauaccaccaaauggauauuucagauucgauucauggguaaaucaauucuacacacuagcaccaaugggaaauggaacuggaagaagacgugcacuuuaa

SEQ ID NO: 30895 - RNA, 1623 nt, Artificial Sequence
  derived and/or modified sequence opt6 from capsid_protein_VP1__Norovirus__AFW15950
augaaaauggcaucuuccgacgcaaacccauccgacggaaguacagcaaaucuuguaccugaaguaaauaaugaaguaauggcacuagaaccaguaguuggagcugcuauagcagccccuguagcuggacagcaaaacguaauugauccuuggauaagaaacaacuuuguacaagcaccaggaggagaauuuacaguaucaccccgaaaugcaccaggugaaauauuauggucagccccacucggaccagauuuaaauccauauuuaagccauuuagcuagaauguauaacgguuaugcaggaggauucgaaguccaaguaauacuggcuggaaaugcauucaccgcaggaaaaauaauauucgcagcaguuccuccuaauuuuccaacagaaggacuuucaccaucccaagucacaauguuuccacacauaauugucgacgucagacaacuagaacccguacuaauaccucuacccgacguaagaaacaacuuuuaucauuauaaccaaagcaacgauucaaccauaaaacuuauagccaugcuauacacaccacuuagagcaaauaacgcaggcgaugauguauuuaccguaucauguagaguacuaacuagaccuucaccagacuuugauuuuauauuuuuaguaccccccacaguagaaagcagaacaaaaccauucucaguaccaauauuaacaguagaagaaaugacaaacucaagauuuccaauacccuuagaaaaacuauucacaggaccaucuagugcauuuguaguacaaccacaaaacggcagauguacaacagacggagucuuauuagguacaacacaauuauccccaguaaauguaugcacauucagaggagacguaacacauauaagcgguucacgaaauuacaccaugaauuuagccucucaaaacuggacaucuuaugauccaaccgaagaaauuccugcgccucucgguaccccugauuuuguaggaaaaauucaaggaguacuaacccaaaccacacgaacaaacgguucuacuagaggucauaaagcaacaguauauacaggauccgccgacuucucaccaaaauuaggaagaguccaauucgcaacagauacagauaacgauuucgaaacaaaucaaaacacaaaauuuacaccagucggaguaauucaagacggcagcacaacaccaagaaaugaaccacaacaauggguacuaccuuccuauucaggaagaaacauacauaacguacaccuugcuccagcaguagcaccaaccuucccaggugaacaacucuuauuuuuuagaucaacaaugccuggauguucaggauaucccaauauggaucuagauugccuuuuaccucaagaauggguacaauauuucuaucaagaagcagcaccagcacaaucagacguggcacuacuacgcuuuguaaauccagacacaggaagaguauuauucgaaugcaaacuucacaaauccggauauguuacaguagcucauacaggacaacacgacuuaguaauaccuccuaauggauacuucagauucgauuccugggucaaccaauuuuauacacuagcccccaugggaaauggaacaggaagacgaagagcacuauaa

SEQ ID NO: 30896 - RNA, 1623 nt, Artificial Sequence
  derived and/or modified sequence opt6 from capsid_protein_VP1__Norovirus__AFW15951
augaaaauggcuucauccgacgccaacccuagcgacggcucaacagcaaaccuuguaccugaaguaaacaaugaaguaauggcacuagaaccaguagucggugcagcuauagcugcaccugucgcuggccaacaaaauguaaucgacccauggauaagaaacaauuuuguccaagcaccggguggagaauuuacaguaucucccagaaaugcucccggcgaaauacuauggucagcaccucuaggaccagauuuaaacccauauuuaucacaucuugccagaauguauaauggauacgcaggaggauuugaaguacaaguaauauuagcuggaaaugcuuuuaccgcagguaaaauaaucuuugccgcaguaccaccaaauuucccaacagaaggcuuauccccaucacaaguaaccauguuuccacacaucauuguagacguaagacaacuagaaccaguauuaauuccauuaccagauguuagaaauaacuucuaucauuauaaucaauccaaugauucaacaauaaaauuaauugcaauguuauacacaccauuaagagcaaacaacgccggugacgaugucuucacuguaaguugucgaguauuaacacgaccaucaccagauuuugacuuuauauuuuuagucccaccuaccguagaaucaagaacaaaaccauucucuguacccauacucacgguagaagaaaugacaaacucacgauuuccaauaccuuuagaaaaacuauucaccgguccaucaucugcuuucguaguacaaccacaaaacggucgauguaccacagacggagucuuguuaggaacaacacaacuauccccaguaaauauuuguaccuucagaggagauguaacacauauuucaggcucacgaaauuauacaaugaaccuagcaucacaaaauuggacauccuaugacccaacugaagaaauaccagcuccacuaggcacuccagacuuuguggguaaaauacaaggugucuuaacccaaaccacuagaacuaauggcucaacaagaggacauaaagcaacaguauauaccggaucagcagacuuuucaccuaaauuaggaagaguacaauucgccacagacacugacaacgauuucgaaaccaaccaaaauacaaaauuuaccccuguaggaguuauacaagauggaaguacaaccccucgaaaugaaccacaacaauggguccuaccaucauacuccggaagaaauauucauaacguacacuuagcaccagcaguugcaccuacauuucccggcgaacaacuauuauucuuucguucaaccaugccaggcugcucuggcuauccaaauauggaucucgauugcuuacuuccacaagaauggguacaauacuucuaccaagaagcagcaccagcacaaucagauguagcacuacuaagauuugucaacccugauacaggacgaguauuauuugaaugcaaauuacauaaaucaggauauguaacaguugcccacacaggacaacaugaucuaguuauuccaccaaauggauauuucagauucgacucauggguaaaucaauuuuacacacuagcaccaaugggaaacggaacaggcagacgaagagcacuauaa

SEQ ID NO: 30897 - RNA, 1653 nt, Artificial Sequence
  derived and/or modified sequence opt6 from capsid_protein_VP1__Norovirus__AFX71665
augaaaauggccaguaacgacgcugcaccaucaaaugauggagcugcuaaucuaguuccagaagcaaauaaugaaguaauggcauuagaaccaguagucggcgcaagcauugcagcaccaguaguuggccaacaaaacauaauagauccauggauaagagaaaacuuuguucaagcuccacaaggagaauuuacgguuucuccacgaaacagcccaggagagauguuacucaaccuagaacucggaccugaauuaaacccauaccuuucgcaccucucaagaauguauaauggguaugcuggcgguaugcaaguacaaguaguucuugcugguaaugcauucacagcaggaaaaaucaucuuugcagcaguaccaccccacuuuccaguagaaaacauaagugcugcacaaauaacaaugugcccacacguaauaguagacguacgacaauuagaaccaguauuacuuccacuaccagauauucguaauagauucuuucauuauaaucaagaaaacacaccaagaaugagacuaguagcuauguuauacacaccauuaagagcaaacucuggagaagauguauuuacaguaagcuguagaguauuaacaagaccagcaccugauuuugaauuuacauuucuaguacccccuacagucgaaucuaaaacaaaaccuuucacacuaccaauauuaacauuaggcgaacuuucaaauuccagauucccugccgcaauagacauguuauacacugaccccaacgaaucuauaguuguacaaccacaaaauggaagauguacacuagaugguacacuacaagggaccacacaacuuguacccacucaaauaugugcauuucgaggcacauuaauuucacagacagcaagagcagcagacucaacagauuccccacaacgagcacguaaucacccauuacauguacaaguaaaaaaucuagacggaacucaauacgacccaacugacgauauaccagcuguuuuaggagcaauagauuuucaaggaacaguauuuggaguggcaucacaaagagauguaucaggucaacaagaacaaggacacuacgcaacaagagcacacgaagcacacauagacacaacagauccaaaauaugcucccaaauuaggaacaauucuuauaaaaucagacuccgaugacuucaauacaaaucaaccaauucgcuuuacacccguugguaugggugacaauaauuggagacagugggaacuaccugauuauucaggacgcuuaacauuaaacaugaauuuagcaccggcaguaucaccaaguuucccaggcgaaagaauccuauuuuuuagaucaauaguaccauccgcagguggauauggaucugguuauauagauugucuuauaccacaagaauggguacaacacuuuuaucaagaagcagcacccagccaaucagccguagccuuaguccgauacguaaacccagacacaggaagaaacauauuugaagcuaaacuacacagagaaggcuuccuaacuguugccaacucaggaaacaauccaaucgucgucccaccaaauggauacuucagauuugaagcauggguuaaucaauuuuauacacuagcaccgaugggaucaggucaaggcagacgaagagcacaguaa

SEQ ID NO: 30898 - RNA, 1623 nt, Artificial Sequence
  derived and/or modified sequence opt6 from capsid_protein_VP1__Norovirus__AFX71668
augaaaauggcauccucagacgcaucaccuagcgacggauccacugcaaaccuaguaccugaagucaauaaugaaguaauggcucuagaaccagucgcaggugcagcuauugcagcucccguagcaggacaacaaaacguuauagauccauggauaagaaauaauuuuguacaagcucccggaggagaauuuacagucucaccaagaaacgcaccaggagaaauacuuugguccgcaccccucggaccagaucuaaacccauauuuaucccacuuagcccgaauguauaacggauaugcaggaggauucgaaguccaaguaauucuagcuggaaaugcauucacagcaggaaaaauaauauucgcagccguuccaccaaacuuuccaacagaaggauuaucaccuucacaaguaacaauguucccacauaucauugucgacguacgucaacucgaaccaguacuuauaccauuaccagauguaagaaacaauuuuuaucacuauaaccaacuaaaugacccuacaaucaaacucauugcuauguuauacacuccacuaagagccaauaacgcaggagacgacgucuucacaguuucuuguagaguacucaccagaccuucaccagauuuugacuuuauauuucuaguacccccaacaguagaaucaagaacuaaaccauucucagucccagucuugacagucgaagaaaugacaaauucccguuucccaauaccacuugaaaaauuauuuacagguccaucaucagcauuuguaguacaaccacaaaacggcagauguacaacagacggaguacuucuaggaacaacacaauuaucaccaguuaauaucuguaccuuuagaggcgauguaacacauauuucaggaucuagaaauuacacaaugaaccuagcuucacaaaacuggaacucauacgauccaacagaagaaauaccagcccccuuaggaacucccgauuuuguaggaaaaauacaagguguauuaacucaaacaaccagaacuaacggauccacaagaggccauaaagcaaccguauauaccggaucagcugacuuuucaccuaaauuaggcagaguacaauucgcaacagauaccgauaacgauuucgaaaccaaccaaaauacaaaauucacuccuguuggaguuauccaagaugguaauacaacgccacgaaacgaaccacaacaauggguauuaccaucauauuccggcagaaauauacaaaacgugcaccuagcgccagcagucgcaccaacauuucccggugaacaauuauuauuuuucagaucuacaaugccagguugcucuggauaccccaacauggauuuagauugucuacucccucaagaauggguacaauauuucuaucaagaagcagcaccagcucaaucagacguagcauuacucagauuuguaaacccagacacaggucgaguccuauucgaaugcaaacuucauaaaucagguuauguaacaguagcacauacuggacaacaugacuuaguaauccccccaaacgguuauuuuagauucgacucauggguaaaccaauuuuacacauuagcaccaaugggaaaugguacaggaagaagacgagcccuuuga

SEQ ID NO: 30899 - RNA, 1623 nt, Artificial Sequence
  derived and/or modified sequence opt6 from capsid_protein_VP1__Norovirus__AFX81121
augaaaauggcaucaaacgacgcaaaccccucagacggcucagcggccaaucuaguaccagaaguaucuaaugaaguaauggcuuuagaaccuguaguaggagccgcaauagcagcaccaguagcaggccaacaaaaugucauagaccccuggaucagaaauaacuucguccaagcaccuggcggugaauucacaguaucaccccgcaaugcaccaggagaaauacuauggucugcaccacuaggaccagaucucaacccauauuuaucccauuuagcaagaauguauaacgguuacgccggaggauuugaaguacaagucauacucgcaggaaacgcauuuaccgccggaaaaauaauuuuugcugccguaccaccaaauuuuccaaccgaaggacucuccccuagucaaguaacuauguucccucacauuaucgucgaugucagacaacuagaaccaguuuuaauuccccuaccagacguuagaaacaauuucuaccauuacaaucaaacaaaugacuccaccaucaaauuaauagcaaugcuauauacacccuuaagagccaacaaugcaggagaagauguauuuacuguuucaugcagaguuuuaacaagaccaucaccagauuuugacuuuaucuuucuaguuccaccaacaguagaaucaagaacaaaaccuuucacagucccaauacuaacaguugaagaaaugacaaacuccagauuuccaauuccauuagaaaaauuauucacaggucccucaggagcauuugucguacaaccucaaaacggaagauguacaacugacggcguacuacuaggcaccacucaacuaucacccguaaacauaugcacauuuagaggugauguaacacacauagcaggaucuagaaauuacacaaugaauuuagcaucguuaaacuggaacaacuaugacccaacagaagaaauacccgcuccccuaggaacaccagacuuuguagguaaaauacaaggcguccuaacacaaacaacaaaaggagacggaucaacaagaggucauaaagcaacaguuuauacuggaucagcaccauuuacaccaaaauuaggaucaguacaauuuucaaccgauacagaaaaugauuuugaaacacaccaaaacacaaaauuuacaccaguaggcguaauacaagauggaggaacaacacacagaaaugaaccacaacaauggguacucccuucauauuccggacgagacguacauaacguacacuuagcaccugccguagccccuacauuccccggagaacaauuacucuucuuucgcucaacaaugccaggauguucaggauacccaaauauggauuuagacugccuuuuaccacaagaguggguucaacauuuuuaccaagaagcagccccagcacaaucagacgucgcccuacuacgauucguaaauccagacacuggaagaguauuauucgaauguaaacuacacaaauccggcuauguaacaguagcacauacuggccaacacgauuuaguaauacccccaaauggauauuuccgauucgauucauggguuaaccaauucuacacauuagcaccuaugggcaaugguaccggacgucguagagcacuauaa

SEQ ID NO: 30900 - RNA, 1623 nt, Artificial Sequence
  derived and/or modified sequence opt6 from capsid_protein_VP1__Norovirus__AFX81127
augaaaauggcaucaaaugaugccaacccaagcgauggaucagcagcuaaccuuguaccagaagucucaaacgaagucauggcucuagaacccguagucggagcagcuauagcagcuccaguagcaggacaacaaaauguaauugauccuuggauacgaaacaacuucguacaagccccaggaggagaauucaccguaucaccgagaaaugcaccaggcgaaauccuauggucggcaccauuaggacccgaucuuaacccuuaccuaucucaucucgcaagaauguauaauggauaugcaggaggauuugaaguccaaguaauuuuagcagguaaugcauuuacugcgggaaaaauaauuuucgcagcaguaccaccuaauuuuccaacugaaggucuuucaccaucacaaguaacuauguucccacauauaauaguagacguuagacaacuagaaccaguccuuauacccuuaccagauguacgaaauaauuucuaccacuauaaccaaacaaaugacucaacaauaaaacucauagccaugcuuuacacaccacuaagagcuaacaacgccggagaagauguauuuacaguaaguugucgcguauuaacaagaccuucaccugauuuugacuuuauauuuuuaguaccaccaacaguagaaucaagaacaaaaccauucacaguuccaauauuaacagucgaagaaaugacuaacuccagauuuccaauaccucuagaaaaacuuuuuacaggaccuucaggagcauucgucguacaaccacaaaacggaagauguacaacagacgguguauuacuagguaccacacaacuuucaccuguaaauauauguacauuucguggagauguaacacauaucgccggcuccagaaauuauaccaugaaccuagcaucacuaaacuggaacaauuacgauccaacagaagaaauacccgccccacuaggaaccccagacuuuguaggaaaaauacaaggugucuuaacacaaaccacuaaaggagacggaucaacaagaggccacaaagccacaguauacacagguuccgcacccuuuacaccaaaauuaggauccguccaauucucuacagauacagaaaacgauuuugagacacaccaaaacacaaaauuuacuccaguuggagucauacaagauggaggcacaacacauagaaacgaaccacaacaauggguacuaccuucauauucaggcagagauguacauaacguccauuuagccccagcaguagcaccuacauucccaggagaacaauuauuauuuuucagaucuacaaugccaggaugcucugguuauccaaacauggauuuagauugccuacuaccacaagaauggguacaacacuucuaucaagaagcagcuccagcacaaucugauguagcauuacuacgcuucguaaacccagacacugggagaguacuuuucgaauguaaacuacauaaaucaggauauguaacuguagcucacacaggacaacacgacuuaguaaucccaccaaacggauauuuccgauucgauucauggguaaaucaauucuacaccuuagcaccaaugggaaacggcacaggaagacgaagagcacuauaa

SEQ ID NO: 30901 - RNA, 1623 nt, Artificial Sequence
  derived and/or modified sequence opt6 from capsid_protein_VP1__Norovirus__AFX81130
augaaaauggcaucaaacgacgcaaacccaucagaugggucagccgcaaacuuaguuccugaaguuucaaaugaaguaauggcuuuagaaccagucguaggcgccgcaaucgcugcacccguugcaggccaacaaaauguaauugauccuuggauaagaaauaacuucguccaagcaccagguggugaauucacaguaucuccaagaaacgcaccaggggaaauauuauggucagcuccacuagguccagaucuaaauccauaucuaucacauuuagcacgaauguacaacggcuaugcaggcggcuucgagguacaagucauauuagcuggaaaugccuucacagccgguaaaauaaucuucgcagcaguaccuccuaauuuuccaacagaaggacuaucaccaagccaaguaaccauguucccacacauuauaguagacguccgacaacuagaaccaguacuaauaccacuaccagauguacgaaacaauuucuaccacuauaaccaaacaaacgauucaacaauuaaauuaauagccauguuauacacaccacuacgagcuaacaacgcuggugaagauguauucaccguauccugucguguccuaacccgaccaucaccagauuucgacuucauauucuuagucccuccuacaguugaaucacgaacuaaacccuucacaguaccuauauuaacagucgaagaaaugacuaacucaagauuucccauaccauuagaaaaauuauucacuggaccaucaggagcauucguaguccaaccacaaaaugguagauguacaacagaugguguacucuuaggaacaacacaauuaucaccaguuaauauaugcaccuuuagaggcgauguaacacauauagccggaagucgaaauuauacuaugaauuuagcaucauuaaauuggaauaauuaugacccaacugaagaaauaccagcaccauuaggaacaccagauuucguaggcaaaauccaaggaguauuaacacaaacaacaaaaggagauggaucaacaaggggacacaaagccacagucuauaccggaucagcuccauucacuccaaaauuaggauccguacaauucucgaccgauacagaaaacgauuuugaaacccaucaaaauaccaaauuuacaccaguuggaguaauucaagacggagguacaacucaucgcaaugaaccacaacaauggguauuaccuucauacuccggaagagacguacauaauguccaccuagcaccagccguagcacccacauuuccaggagaacaauuauuauucuuucgcucaacuaugccuggaugcaguggauauccaaacauggaucuagacugcuuacuaccucaagaauggguacaacauuucuaucaagaagcagcaccagcacaaucugacguagcccuacuccguuucguaaaucccgauaccggaagaguacuauuugaaugcaaguuacauaaaagcggauauguaacuguagcacacacaggccaacaugaucuaguaauaccaccaaacggauauuuccgauucgauuccuggguaaaucaauuuuacacauuagcuccaaugggcaacgguacuggacgaagaagagccuuauaa

SEQ ID NO: 30902 - RNA, 1623 nt, Artificial Sequence
  derived and/or modified sequence opt6 from capsid_protein_VP1__Norovirus__AFX81136
augaaaauggcaagcaacgacgccaauccaucagauggaagcgccgccaaccuaguaccagaaguaucaaaugaaguaauggcacuagaaccuguaguaggagccgccauagcagcaccaguagccggacaacaaaauguaauagauccauggauaagaaauaauuuuguacaagcacccggaggagaauuuacaguaaguccacgaaaugcaccaggagagauuuuauggucagcaccucuaggucccgaccuuaacccauaccuuucucaucucgcacgaauguauaacggauacgcuggagguuuugaaguacaaguaauauuagcaggaaaugcauuuacagcaggaaaaauaauauuugcugccguuccaccaaauuucccuacagaaggccuaucuccaucucaaguaacaauguucccacacauuauaguagauguuagacaacuagaacccguauuaauaccuuugccagaugucagaaacaauuuuuaucacuauaaccaaacaaaugacuccacaauaaaacuaaucgcaauguuauauacaccauuaagggcuaacaaugccggugaagauguauuuacaguaucaugucgaguuuuaacacgaccuucaccagacuucgauuuuauauuucuagucccaccaacaguugaauccagaacaaaaccauuuacaguaccaauauuaacuguagaagaaaugacaaacagcagauuuccaauaccauuagaaaaacuauuuacagguccauccggagcauucguuguacaaccccaaaaugguagaugcacaacagauggaguacucuuagggacaacacaauuaucaccaguaaauauauguacauuuagaggagauguaacccacauagcagguaguagaaacuacacaaugaaucuugcuucauuaaauuggaauaacuaugauccuacagaagaaauaccagcaccacuaggaacaccugauuuuguaggaaaaauacaaggaguacuaacacaaacaacuaaaggugacggauccacuagaggucacaaagcaacaguuuauacaggaucagcaccuuucacaccaaaauuaggcucuguucaauuuucaacagacaccgaaaacgauuuugaaacacaccaaaauacaaaauucacaccaguaggcguuauacaagacgguggaacaacacacagaaaugaaccccaacaauggguacuaccuucauauucaggacgagacguccauaauguacaccuagcaccagcaguagccccuacauuucccggagaacaacuacuauucuuucguucaacaaugccaggaugcucuggauacccaaauauggaucuagauugcuuauuaccacaagaauggguucaacacuuuuaccaagaagccgcgccagcacaaagugauguagcccuacuaagauuugucaacccugacacagguagaguauuauucgaaugcaaacuacauaaaucuggauauguaacaguugcacacacaggccaacacgauuuaguaauaccaccaaacggcuauuuucgauucgauucauggguaaaucaauuuuacacccucgccccaaugggaaauggcacaggaagaagaagagcacuauaa

SEQ ID NO: 30903 - RNA, 1623 nt, Artificial Sequence
  derived and/or modified sequence opt6 from capsid_protein_VP1__Norovirus__AFX81139
augaaaauggcauccaaugaugcaaaccccucagauggaucagccgcaaacuuaguucccgaaguaagcaaugaaguaauggcacuagaaccaguaguaggagcagcuauagccgccccaguagcuggccaacaaaaugucauagauccauggauacgaaauaauuucguacaagcccccggaggagaauuuacaguaucccccagaaaugcaccuggagaaauauuauggucagcaccucuuggaccagaucucaauccauaucuaucccacuuagcacgaauguauaacggcuacgcaggagguuucgagguacaaguaauauuagcaggaaaugcauuuaccgcaggcaaaauaauauuugcagcaguaccaccuaauuuuccaacugaaggacucuccccuucacaaguaacaauguucccacauauaauaguagauguucgacaacuugaacccguauuaauaccacuuccagacguacgaaauaacuucuaucacuauaaccaaacuaaugauuccacaauuaaacuaauugcaaugcuuuauacuccuuuaagagcaaauaaugcaggagaagauguuuucacaguaucaugccguguacuuacuagaccaucaccugauuuugacuuuauauuccuuguaccucccacaguugaaucacgaacaaaaccauucacagucccaaucuuaacaguagaagaaaugacuaacagucgauucccuaucccauuagaaaaacucuuuacaggaccaucuggagcauuuguuguacaaccacaaaaugguagauguaccacagacgguguauuacuaggaacaacacaauuaucuccagucaauauaugcacauucagaggcgacguaacacauauugcuggcucaagaaauuacacaaugaacuuagcaucauuaaacuggaacaauuacgaccccacagaagaaauaccagcaccauuaggcacaccagauuuuguaggaaaaauacaagguguccuaacccaaacaacuaaaggcgacgguaguacaagaggacacaaagcaacuguauacacagguucagcuccauucacuccaaaacuuggaucuguacaauucaguacagauaccgaaaacgacuuugaaacacaccaaaacaccaaauucacaccuguaggcguuauacaagauggcggcacuacccauagaaaugaaccacaacaauggguauuaccauccuauucaggaagagacguucacaacguccaccuagcaccugcaguagcuccaacauucccaggagaacaacuacuuuucuuuagaucaacaaugccagguugcucaggauauccaaauauggauuuggauugcuuacucccacaagaauggguacaacauuucuaucaagaagcagcuccagcacaaucagacguugcacuccuacguuuuguaaacccugacaccgguagaguucuauucgaauguaaauuacauaaaucaggauacguaacaguagcacauacuggucaacaugauuuaguaauuccgccuaauggauacuuuagauucgauucauggguuaaccaauuuuauacucucgcacccaugggaaauggaacaggaagacgaagagcauuauaa

SEQ ID NO: 30904 - RNA, 1623 nt, Artificial Sequence
  derived and/or modified sequence opt6 from capsid_protein_VP1__Norovirus__AFX81142
augaagauggcaucaaacgacgcaaacccaucagauggaagugcagcaaaucuaguaccagaaguaucaaaugaaguaauggcauuagaaccuguagucggugcugcaauagccgcuccaguagcaggacaacaaaauguaauugaccccuggauaagaaacaacuuuguacaagcaccuggaggcgaauuuacagucucaccacgaaaugcaccaggagaaauccuauggucagcaccuuuaggacccgaccuaaacccauaucuuucacaucuagcuagaauguauaacgguuaugcaggcggauuugaaguacaaguuauucuagccggaaaugcauucacugccgguaaaaucauuuucgcugcagucccaccuaauuuuccaaccgaaggacuaucuccaucccaaguaacaauguucccacauauaauuguagacguuagacaacuagaaccaguacucauucccuuaccagauguuagaaauaauuuuuaucacuacaaccaaaccaacgacucaaccauuaaauuaauugcaaugcuauacaccccacuaagagcaaauaacgcaggugaagaugucuuuaccgucucauguagaguacugacuagaccuuccccagacuucgacuuuauauuccuaguacccccaaccguagaaucaagaacuaaaccauuuacaguaccuaucuuaaccguagaagaaaugacaaauucaagauuuccaauacccuuagaaaaacuauuuaccgguccaucuggagcuuucguaguacaaccacaaaauggacgcuguacaacugacggagucuuacuuggaacaacacaacuaucccccguaaauauauguaccuuuagaggagauguuacacauauugcuggaucacgcaacuauacaaugaaucuagcaagccuaaacuggaacaauuacgauccuacagaagaaauaccagccccucuagguacaccugauuuuguuggaaaaauacaagguguauuaacacaaacaacaaaaggagauggaucaacaagaggacauaaagcuacagucuacacuggaucagccccauucacaccaaaauuaggaucuguccaauuuucaacagauacugaaaaugacuuugaaacacaccaaaauacaaaauucacccccguagguguaauccaagauggaggaacaacacauagaaacgaaccacaacaauggguauuaccaucauauucagguagagauguacacaauguacaucuagccccagcaguugcaccaaccuuccccggagaacaacuucuauuuuuucgcaguacaaugccagguugcucaggcuacccuaauauggaccucgacuguuuauuaccacaagaauggguacaacacuucuaccaagaagcagcaccagcucaaucugauguagcacuauuaagauucguaaauccagauacuggacgaguauuauucgaaugcaaauuacacaaaucaggauacgucacaguagcccauacaggacaacacgaucuaguuauuccaccaaacggauacuuuagauuugauagcuggguaaaucaauuuuacacccucgcaccaaugggaaaugguacuggccgaagaagagcauuauaa

SEQ ID NO: 30905 - RNA, 1623 nt, Artificial Sequence
  derived and/or modified sequence opt6 from capsid_protein_VP1__Norovirus__AFX81145
augaaaauggcaucaaaugaugccaacccauccgacggaagugcagcaaaccuaguuccugaaguaucuaacgaaguaauggcucuugaaccagucguaggugcagcuauagcugcuccaguagcaggacaacaaaacgucauagacccauggauucgaaauaacuucguacaagccccaggaggugaauuuacaguaucaccacgaaaugcaccuggagaaauacuauggucugcuccccuaggaccagaccuaaauccauaccucucucacuuagcaagaauguauaauggauaugcaggaggauuugaaguccaagucauuuuagccggcaaugcuuuuacagccgguaaaauaaucuucgcugcagucccuccaaacuucccaaccgaaggucuuucuccaagucaagucacaauguucccacacauaauagucgauguaagacaacuagaaccuguauuaauuccauuaccagaugucagaaacaauuuuuaucauuauaaccaaacaaaugauucuaccauuaaacuaauagcaauguuauacacaccauuaagagcuaacaaugcaggagaagacguauucaccgucucauguagaguacuaaccagaccaucacccgauuucgauuuuauauuuuuaguacccccaacuguagaaucuagaacaaaaccauucacaguaccaauauuaacaguagaagaaaugacaaauuccagguuuccaauaccacuagaaaaacucuuuacaggaccuuccggagcauuuguaguccaaccacaaaauggcagaugcacaacugacggaguauuauuagguaccacacaauugucaccaguaaacauauguaccuuucguggugacguuacacacauugcuggaucaagaaauuacaccaugaauuuagccuccuuaaacuggaacaauuacgauccaacagaagaaauacccgccccucuaggaacaccugacuuuguaggaaaaauucaagguguucuaacacaaacaacuaaaggcgacggaucaacaagaggccauaaagcuacaguauauaccggaucagcuccauucacaccaaaauuaggcucaguccaauucuccaccgauacugaaaacgauuucgaaacacaucaaaauacaaaauucacuccaguaggaguaauacaagauggaggaacaacacacagaaaugaaccucaacaauggguacuaccaucauauuccggucgagacguacacaauguacauuuagcaccagcaguagcaccuaccuuccccggcgaacaacuacuuuucuucagaagcacaaugcccgggugcucaggauauccaaauauggaucuagacuguuuacucccacaagaauggguccaacacuuuuaucaagaagccgcgccagcucaaucagauguagcauuacuucgcuucguaaacccagauacaggaagaguccuuuuugaauguaaacuccauaaaucagguuauguuacaguagcacacacaggacaacaugacuuaguuaucccacccaacggauacuucagauucgauucauggguaaaccaauuuuauacauuagccccaaugggcaacggaacaggaagacgacgagcauuauaa

SEQ ID NO: 30906 - RNA, 1623 nt, Artificial Sequence
  derived and/or modified sequence opt6 from capsid_protein_VP1__Norovirus__AFX81148
augaaaauggccucaaaugaugcaaauccauccgauggcucugcagccaacuuaguaccagaaguaucuaaugaaguaauggcacuugaaccugucgucggugcagcuauagcagccccuguagcuggacaacaaaacguaauugauccauggauacgaaauaauuuuguccaagcaccuggaggagaauucacuguaucacccagaaaugcaccuggagaaauuuuauggagugcaccuuuaggcccugaccuaaacccauaucuaucacaucuagcucguauguauaacggauaugcaggaggauucgaaguacaaguaauccuagcaggaaaugcauuuacugcaggaaaaauaauauucgcagcaguaccaccuaauuuuccuacagaaggcuuauccccaucucaaguuacaauguuuccacauauaauaguugauguaagacaauuagaaccaguacuaauaccucuaccagauguuagaaauaacuucuaccauuauaaccaaacaaaugacucaacuauaaaacuaaucgcaauguuauauacuccccuacgagcuaacaaugccggagaagaugucuuuacagucucaugucguguauuaacaagaccaucaccagacuuugauuucauuuuucucguaccacccaccguagaaucacguacaaaaccauucacaguaccaauauuaacuguagaagaaaugacaaauucuagguucccaauaccauuagagaaauuauuuacaggaccaucuggagcauucgucguucaaccacaaaacggaagauguaccacagaugguguauuauuaggaacaacacaacuuucaccaguaaauaucuguacuuuccgcggagacguuacacauauagcaggaucucguaacuauacaaugaaccuagcaucauuaaauuggaauaacuaugauccaacagaagaaauaccagcuccauuaggcacuccagacuucguaggaaaaauacaaggcguccuaacacaaacaacaaaaggcgacggauccacgagaggucauaaagcaacugucuauacuggaucagccccauuuacuccuaaguuagguuccguucaauucucaacagacacagaaaaugacuucgaaacacaucaaaacacuaaauuuaccccaguuggaguaauucaagacggaggcacuacucauagaaaugaaccucaacaauggguacuaccaucauauagcggcagggauguacacaauguccacuuagcuccagcuguagccccaacauuuccaggagaacaacuuuuauucuuuagaucaacaaugccuggaugcucaggcuauccaaauauggaccuagacugccuacuuccacaagaauggguacaacauuuuuaccaagaagcagcacccgcacaaucagauguagcauuauuaagauucguaaauccagacacaggaagaguuuuauucgaauguaaauuacacaaaucaggauauguaacugucgcucacacaggacaacaugauuuaguaauuccaccaaauggcuacuucagauuugacucauggguaaaucaauuuuacacacuugcuccaauggguaauggaacagguagacgaagagcacuauaa

SEQ ID NO: 30907 - RNA, 1623 nt, Artificial Sequence
  derived and/or modified sequence opt6 from capsid_protein_VP1__Norovirus__AFX81154
augaaaauggccaguaaugaugccaauccuagcgauggaucagcagcaaacuuaguacccgaaguaagcaaugaaguuauggcccucgaaccaguaguaggagcugccauagccgcaccaguagccggacaacaaaauguaauugaccccuggaucagaaauaauuucguacaagccccagguggagaauuuacaguaucuccaagaaaugcaccaggcgaaaucuuauggucugcaccgcuuggcccagauuuaaacccuuaucuaagccacuuagcaagaauguauaauggauacgcaggaggauuugaaguacaaguaauacuagcuggaaaugcauucacagccggaaaaauaauauuugcagcuguaccaccaaauuucccuacagaaggacuaucacccagucaaguaaccauguucccacauauaauaguugauguucgacaacuagaaccaguacuaauaccauuaccagauguaagaaacaauuucuaucacuauaaccaaacaaaugauaguacaauaaaacucauugcaaugcuauacacaccauuaagagcaaacaaugcaggugaagauguauucacuguuucuugucgaguacuaacuagaccaucuccugacuuugacuucauauuucucguaccuccaacaguagaaucuagaacaaaaccauucacaguaccaauucuaacaguugaagaaaugacaaacaguagauucccaauaccccuagaaaaauuauuuacagguccaucaggagcauucgucguacaaccccaaaauggaagauguacaacagacggaguauuauuaggaacaacacaacuuucaccugucaauaucuguacauuuagaggagacguaacacauauagcagguucaagaaauuauacaaugaaucuagccucauuaaauuggaacaauuacgacccaacagaagaaauaccagcaccacuaggaacaccagacuuugucggcaaaauucaagguguauuaacacaaaccacaaaaggugacgggucaacacguggucauaaagcuacaguauacacaggaucagcaccauuuaccccaaaacucggaucuguccaauuuaguacagauacugaaaaugacuuugaaacccaucaaaauacaaaauuuacacccguaggaguaauucaagauggaggaacaacucacagaaacgaaccacaacaauggguccucccuuccuauuccggaagagacguacauaauguacauuuagcacccgcaguagccccaacauuucccggagaacaacuccucuucuuuagaucaacuaugccaggaugcucaggauaucccaauauggauuuagauugucuacuaccacaagaauggguacaacacuucuaucaagaagcugcuccagcccaaucagauguugccuuacucagauucguuaacccagacacuggaagagucuuauuugaaugcaaacuacauaaaaguggcuaugucacaguagcccacacaggucaacaugaucuaguaauaccaccaaauggcuauuucagauuugauucuuggguaaaccaauuuuacacacuagcacccaugggaaauggaacugggcgacgucgugcacuauaa

SEQ ID NO: 30908 - RNA, 1623 nt, Artificial Sequence
  derived and/or modified sequence opt6 from capsid_protein_VP1__Norovirus__AFX81157
augaaaauggcaucaaacgaugcaaacccaucugauggauccgcagcaaaucucguuccagaaguaaguaaugaaguuauggcacuugaaccaguaguaggagcagcuauugcagcaccuguugcaggacaacaaaauguaauagacccauggauacguaauaacuucguacaagcaccugguggagaauuuacaguuucucccagaaaugcacccggagaaauauuaugguccgcaccacuuggaccugaucuaaauccauaccucucacacuuagcaagaauguauaacggguaugcaggaggauucgaaguccaagucauucuagcaggcaacgccuucacagcaggcaaaauaauauucgcagcaguuccacccaacuuuccuacagaaggauuaucuccaucacaaguaacaauguuuccacacauaauuguagauguacgacaauuagaaccaguuuuaauaccccuaccugauguacgaaacaauuuuuaucauuauaaucaaacaaaugauucaaccauaaaacuaauagcaauguuauacacaccacuuagagcaaacaacgcaggagaagauguauuuacuguaaguugucgaguacuaacaagaccaucuccugacuucgacuuuauauuucuaguaccaccaacaguagaaucaagaacuaaaccauucacaguaccuauacuaaccgucgaagaaaugacaaauucuagauuuccuaucccucucgaaaaacuauuuacagguccaucaggagcauuuguaguacaaccacaaaauggacguuguaccacagacgguguauuacuagguacaacacaacuaucuccuguuaauaucuguacauucagaggagauguaacacauauagcaggaucaagaaauuacacuaugaaucuagcuucucuuaacuggaauaacuaugauccaacagaagaaauaccagcaccauuagguacaccagacuuuguaggaaaaauacaagguguauuaacacaaacaacaaaaggagacggaucaacaagaggacauaaagcaacagucuacacaggaucagcaccauucaccccaaaacucggcucaguacaauucucaacugauacagaaaacgauuucgaaacacaucaaaauacaaaauuuacaccaguaggcguaauacaagacggugguacgacacacagaaaugaaccccaacaauggguuuuaccaucauacucaggaagagauguacacaacguacaccuagcaccagcaguugcaccuacauuucccggagaacaacuuuuauucuuuaggaguacaaugcccgguugcucaggcuaucccaacauggacuuagacugccuauuaccacaagaauggguacaacauuucuaccaagaagcagcaccagcacaaucugacguagcacuacuucgcuucguaaacccagauacaggaagaguucuauucgaauguaaauuacauaaaaguggauauguaacaguagcucacaccggacaacacgaucuaguaauaccuccaaacggauacuuuagauucgauucauggguaaaucaauuuuacacccuugcaccaaugggaaaugggacaggacgacgacgcgcacucuaa

SEQ ID NO: 30909 - RNA, 1623 nt, Artificial Sequence
  derived and/or modified sequence opt6 from capsid_protein_VP1__Norovirus__AFX81163
augaaaauggcaaguaacgacgcaaacccaucugauggcucagcagcaaaucuaguaccugaaguaaguaacgaaguaauggcacuugaaccaguaguaggagccgcaauagcugccccaguagcuggacaacaaaauguuauagauccuuggaucagaaacaauuucguccaagcaccaggaggugaauuuacaguaucaccacgaaaugcaccaggagaaaucuuauggucugccccauuaggaccagauuuaaacccauaucucucacacuuagcacgaauguauaaugguuaugccggaggauucgaaguccaaguaauuuuagcaggaaaugcauuuaccgcuggaaaaauaauauucgcugcaguaccaccaaauuuuccuacagaaggauuaucaccaucucaaguuacuauguucccacacauaauaguugacguaagacaacucgaacccguacuaauuccuuuaccagacguacguaacaacuucuaucacuauaaucaaacaaaugacucaacaauuaaacuaauagcaaugcuauacaccccacuaagagcaaacaacgcaggagaagacguauuuacaguaagcugucgagucuuaacuagaccaagcccagauuucgacuuuauauuuuuagucccaccaacaguugaaucaagaacuaaaccauucacaguaccuauacuuaccguugaagaaaugacaaauucuagauuccccauaccacuagaaaaauuauuuacaggaccuucuggagcauucguuguacaaccacaaaacggacgaugcacaacagacggaguauuauuaggcacaacucaacuuucaccaguuaauauaugcacauuccgaggagauguaacacauauagcaggaucgcgaaauuacacaaugaaucuagcaucacuuaauuggaacaauuacgauccaacagaagaaauaccagcuccucuaggaaccccugauuuugucggaaaaauacaagguguacuaacacaaaccacaaaaggagacggaaguacucguggacauaaagcaaccguauauacaggcucagcacccuucacaccaaaauuaggaucuguccaauuuucaaccgauacagaaaaugacuucgaaacucaccaaaauacaaaauuuacacccguaggaguuauacaagaugguggcacaacccauagaaacgaaccucaacaauggguacuaccuucauauucugggagagauguacauaauguucaucuugcaccagcagucgcaccuacauuuccuggagaacaauuauuauucuuuagaucaacaaugccaggaugcaguggcuauccaaauauggaccucgacugucuacucccacaagaauggguucaacauuucuaucaagaagcagcaccugcccaaagugacguagcauuacuacgcuuuguaaacccagacacaggucgaguuuuauucgaauguaaacuacauaaaaguggauauguaacaguagcacacacaggacaacaugacuuagucauuccaccaaauggauauuuccgcuuugauucauggguuaaccaauuuuauacuuuagcacccauggguaacggaaccggacgaagacgagcauuauaa

SEQ ID NO: 30910 - RNA, 1623 nt, Artificial Sequence
  derived and/or modified sequence opt6 from capsid_protein_VP1__Norovirus__AFX81166
augaaaauggcaucaucugacgcaaaucccucagauggcucagcagcaaauuuaguucccgaaguaaauaaugaagucauggcucuugaacccgucguuggcgccgcaauagcugcaccaguagcaggacaacaaaauguaauagauccauggauaagaaauaacuuuguacaagcuccaggaggagaauuuacagucagcccaagaaaugcacccggcgaaauacucuggucagccccauuaggaccagauuuaaauccauauuuaucccacuuagcuagaauguauaauggauaugcaggaggauuugaaguccaaguaauauuagcugguaaugcauuuacagcuggaaaaauaauauuugcagcaguaccaccuaauuucccaacugaaggauuaucuccaucccaagugacaauguuuccacacauaauaguagacguaaggcaacuagaaccaguacuaauaccacucccagauguaagaaacaauuucuaccacuauaaccaaucaaaugauucaacaauaaaauuaauagcaauguuauacacaccucuuagagcaaacaaugcaggagaagauguauuuaccguaucaugucgaguucuaacaagaccuuccccagacuuugauuucauauuucucguacccccaacaguagaaucccgaacaaaaccauuuaccguacccauucuuacaguagaagaaaugacaaacucacguuuuccaauacccuuagaaaaacuuuuuacaggaccaucaagcgcauuugucguucaaccacaaaauggacguuguacaaccgauggaguacuucuaggaacuacacaacuuucuccaguaaacauauguacauuccgcggagacguaacucauauagcuggaagucgaaauuacacaaugaauuuagcaucacuuaauuggaacaauuaugauccaacugaagaaauaccagcaccucuaggaacaccagacuucguuggcaaaauacaagguguacucacacaaacuacaaaaggugacggaucaacucguggucacaaagcaacaguauauacagguagugcaccauucacaccuaaacuaggaucaguccaauucuccacugauacagaaaacgauuucgaaacacaucagaacacaaaauucacaccaguaggaguaauacaagacgguggaacaacccauagaaacgaaccccaacaauggguucuacccaguuauucagguagaaaugucccaaacguucaccuugcgccagcaguagcacccacuuuuccaggugaacaauuauuauucuucagaaguacuaugccaggauguucaggauaucccaauauggaucucgauuguuuacuuccucaagaauggguacaacauuucuaucaagaagcugcaccagcacaaucagacguggcauuacuacgauuuguaaacccugacacaggaagaguacuauucgaaugcaaauuacauaaaucaggauauguaacaguagcacauacuggacaacaugaucugguuauacccccaaacggauacuucagauuugauaguuggguaaaccaauuuuacacuuuagcacccaugggaaauggaacaggaagaagaagagcucuauaa

SEQ ID NO: 30911 - RNA, 1623 nt, Artificial Sequence
  derived and/or modified sequence opt6 from capsid_protein_VP1__Norovirus__AFX81169
augaaaauggccucaaaugacgcuaaucccagcgauggaucagcagcaaauuuagugccagaaguuucaaaugaaguaauggcauuagaaccaguuguaggagcagcaauagcagcacccguagcaggccaacaaaauguaauagacccuuggauacguaauaacuuuguucaagcaccaggaggagaauuuaccguaucccccagaaacgcaccuggagaaauacuauggucagcaccuuuaggcccagauuuaaacccauauuuaucucaucuagcacgcauguauaacggcuaugcaggagguuucgaaguucaaguaaucuuagcaggaaacgcuuuuacugccggaaaaauaauauucgcagcaguaccaccaaauuuuccaacagaaggacuaucuccaucacaaguaacaauguucccucacaucaucgucgacguaagacaacucgaaccaguacuuauaccauuaccagauguccgcaacaacuucuaucacuacaaccaaacaaacgacaguacaauaaaacuaauagcaaugcuauacacaccccuacgagcaaacaacgcaggugaagauguauuuacaguauccugucgaguacuaaccagacccucaccagauuucgacuuuaucuuuuuaguuccaccaacaguugaaucaagaacaaaaccauuuacagugccaauauuaacugucgaagagaugacaaauucuagauuuccaauaccccuugaaaaauuauuuacaggacccucaggagcuuuuguaguucaaccacaaaauggcagauguacaacagauggaguacuacuaggaaccacacaauuauccccuguaaauauauguaccuucagaggagauguaacacacauagcaggaucacgcaauuacaccaugaauuuagccagucuaaauuggaacaauuaugauccaacagaagaaauacccgcaccacuaggaaccccagacuucguaggaaaaauacaaggaguauuaacacaaacaacaaaaggagacggaucaacacgcggucacaaagcaacaguauauacaggaucugcaccauuuacgccuaaauuaggaucuguacaauucucaacugacacagaaaacgauuucgaaacacaucaaaauacaaaauucacaccugucggaguuauacaagacgguggaacuacacaccguaaugaaccacagcaauggguacuuccuucuuacuccggacgagacguacauaauguccauuuagcaccugcaguagcaccaacauuuccaggagaacaacuacuauucuucagaucaacaaugccaggaugcuccggauauccgaauauggauuuagauugccuucuaccacaagaauggguacaacacuucuaucaagaagcagcaccagcucaaucugauguagcauuauuaagauucguaaacccagacacaggaagaguucuauucgaaugcaaacuccauaaaucaggauacgucacaguagcacauacuggacaacacgaccuaguaauaccaccuaauggauauuucagauuugauucauggguuaaucaauuuuacacacuagcuccaaugggaaauggaacaggaagaagaagagcauuauaa

SEQ ID NO: 30912 - RNA, 1623 nt, Artificial Sequence
  derived and/or modified sequence opt6 from capsid_protein_VP1__Norovirus__AFX81172
augaaaauggcaucaaaugaugcaaauccuuccgauggaucugccgcaaauuuaguacccgaagucucuaaugaaguaauggcucuagaaccuguaguuggagcagcuauagcagcaccaguagcaggacaacaaaauguaauugauccauggaucagaaauaauuuuguacaagcaccaggaggcgaauucacugucucuccuagaaacgcaccaggcgaaauauuauggagcgcuccucuaggcccagaucuaaacccauaccucucacaccuugccagaauguauaauggcuaugcaggaggauucgaaguacaagucauauuagcaggcaacgcauucacagcaggaaaaauaauauucgccgcaguaccuccaaauuucccaacagaaggccuaucaccaucucaaguaacaauguucccacacauaauaguugacguaagacaauuagaaccaguccucauaccauuaccagacguaagaaauaauuucuaccauuacaaccaaacaaacgacuccacaauuaaauuaauagcaauguuauacacaccucuaagagccaacaaugcaggagaagauguuuuuacugucucauguagaguacuaacaagaccauccccagacuuugauuuuaucuucuuaguaccaccaacaguugaauccagaacaaaaccuuucaccguaccuauauuaacaguugaagaaaugacaaacucuagauucccuauaccacuagaaaaauuauuuacaggaccaucaggugccuuuguaguacaaccacaaaacggaagaugcacaacugauggagucuuacuuggaacaacacaauuaagucccgucaauauaugcacauuuagaggagauguaacucacauagcaggcuccagaaauuacacaaugaaucuagcaucauuaaauuggaacaacuacgauccuaccgaagaaauccccgcaccucuagguacaccugacuucguaggaaaaauacaaggaguauuaacacaaacaacuaaaggugacggauccaccagaggacacaaagccacaguauauaccggaagcgccccuuucacaccuaaacuaggaucaguacaauucucuacugauacagaaaaugacuucgaaacccaccaaaacacaaaauucacuccagucggaguaauacaagacggaggaacuacccauagaaaugaaccacaacaauggguauuaccuuccuauucgggaagagauguacacaauguacauuuagcaccagccguagccccaacauuccccggcgaacaacuccuauucuuucguucaacaaugcccggauguucaggauauccaaacauggaucuagauugcuuauuaccacaagaauggguacaacauuucuaucaagaagccgcacccgcacaaucagacguagcauuauuacgauuuguuaacccugauacaggaagaguacuauuugaaugcaaauuacauaaaucugguuauguaacaguagcacacacaggacaacacgaucuaguaauaccuccaaauggcuauuuuagauuugauuccuggguaaaucaauuuuauacccuagcaccuauggguaauggaacaggaagaagaagagcccucuaa

SEQ ID NO: 30913 - RNA, 1623 nt, Artificial Sequence
  derived and/or modified sequence opt6 from capsid_protein_VP1__Norovirus__AFX81178
augaaaauggcaucaaaugacgccaacccaucugauggaucagcagcuaacuuaguaccagaaguauccaaugaaguaauggcucuagaaccaguaguaggagcugcuauagccgcuccagucgcaggucaacaaaauguaauagacccuuggauaagaaauaacuuuguccaagcgccaggcggagaauuuacaguaucaccaagaaaugcaccuggagaaauacuuuggucagcaccacuugguccagaccuaaauccauaucuaucucaccuugcuagaauguauaaugguuacgcaggagguuuugaaguacaaguaauacuagcuggcaacgcauuuaccgccggcaaaauaaucuucgcagcaguacccccaaacuuuccaacagaaggauuaagcccaucacaaguaacaauguuuccucauauuauaguugacguaagacaauuagaaccaguccuaauuccauuaccagauguacgaaauaauuuuuaccauuauaaucaaacuaacgauuccacaauaaaauuaaucgcaaugcuauacacaccacuaagagcaaacaaugcaggagaagauguauuuaccguaucaugcagaguucucacucgaccaucaccagacuuugauuuuauauuucuuguuccaccuacaguagaaucaagaacuaaaccuuucacaguuccaaucuuaacaguugaagaaaugaccaacaguagauuuccaauuccauuagaaaaacuauucacuggaccaagcggggcauucguuguacaaccacaaaauggacgcugcaccacagacggagucuuacuagguacaacacaacuaucaccuguaaacauauguacuuuuagaggagaugucacacauauagcaggaucaagaaauuauacaaugaaucuugccucauuaaacuggaacaacuacgauccgacugaagaaauaccugcaccuuuagguacaccagacuuuguaggaaaaauucaagguguacuaacacaaaccacaaaaggugacggaucaacacgaggacauaaagcaaccguauauacaggauccgccccauuuaccccaaaacuaggcucaguacaauuuaguacagauacagaaaacgauuuugaaacacaucaaaauacuaaauucacaccaguuggaguaauacaagacggaggaaccacacauagaaaugaaccacaacaauggguauuaccuucguacucaggcagagacguucauaauguccacuuagcaccugcaguagccccaacuuucccaggcgaacaacuacuuuucuucagaucuacuaugccgggcugcuccggauauccuaauauggaucuagacuguuuacuaccucaagaauggguccaacacuucuaucaagaagccgcaccagcucaaucugacguagcauuauuaagauucgucaaucccgacacaggacgagucuuauucgaaugcaaauuacacaaaucaggcuacguuacaguagcucauaccggacaacacgacuuaguaauaccuccaaauggauauuucagauucgauucuuggguaaaccaauuuuacacacucgcgccaaugggaaacggcaccggacgaagaagagcacucuaa

SEQ ID NO: 30914 - RNA, 1623 nt, Artificial Sequence
  derived and/or modified sequence opt6 from capsid_protein_VP1__Norovirus__AFX81181
augaaaauggcaucaaaugacgcuaauccuucagacggaagugcagcaaaucuaguaccagaagucucaaaugaaguaauggcacucgaaccaguuguuggcgcugccaucgcagcacccguagcaggccaacaaaauguaauugacccauggauucgaaacaauuuuguacaagccccuggaggagaauucacaguaucuccaagaaaugccccaggcgaaauauuauggagcgcaccacuagguccagaucuaaaccccuauuuaucacacuuagcccgcauguacaauggauacgcaggaggcuucgaaguucaaguaauccuagcugguaaugcauucacagcuggaaaaauaauauuugcagcaguaccaccaaacuuuccaacagaaggacucucuccaucacaaguaacaauguuuccacacauuauaguagacguaagacaacuugaaccaguacuaauuccccuuccagacguaagaaacaauuuuuaccacuauaaccaaacaaacgacucuacaauaaaacuaaucgcaauguuauacacaccacuacgagcuaauaacgcaggugaagauguuuuuacggucucauguaggguacuaacaagacccucaccagauuuugacuucauauuucuagucccaccaacuguagaaucacgaacaaaaccauuuacugucccaauauuaacaguagaagaaaugacaaacaguagauuuccaauuccacuagaaaaacuauuuacagguccaucaggugcauucguaguacaaccacaaaacgguagauguacaacagauggaguauuacucggaaccacucaauuaucaccaguaaauauuuguaccuuuagaggagauguuacucauauagcugguagcagaaacuacacuaugaaccucgcaagcuuaaauuggaauaauuacgaucccacagaagaaauaccagcaccacuaggaacaccagacuuuguaggaaaaauucaaggaguacuaacucaaaccacaaaaggugacggcucaaccagaggacauaaagccacaguuuauacuggaucugcaccauuuacaccaaaauuaggaucuguacaauucucaacagacacagaaaaugauuuugaaacccaccaaaauacaaaauuuacaccagucggaguuauacaagauggaggaacaacccauagaaaugaaccucaacaauggguacuacccaguuauucaggacgugacguacauaacguucauuuagcaccagcaguagcacccacauuuccuggagaacaauuacuauuuuucagaucaacaaugcccggcugcucaggauauccaaacauggaucuagacugcuuacucccucaagaauggguacaacauuuuuaccaagaagcggccccagcacaaucagacguugcacuuuuacgauuugucaauccagauacaggacgaguauuauucgaaugcaaauuacacaaaucuggauauguaacagucgcacacacuggacaacacgauuuagucauuccaccaaauggauauuucagauucgauucauggguaaaucaauuuuauacuuuagcaccaaugggaaauggcacaggaagaagaagggcacuuuaa

SEQ ID NO: 30915 - RNA, 1623 nt, Artificial Sequence
  derived and/or modified sequence opt6 from capsid_protein_VP1__Norovirus__AFX81190
augaaaauggcaucaaaugacgcaaauccaagugaugguucagcagcuaaccuugugccagaagucucuaacgaagucauggcacuagaaccaguugucggagcagcaauagcagcaccuguagcuggacaacaaaacguaaucgacccauggauaagaaacaauuuuguacaagcuccaggaggugaauuuacuguaucaccaagaaaugcaccaggagaaauauuauggucagcaccauuaggcccagacuuaaauccauaccuaucacauuuagcaagaauguauaacggauaugcaggaggauucgaaguacaaguaauauuagcaggcaaugcauucaccgccggaaaaauaauauucgcagcaguuccccccaacuuuccaaccgaaggauuaucaccaucccaaguaaccauguucccccacauaauaguugauguaagacaacuagaaccaguauuaauaccacuaccagacguaagaaacaacuuuuaucacuauaaccaaacaaaugauucaacaauaaaacuaauagccauguuauacacaccacuaagagcaaacaaugcgggugaagacguauucacaguaucauguagaguacuaacacgaccaucaccagauuucgauuucauauuuuuaguacccccaacaguagaauccagaacuaaaccauuuacuguuccaauauuaaccguagaagaaaugaccaauucuagauuuccuauaccauuagaaaaauuauuuacaggucccucuggugccuucguaguccaaccacaaaacggacgcuguacaacagacggaguacuacuaggcacaacacaauuaucaccagucaacauuugcacauuccgaggagaugucacacacauagcaggcucaagaaauuacacaaugaaccucgcuagcuuaaauuggaacaauuacgaccccacagaagaaauuccagcaccauuaggaacaccagacuucguaggaaaaauacaaggaguacuaacacaaacaacaaaaggagacggaucaacaagaggacacaaagcaacagucuauacaggaucagcaccauucacaccaaagcuaggaucuguacaauuuucuacagauacagaaaacgauuucgaaacccaucaaaacacaaaauucacaccagucggcguuauacaagacggagggacaacccacagaaacgaaccacaacaauggguauuaccaucauacucaggaagagauguacauaacguacacuuagcacccgcaguugccccuacauuuccaggagaacaacuauuauuuuuuagaucaacaaugccugguuguuccgguuauccaaauauggauuuagacugucuacuuccacaagaauggguucaacacuuuuaucaagaagcagcaccagcucaaucagacguagcccuucuaagauuuguaaacccugacaccggaagaguacucuucgaaugcaaacuccauaaaucaggauauguaaccgucgcacacacaggccaacaugaucucguaauaccuccgaacggauauuuuagauucgauuccuggguaaaccaauuuuacacacuagcucccauggguaacgguacuggaagaagaagagcacuauaa

SEQ ID NO: 30916 - RNA, 1623 nt, Artificial Sequence
  derived and/or modified sequence opt6 from capsid_protein_VP1__Norovirus__AFX81193
augaaaauggcaucgaaugacgcaaacccauccgauggaucugccgcuaaucucguaccagaaguuucaaaugaaguuauggcauuagaaccaguuguaggagcagcuauagcagcaccaguugcuggacaacaaaauguaauugauccauggauuagaaauaacuucguacaggccccuggaggagaauucacuguauccccacgaaacgcgccaggagaaauccuuugguccgcacccuuaggaccagaucuaaauccauaucuaucacacuuagcaagaauguauaacggauaugcaggcggauucgaaguacaaguaauacucgcagggaacgccuuuacagcaggaaaaaucauauucgcagccguaccaccaaacuuuccaacugaaggacuaucacccucacaaguuacaauguucccucauauaauaguugaugucagacaacuagaacccguauuaauuccauuacccgauguaagaaacaauuucuaucauuauaaccaaacuaaugacuccacaauaaaacuaauagcaaugcuuuauacaccucuacgcgcaaacaaugccggugaagauguauuuacugucuccuguagaguauuaacaagaccuucgcccgacuuugacuuuauauuuuuaguucccccuacaguagaauccagaacaaaaccuuucaccgucccaauacuaacaguagaagaaaugaccaacaguagauuccccauaccucucgaaaaauuauuuacaggaccauccggagccuuuguaguacaaccacaaaauggaagauguacaacugacggcguauuacuuggaaccacacaacuaaguccaguaaauauuugcaccuuucgaggagauguuacacacauagcaggaucaagaaacuauacuaugaaccuagcuucccuaaauuggaacaauuacgacccaacagaagaaauaccagcacccuuaggaacacccgacuuuguaggaaaaauacaaggaguacuaacucaaacuacaaaaggagauggaucaacucgaggacauaaagcaacaguauauacuggaucagcacccuuuacaccuaaauuaggaucaguucaauucucaacagauaccgaaaaugauuucgaaacacaucaaaauacaaaauucacaccaguugguguaauucaagacggaggaacuacacauagaaaugaaccucaacaauggguacuaccuagcuauucagguagagauguacacaacguacaccuagcaccggcuguagcaccaacauuuccaggagaacaauuauuauuuuuuagaucuacaaugccaggauguucaggcuauccaaauauggaucuugauugccucuuaccacaagaauggguucaacacuucuaucaagaagcagcaccagcccaaucagacguagcacuauuacgauuuguaaauccagauacuggaagaguacuauucgaaugcaaacuccauaaaucaggauacguaacaguagcucacacaggacaacaugauuuaguaaucccucccaacggcuauuucagauuugauucauggguaaaccaauuuuauacucuagcaccaaugggaaauggaacaggaagaagaagagcacuauaa

SEQ ID NO: 30917 - RNA, 1623 nt, Artificial Sequence
  derived and/or modified sequence opt6 from capsid_protein_VP1__Norovirus__AFX81196
augaaaauggccaguaacgacgcaaacccaucugauggaucugcagcaaacuuaguaccagaagucucaaaugaaguuauggcauuagaacccgucguaggugcagcuaucgcagccccagucgcaggacaacaaaauguuauagacccauggauaagaaauaacuuuguccaagcuccuggaggugaauuuacagucucaccaagaaaugcaccaggagaaauauuaugguccgccccucuagguccagaucuaaauccauaccuaucacaucuagcaagaauguauaauggauaugcaggcggauuugaaguacaaguaauuuuagcaggcaaugcuuucacagccgguaaaaucaucuuugcagcuguacccccaaacuuuccaacagaaggacuaucuccaucacaaguaacaauguucccucauauuauugucgauguaagacaauuagaaccaguauuaauaccacuaccugacguacguaauaauuuuuaccauuacaaccaaacaaaugauucaacaauuaaacuuauagccauguuauauacaccauuaagagccaacaaugcaggagaagauguauucacaguuucuugucgaguacuaacaagacccuccccugacuuugacuuuauauuuuuaguaccaccaacaguagaaucaagaaccaaaccauucacaguaccuauauuaacaguugaagaaaugacaaauucuagauuuccaauacccuuagaaaaauuauuuacaggaccaucgggagcuuuuguuguacaaccucaaaacggucgauguaccacugauggaguccuacuaggaaccacacaacuuucaccaguaaacaucuguacauuccgaggcgauguaacacacauagcaggcucaagaaacuacacaaugaaccucgccucacuaaauuggaauaacuacgaucccacugaagaaauaccagcaccauuaggaacaccagacuuuguuggaaaaauacaaggaguauuaacacaaaccacaaaaggagacggaucaacuagaggacauaaagcaacaguauacacaggaucagcaccauuuacaccuaaauuagguucaguacaauucucaacagauaccgaaaacgauuucgaaacucaucaaaacacaaaauucaccccaguuggagucauccaagauggaggaacaacacaccgaaaugaaccucaacaaugggucuuaccauccuauucaggaagagacguccauaauguacaccuagcacccgcaguagcuccaaccuuuccaggagaacaacuccuuuucuuuagaucuacaaugccuggaugcucaggcuacccaaacauggaucuagacuguuuacuaccccaagaauggguucaacauuucuaccaagaagccgcaccagcacaauccgacgucgcccuacuaagauuuguaaacccagacacaggaagaguauuauuugaauguaaacuacacaaauccggauacguaacaguagcacauacaggacaacacgaucuuguaauaccaccaaauggcuauuuuagauuugauuccugggucaaccaauuuuacacauuagcuccaauggguaacggaacagguagaagaagagcauuauaa

SEQ ID NO: 30918 - RNA, 1623 nt, Artificial Sequence
  derived and/or modified sequence opt6 from capsid_protein_VP1__Norovirus__AFX81199
augaaaauggcauccaaugaugcaaacccaucagacggcucagcagcaaaccuuguaccagaaguaucaaaugaaguaauggcguuagaaccaguaguaggugcugccaucgcagcaccugucgcagggcaacaaaauguaauagauccauggauaagaaauaacuuuguacaagcaccagguggagaauuuaccguuucuccaagaaaugcuccaggagaaauauuauggucagcaccucucggaccagauuuaaauccuuacuuaucccaucuugcaagaauguauaacggauacgcagguggguuugaaguucaaguaaucuuagcaggaaaugcauucacagcugguaaaauaaucuucgcagcagucccaccaaauuuucccacagaaggacuaucaccaucacaaguaacaauguucccacauauaauaguagauguacgacaauuagaacccguacuaauaccauuaccagacguaagaaacaacuuuuaucacuauaaccaaacaaaugacucaacaauuaaacucauagcaaugcuauacacuccacuuagagcaaacaacgcaggugaagauguauucacuguaucauguagaguacuaaccagaccaucaccagacuucgauuuuaucuuucuaguaccaccaacaguagaaucaagaaccaaaccauucaccguaccaauacuuaccguugaagaaaugacaaacucgagauucccaauaccuuuagaaaaacucuucaccggccccaguggcgcuuuuguuguccaaccccaaaacggacgcuguacaacagacggaguauuauuagguacaacacaacuauccccaguaaacaucuguaccuuucgaggcgauguuacacacauagcaggaucaagagacuauacaaugaaucuugcuucacuaaauuggaacaacuacgauccaacagaagaaauaccugcaccacuaggaacuccagauuuugucggaaaaauacaaggcguauuaacacaaacaacaaaaggagacggaucaacucgaggucacaaagcaacagucuauacagguagugcaccuuucacaccaaaacuugggucaguacaauuuucaacagauacugaaaacgauuucgaaacacaucaaaauaccaaauucacaccuguaggaguaauacaagacggagguaccacucauagaaaugaaccacaacaauggguacuaccaucauacucaggaagagauguucauaacguucauuuagcuccagcuguagcaccaaccuucccaggagagcaauuauuauucuuuagaucuacaaugccaggauguuccgguuacccaaauauggauuuagauugcuuguuaccacaagaauggguucaacauuucuaccaagaagcagcuccugcacaaucugacgucgccuuacuaagauuuguaaacccagacacaggaagaguacuuuucgaguguaaacuacacaaaucaggauaugucacaguagcacauacaggccaacaugacuuagucauaccaccaaauggauacuucagauucgauuccuggguuaaccaauuuuauacauuagcaccaaugggcaauggcacuggacgaagaagagcauuauga

SEQ ID NO: 30919 - RNA, 1623 nt, Artificial Sequence
  derived and/or modified sequence opt6 from capsid_protein_VP1__Norovirus__AFX81202
augaaaauggccucaaaugacgcaaacccaucagacggaucugcagcaaaucuaguaccagaaguuuccaaugaaguaauggccuuagaaccuguuguuggagcagcuaucgcagccccaguagcgggacaacaaaauguuauagauccauggauuagaaauaacuuuguacaagcaccagguggcgaauuuacaguaucaccucgaaaugcaccuggagaaauccuauggucagcaccauuaggaccugaucuaaauccuuaccuaucccaccuagcaagaauguauaacggauacgcagguggauucgaaguacaaguaauauuagcaggaaaugcauuuaccgcaggaaaaauaauauuugccgcaguucccccgaacuucccaacugaaggauuauccccaucucaaguaacaauguucccacacauuaucguugacguaagacaauuagaaccaguacuaauaccauuaccagauguaaggaacaauuucuaccauuacaaucaaacaaaugacucaacuauaaaauuaauagcaaugcuauacacuccccuacgugcaaacaacgcaggugaagauguauucacaguaagcugucgaguacuaacaagaccaucuccagauuuugacuuuauauuucucguuccaccaacaguugaaucaagaacuaaaccauucacagucccgaucuuaaccguagaagaaaugacaaauucuagauucccaauaccauuggaaaaauuauuuacuggaccaucaggagcauucguuguacaaccacaaaacggacgaugcaccacagacggagucuuacuagguacuacucaacuuuccccaguaaauauauguaccuuuagaggagauguaacucauauagcaggcucacgaaacuacacaaugaaucuagcuucacuaaacuggaauaauuaugauccuacagaagaaauaccagcuccucuaggaacaccagauuuuguaggaaaaauacaagguguccuaacacaaacaacaaaaggagacggaaguacaagaggucacaaagccacuguauauacuggaucagcaccuuuuacaccaaaacuaggaucaguacaauuuaguacagauacagaaaacgauuucgaaacacaccaaaacacaaaauuuacaccuguugguguaauucaagaugguggcacaacacaccgaaaugaaccacagcaauggguacuuccaagcuacucaggaagagacguccauaauguacauuuagcaccagcaguugcaccuacauuuccaggagaacaacuacuauuuuuuagaucaacaaugccagguugcucuggcuauccaaacauggauuuagacugcuuacuaccacaagaauggguacaacauuuuuaccaagaagccgcaccagcacaaagugacguugcauuacuacguuucguuaauccugauacuggacguguccuauuugaauguaaauuacauaaaucaggauauguuacagucgcacauacuggacaacacgaucuugucauuccucccaauggauauuucagauucgauucaugggucaaccaauuuuauacuuuagcaccaaugggaaauggcacagguagaagaagagcccuauag

SEQ ID NO: 30920 - RNA, 1623 nt, Artificial Sequence
  derived and/or modified sequence opt6 from capsid_protein_VP1__Norovirus__AFX81205
augaaaauggcaucaaaugaugcaaacccaucagauggaagugcagccaacuuaguaccugaaguaucaaaugaaguaauggcuuuagaacccguuguaggcgcagccauagcagcaccaguagcuggacaacaaaauguaauugacccauggauuagaaauaacuuuguacaagcaccuggaggagaauuuacugucucaccaagaaaugcaccuggagaaauauuauggucagccccauuaggaccagaucuaaacccuuaucuuucccacuuagcaagaauguauaauggauaugcaggaggauuugaaguccaaguuauauuagcuggcaaugcauuuacagccggaaaaauaauauucgcugcaguaccuccaaacuuuccaacagaagguuuaucaccaucacaaguuacaauguucccucauauaauaguagauguaagacaacuagaaccaguacuaauaccauuacccgacguacgaaacaauuucuaucacuauaaccaaaccaaugacuccacaauaaaacucauugcaaugcucuauacaccauuaagagcuaauaacgcaggugaagauguauucaccguaucauguagaguuuuaacaagaccaucacccgacuuugauuucauauuucuaguaccuccaacaguagaaucuagaaccaaaccauucacuguaccaauccuaacuguagaagaaaugacaaauucaagauuuccaauaccauuagaaaaauuauucacaggucccucuggagcauuuguaguacaaccacaaaacggccgauguacaacagacggaguauuauuaggaacaacucaauuauccccagucaauauaugcacauucagaggagauguuacucauauagcuggaucucgaaauuacacaaugaaccuagcaucacuaaacuggaauaauuacgacccaacagaagaaauaccagcuccauuaggaacaccagauuucgucgguaaaauacaagguguauuaacacaaaccacaaaaggagacggcucaacccggggccacaaagccacuguuuacaccggaucugcaccauuuacaccuaaacuagguucuguccaauuuucaacagauacagaaaacgacuuugaaacacaucaaaacaccaaauuuacaccuguugguguaauacaagaugguggaacaacacaccgcaaugaaccucaacaaugggcacuuccaucauauucaggaagagauguacacaauguacacuuagcaccagcaguagcacccacuuuuccuggagaacaauuauuauuuuuucguucaacaaugcccggcugcaguggcuauccaaauauggauuuagauuguuuacuaccucaagaauggguacaacauuucuaucaagaagccgcaccagcucaaucagacguugcccuauuacgauuuguaaacccagacacuggaagaguccucuucgaauguaaauuacacaaauccgguuauguaacaguagcacacaccggacagcacgaccuugucauccccccaaacggauacuucagauuugacucauggguuaaccaauucuacacauuagcaccaaugggaaauggaacaggaagaagacgagcccuauaa

SEQ ID NO: 30921 - RNA, 1623 nt, Artificial Sequence
  derived and/or modified sequence opt6 from capsid_protein_VP1__Norovirus__AFX81208
augaaaauggcaucaaacgaugccaauccaucagauggaucugcagcaaacuuaguaccugaaguaucaaaugaaguaauggcuuuagaacccguaguaggagcagcaaucgccgcaccuguagcaggacaacaaaauguaauagacccuuggauuagaaacaauuucguucaagcuccuggaggcgaauuuaccguuucaccaagaaacgccccaggagaaauauuaugguccgccccuuuaggaccagaucuuaauccauaccuaucacacuuagcaagaauguauaauggcuacgccggaggauucgaaguacaaguaauuuuagccggcaaugcauuuacugcuggaaaaauaauauucgccgcuguaccaccaaauuucccaacagaaggccuaucaccaucucaaguaacaauguuuccacacauuauaguagacguacgacaacuagaacccguccuaauaccacuucccgaugucagaaauaauuucuaucacuauaaccaaacaaaugauucaacaauaaaauuaauagcuaugcuauacacaccacuaagagcuaacaaugcaggagaagacguauucacaguaucaugccguguacucacaagacccagcccagauuuugauuuuauauucuuaguaccaccaacaguagaaucaagaacaaaaccauucacaguaccuauauuaacaguagaagaaaugacuaacucccgcuuuccaauaccacuagaaaaacuauuuacaggaccaucuggagcuuucguaguccaaccacaaaacggacguugcacuacagacggaguauuacucggaacuacacaauuaucucccguaaauaucuguacauuuagaggagacguuacccauauagccggaucgcgcaacuauacaaugaaucuagcaucuuuaaauuggaacaauuacgauccaacagaagaaaucccggcaccuuuagguacaccugacuucguuggaaaaauacaaggaguacuaacacaaaccaccaaaggagauggaucaacaaggggucauaaagcaacaguauauacagguucagcuccauuuaccccuaaacuaggaucuguacaauuuucaaccgauacagaaaacgacuuugaaacucaucaaaauacaaaauucacaccaguaggaguuauacaagauggaggaacaacgcauaggaaugaaccucaacaauggguacuaccaucauauucaggccgagauguacauaauguccauuuagccccagcaguagcgccaaccuuuccaggagaacaacuacuauuuuuccgaucaacaaugccaggaugcucugguuaucccaauauggauuuagacugccuacuaccacaagaauggguacaacauuucuaucaagaagcagcuccagcccaaucagauguagcucuauuaagauucguaaaucccgauacaggcagaguauuauucgaaugcaaauuacacaaaucuggauauguaacuguagcccacacaggacaacacgaccuaguaauaccaccaaaugguuauuuuagauucgauucauggguaaaccaauucuauacauuagcaccuaugggaaauggcaccggcagaagaagagcacucuaa

SEQ ID NO: 30922 - RNA, 1623 nt, Artificial Sequence
  derived and/or modified sequence opt6 from capsid_protein_VP1__Norovirus__AFX81211
augaaaauggcuucuaaugaugcaaacccaucagacggaucugcagcuaauuuaguaccugaaguaucaaaugaaguaauggcauuagaaccaguugucggugcagccauagcagccccaguagcuggacaacaaaacguaauagacccauggauacgaaacaacuuuguacaagcuccaggaggagaauuuaccguuucaccaagaaacgcacccggagaaauacuuugguccgccccauuaggaccugaccucaacccauacuuaucucaccuagcaagaauguacaaugguuaugcaggagguuuugaaguacaaguuauauuagcaggaaaugcauuuacagcaggcaaaauaauauucgcagccgucccacccaauuuucccacagaagguuuaucccccucacaaguuacaauguucccacacauaauuguagauguccgccaauuagaaccaguauuaauaccauuaccagauguaagaaauaauuuuuaucacuauaaccaaacgaaugacaguacaauaaaacuuauugcaaugcuuuacacuccauuaagagccaauaaugcuggcgaagauguuuuuacaguaucaugcagaguuuuaacaagaccaucaccugauuucgauuuuauauuuuuaguaccaccuacaguugaaucacgaacaaaaccuuucacuguaccuaucuuaacaguugaagaaaugacaaacucaagauuuccaauuccauuggaaaaauuauuuacuggaccuucuggagcauucguagugcaaccucaaaauggaagaugcacaacagauggaguucuacuuggaacuacacaauuaucccccguaaauauauguaccuuuagaggagacguuacucacauagcuggaucaagaaauuacacuaugaaucucgcaucuuuaaacuggaacaauuacgauccuacagaggaaauuccagcaccacugggaacaccagauuucgucggaaaaauacaagguguucuaacacaaacuacaaaaggagacggauccacaagaggacacaaagcaacaguauauaccgguagugcacccuuuaccccaaaauuaggaucaguccaauuuuccacagauacagagaacgauuucgaaacacaccaaaauacaaaauucacaccaguuggaguaauacaagacgguggaacaacacauagaaaugaaccacaacaauggguacucccuucauauucaggacgagauguccauaacguccacuuagcaccagcaguugcaccuacuuuccccggagaacaauuacuauucuuuagaucaacuaugccaggcuguuccgguuauccaaauauggaccuugauugucuucuaccacaagaauggguacaacauuucuaccaagaagcagcaccagcucaaucagauguagcacuacucagauucguaaacccagauacaggaagaguauuauuugaaugcaaacuacauaaaagugguuauguuaccguagcacacacaggacaacaugauuuaguaauaccacccaauggcuauuuccgauucgauucauggguaaaucaauuuuacacacuugcaccaaugggaaauggcacaggacgaagaagagcgcuauaa

SEQ ID NO: 30923 - RNA, 1623 nt, Artificial Sequence
  derived and/or modified sequence opt6 from capsid_protein_VP1__Norovirus__AFX81214
augaaaauggcuucaaaugacgccaacccauccgacgguagugcugcuaacuuaguaccagaaguaucuaaugaagucauggcauuagaaccaguuguaggugcagcaauagcagccccuguugcaggccaacagaacguaauagacccuuggauaagaaauaacuuuguccaagcuccaggaggagaauucacaguaucaccaagaaaugcaccaggagaaauauuauggucagcaccauuagguccugauuuaaacccauauuuaucacaccucgcaagaauguauaacggauaugcuggaggauuugaaguacaaguaauucuagcagguaaugcauuuacagcuggaaaaauaauauuugcagcagucccaccuaauuuucccacagaaggauuaucaccaucacaaguaacuauguuuccacauaucauaguagacguuagacaacuagaaccaguacuaaucccauuaccagauguuagaaacaauuucuaucacuauaaucaaacgaacgacucgacaauaaaauuaaucgcaauguuauauacaccacuaagagcaaacaacgcuggcgaagauguauuuacaguaucauguagaguucuaacaagaccaucuccugacuuugauuuuaucuuuuuaguaccaccuacaguugaaucacgcacaaaaccauucacuguaccaauauuaacaguagaagaaaugacaaacucacgauucccaauaccauuagaaaaacucuuuaccgguccaucaggggccuucguaguacaaccacaaaauggacgauguacaacagacggaguauuacuaggaacaacacaauuaaguccaguaaacauauguacauuuagaggcgacguaacacauauagcagguucuagaaacuacacuaugaaucuagcaagucuaaacuggaacaauuacgaucccacagaagaaauucccgccccacuaggaacaccugauuuugucggaaaaauacaaggcguauuaacacaaacaacuaaaggagacggaaguacaagaggccacaaagcuacaguauacacaggaucagcuccauuuaccccuaaacucggaucaguccaauuuucaacagauaccgaaaaugauuucgaaacacaucaaaacacaaaauuuacuccaguuggaguaauacaggauggcggcacaacacauagaaaugaaccacaacaauggguacuaccaucauauucaggaagagauguacauaauguccaccuagcaccagcaguagcuccaacauuuccaggcgaacaacuauuauucuucagaucaacaaugccaggauguucagguuauccuaauauggaccuagauuguuuauuaccacaagaauggguacaacauuucuaucaagaagccgcuccagcacaaucugaugucgcacuauuacgauucguaaacccagauacuggccgagucuuauucgaauguaaacuccauaaaucaggguacguaacuguagcucacaccggacaacaugauuuaguaauaccaccaaaugguuauuuuagauucgauucuuggguaaaucaauuuuacacuuuagccccaaugggaaauggcacuggaagaagacgagcacuauaa

SEQ ID NO: 30924 - RNA, 1623 nt, Artificial Sequence
  derived and/or modified sequence opt6 from capsid_protein_VP1__Norovirus__AFX81226
augaaaauggcaaguaacgacgcaaauccaucagauggaucagcugcaaaccuaguuccagaaguuucaaaugaagucauggcacuagaaccaguagucggagcagcaauagcagcaccgguagcaggccagcaaaauguuaucgacccauggauucgcaauaauuuuguucaagccccuggaggugaauuuacagucucaccuagaaaugcaccuggugaaauauuauggucagcaccauuaggaccugauuuaaauccauaucuaucacaucuugcaagaauguacaaugguuacgcaggaggauuugaaguacaaguaauccuagccggaaaugccuucacagcugguaaaauaauauucgcagcggugccaccaaacuucccaacagaaggccuaucucccucacaaguaacaauguucccucauauuauaguagacgucagacaacuagaaccuguacuaauuccccuaccagauguaagaaacaacuucuaccacuacaaucaaacaaaugacucaacaauaaaacuaauugcaaugcuauacacaccacucagagcaaacaaugcuggagaagauguauuuacaguaucauguagaguuuuaacaagaccuaguccagauuuugacuuuauauuuuuaguuccaccaacagucgaaucaagaacaaaaccauucacaguuccaauauuaacuguagaagaaaugaccaauucaagauuuccaauaccacucgaaaaacuuuuuaccggcccaucaggagcauuugucguacaaccacaaaacggaagauguaccacugauggaguauuacuaggaacaacacaauuauccccaguaaauauaugcacauucagaggcgacguuacccacauagcaggaucuagaaauuacacuaugaauuuagcaaguuuaaacuggaauaauuacgaucccacagaagaaauaccagcaccacuuggaacaccugacuuuguagguaaaauacagggaguccuuacacaaacaacaaaaggagacggcucuacaagaggacauaaagcaacuguauacacaggaucagcuccauucacuccuaaauuaggaucaguucaauuuucaacagauacagaaaaugacuucgaaacccaucaaaauacuaaauucacuccaguaggaguaauacaagauggaggaacaacccauaggaaugaaccacaacaauggguacuuccuucauauaguggaagagauguacacaacguacacuuagcaccagcaguugcaccaacauuuccaggugaacaacuuuuauuuuuuagaucaacaaugccagguugcucuggauauccaaauauggauuuagauugccuauuaccccaagaauggguacaacauuucuaucaagaagccgccccugcacaaucagacguagcacuauuacgcuucguaaacccagacacaggcagaguauuauuugaaugcaaauuacauaaauccggauacguaacaguggcucacaccggccaacaugaccuuguuauaccaccaaacggauacuuccgauuugauucauggguaaaucaauuuuauacauuagcacccaugggaaauggcacaggaagacgacgugcacuauaa

SEQ ID NO: 30925 - RNA, 1623 nt, Artificial Sequence
  derived and/or modified sequence opt6 from capsid_protein_VP1__Norovirus__AFX81229
augaaaauggcaagcaaugacgcaaauccauccgauggauccgcagcuaaccuuguaccagaaguaucgaaugaaguaauggcccuagaaccaguuguaggagcagcuaucgccgcaccaguagcaggacagcaaaauguaauagacccauggauaagaaauaacuucguacaagcaccagguggagaauuuacuguaucuccacgaaacgccccuggagaaauacuauggucagcaccacuaggaccugauuuaaacccauaucuaucccaccuagcaagaauguauaauggcuacgcuggaggcuuugaaguacaaguaauacucgcugguaaugcauuuacugcuggaaaaauaauauucgcagccguaccaccaaacuucccaacagaaggucuuucaccaucacaaguaacaauguucccccauauaauaguagacguacgacaauuagaaccaguauuaauacccuuaccagacguccgcaauaauuuuuaccauuauaaccaaacaaacgacucaacaaucaaauuaauagccaugcuauauacaccacuaagagcaaacaacgcuggagaagacgucuuuacaguaucauguagaguuuuaacacgaccaucuccugauuuugacuuuauauuucuagugccuccaacaguagaaucacgaaccaaaccuuucacuguaccaauacuaacaguugaagaaaugacaaauucgcgauucccaauuccacuagaaaagcucuuuacaggacccucaggagcuuucguaguucaaccccaaaaugguagguguacuacagacggaguacuacucggaaccacacaauuaucaccaguaaauauuugcacauuuagaggagaugucacccauauagccgguucucguaacuacacaaugucacuagcuagccuuaauuggaacaauuacgacccaacugaagaaauaccagccccucucggaaccccugauuuugucggaaaaauucaagguguucuaacacaaacuaccaaaggcgauggaucaacaagaggacacaaagccacaguauauacaggauccgcaccuuuuacaccaaaauuaggaucaguacaauucuccaccgauacagaaaacgacuucgaaacacaccaaaacacaaaauuuacccccguaggaguaauccaagauggaggcacaacccauagaaaugaaccucaacaauggguauuaccauccuauucaggcagagauguacacaauguucaucucgcaccugcagucgcaccaaccuucccaggagaacaauuauuauucuucagaucaacaaugccuggaugcucaggauacccaaauauggaucuagauugccuacuaccacaagaguggguacaacacuucuaucaagaagcagcaccugcacaaucugacguagcacucuuaagauuuguuaacccagacacagguagaguauuauuugaaugcaaauuacauaaaucaggauauguaacaguugcacauacuggacaacacgaucuaguuauaccaccuaacggcuacuucagauucgauagcuggguaaaucaauucuauacacuagcuccaaugggcaauggcacugguagaagacgcgccuuauaa

SEQ ID NO: 30926 - RNA, 1623 nt, Artificial Sequence
  derived and/or modified sequence opt6 from capsid_protein_VP1__Norovirus__AFX81232
augaaaauggcaucaaaugaugcaaacccaucugauggaucagcagcaaacuuaguuccagaagugucaaaugaagucauggcacuugaaccagucguaggcgcagcaauagcagcaccagucgcaggacaacaaaacguaauagacccauggauacguaacaacuuuguacaagcaccagguggugaauuuacaguauccccaagaaaugcaccaggcgaaauacuuuggucugcaccacuagguccagaucucaauccauaucuuucacacuuagcaagaauguauaacggauacgcaggagguuuugaaguucaaguuauauuagcaggaaacgcauuuacagcaggaaaaauaauauucgcagcaguaccaccaaacuucccaacugaaggacuaucaccuucacaaguaacaauguucccacacauaauaguagacguucgacaauuagaacccguauuaauaccacuaccagauguaagaaacaauuucuaucauuauaaucaaacuaaugauagcacaauaaaauuaauagcaaugcuauauacaccauuaagagcuaacaaugcuggagaagacguauucacaguaucaugucgaguucucacacgaccaaguccagacuuugacuuuauauuucuaguaccaccuacaguagaaucacgaacaaaaccauucacaguaccaaucuuaacuguagaagaaaugacuaacucaagauuccccauuccacuagaaaaauuauuuacaggacccucuggagcuuuugucguacaaccacaaaacggucgcuguacaaccgacggaguccuauuaggaacaacacaacuaucaccaguuaacaucuguacguuucgaggagauguaacucauaucgcaggaucaagaaauuauacaaugaauuuagccucauuaaauuggaauaauuaugaucccacagaagaaauaccugcaccuuuaggaaccccagacuucguaggaaagauacaagguguuuuaacacaaaccaccaaaggcgauggaucaacacgaggccauaaagcaacaguuuacacaggaucagcacccuuuacacccaaacucgguagcguacaauucucuacagacaccgaaaacgacuuugaaacacaucaaaacaccaaauuuacacccguaggaguuauucaagacggaggaacaacacacagaaaugaaccacaacaauggguucuaccaucauauucaggaagagacguccauaauguacacuuagcaccugcagucgcuccaacuuucccuggugaacaacucuuauucuuuagauccacuaugccaggaugcaguggcuacccaaauauggaucuagauuguuuacuaccucaagaauggguacaacauuuuuaucaagaagccgcaccagcacaauccgacguugcacuuuuaagauucguaaacccagauacuggaagaguuuuauucgaaugcaaauuacauaaaucaggauauguaacagucgcacauacuggacaacacgaucuugucauaccaccaaauggauauuuucgauucgauuccuggguaaaucaauuuuauacuuuagcuccaaugggaaauggaacaggaagaagaagagcauuauaa

SEQ ID NO: 30927 - RNA, 1623 nt, Artificial Sequence
  derived and/or modified sequence opt6 from capsid_protein_VP1__Norovirus__AFX81238
augaaaauggcaucuaacgaugcaaauccaucagacggaucagcagcaaaccuuguaccagaaguaaguaaugaaguaauggcauuagaaccaguuguaggagcagcaauagcagcaccaguagcaggacaacaaaauguaauagauccauggauaagaaauaauuuuguucaagcaccuggaggagaauuuacuguaucaccuagaaaugcuccaggagaaauacuuuggucagccccacuagguccagaucuaaaucccuauuuaucacaucuagcaagaauguauaauggauacgcaggagguuuugaaguucaagucauacucgcuggaaaugcauucacagccggaaaaauaaucuucgcagccguuccaccuaauuuuccaacugaaggucuaucaccaucacaaguuacaauguuuccacacauaaucguagacguaagacaacucgaacccguacuaauaccauuaccagaugucagaaacaauuucuaccacuauaaucaaacuaacgacuccacaauaaaauuaauagcaauguuauacacaccacuuagagcaaacaacgcaggagaagauguauuuacaguaucuugcagaguauuaacaagaccaucaccagauuucgacuuuaucuuuuuaguaccuccuacaguugaaucaagaacaaaacccuucaccguuccaauccuaacaguugaagaaaugacuaacucacgauuuccaaucccuuuagaaaaacuauuuaccgguccuucaggagcauuuguaguacaaccacaaaacgguagauguacaacagacggcguccuucucgguaccacccaauuaucaccaguuaacauauguacauucagaggagacguaacacauauagcaggcuccagaaauuacacuaugaauuuagcaucccuaaacuggaauaauuaugauccuacugaagaaauaccugcaccuuuagguacuccugacuuuguagguaaaauucaaggaguacuaacacaaacaacaaaaggagauggcucaacacgaggccacaaagcaacaguuuauacaggaucagcaccauucaccccuaaacuagguucuguacaauucaguacagauacagaaaacgauuucgaaacacaccaaaauacaaaauucacaccaguaggaguaauacaagauggagguacaacacauagaaacgaaccucaacaauggguacuacccucauauucuggaagagauguacauaacguacaccuugcaccagcagucgccccaacauucccuggagaacaauuauuauucuucagauccaccaugccuggaugcucaggauauccaaauauggauuuagacugcuuacuaccucaagaauggguacaacauuucuaucaagaagcagcaccugcacaaucagacguagcucuccuuagguucguaaacccugauacuggaagaguauuauucgaaugcaaacuacauaaaucaggauauguaacaguagcacacaccggucaacacgauuugguaauaccucccaauggauacuucagauuugacucauggguaaaucaauucuacacacuagcuccuaugggaaaugguacaggacgacgacgagcacuauaa

SEQ ID NO: 30928 - RNA, 1623 nt, Artificial Sequence
  derived and/or modified sequence opt6 from capsid_protein_VP1__Norovirus__AFX81241
augaaaauggcuucaucagaugcaaaccccucagauggaucaacugcaaacuuaguacccgaaguaaacaacgaaguuauggcacuagaaccuguaguaggagcagcaaucgccgcacccgucgcaggacaacaaaauguuaucgacccauggauacgaaauaauuuuguucaagcaccaggaggagaauuuacaguauccccaagaaaugcaccuggagaaauacuauggagugcaccauuaggaccagacuuaaaucccuauuuaucccacuuggcacgaauguauaauggauacgcaggagguuuugaaguucaaguaaucuuagcaggaaacgcuuucacagcagguaaaauaauauucgcugccguaccaccaaauuuuccaacagaaggacuaucaccaucacaaguaacaauguuuccucauauaauaguagacguuagacaacuagaacccguacuaauaccuuuaccagauguaagaaacaacuuuuaucauuauaaccaaucaaaugacccaacaauuaaauuaauagcaauguuauauacaccacuaagagcuaauaacgcuggagaugauguauuuacaguaucauguagaguacucacccgcccaucaccagacuuugacuuuauauucuuaguaccacccacaguagaaucacguacaaaaccauucucaguaccuguacuaacuguagaagaaaugacaaauucucgcuuuccaaucccacuagaaaaauuauuuaccggcccuucaucagcuuuuguaguccaaccacaaaacggacgcugcacaacagaugguguacuauuaggaacuacacaauuauccccaguuaauauaugcacauuccgaggagauguaacacauauaucaggaucaagaaauuacacaaugaaucuagcuucucagaauuggaauuccuacgaucccacugaagaaauuccagcaccacuaggaacuccugacuuuguaggaaaaauacaaggaguccuaacgcaaaccacaagaacaaacggaucaacaagaggccacaaagcaaccguauauacugguucugcagacuucucaccuaaauuaggaagaguacaauuugcaacugauacagacaaugacuucgaaaccaaccaaaauacaaaauuuacaccaguaggaguaauacaagauggaucaacaacccccagaaaugaaccucaacaauggguucuaccaucauauagcggacgaaauauucacaauguucauuuagccccagcaguagcccccacauuuccaggagaacaacuauuauucuucagaucuacaaugccaggaugcaguggcuaccccaauauggaucuagauugcuuauuaccacaagaauggguacaauacuuuuaucaagaagcagccccagcacaaucagacguagcauuauuacgcuucguuaacccagacacaggccgaguacuauuugaaugcaaacuccacaagucagguuaugucacaguagcacacacaggucaacacgaucuagucauaccuccaaauggauauuuuagauuugauagcuggguaaaccaauuuuacacauuagcaccuaugggcaauggaacagguagacgcagagcauuauaa

SEQ ID NO: 30929 - RNA, 1623 nt, Artificial Sequence
  derived and/or modified sequence opt6 from capsid_protein_VP1__Norovirus__AFX81247
augaaaauggcaucuucagaugccaauccaucugaugguucuacagcaaaccuaguaccagaaguuaacaaugaaguaauggcacuggaaccagucguaggcgcagccauagcagcaccaguagccggucaacaaaauguaauagacccauggauaagaaauaauuuuguccaagcacccggaggugaauuuacagucucaccaagaaaugcacccggagaaauauuauggucagcuccacucggacccgacuuaaaucccuacuuaucacaccuugcgcguauguacaacggauaugcaggaggcuuugaaguacaaguaauauuagcuggaaaugcauucacagcaggaaaaaucaucuucgcagcaguaccaccaaacuuuccaacagaaggauuaucaccaagccaaguaacaauguuuccacacauaauuguagauguaagacaguuagaaccaguacuaauaccuuuacccgauguaagaaacaauuucuaucacuauaaccagucuaaugacccaacaauuaaauuaauugcaauguuauacacuccacuaagagccaacaaugcuggagaugacguauuuacaguaaguuguagagucuuaacucgucccucuccugacuucgacuuuauauuuuuagucccaccaacaguagaauccagaacaaaaccauucucaguaccaguauuaacaguagaagaaaugacaaauagcagauuuccaauaccauuagaaaaacuauuuacuggaccaaguucagcauucguaguacaaccccaaaacggacguugcacaacugacggaguuuuacuaggaacaacacaauuauccccaguuaauauauguacauuucguggagacguaacacauauaccagguucuagaaauuacacuaugaaucuugcuucccaaaauugggacucauaugaucccacugaagagacaccggcaccauuaggaacaccugacuuugucggaaaaauccaaggaguauuaacacaaacaacaagaacaaacgguucuacaagaggacacaaagcaacaguauauacaggaucugcagacuuuucaccuaaacuaggaagaguacaauuugccacagacacagauaacgacuucgaaacaaaucaaaacacaaaauucacuccaguagguguaauacaagacggcucgacuacaccacgaaaugaaccacaacaauggguucuaccaucauacuccggacgcaauauacauaacguucaccuugcaccugcaguagcaccaacauucccaggugaacaacuauuauucuucagaucaaccaugccagguugcucaggauacccaaacauggaucuagauugcuuacuaccacaagaauggguacaauacuucuaucaagaagcugcaccagcucaauccgacguagcauuacuacgauuuguaaauccagauacaggaagaguauuauuugaaugcaaacuccauaaauccggauacgucacaguagcccacaccggacaacacgaucuagucauaccaccaaacggauauuuuagauucgauucauggguuaaccaauuuuauacccuagcaccaaugggaaauggcacaggaagaagaagagccuuauga

SEQ ID NO: 30930 - RNA, 1623 nt, Artificial Sequence
  derived and/or modified sequence opt6 from capsid_protein_VP1__Norovirus__AFX81250
augaaaauggcaucaucggaugcaaauccuucaaacgguucaacagcaaauuuaguacccgaaguaaauaaugaaguuauggcauuagaaccaguagugggagcugcuauagcugcuccagucgcuggucaacaaaacgucauagauccauggauacgaaauaauuucguacaagcaccagguggagaauucacaguauccccacgaaaugccccaggugaaauucuaugguccgcuccauuaggaccagauuuaaauccauaucuaucacaccuagcaagaauguauaacggauacgcaggcgguuucgaaguucaaguaauacuagcaggcaacgcauuuacagcaggcaaaauaauuuucgcagcaguuccaccuaacuucccuacagaaggccuaaguccaucccaaguaaccauguuuccacacauaauaguagacguacgucaacucgaaccaguauuaauaccccuaccugauguaagaaauaauuucuaccacuauaaccaaucaaacgauccaacaauaaaauuaauagcaaugcuuuauacaccacuaagagcaaauaaugccggagacgauguauucacagucucauguagagucuuaaccagaccauccccagacuucgacuucauauuucuaguaccaccaacaguagaaucccgaacaaaacccuuuucaguucccguccuaacaguugaagaaaugacaaauucaagauucccuaucccauuagaaaaauuauuuacaggaccuaguucagcauucguaguacaaccacaaaauggaagauguacaacagacggaguauuacuaggaacaacacaguuaucaccaguaaacaucuguacauucagaggcgauguuacccacauaccauccucucacaauuauacaaugaacuuagcaucccaaaauuggaauucuuaugacccaacagaagaaauaccugcuccacuaggaacuccagacuucgucggaaaaauucaaggaguacuaacccaaaccacaagaacagacgguucaacccgaggacacaaagcuacaguauacacaggauccgcugauuucucaccaaaauuaggcagaguacaauuugcaacagacacagauaacgacuuccaaacaaaccaaaacacaaaauucacaccaguaggaguuauucaagauggauccacaacaccucgaaacgaaccccaacaauggguucuaccaucuuauucagguagaaauauccauaauguccacuuagcaccagccguagccccaacuuucccaggcgaacaacuacuauucuucagaucaacaaugccaggaugcuccggauacccaaacauggaucuagauugucuauuaccacaagaauggguucaauacuucuaccaagaagcagcaccugcacaaucugacguugcacuacuaagauucguaaauccagacaccggaagaguacuauucgaaugcaaacuacacaaaucagguuauguuacagucgcacauacaggccaacaugaccucguaaucccacccaacggauauuuuagauuugacuccuggguaaaccaauucuacacauuagccccuaugggaaaugguacaggacgcagaagagcacuauaa

SEQ ID NO: 30931 - RNA, 1623 nt, Artificial Sequence
  derived and/or modified sequence opt6 from capsid_protein_VP1__Norovirus__AFX81253
augaaaauggcaucaucggacgccaacccaagugauggaucuacagcuaaccuuguaccagaaguaaauaaugaaguaauggcacuagaacccguaguaggugccgcaauugcugcuccagucgcaggucaacaaaauguaauagauccauggauccgaaauaauuuuguacaagcacccggcggagaauuuacaguauccccaagaaaugcaccaggagaaauacuauggucagcuccacuggguccagauuuaaauccauaucuaucacaucuugcuagaauguauaacggauacgcuggcggauucgaaguacaaguaauauuagcaggaaaugcuuuuacagcugguaaaauaauauuugcagcaguaccaccaaauuuuccaacagaaggcuuaagucccucucaaguaacuauguucccacacauaaucguagauguacgccaauuagaacccguacuaauuccacuucccgauguaagaaacaauuucuaucacuauaaucaauccaaugaccccacaauuaaacucauagcaaugcucuauacaccauuacgggcaaacaaugcaggagacgacguuuucacuguuucuugcagaguuuuaacuagaccuucaccagauuuugacuuuauauuucuugucccaccaacaguugaaucaagaacaaaaccauucucaguacccguacucacaguagaagaaaugaccaacaguagauuuccaauaccauuagaaaaacuauuuacagguccaucaucugcuuucguuguacaaccucaaaaugguagaugcacaaccgauggaguacuacuuggaacaacacaauuauccccugucaauauuuguacauucagaggcgacguuacccauauaucagggucacgaaauuauacaaugaaucuagcaucacaaaauuggaacucauaugauccaacagaagaaauacccgcaccacuagguacuccagauuuuguaggcaaaauacaagguguacucacacaaacaacaagaacaaacggaagcacgagaggccacaaagcaacaguuuauaccggcuccgcagacuucuccccaaaauuaggaagaguacaauuugcaacagacacagacaaugauuucgaaacaaaccaaaauacaaaauucacaccaguaggaguaauacaagaugguucaacaacuccacgaaacgaaccacaacaauggguacuaccauccuauucaggccgaaacauacauaacguccauuuagcaccugcuguugccccaacauucccuggcgaacaauuacuauucuucagauccaccaugccagguugcucuggauauccaaacauggauuuagauugccuuuuaccacaagaauggguacaauacuuuuaucaagaagcagcaccagcccaaucagacguagcauuauuaagauucguuaacccugacacuggaagaguucucuucgaaugcaaauuacacaaauccgguuaugucacuguagcacauacaggacaacacgaccuaguaauaccaccaaacggauauuucagauucgauucauggguaaaucaauucuauacuuuagcacccaugggaaauggaacaggaaggagaagagcacuauaa

SEQ ID NO: 30932 - RNA, 1623 nt, Artificial Sequence
  derived and/or modified sequence opt6 from capsid_protein_VP1__Norovirus__AFX81256
augaaaauggcaucuucagaugcaaaccccucagauggcucaacagcaaauuuaguacccgaaguaaauaaugaaguaauggcacuagaaccaguaguaggagccgcaauagcagcaccaguagccggccaacaaaacguuauagaucccuggauaagaaacaacuuuguccaagcaccaggaggagaauucacaguuucuccuagaaaugcaccaggagaaauauuauggucagcuccacuuggaccagaucuaaacccauauuuaucucaucuagcaagaauguauaaugguuacgcaggcgguuucgaaguacaagucauacuagcaggcaaugcauuuacagcaggcaaaauaauauucgcagcaguaccaccaaacuuuccuaccgaaggacucucaccaucacaaguaaccauguuuccucacauaauaguugauguaagacaacuugaaccaguuuuaauaccacuaccagauguacgaaauaacuuuuaucauuacaaucaaucaaacgacccuacaauuaaauuaaucgcaauguuauacacaccauuacgagcaaauaacgccggugaugauguauuuaccguuucauguaggguucuaacaagaccaaguccagauuuugacuucauauuccuaguaccaccuaccguagaaucucgaacuaaaccuuuuucuguuccaguauuaaccguagaagaaaugacaaacucuagauuuccaauaccuuuagaaaaauuauucacuggacccucuucagcuuucgucguacaaccccaaaauggcagauguacaacugacggaguacuacuaggaacaacccaacuauccccaguaaauauauguacauuucggggagacguuacccauauaccagguucaagaaauuacacaaugaauuuagcaagccaaaauuggaacucauacgacccaacagaagaaauaccugcuccucuaggaacaccagacuucguaggaaaaauccaaggaguauuaacacaaacaacaagaacaaauggcucaacaagagggcauaaagcaaccguauauacuggauccgcugacuucucuccaaaauuaggacguguacaauuugcgacagauaccgauaaugacuuugaaacuaaucaaaauacaaaauucacacccguuggagucauacaagacggaucaacaacaccacgaaacgaaccacaacaauggguacuaccuucauauucaggacgaaauauccauaacguacaucuugcaccugcaguagcuccaacauuuccaggugaacaacuucuuuucuuuaggucaacuaugccaggcugcucaggauauccuaauauggaucucgacugcuuacuaccucaagaaugggugcaauauuuuuaccaagaagcugcuccagcacaaucagacgucgcauuauuaagauuuguaaauccagacacaggacgaguacuauuugaauguaaacuacauaaaucaggcuauguaacaguagcccacacuggacaacacgauuuaguaauaccaccaaauggauauuuccgauucgauucuuggguaaaucaauuuuacacacucgcaccaaugggaaacggaacagguagaagacgugcacuauaa

SEQ ID NO: 30933 - RNA, 1623 nt, Artificial Sequence
  derived and/or modified sequence opt6 from capsid_protein_VP1__Norovirus__AFX81262
augaaaauggcuucaaaugaugcaaacccuucagauggaucagccgcaaacuuaguuccagaaguauccaaugaaguaauggcacuagaaccaguaguuggcgcugcaauagcagcuccuguugccggucaacaaaauguuauagauccuuggauaagaaauaauuuuguacaagcaccagguggagaauuuacaguaagcccuagaaaugcaccaggagaaauacucuggucugcaccacuaggaccagauuuaaacccauauuuaagucaccuagcaagaauguacaauggauaugcaggaggauuugaaguacaaguaauauuagcaggaaaugcauucacugcuggaaaaauaauauuugccgccgucccaccaaauuuucccacagaaggauuaucaccaucacaaguuaccauguuuccacauauaauuguagaugucagacaacuagaaccagucuuaaucccccuacccgaugucagaaacaauuuuuaucauuauaaccaaacaaacgauuccacaauaaaacuaauagcaaugcuauauaccccacuacgagcaaacaaugcuggagaagauguauuuacaguaagcugucgaguauuaacacgaccaucaccagauuuugacuuuauauuccuaguaccuccuacaguagaaucacgaacuaaaccauucacaguaccuauccucaccgucgaagaaaugacuaauucccguuuuccaauacccuuagaaaaacuuuuuacaggaccaucaggagcauuugucguacaaccacaaaauggaagaugcacaacagauggaguacuacuaggaacaacacaauuauccccaguaaacauauguacauuucgaggcgacguaacucacauagcaggaucaagaaauuacacaaugaauuuagcaucauuaaacuggaacaacuacgacccaacagaagaaauaccagcaccucucggaacaccagauuuuguuggaaaaauacaaggaguacuaacacaaacaacaaaaggagauggaucaacucguggacauaaagcaacagucuauacugguuccgcaccauuuacaccaaaauuagguucuguacaauuuucuacagauaccgaaaacgauuuugaaacucaucaaaauacaaaauuuacaccuguuggaguaauacaagacggagguacuacacaucgaaacgaaccacaacaauggguauuaccaucuuacucaggacgcgauguacauaacguucaccuagcaccagccguagcaccaacauuuccaggugaacaauuauuauucuuuagaucaacaaugccaggauguucugguuacccaaauauggaucuugauugccuacucccucaagaauggguccaacacuuuuaucaagaagcagcaccugcccaauccgacguugcauuauuacgcuucguaaacccagauacuggccguguauuauuugaaugcaaauuacauaaaucaggauauguaacagucgcacacacaggucaacacgaucuaguaauuccuccaaaugguuacuuuagauuugauucgugggucaaccaauuuuacacacuagcaccuaugggaaauggaacaggcagacguagagcacuauaa

SEQ ID NO: 30934 - RNA, 1623 nt, Artificial Sequence
  derived and/or modified sequence opt6 from capsid_protein_VP1__Norovirus__AFX81265
augaaaauggccucaaacgacgcaaacccaucagacgguucagcagcuaacuuaguuccagaagucucaaaugaaguuauggcacuagaaccaguaguaggagcagccauagcugcaccuguggcuggacaacaaaauguuauugacccauggauaagaaacaauuuuguacaagcaccaggaggagaauuuacaguauccccuagaaaugcaccaggcgaaaucuuauggucugcaccccugggaccugaucuaaauccauaucucucucaccuugcccguauguacaacggauacgccgguggcuuugaaguccaaguaauauuagcaggaaacgccuucacugccggaaaaaucauauucgcagcaguuccaccaaacuuuccaaccgaaggauuaaguccaucucaaguaacaauguuuccacauauaauaguagacguaagacaacuagaaccaguacucauaccacuaccugauguaagaaacaauuuuuaucauuauaaccaaacaaaugauucuacaaucaaauuaauagcuaugcuauauacaccauuaagagcaaacaaugcaggagaagacguauuuacugucucauguagaguauuaacuagaccaagcccagacuucgacuuuauauuuuuaguaccaccaacaguugaaucaagaacaaaaccauuuacaguuccaauacucacagucgaagaaaugaccaacucaagauucccaauaccauuagaaaaauuauuuacaggaccaucgggugcauucguaguacaaccacaaaacggacgauguacuacugacgguguacuacucggaacaacccaacuaucaccaguaaacauauguacuuuuagaggagacguaacacauauugcuggaaguagaaauuacacaaugaaccucgcaucauuaaauuggaacaauuacgaccccacugaagaaauaccagcaccacuaggaacuccagacuucguagguaaaauacaaggaguccuaacucaaaccacaaaaggagaugguucaaccagaggacacaaagccacaguauauacaggauccgccccauuuacaccaaaauuaggcucuguacaauuuucuaccgauaccgaaaaugauuucgaaacucaccaaaauacaaaauucacccccguuggaguaauccaggacgguggaacuacucacagaaacgaaccacaacaauggguucuuccaucauacuccggaagagauguacauaacguacauuuagcaccagccgucgcuccaacauuuccuggagaacaauuacuuuucuuucgaucaacaaugccaggaugcucaggauauccaaauauggacuuagauugcuuauuaccacaagaauggguacaacauuucuaccaagaagcugcuccagcacaaucugacguagcacuacuaagauucguaaauccagauacagguagaguacuuuucgaaugcaaacuacauaaaaguggauauguaacuguagcacauacaggacaacacgaucuagucauaccacccaauggauauuucagauucgauucuuggguaaaucaauucuacacuuuagcaccaaugggaaauggaacuggacgcagacgagcacuauaa

SEQ ID NO: 30935 - RNA, 1623 nt, Artificial Sequence
  derived and/or modified sequence opt6 from capsid_protein_VP1__Norovirus__AFX81268
augaaaauggcaucaaaugacgcaaacccaucagauggaucagcagccaauuuaguaccagaaguauccaaugaaguaauggcucuagaacccguugucggugccgccauagcagcaccaguagcaggccaacaaaauguaauagacccuuggauuaggaauaacuucguacaagcaccuggaggagaauuuacaguuucaccacgcaacgccccuggcgaaauauuauggucugcaccauuagguccagacuuaaauccauacuuaucacaucuagcacgaauguauaauggauaugcaggcggauucgaaguuagagucauacucgcuggaaacgcauuuaccgcaggaaaaauaauuuucgcugcuguacccccaaacuucccaacagaaggacuaucaccaucccaaguaacaauguucccacacauaauaguagacguuagacagcuugaaccaguauuaauacccuuaccagaugucagaaacaauuucuaucauuacaaccaaacaaaugauuccacaauaaaacuaauagcaaugcuauauacaccacuaagagcaaauaaugcaggagaagauguauuuacagucucaugcagaguacuaacaagaccaucaccagacuuugacuucauauuccuaguaccaccuacuguagaaucuagaacaaaaccuuucacaguaccuauauuaacagucgaagaaaugaccaauucuagauuuccaauuccacucgaaaaacuauuuacaggaccauccggagcauucguaguucaaccucaaaacgguagauguacaaccgaugguguauuacuagguacuacucaacuaucuccaguaaacauauguacauucagaggugacguaacacacauugcaggaucucgaaauuauacaaugaaucuugccucacuaaacuggaacaauuacgaucccacugaagaaauacccgcaccuuuagguacaccagauuuugucggaaaaauacaaggaguauuaacacaaacaacuaaaggagacggaucuacaagaggacacaaagcaacagucuauacaggguccgcaccauucacacccaaacuuggguccguacaauuuaguacagauacagaaaaugacuucgaaacccaucaaaacacaaaauucacacccguaggcgugauucaagacggugguacaacacauagaaacgaaccucaacaauggguacuaccaucuuacucugguagagauguucauaacguacacuuagcacccgcuguagccccaacuuuuccaggugaacaauuauuauuuuuucgcucuacaaugccaggaugcucaggauauccaaauauggaucuagauugccuuuuaccacaagaguggguacaacacuuuuaucaagaagcagcaccagcacaaucugacguugcauuauugagauucguaaauccugauacaggacgaguacuauuugaauguaaacuucacaaauccggauacguaacaguagcacauacaggccaacacgaucuuguaauaccacccaacggauauuuuagauucgacagcuggguuaaucaauuuuauacacuagcaccaauggggaacgguacaggaagaagacgagccuuauaa

SEQ ID NO: 30936 - RNA, 1623 nt, Artificial Sequence
  derived and/or modified sequence opt6 from capsid_protein_VP1__Norovirus__AFX81271
augaaaauggcaaguaaugacgcaaauccaucagauggcucagcagcuaaccuuguaccagaagucucaaaugaaguaauggcccuagaacccguaguaggagcagcaaucgcagccccaguugcaggucaacaaaauguaauagaccccuggauaagaaauaacuuuguacaagcaccaggaggagaauucacaguuucaccuagaaacgcacccggcgaaaucuuaugguccgccccucuaggacccgauuuaaauccauaccuaucacauuuagcaagaauguauaauggcuaugcuggaggcuuugaaguacaaguaauacuagcaggaaaugccuuuacagcuggaaaaauaauauuugcagcuguuccaccuaauuuuccaacagaaggucucucaccuucccaaguaacaauguucccacauauuauuguugauguacgccaauuagaaccaguacuaaucccauuaccagaugucaggaauaauuucuaucauuauaaucaaacaaaugacucuacaauuaaauuaauagcaauguuauacacaccacuacgagcaaacaacgccggagaagauguauucacaguaucauguagaguacuaacaagaccauccccugacuuugauuuuauauucuuaguucccccaacuguagaaucuagaaccaaaccuuuuacaguuccaauucuaacagucgaagaaaugacaaacaguagguucccaauaccauuagaaaaauuauuuaccggacccucuggagcauuuguaguacaaccacaaaacgguagaugcacaacagacggaguacuauuaggaacaacacaauuauccccuguuaauaucuguacauuucgcggugauguaacacauauagcagguucacgaaauuacacuaugaaucuagcaucacuuaacuggaauaacuaugauccuacagaagaaauaccagcaccauuaggaacacccgacuuuguaggaaaaauacaagguguacuaacucaaaccacaaaaggcgauggauccaccagaggacacaaagccacaguauauacugggucagcaccauuuacacccaaauuagguucaguacaauucaguacagauaccgaaaaugauuuugaaacucaccaaaauacaaaauucacucccguaggcguuauacaagacggagguacaacacauagaaaugaaccucaacaauggguuuuaccaagcuauucaggacgagacguccauaauguacacuuagcacccgcaguagcuccaacauuuccaggagaacaacuuuuauuuuucagaucaacaaugccaggaugcuccgguuauccaaauauggacuuagauugcuuauuaccacaagaauggguacaacauuuuuaccaagaagccgcaccagcucaaucugauguagcauuacuacgauuuguuaacccugacacaggaagaguauuauucgaauguaaauuacauaaaucaggauaugucacagucgcucacaccggacaacaugaccuaguuauaccaccaaacggauauuuuagauuugauucauggguaaaccaauuuuacacacuagccccaaugggcaacggcacaggacgacgaagagcacuuuga

SEQ ID NO: 30937 - RNA, 1623 nt, Artificial Sequence
  derived and/or modified sequence opt6 from capsid_protein_VP1__Norovirus__AFX81274
augaaaauggcuucuaacgacgccaauccaucagauggaagugcagcuaacuuaguaccugaagucucaaaugaaguaauggcacuagaaccuguaguaggugcagcuauagcagcaccuguagcaggacaacaaaauguaauagaucccuggauaagaaauaauuuuguccaagcaccaggaggugaauucacuguaucuccuagaaaugcaccaggugaaauauuauggucagccccauugggaccagaccuaaauccauaucuaucccacuuagcaagaauguauaauggauacgccggagguuuugaaguaagagucauauuagcugguaacgcuuuuacagcaggaaaaaucauauuugccgcagucccaccuaacuucccaacagaaggucuuuccccaucacaaguuaccauguucccacacauuauaguagacguaagacaauuagaaccaguauuaauacccuuaccagauguccgaaacaauuucuaccacuauaaccaaacaaaugacucaacaauaaaauuaauagcaaugcuuuacacaccccuaagagcuaauaaugccggagaagauguauuuacugucucauguagaguacuaaccagacccucaccagacuucgacuucaucuuccucguaccuccaaccguugaauccagaacaaaacccuucacaguaccaauacuaacgguagaagaaaugacaaacucacgcuucccaauaccuuuagaaaagcucuuuacaggccccuccggugcauuuguaguacaaccacaaaacggaagauguacaacagacgguguacuccuagggacaacacaauuaucaccaguuucuauauguacauuuagaggugacguaacucauauagcaggcuccagaaauuacacuaugaauuuagcuuccuuaaacuggaauaauuacgauccaacagaagaaauaccagcaccauuagguacaccugauuuuguaggaaaaauacaaggagucuuaacacaaacaacuaaaggugacggaagcacaagaggucauaaagcaacaguuuacacaggaucagcacccuuuacuccaaaacuuggaucuguacaauucucaacagauacagaaaacgauuucgaaacacaucaaaauacaaaauuuacaccagucggaguaauacaagacggagguacuacacacagaaaugaaccucaacaauggguacuacccuccuauagcggaagagacguacacaacguacacuuagcaccagcaguagcaccaacauuuccaggcgaacaauuacucuuuuuuagaucaacaaugccaggaugcucaggauauccaaauauggaucuagauuguuuauuaccacaagaauggguccaacauuuuuaucaagaagcagcuccagcacaaucagacguagcacuauuaagauuuguaaacccagacacaggaagaguauuauuugaaugcaaacuacauaaaucagguuaugucacuguagcacacacaggacaacacgauuuaguaaucccuccuaaugguuacuuccgauucgauuccuggguaaaucaauuuuacacauuagcuccaaugggaaacggaacaggcagacgaagagccuuauag

SEQ ID NO: 30938 - RNA, 1623 nt, Artificial Sequence
  derived and/or modified sequence opt6 from capsid_protein_VP1__Norovirus__AFX81277
augaaaauggcaucuaaugaugcaaacccaucugauggaucagcagcaaacuuagucccagaaguaaguaaugaaguaauggcauuagaacccguaguaggagcugccauagcagcuccaguagcaggacaacaaaauguuauugacccauggauucgaaauaacuuuguccaagcaccuggaggagaauuuacuguuucaccucgaaaugcacccggagaaauauuauggucagcaccacuugguccagacuuaaauccuuaucuaucacaucuagccagaauguauaacggauacgcuggaggauucgaaguaagaguaauucuagcaggaaaugcauucacagcaggcaaaauaauauucgcagcagucccaccgaauuuuccaacagaaggacuaucaccaucccaaguuacaauguucccucacauaauagucgacgucaggcaauuggaacccgucuuaauaccauuaccagauguaagaaauaauuucuaucauuacaaccaaaccaaugauucaacaauaaaauuaauagcaaugcuauauacaccucucagagcaaacaaugccggagaagauguauucacaguuagcugucgaguacuaacuagaccaucaccagauuucgacuuuauauuucuagucccaccaaccguugaaucuagaacaaaacccuucacagucccaauacuaacaguagaagaaaugacaaacucacguuucccaauaccacuagaaaaacuuuucacagguccuucaggagccuucguaguacaaccacaaaacggcagauguacaacagacggaguauuauuagguacaacacaacuauccccagucaauauauguacuuucagaggugauguaacccauauagcaggaucaagaaauuacacaaugaauuuagcauccuuaaauuggaauaauuacgauccaaccgaagaaauaccagcaccacuaggaacaccugacuuuguaggcaaaauacaaggaguauuaacccaaacaacaaaaggagacggaucaacaagaggucauaaagcaaccguauauacaggaucugcaccuuuuacaccaaaauuaggaucaguacaauucucaacagauacugaaaacgacuucgaaacccaccaaaauaccaaauuuacuccuguaggugucauacaagacgguggaacaacccaccgaaaugaaccacaacaauggguccucccuucauauagugguagagacguucauaacguacacuuagccccagcaguagcuccuacuuucccuggagaacaacuacucuuuuuccgaagcacuaugccaggaugcucgggcuauccaaauauggaccuagacugccuucuaccucaagaauggguacaacauuucuaccaagaagcugcucccgcacaaucugacguugcacuacuuagauucguaaacccugacacaggccgaguacuuuuugaauguaaacuacauaaaucaggauauguaacaguagcccacaccggucaacacgaucuuguaauaccaccaaaugguuauuuccgauucgauucuuggguaaaucaauuuuacacauuagcaccaaugggaaauggcaccggaagaagaagagccuuauaa

SEQ ID NO: 30939 - RNA, 1623 nt, Artificial Sequence
  derived and/or modified sequence opt6 from capsid_protein_VP1__Norovirus__AFX81283
augaaaauggcuagcaaugacgcuaauccaucagauggauccgcagcaaacuuaguaccagaaguuagcaacgaaguaauggcacuagaaccaguaguaggagcagcaaucgcagcaccaguagcaggacaacaaaauguuauagacccuuggauaagaaacaauuucguacaagcaccagguggagaauuuaccgucaguccuagaaaugcaccaggagaaauauuaugguccgcaccacuaggcccugacuuaaauccauaccuaagucaucuugcaagaauguauaacggauaugccggaggauucgaaguacaaguuauuuuagcuggcaacgcauuuacagcaggaaaaauaauuuuugccgcaguuccaccaaacuucccaacagaaggccuaaguccaucacaaguaaccauguucccacacauaauaguugacguaagacaacuagaaccaguccucauuccauuaccugauguacgaaacaauuuuuaucacuacaaucaaacaaacgacucuacaaucaaacuaauugcuaugcuauacacaccucuucgagcaaacaaugcaggugaagacguuuuuaccguuucauguagaguacuaacccgucccaguccagauuucgauuuuauauuucuagucccaccaacuguagaaucacgaacuaaaccauucacaguaccuaucuuaacagucgaagaaaugacuaacucuagauuuccuauuccacuagaaaaauuauuuaccgguccaucaggagcauuuguagugcaaccacaaaacggacgauguacaacugacggcguucuuuuaggaacaacucaacucucacccguaaauauauguaccuucagaggagacgucacacauauugccggcucacgaaauuacacaaugaaucuagcaucauuaaacuggaauaauuacgauccuacagaagaaauaccagccccacuagguaccccagauuuuguaggaaaaauucaaggaguucuaacccaaacuacaaaaggagauggcucaacaagaggucauaaagcaacagucuacacaggcucugcaccauuuacaccaaaauuaggcucaguacaauuuucuacagauacagaaaaugacuucgaaacacaucaaaauaccaaauucacaccaguuggaguaauacaagacgguuccacaacacauagaaacgaaccacaacaauggguuuuaccauccuauucaggaagagauguccacaacguacaccuugcacccgccguagcaccuaccuucccuggagaacaauuacuauucuuccgcucuacaaugccagguugcagcggcuacccaaauauggaccuugauugucuacuaccacaagaauggguacaacauuucuaccaagaagcugcucccgcacaaucugacguagcuuuacuaagauucguuaacccugauacaggaagaguacucuucgaaugcaaacuacauaaaucaggauacguuaccguagcacauaccggacaacaugauuuaguaauaccaccaaacggauauuuucgcuuugauucauggguaaaucaauuuuacacucuagcacccaugggaaauggaacaggacgucgccgagcacuauaa

SEQ ID NO: 30940 - RNA, 1623 nt, Artificial Sequence
  derived and/or modified sequence opt6 from capsid_protein_VP1__Norovirus__AFX81289
augaaaauggcaucaaaugacgcaaacccaucagauggaucagcagcaaaucucguaccagaaguaucaaacgaaguaauggcacuagaaccaguaguaggagcagcuauagcagcaccuguagcuggacaacaaaacgucauagauccauggauaagaaauaacuuuguacaagcaccagguggagaauucacuguuuccccucgaaacgcuccuggagaaauauuauggucagcaccucuaggaccggauuuaaauccauacuuaagucacuuagcaagaauguacaacggauaugcaggcgguuucgaaguacaaguaauauuagccggaaaugccuucacagccggaaaaauaauauucgcagcaguacccccaaauuuucccacugaagguuuauccccaucacaagucacaauguuuccacauauaauaguagacguaagacaauuagaaccaguuuuaauaccauuaccagauguccguaacaacuucuaucauuauaaucaaaccaacgacagcacaauaaaacucauugcuauguuauauacaccauuaagagcaaauaacgccggugaagauguauucacagucucaugucgagucuuaacaagaccuucacccgauuuugacuucauauucuuaguaccgccaacaguagaaucacgcacuaaaccuuucacaguaccuauacuuaccguagaagaaaugacaaauucacgauuuccaauucccuuagaaaaacuauucacaggaccuucuggagccuucguaguacaaccacaaaacggucgauguacaacagauggaguauuacuagguacaacacaauuaucacccguaaauauaugcacauucagaggugauguaacacauauagcaggaucaagaaacuauacaaugaacuuagcaucacuaaacuggaauaauuacgauccaacagaagaaauaccagcaccucuuggaacgccagacuucgucgguaaaauacaagguguacuaacucaaacaacuaagggagacggauccacccgaggacacaaagcaaccguauauacaggcagcgcuccuuuuacaccaaaacuuggaucaguacaauuuucaacugauacagaaaacgauuucgaaacgcaccaaaauacaaaauucacuccaguagguguaauucaagacggagguacuacacauagaaaugaaccacaacaauggguuuuaccuucuuauucaggcagagauguacauaacguacaucuagcaccagccguagcacccacauucccaggagaacaacuucuauucuuucgaucuacuaugccagguugcaguggauauccaaauauggaucuagauuguuuacuaccacaagaauggguacaacauuucuaucaagaagcagcacccgcucaaucagaugucgcauuacuacgauucguaaauccggacacaggacgugucuuauuugaaugcaaacuacauaaaucaggauacguuacuguagcacacacaggacaacaugauuuagucauaccaccaaauggcuacuucagauucgauucaugggucaaucaauuuuacacacuagcaccaaugggaaauggaacuggaagaagaagagcacuauaa

SEQ ID NO: 30941 - RNA, 1623 nt, Artificial Sequence
  derived and/or modified sequence opt6 from capsid_protein_VP1__Norovirus__AFX81292
augaaaauggcuucuaaugacgcuaaucccucagacggaucagcagcuaacuuagucccugaaguaucaaacgaaguaauggccuuagaaccuguaguaggugcagcaauagcugcaccaguugccggccaacaaaauguaauugauccauggauuagaaauaauuuuguacaagcaccaggaggcgaauuuacuguuuccccaagaaaugcaccaggagaaauauuauggucagcaccauuaggaccagaucuaaauccauauuuaucacaucuagcacgaauguacaacggauacgcaggagguuucgaaguucaagucauauuagcugguaacgccuucacagcaggaaaaauaauauuugcugcaguuccccccaacuucccaacugaaggacucagucccucucagguaacuauguuuccucacauaauaguagacguucgucaacuugaaccuguacucauaccacuaccagacguccgaaauaauuucuaccacuauaaccaaacaaaugauucaaccauaaaacuuauagcaauguuauauacucccuuaagagcaaacaaugcuggagaagacguuuuuacuguuucuuguagaguauuaacaagaccuuccccagauuuugauuucaucuuccuaguacccccaacuguugaaucuagaacaaaaccauucaccgucccuauuuuaaccguagaagaaaugacuaacucaagauuuccaauuccauuagagaaauuauucaccggaccaucaggugcauucguuguucaaccucaaaacgguagauguacuacagauggcguauuacuaggaacaacucaauuaucaccaguaaauauauguaccuuuagaggagauguaacacauauagcagguucucgaaauuauacaaugaaucuagcaucacuaaauuggaacaacuaugauccaacagaagaaauaccagcaccauuaggaacacccgacuuuguaggaaaaauacaaggagucuuaacucaaacaacaaaaggagacgguagcacaagaggacacaaagcuacuguauauacaggaucagcaccauuuaccccaaaauuaggcuccguacaauucuccacagauacugaaaacgauuuugaaacacaccaaaacacaaaauucacaccaguaggcguuauucaagacggcggaacaacacaucgaaaugaaccacaacaauggguauuaccaucuuauucaggaagagauguacacaacguacacuuagcaccugcaguagcacccacauuuccaggagaacaacuacuauucuuucgaucaacaaugcccggaugcucaggauaucccaauauggaucuagacugcuuauuaccacaagaauggguucaacauuuuuaucaagaagcugcaccagcacaaucagauguugcacuacuaagauuuguaaauccagauaccggaagaguacuauucgaauguaaauuacauaaauccggauacguaacaguagcucauacaggucaacacgaccuaguaauaccacccaacgguuauuuuagauuugauuccuggguaaaccaauuuuauacccuagcacccaugggcaacggaacaggaagaagacgugcacuauaa

SEQ ID NO: 30942 - RNA, 1623 nt, Artificial Sequence
  derived and/or modified sequence opt6 from capsid_protein_VP1__Norovirus__AFX81295
augaaaauggcuucuaaugaugcaaaccccucugacgggucagcagcaaacuuaguaccagaaguaucaaaugaaguaauggcucuugaaccugucgucggagcagcaaucgcugcaccuguagcaggacaacaaaacgucauagauccauggauacgaaauaauuuuguacaggcaccuggaggagaauuuaccguaucaccuagaaaugcaccaggugaaauacucuggucugccccuuuaggaccagacuuaaauccauaucuuucacaucuugcuagaauguauaauggcuaugcaggcggauucgaaguacaagucauucuagcaggaaaugcauucaccgcaggaaaaaucauauuugcugcaguaccacccaauuucccuacagaaggacucucaccaucucaaguuacaauguuuccacauauaauagucgacguacgucaacuagaacccguauuaauaccccuaccagauguaagaaacaauuuuuaccacuacaaccaaacaaaugauucaacaauuaaacucaucgcaaugcuauauacaccuuuaagagcuaacaacgcaggagaagauguauuuaccguauccugcagaguccucacuagaccaagcccugacuucgacuuuauauuucuaguacccccaacaguagaaucaagaacgaaaccuuuuacaguaccaauucuaacgguagaagaaaugacuaauucuagauucccuauacccuuagaaaaauuauuuacuggaccaucaggagcuuucguaguacaaccccaaaauggaagauguacaacagacggcguuuuacuaggcacaacacaauuaucuccaguaaauauaugcacuuuuagaggagacguaacacacauagcuggaucacgaaauuacaccaugaacuuagcuucacuaaacuggaauaauuacgauccaacugaagaaauaccagccccauuaggcacaccugauuuuguagguaaaauacaaggcguauuaacgcaaacaaccaaaggagauggaucaacucgaggacauaaagcaaccguauauacaggauccgcccccuuuacuccuaaacuaggaucaguucaauucuccacugacacagaaaacgauuuugaaacacaucaaaauacaaaauucacuccagucggaguuauacaagacggagguacaacucauagaaaugaaccccaacaauggguucucccaucauauucagguagagauguacauaacguucacuuagcaccagcagucgcaccuacauuuccaggugaacaauuauuauucuuuagaucaacaaugccaggcugcucuggcuacccaaauauggaccuagauugccuacuaccacaagaauggguucaacauuucuaucaagaagcagcaccagcucaaucagacguagcauuacucagauuuguuaacccagauacuggcagaguacuauucgaauguaaauuacauaaaaguggcuauguaacaguagcacacacaggacaacacgaucucgucauaccuccaaauggauauuuuagauucgauucaugggucaaucaauucuacacacuagcuccaaugggaaauggcacuggacgcagacgugcauuauaa

SEQ ID NO: 30943 - RNA, 1623 nt, Artificial Sequence
  derived and/or modified sequence opt6 from capsid_protein_VP1__Norovirus__AFX81298
augaaaauggcaucaaacgacgcaaaccccucagauggaucagcagcuaauuuaguuccagaaguaucuaaugaaguaauggcucuagaaccuguuguuggagcagcaauagcagcaccaguagcaggacaacaaaaugucauugauccauggauucgaaauaauuuuguacaagcuccaggaggagaauucacaguaagccccagaaacgccccaggagaaauauuauggucagcaccauuaggacccgauuuaaauccauaucuaagccauuuagcaagaauguauaacggcuacgcagguggauucgaaguacaaguuauauuagcaggcaaugccuuuacagccgguaaaauaauuuuugcagccguacccccuaacuucccaacagaaggacuuaguccaucacaaguaacuauguucccucauauaauaguagauguaagacaacucgaaccaguauuaauuccacuacccgacguaagaaacaauuuuuaccacuauaaucaaaccaaugauucaaccauaaaacuaauugcaaugcuauauaccccauuaagagccaacaacgcaggagaagauguauuuacaguuucauguagaguucuaacuagaccaucuccagauuuugauuucauauuccuuguccccccaacuguugaaagucgaacaaaacccuucacggucccaauuuuaacaguagaagaaaugacaaauucaagauuucccauacccuuagaaaaacuuuucacagguccaucaggcgcauucguuguacaaccacaaaacggaagaugcaccacagacggaguauuacucggaacaacacaauuauccccgguaaauauauguaccuuuagaggagacguaacacacauagccggaaguagaaacuacacaaugaaucuagcaucacucaauuggaacaauuaugauccaacagaagaaauaccugcaccucuaggaacaccugacuuuguaggcaaaauacaaggaguccuuacacaaacaacuaagggugacggauccacacgcggccauaaagcaacaguuuauaccggaucagcaccauuuacaccaaaacucggaucuguacaauucucgaccgauaccgaaaacgauuucgaaacucaccaaaauacaaaauucacaccaguaggaguuauacaagacggaggaacaacacauagaaaugaaccacaacaaugggucuuacccucguauuccggacgcgacguccauaauguacaucuagcaccagcaguagcaccgacauuucccggagaacaauuacuuuucuucagaaguaccaugccaggaugcucaggauauccaaauauggauuuagacuguuuauuaccacaagaauggguacaacauuucuaucaagaagcagcaccagcacaaucggauguagcccuucuaagauucguuaauccagauacaggaagaguauuauucgaauguaaacuacacaaaaguggauauguaacaguagcucacacaggucagcacgaucucguuauaccaccaaauggauacuuuagauucgauucauggguaaaucaauuuuacacacuugcaccaaugggcaauggcacaggacgaagaagagcacuauaa

SEQ ID NO: 30944 - RNA, 1623 nt, Artificial Sequence
  derived and/or modified sequence opt6 from capsid_protein_VP1__Norovirus__AFX81301
augaaaauggccagcucagaugcaaacccaucagauggaucagcagcaaacuuaguucccgaaguaaacaaugaaguaauggcacuagaaccaguagucggagcagcuauagcugcuccaguagcuggccaacaaaauguaauagacccauggauacgaaauaacuuuguacaagcaccagguggugaauucacuguauccccaagaaacgcuccuggcgaaauuuuauggucagcaccacucgguccugauuuaaacccauaccuaucacaucucgccagaauguauaacggauaugccggaggauuugaaguacaagucauucuagcagguaaugcuuuuaccgccggcaaaauaauauuugcugcagucccaccaaacuucccaacagaaggccuaucuccaucacaaguaaccauguucccacacauuauaguagacguccgacaauuagaaccaguucuaauacccuuaccagauguuagaaauaacuucuaucauuauaaccaaucaaaugacucuaccauaaaauuaaucgccauguuauauacccccuuacgagcaaauaacgccggugaagacguauuuacuguaucuugucgcguauuaacuagaccuucaccagacuucgacuuuauauuuuuagucccaccaacaguagaaucacguacaaaaccauuuacuguaccuauacuuacaguagaagaaaugacaaacucaagauuuccaauaccucucgaaaaauuauucacagguccaucaucagcauucguuguccaaccacaaaacgguagauguacaacagauggaguacuuuuaggaaccacucaauuaucuccuguuaauauauguacauucagaggcgauguaacacacauagccggaucaagaaauuauacuaugaaucuagccucacuaaacuggaacaauuacgauccuacagaagaaaucccugcgccacuaggaacaccagacuuuguagguaaaauacaaggaguauuaacacaaacaacuaaaggagacggcucgacucgcggacacaaagcaacuguauauacaggaucagcuccauuuacaccaaaauuaggaaguguccaauucucuacagauacagaaaacgauuucgaaacacaccaaaacaccaaauuuacaccaguaggcguaauucaagacggaucuacaacacauagaaaugaaccacaacaauggguacuaccaucauauucaggaagaaauguaccaaauguacaccuugcaccagcaguugcaccaacauuccccggcgaacaguuauuauucuucagaucaacuaugccuggaugcuccggauauccaaauauggaucucgacugcuuacuaccacaagaauggguacaacacuuuuaucaagaagcagcacccgcucaaucagauguagcccuauuaagauucguaaauccagauacaggcagaguacuauucgaaugcaaauuacacaaaucaggauauguaacugucgcacacacaggacaacaugaccuaguaauaccaccuaaugguuacuucagauuugauucuugggugaaccaauuuuacacucuagcuccaauggguaauggaacaggaagacgacgugcauuauaa

SEQ ID NO: 30945 - RNA, 1623 nt, Artificial Sequence
  derived and/or modified sequence opt6 from capsid_protein_VP1__Norovirus__AFX81304
augaaaauggcauccaaugacgcaaacccaucagacgguucagcagcaaaucuuguaccagaaguaucuaaugaaguaauggcccuagaaccaguuguaggagcagcaauagccgcuccaguagcaggccaacaaaauguaauagacccuuggauacgaaacaacuucguucaagcaccaggaggagaauuuacaguaucaccucgaaaugcaccuggagaaauauuauggucugccccacuagguccagauuuaaauccuuacuuaucccaucuagcaagaauguauaacggauaugcaggagguuuugaaguacaaguaaucuuagccgguaaugcauucacagcugguaaaauaauauucgcagcaguacccccaaacuuuccuacagaaggucuaagccccucucaaguaacuauguuuccccauauaauaguagacguuagacaacucgaacccguauuaauuccacuuccagauguacgaaauaacuucuaucauuauaaccaaacaaaugacucaacuauaaaauuaauagcaaugcuauauacaccccuaagagccaauaaugcaggagaagauguauuuacuguaagcugucgcguacuaacccgaccaucaccugacuucgauuuuauauuucuaguaccaccaacaguagaaucccgaacuaaaccauucaccgucccaauacucacaguugaagaaaugacaaacucacgcuuuccuauaccauuagaaaaacuauucacaggaccaucuggagcauuuguuguacaaccacaaaacggaagauguacaacagauggaguccuauuaggaacaacccaacuaucuccaguaaacauauguacauuuaggggugacguaacccacauagcagguucaagaaauuacaccaugaaucuugcaagucucaauuggaacaauuaugaucccaccgaagaaaucccagccccacuaggaacaccagacuucguuggaaaaauccaaggaguauuaacucaaacaacaaaaggagacggaucaacgagaggacacaaagcaacuguuuauacaggaucagcaccauuuacacccaaauuaggaucaguacaauucucaacagauacagaaaaugauuucgaaacacaucaaaauacaaaauuuaccccuguaggagucauacaagauggaggaacaacacacagaaaugaaccacaacaauggguucucccaucauauucaggaagagauguccacaauguucauuuagcaccggcaguugcuccaacauuuccaggagaacaauuacuuuuuuuuagaucaacaaugccaggaugcaguggauauccaaauauggaucuagauuguuuacuaccacaagaauggguucaacauuucuaucaagaagccgcaccagcacagucagauguagcccuucuuagauuuguaaacccugacaccggaagaguauuauucgaauguaaacuacacaaaucaggauacguaacaguugcacauacaggccaacacgauuuagucauaccacccaauggauacuuuagauuugauuccuggguaaaucaauucuauacacuugcaccaaugggaaauggcacaggcagaagaagagcuuuauaa

SEQ ID NO: 30946 - RNA, 1623 nt, Artificial Sequence
  derived and/or modified sequence opt6 from capsid_protein_VP1__Norovirus__AFX81307
augaaaauggcaucaaaugaugcaaauccaucagacggcuccgcugcaaacuuaguaccagaaguaucaaaugaaguaauggcacuagagccaguagucggagccgcaauagcagcaccaguugcaggacaacaaaauguaauugaucccuggauuagaaauaacuucguacaagcaccaggaggagaauucacugucucaccaagaaacgccccaggagaaauauuauggucugccccacuaggaccagaucucaauccuuaccuuucacacuuagcuagaauguauaacggauacgcaggaggcuuugaaguucaaguaauacuagcaggaaaugcauuuacagcugguaaaauaauauuugccgcgguacccccaaacuuuccaacugaaggacuaucuccaucacaaguuaccauguucccucacauaauaguagacguuagacaauuagaaccaguacuuaucccauuaccagauguacgcaauaauuucuaucauuauaaucaaacaaacgauucaacaauaaaacuaauagccauguuguauacuccacuacgcgcaaacaaugcaggcgaagacguauucacagucucauguagaguauuaacuagaccaagcccagacuuugacuuuauauuucuaguacccccaacaguugaaucacgaacaaaaccuuuuacaguaccaauuuuaacaguagaagaaaugacaaauaguagauuuccaauaccacuagaaaaacucuuuacaggaccaucaggagcauucguaguacaaccucaaaacgguagaugcacaacagacgguguucuucuaggaacaacacaauugucaccgguaaauauaugcaccuuuagaggagauguaacucauauagccggaucaagaaauuauacaaugaacuuagcaucacuuaacuggaacaauuaugauccaaccgaagaaauaccagcaccacuaggaaccccugacuuuguaggaaaaauucaaggaguacucacacaaacuacaaaaggagacggauccacccgaggccacaaagcaacaguuuacaccgguucugcaccuuucacaccaaaauuaggaucaguccaauucucaacagauacagaaaacgauuuugaaacacaucaaaauaccaaauucacuccaguaggaguuauacaagacggcggaacaacacaucgaaaugaaccacaacaauggguacuaccuuccuauucaggaagagacguccacaacguccauuuagccccagcagucgcuccaacauuuccaggugaacaacuauuauuuuucagaucaacaaugccagguuguucaggauaucccaacauggaccuagauugccuacuaccacaagaauggguccaacauuucuaucaagaagcagccccugcacaaucagacguagcacuacugagauuuguuaauccagacacuggaagagucuuauuugaaugcaaacuacauaaaucaggcuauguaaccguagcucauacaggacaacaugaucucguaauuccaccaaacgguuacuucagauucgauuccuggguaaaucaauuuuauacccuagcacccaugggcaacgguacaggacgacgaagagcucuauaa

SEQ ID NO: 30947 - RNA, 1623 nt, Artificial Sequence
  derived and/or modified sequence opt6 from capsid_protein_VP1__Norovirus__AFX81313
augaaaauggcaaguaaugaugcaaacccaagugauggaucagccgcuaauuuaguaccagaaguaucaaaugaaguaauggcauuagaaccuguugucggagcagccaucgcugcuccuguugcaggacaacaaaauguuauagauccauggauaagaaauaauuuuguacaagcaccaggcggagaauuuacuguauccccacgaaaugcuccuggcgaaauacuauggucagcaccucuuggaccagaucuuaauccauaccuaucacauuuagcaagaauguacaaugguuaugcaggagguuuugaaguacaagucauacuagcaggaaaugcauucacagcaggaaaaauaauauucgccgcaguaccaccuaauuuuccaaccgaaggacuaucaccaucacaaguaacaauguuuccacauauaauaguagauguuagacaauuagaaccuguauugaucccuuuaccagauguuagaaauaauuuuuaucauuauaaccaaacuaaugacucaacaauaaaacuaaucgcuauguuauacacuccacuaagagcaaauaaugcaggagaagauguauuuacuguaucauguagaguauuaacucguccaucuccugauuuugauuuuaucuucuuaguucccccuacaguugaaucucgaacuaaaccauuuacugucccaauuuuaacagucgaagaaaugaccaacucuagauucccaauuccacuugaaaaacuauuuacaggaccaucaggagcauucguaguacaaccccaaaacggcagauguaccacugauggcguauuacuaggaacaacacaacuauccccaguaaauauauguacauucagaggugaugucacacacauagcuggcucucgaaauuacacaaugaacuuagcaucauuaaauuggaauaauuaugacccaacagaagaaauaccugcaccacuaggaacaccagacuuuguaggaaaaauucaaggaguacuaacacaaacaacaaaaggugacggcucaacacgcggacauaaagcaacuguauauacaggcuccgcaccauuuacaccaaaacuagguucaguacaguuuucuacagauacagaaaaugacuuugaaacacaucaaaauacaaaauucacacccguuggaguaauacaagacggcggcacaacacacagaaaugaaccccaacaauggguauuacccucauacuccggacgcgacguucacaauguccacuuagccccugcaguugcaccaacguuucccggagaacaacucuuauucuuuagauccacaaugccaggcugcucuggauauccaaauauggaucuagacuguuuauuaccccaagaauggguacaacauuuuuaccaagaagcagcaccugcucaaucugauguagcuuuauuaagauucguaaauccagacacaggaagaguacucuucgaauguaaauuacauaaaucuggauauguaacaguagcucacaccggacaacaugauuuaguaaucccaccaaaugguuauuuuagauuugauuccuggguaaaucaguuuuacacucuagcaccuaugggaaaugguacaggaagacgaagagcacuauaa

SEQ ID NO: 30948 - RNA, 1623 nt, Artificial Sequence
  derived and/or modified sequence opt6 from capsid_protein_VP1__Norovirus__AFX81316
augaagauggccucaaaugacgcaaacccaagugauggaucagcagcaaauuuaguaccagaaguuucaaaugaaguaauggcacuagaaccagucguaggcgcagcaauagcugcaccagucgcuggacaacaaaauguuaucgaccccuggauaagaaauaacuucguacaagcaccaggaggugaauuuacuguaucuccaaggaaugcaccaggcgaaauccuauggucugcuccuuuaggcccagaucuaaacccauaucuaucacacuuagcaagaauguauaaugguuacgcaggaggauucgaaguacaaguaauauuagcuggaaacgcauucacagcaggaaaaauaauauucgcugcuguaccaccaaacuuuccaacagaaggacuaucaccaagucaaguuaccauguucccacacauaauagucgauguuagacaauuagaaccaguuuuaaucccauuaccagauguuagaaacaauuuuuaucacuauaaccaaacaaaugacucaacaauaaaauuaauagccaugcucuauacaccacucagagcaaacaaugcaggagaagauguuuuuacagucuccugcagaguauuaacuagaccaucaccugauuuugauuuuauauuucuaguaccaccuacaguugagucucgcacaaaaccauucacuguaccaauacuuaccguagaagaaaugacuaacucaagauuuccgauaccacuagaaaaacuauucacaggaccaucuggagcuuuuguaguacaaccacaaaacggaagauguacaacagaugguguacuauuaggaacaacacagcuuucaccuguaaauauauguacauuuagaggagacguaacacauauagccgguuccagaaauuauacuaugaaccuugcaucacuaaauuggaauaauuacgauccaacugaagaaauucccgccccacucggaacaccagacuuuguaggcaaaauccaaggaguauuaacacaaacuacaaaaggagauggaucuacuagaggucacaaagcuacuguauauacagguucagcaccauuuacaccuaaacuaggaucaguccaauucucaaccgauacagaaaaugauuuugaaacacaucaaaauacaaaauuuacuccgguuggaguaauacaagauggaggaacaacucaucguaacgaaccacaacaauggguuuuaccgucauacucugguagggauguacacaacguccaucuugccccugcaguagcaccaacauuuccaggagaacaacuacuauucuuuagaaguaccaugccaggcuguuccggcuauccuaauauggaccuagauuguuuacuaccacaagaauggguacaacauuuuuaucaagaagcagcaccagcacaaucagacgucgcucuuuuacgauucguaaacccugacacuggccgaguauuauucgaauguaaacuacacaaaucaggauauguaacuguagcacacacaggacaacacgaucucgucauuccaccaaaugguuauuucagauucgauuccugggucaaucaauuuuauacacuagcuccaaugggaaauggaacaggaagaagaagagcacuauaa

SEQ ID NO: 30949 - RNA, 1623 nt, Artificial Sequence
  derived and/or modified sequence opt6 from capsid_protein_VP1__Norovirus__AFX81319
augaaaauggcaucaaacgaugcaaauccaagugauggaucagcugcaaaccuaguaccggaaguuucaaaugaaguuauggcccuagaaccaguaguaggagcagcaauagcugcuccaguagcaggacaacaaaauguuauagaucccuggauacgaaauaacuucguacaagcaccaggaggugaauuuaccguaucaccaagaaaugcacccggagaaauccuauggagugccccauuaggaccagaucuaaaucccuauuuaucccauuuagcacgcauguauaacggauaugcaggcggauuugaaguacaaguaauucuagccggcaacgcauuuacagcaggaaaaauuauauuugcagcaguacccccaaauuucccuacagaaggauuaucaccuucacaaguaacaauguucccucacauaauaguugacguaagacaacuugaacccguccuaauaccauuaccagacgucagaaacaauuucuaccauuacaaccaaacaaaugauucaacuauaaaacuaauagcaauguuauauaccccauuacgugcuaauaaugcgggagaagauguauucacaguaagcugccguguacucacaagacccaguccagauuuugacuuuauauuuuuaguaccaccaacaguugaaucuagaacaaaaccauuuacaguaccaauacuaacaguagaagaaaugacaaacucaagauuccccaucccacuugaaaaacuauucacaggaccaucaggcgcauucguaguacaaccccaaaauggaagaugcacaacagauggaguacuacucgguacaacacaauuaaguccaguaaauauaugcacauuuagaggagauguaacacauauagcaggaucccgaaauuauacaaugaaucuagcaucuuuaaauuggaacaauuaugauccuaccgaagaaauaccugcaccacuaggaacaccugauuuuguaggaaaaauacaaggagucuuaacacaaaccacuaaaggugacggcucaacaagaggacauaaagccacaguauauacuggauccgccccauuuacuccaaaauuaggaucuguacaauucuccaccgacacagaaaacgauuucgaaacacaucaaaauacaaaguuuacaccaguuggcguaauacaagauggagguacaacccaucgaaaugaaccccaacaauggguauuacccucauacucaggaagagauguacauaacguacaucuagcaccagcagucgcaccaacauuuccaggagaacaacuacuguuuuucagaucuacaaugccaggaugcuccggauacccaaauauggacuuagauugccuuuuaccacaagaauggguacaacauuucuaucaagaagcagcuccagcacaaagugacguagcucuacuaagauuugucaaucccgauaccggcagaguauuauuugaaugcaaacuacauaaaucaggauauguaacuguugcucauacaggucaacacgauuuaguaauccccccaaauggauacuuccgauuugauucauggguaaaucaauucuacacacucgcuccaaugggaaauggaacaggccguagaagagcauuauaa

SEQ ID NO: 30950 - RNA, 1623 nt, Artificial Sequence
  derived and/or modified sequence opt6 from capsid_protein_VP1__Norovirus__AFX81322
augaaaauggccucaaacgacgcaaaccccuccgacggaucugcagccaaccuaguaccagaaguaucaaaugaagucauggcacucgaaccaguuguaggugccgcuaucgcagcaccuguagcaggucaacaaaaugucauugacccuuggauaagaaauaacuuuguacaagcuccaggaggugaauuuacagugucuccaagaaacgcuccaggcgaaauauuauggucagcaccacucggaccagaucuaaaucccuauuuaucucacuuagccagaauguacaauggauacgcaggugguuuugaaguucaagucauauuagccggcaaugcuuucacugcagguaaaauaauauuugcagcaguaccaccaaacuuucccaccgaaggacuaucaccaucacaaguaaccauguucccucauauuauaguagauguaagacaauuagaaccuguauuaauuccauuaccugauguaagaaacaauuuuuaucacuauaaccaaacuaaugauucaacaauaaaacuaauagcaaugcuuuauacaccacuucgagcaaacaacgcaggagaagauguauuuacaguaucuuguagaguuuuaacuagaccaagcccugauuucgacuuuauauuucuaguuccuccuacaguagaaagcagaacuaaaccauucacaguaccuauacuaacaguagaagaaaugacaaauagucgauuuccaauacccuuagaaaaacuauuuacaggucccucaggugcauucguaguccaaccucaaaauggcagauguacaacugacggaguccuucuaggaacaacucaauuaucaccaguaaacauauguaccuuccgaggggauguuacacauauagcaggaucacgaaauuauacaaugaaucuagcaucacuaaauuggaauaacuacgaucccacugaagaaauaccugcaccauuaggaacaccagauuuuguaggaaaaauucaaggagucuuaacacaaacaacaaaaggagacgguucaacacguggacauaaagccacagucuacacagguucagcaccauuuacaccaaaauuaggaucaguacaauuuucuacagauacagaaaacgauuuugaaacacaucaaaacacuaaauuuacaccagucggagucauccaagacggaggaaccacacaccguaacgaaccacaacaauggguauuaccuucauauucaggaagagacguacauaauguacacuuagccccagcaguagccccaacauuuccaggagaacaauuauuauuuuuuagaucuacaaugccagguugcucaggauauccaaauauggaucuagacuguuuacuuccucaagaauggguacaacauuucuaccaagaagcagcucccgcacaaucagacguagcuuuauuacgauuuguaaauccagauacuggaagaguacuauucgaaugcaaacuacacaaaucuggauacguaacagucgcacauacuggacaacaugaccuuguaauuccaccuaauggcuauuuucguuucgacagcuggguaaaucaauuuuauacacuagcaccaaugggaaaugguacuggaagaagaagagcucuuuaa

SEQ ID NO: 30951 - RNA, 1623 nt, Artificial Sequence
  derived and/or modified sequence opt6 from capsid_protein_VP1__Norovirus__AFX81325
augaaaauggccuccaacgacgccaauccauccgauggaucagcagcaaacuuaguaccagaagucuccaaugaaguaauggcucuugaacccguagucggagcagcaauagcugcacccguagcaggacaacaaaacguuaucgaccccuggauuagaaacaacuucguucaagcaccaggcggugaauuuacaguuuccccacgcaaugcaccuggagaaauacuauggucagcaccucuaggaccagacuuaaauccauaucuuucacaucuugcaagaauguacaacggauaugccggagguuuugaaguucaagucauacuagcaggaaaugccuucacagcuggaaaaaucauauuugcagcaguaccacccaauuuuccaacugaaggacuuucaccaucacaaguuacaauguuuccacacauaauaguagaugucagacaauuagaaccaguacuaauacccuuacccgacguuagaaacaacuuuuaucacuacaaucaaacaaacgauucaacuauaaaacuaauagcuaugcuauacacaccauuacgagcaaacaaugcaggagaagacguauuuacaguaucaugcagaguacuaacaagaccaucaccugauuuugauuuuauauuuuuaguaccacccacuguugaaucaagaaccaaaccauuuacaguuccuauacuaacaguugaagaaaugaccaacucaagauuuccaauaccauuggaaaaauuauuuacuggacccucaggagcuuucgucguacaaccucaaaauggaagauguacaacagacggaguacuauuaggcacaacucaacucuccccaguuaauauuugcacauuuagaggcgacguaacacauaucgcugguucaagaaauuacacuaugaaucuagcaagucuaaacuggaacaauuacgacccaacugaagaaauacccgccccccuaggcacaccagacuuuguagguaaaauccaagguguacuaacacaaacaacaaaaggagauggcucgacacgaggacacaaagcaacaguuuauacaggauccgcucccuuuacaccaaaauuagguucaguucaauucucaacagauaccgaaaaugauuucgaaacacaucaaaacaccaaauuuacacccguuggagucauucaagacggaggaacuacccauagaaaugaaccccaacaaugggucuuaccaagcuacucagguagagauguccacaacguccaucuugcuccugcaguagcacccacauuuccaggagaacaauuacuauucuuuagaucaacaaugccuggauguaguggauauccaaauauggauuuagauugccuauuaccucaagaauggguacaacauuucuaucaagaagcagcaccagcacaaucagacguagcauuacuaagauucguaaauccugacacaggaagaguacuauuugaauguaaacuccacaaaucuggauauguaacagucgcacauacaggccaacacgaccuuguuauaccuccaaacggauacuucagauucgauucaugggucaaccaauuuuauacacuagcuccaaugggaaauggaacaggacgucgcagagcacuuuaa

SEQ ID NO: 30952 - RNA, 1623 nt, Artificial Sequence
  derived and/or modified sequence opt6 from capsid_protein_VP1__Norovirus__AGE89433
augaaaauggcuagcaaugacgcaaacccuucagaugguucagcagcuaacuuagucccagaagucucaaaugaaguuauggcauuagaaccagucguaggugcagcaauagcagcaccaguagcuggccaacaaaauguaauagacccuuggauuagaaacaauuucguucaagcuccaggaggagaauucaccguaucaccuagaaacgcaccaggggaaauauuauggucagccccacuaggaccagaccuaaacccauauuuaagucacuuagcuagaauguauaacggauacgcaggaggauucgaaguacaagucauuuuagccggcaaugcauucacagcaggcaaaauaauauuugcugcaguaccaccaaacuucccaacagaaggauuaucuccaucacaaguaaccauguuuccccacauaauaguugacguuagacaacuugaaccaguacuaaucccacuacccgaugucagaaacaauuuuuaccauuacaaucaaacaaacgacucuacaauaaaacuaauagcaaugcuauacacaccacuaagggcaaacaaugcaggggaagaugucuuuaccguauccugucguguacucacaagaccauccccggacuucgacuuuauuuuucucguuccacccacaguagaaucacgaacuaaaccauuuacuguaccaauacuuacaguagaagaaaugacaaauuccagauuuccaauaccucucgaaaaacuuuuuacaggaccuucaggcgcuuucguaguacaaccucaaaauggaagauguaccacugauggaguauuauuaggaacaacacaacuaucaccaguaaauauauguaccuuuagaggagauguuacacauauagcagguucacguaacuacacuaugaaccuagcaucacucaacuggaacaauuacgacccaacagaagaaauuccugcaccacuugguacaccagacuuuguaggaaaaauucaaggaguacuaacacaaacaacuaaaggagacggaaguacacgaggacacaaagcaacaguauauacaggaucagcuccauucacaccaaaauuaggcucuguacaauucucaacagacacagaaaaugauuucgaaacacaucaaaacacaaaauucacaccuguaggaguaauccaagacggaggcacaacccauagaaaugaaccucaacaauggguuuuaccauccuauucaggucgcgauguacacaacguacaccuagccccagcuguagcuccaacuuuuccaggugaacaauuacucuuuuuuagaucaaccaugccagguuguucuggauauccaaacauggacuuagauugcuuauuaccccaagaauggguacaacauuuuuaucaagaagcagcaccagcacaaucagacguagcauuacuacgauucguaaauccugacacuggacgaguacuuuuugaaugcaaacuucacaaauccggauacguuaccguagcacacaccggacaacacgaucuaguaauacccccaaacggauauuuucgauucgauucaugggucaaucaauucuauacacucgcaccuaugggaaauggaaccggacgacgaagagcacuauga

SEQ ID NO: 30953 - RNA, 1623 nt, Artificial Sequence
  derived and/or modified sequence opt6 from capsid_protein_VP1__Norovirus__AGE89436
augaaaauggcauccaaugaugcaaacccaucagaugguucugcagcaaacuuaguacccgaaguaucaaaugaaguuauggcacucgaaccagucguaggugcagcuauagccgcacccguagcaggccaacaaaauguaaucgacccauggaucagaaauaacuuuguacaagcaccuggaggcgaauucacaguuucacccagaaaugcaccaggugaaauacuauggucugcuccacuaggaccagaucuuaauccauaccuaucucacuuagcccgaauguacaaugguuaugcaggaggauucgaaguacaagucauacuagccggaaaugcauucaccgccggaaaaauaauauucgcugcaguaccaccuaacuucccaacagaaggacuaucaccaucacaaguaacaauguucccacauauaauuguagauguaagacaauuagaacccguucuaauuccacuaccagacguaagaaauaauuuuuaucacuauaaucaaacaaaugacaguacuauaaaauuaauagcaaugcucuauacaccauugagagcaaacaacgccggugaagacguauucacaguaagcugcagaguccuaacgcgcccaucccccgacuuugauuuuauauucuuaguaccaccaaccgucgaaucucgaacaaaaccauucacaguaccaauauuaacaguagaagaaaugacuaauucuagauuuccaauaccauuagaaaaauuauuuacaggcccaucuggcgcauuuguaguacaaccucaaaauggacgaugcaccacagacgguguacuuuuaggaacuacucaauuaucgccuguaaauauauguacauuucgaggagauguaacacacauugcuggaucacgcaacuacacaaugaaccuagccucuuuaaauuggaauaauuaugauccaacagaagaaauaccagcuccacuaggaaccccagauuuugucggaaaaauacaaggaguccuaacucaaacaacaaaaggagacggaucaacaagaggacacaaagcaacaguauauacaggaucugcaccauuuacaccaaaacuaggauccguccaauucuccacagauacagaaaaugauuucgaaacacaucaaaauaccaaauucacuccaguaggaguaauccaagauggaggaacaacccauagaaaugaaccucaacaauggguccuaccauccuauucuggucgugauguacauaauguucauuuagcaccagccguagcaccuacuuuuccaggagaacaauuacuuuucuuccgaucuacaaugccaggauguagcggauauccaaacauggaucuagacuguuuacucccacaagaauggguacaacacuucuaucaagaagcagcaccagcacaauccgaugucgcucuccucagauucguaaaccccgacacaggacgagucuuauucgaauguaaauuacauaaaucugguuauguaacagucgcucauacaggacaacacgauuuaguuauaccacccaauggauauuuuagauucgacucuuggguaaaccaauuuuauacacuagccccaaugggaaauggcacaggacguagaagagcauuauaa

SEQ ID NO: 30954 - RNA, 1623 nt, Artificial Sequence
  derived and/or modified sequence opt6 from capsid_protein_VP1__Norovirus__AGE89439
augaaaauggcauccucagacgcaaacccaucagacggaucaaccgcaaaccuaguaccagaaguaaacaaugaaguaauggcacuagaaccaguaguuggagcagcaauagccgccccagucgcuggucaacaaaaugucauagacccauggauuagaaacaacuucguacaagcaccaggcggagaauucacuguaucaccaagaaacgcaccaggagaaauacuauggucugcuccucuagguccugaucuaaacccauaucuaucacaccuagcaagaauguauaacggcuacgcaggagguuucgaaguucaaguuauccuugcaggaaacgccuuuacagcuggaaaaauaauauuugcagcuguucccccaaauuuucccacagaaggacuaucaccuucucaaguaacaauguuuccacacauaauaguagacguacgccaacucgaacccguacuaauaccauuaccagauguaagaaauaauuuuuaucacuacaaucaaucaaacgacccaacaauaaaacuaauagcaauguuauacacaccacuacgagcaaacaaugcuggagaugauguauuuaccgucucauguagaguacuaacucguccaucaccagacuucgacuuuauauuucucguacccccaaccguagaauccagaaccaaaccauuuucugucccagucuuaacuguagaagaaaugacuaauucaagauucccuauaccauuagaaaaauuauuuacagguccaucaucagcauuuguaguacaaccucaaaacggaagauguacaacagacggaguauuauuaggaacuacccaacuaucaccaguuaauauuuguacauuucgaggagacguaacacacauaccagguucaagaaacuacaccaugaaucuagcaucacaaaauuggaauucauacgaccccaccgaagaaauaccagccccacuaggaacuccagacuuuguuggaaaaauacaaggaguacuaacacaaacaacacggacuaacggaucuacaagaggucacaaagcaacugucuauacuggaucagcagauuuuucaccuaaauuaggaagaguacaauucgcaacugacacagauaaugauuuugaaacaaaccaaaauacaaaauucacaccuguaggagucauccaagacggcucaacuacaccuagaaaugaaccacaacaauggguacuaccaucuuacucaggaagaaacauacacaacguccacuuagcaccugcuguagcaccuacauuuccaggcgaacaauuauuauucuuuagaucaacuaugccaggaugcucaggauacccaaauauggaccuagauugucuucuuccacaagaguggguacaauauuuuuaucaagaagcagcaccagcacaaucagauguagcucuauuaagauuuguuaauccagacacaggacgaguccuauuugaauguaaauuacauaaaucuggauauguuaccguugcccacacaggacaacacgauuuaguaauuccucccaauggauauuucagauuugauagcuggguaaaucaauucuacacauuagcuccaauggguaacggcacaggccgacgacgagcguuauaa

SEQ ID NO: 30955 - RNA, 1623 nt, Artificial Sequence
  derived and/or modified sequence opt6 from capsid_protein_VP1__Norovirus__AGE89442
augaaaauggcaucaucugaugcaaauccuuccgauggaucuacagccaacuuaguaccagaaguuaacaaugaaguaauggcacuagaaccaguuguaggagcagcuauugcagcaccagucgcuggucaacaaaacgucauagacccuuggauacgcucaaacuuuguacaagcaccaggaggagaauucacaguaucaccacguaaugcaccuggugaaauauuauggucagcaccauuaggaccugacuuaaauccauauuuaucacacuuagcacgaauguauaacggauacgcuggagguuuugaaguccaagucauauuagcaggaaaugcuuuuacagcaggaaaaaucauauuugcagcagucccaccuaacuuuccuacugaaggauuaucacccucucaaguuacaauguuuccccacauaauaguagacguacgucaacuagaaccaguccuaauucccuuaccagaugucagaaacaauuucuaucacuauaaucaaucuaacgacccaacuaucaaauuaauagcaauguuauauacaccucuuagagcaaacaacgcaggagaugauguauuuacagucucaugucgaguauuaacaagaccuucuccagacuuugacuucauauuuuuaguuccaccaacaguagaaucuagaacaaaaccuuuuuccguaccaguucuaacaguagaagaaaugacaaacagcagauuucccauaccacuagaaaaauuauucacaggaccaucauccgcauuuguaguccaaccucaaaacggacguuguaccacagacggaguucuucuaggaaccacucaauuaucaccaguaaacauauguacauuucgaggcgacguuacacauauaccagggucuagaaauuauacaaugaaccuagcuucucaaaauuggaacucuuacgacccaacugaagaaauaccagcaccauuaggaacaccagacuucguaggaaaaauacaaggcgucuuaacacaaacaacaagaacagacggcucaacaagaggucacaaagcgacgguauacaccggaucagcggauuucucuccuaaauuaggaagaguacaauuugcuacagauacagacaacgauuuugaaacaaaucaaaauaccaaauucacuccaguaggcgucauacaagauggauccacaacacauagaaaugaaccucaacaauggguacuaccuaguuacagcgguagagauguacauaauguacacuuagcaccagcaguagcuccaacauuuccaggugagcaauuacuauuuuucagaucuacaaugccagguuguucuggauauccaaauauggaucucgacugcuuacuuccucaagaauggguacaauauuuuuaucaagaggcagcaccagcacaaucugacguugcacuauuaagauucguaaauccagauaccggaagaguacuauucgaaugcaaacuacauaaaucaggauauguaacaguagcacauacuggacaacacgaucuaguaaucccacccaauggauacuuucgauuugacucauggguaaaucaauuuuacacauuagccccuauggguaauggcaccggaagacgacgagcauuauaa

SEQ ID NO: 30956 - RNA, 1623 nt, Artificial Sequence
  derived and/or modified sequence opt6 from capsid_protein_VP1__Norovirus__AGE89445
augaaaauggccucuuccgacgccaauccuucugaugguucaaccgccaauuuagucccugaaguuaauaaugaaguuauggcacuagaaccuguagucggcgcugcuauagcagcuccaguagccggacaacaaaauguaauagauccauggauacgcucaaauuuuguccaagccccaggcggagaauucacagucucaccaagaaaugcaccaggcgaaauauuauggucagcaccacuaggacccgauuuaaaccccuaucuuucacacuuagcaagaauguauaacggauaugccggaggauuugaaguacaaguuauacuagcuggaaacgcauucacagcagguaaaauaauuuucgcugccguaccaccaaacuuuccaacagagggacuaucaccaucucaaguaacuauguucccacauauaauaguagauguaagacaacuugaacccguauuaauaccacuaccagauguacgaaacaacuuuuaucauuauaaucaaucaaaugauccaaccauuaaauuaauagccaugcuauauacaccacuuagagcaaauaaugcaggagaugauguauuuacaguaucaugucgaguacuuacucgcccaucacccgauuuugauuuuauauuucuaguaccaccaacaguagagucuagaacaaaaccauucucaguaccagucuuaacaguagaagaaaugacaaacucaagauuuccaauaccgcuagaaaaacuauuuacaggaccaucauccgcauuuguuguacaaccacaaaacggacgauguaccacugacgguguccucuuagguacaacucaauuaucaccaguuaauauaugcacauuucgcggagacguaacacauauuccuggaagcagaaauuauacaaugaacuuagcaucacaaaauuggaauucauacgauccaacugaagaaauaccugcuccauuaggaacaccagauuuuguugguaaaauacaaggaguauuaacucaaacaacacgaacuaacggaucuacacguggacauaaagcaacaguauauacaggaagcgcagacuucucuccaaaacuaggaagaguucaauuugcaacagacacugauaaugacuuugaaacaaaucaaaauacuaaauuuacaccaguaggaguaauacaagauggaucaacuacaccucggaacgaaccgcaacaauggguacuaccuucauauagcgguagaaacauccauaauguacauuuagcaccagcuguagccccaacauuuccaggugaacaauuauuguuuuuuagaaguacuaugccaggauguucaggauauccaaacauggauuuagacuguuuauugccacaagaauggguucaauauuuuuaucaagaagcugcaccagcacaaucugacguagcacuauuaagauucguuaauccugauaccggaagaguauuauuugaaugcaaacuucauaaaucagguuacguaacuguagcucauacaggccaacacgacuuaguuauuccaccaaaugguuauuuccgauuugauuccuggguaaaucaauuuuacacacuggcaccuaugggaaaugguacaggccgacgaagagcacuauaa

SEQ ID NO: 30957 - RNA, 1623 nt, Artificial Sequence
  derived and/or modified sequence opt6 from capsid_protein_VP1__Norovirus__AGE89448
augaaaauggcaucaucagacgcaaauccaucagauggaaguacagccaaccuaguaccagaaguaaauaaugaaguaauggcacuugaaccaguaguaggugcugcaauagcagcaccaguagcaggacaacaaaacguuauagacccauggaucagaaauaauuuuguacaagcccccggaggagaauuuacaguaagcccacguaacgcaccaggugaaauacucuggucugcaccacuaggaccagacuuaaauccauauuuaucacauuuagcacgaauguauaacgguuaugcugguggauuugaaguacaaguaauauuagcaggaaacgccuuuacagcaggcaaaauaauauucgcggcaguacccccaaauuucccaacugaaggucuaucaccaagccaaguuacgauguucccacacauaauaguagacguaagacaacuagaaccuguucucauaccccuaccagacgucagaaauaauuuuuaucacuauaaccaaagcaaugaucccacaauaaaacuaauagcaaugcuauauacaccacuaagagccaauaaugcaggugaugauguauucacaguaucaugucgagucuuaacaagaccuuccccagauuuugacuuuauauuccuaguaccaccaacaguagaaucacgaacaaaaccauuuucaguaccaguacuaaccguagaagaaaugacuaacucaagauuuccaauaccuuuagaaaaauuauuuaccggacccucaucugcauucguaguucaaccccaaaacggacgcuguacaaccgaugguguucuucuuggaacaacccaauuaucaccagucaacaucugcacauuuaggggagacgucacccauaucccaggaucaagaaauuacacuaugaacuuagcaucacaaaacuggaauaguuacgauccaaccgaagaaauaccagcuccacuaggcacaccagacuuuguuggaaaaauucaaggagucuuaacucaaacaacaagaacaaacggaucaacaagaggucauaaagcaacaguauauacaggcucagcagauuucuccccuaaacuuggaagaguccaguucgcgacagauaccgauaaugauuucgaaacaaaucaaaauacaaaauucacucccgucggaguaauacaagacggcucuacuacaccaagaaacgaaccacaacaauggguacuaccaaguuacucaggaagaaacauacacaacguucaucuagcaccagcaguagcacccaccuuccccggagaacaacuuuuauucuuuagaucaacaaugcccgguugcucuggauauccaaauauggaucuagauuguuuauuaccacaagaauggguacaauauuucuaucaagaagcagcaccugcccaaucagacguagcacuccuaagauucgucaaccccgauacagguagaguauuauuugaaugcaaauuacauaaaucaggauauguuaccguagcacacacuggacaacacgaucuaguuauccccccaaacggauauuucagauuugacucauggguuaaucaauuuuacacauuagcuccaaugggcaaugguacaggaaggagaagagcacuuuga

SEQ ID NO: 30958 - RNA, 1623 nt, Artificial Sequence
  derived and/or modified sequence opt6 from capsid_protein_VP1__Norovirus__AGE89451
augaaaauggcauccaacgacgcaaacccaucagacggaucggcagcaaaucuaguuccagaaguaucaaaugaaguaauggcauuagaaccagucguaggagcugcaauagcagcaccagucgccggacaacaaaauguuauugacccauggauaagaaauaauuucguccaagcaccuggaggcgaauuuacagucucccccagaaaugcacccggagaaauacuauggucagcaccccuugguccagaccuuaauccauauuugucacacuuagcaagaauguauaacgguuacgcuggaggauucgaaguacaaguaauacuagcuggaaacgcauuuacagcuggaaaaaucauauucgcagcaguaccaccuaauuucccaacagaaggcuuaagcccaucacaaguaacaauguucccacacauaauuguagacgucagacaacuagaaccaguacuaaucccauuaccagacgucagaaacaauuucuaucauuauaaccaaacaaaugacucuacaauaaaacucauagcaauguuauauacuccauuaagagcuaacaaugcaggcgaagauguauuuacaguaagcuguagaguacuaacaagacccucaccagacuucgacuucauauuucucguaccaccgaccgucgaaagucgcacuaaaccuuuuacagucccaauauuaacuguagaagaaaugacaaauuccagauuuccaauuccacuugaaaaacuguucacagguccuucaggagcuuuuguaguacaaccacaaaauggaagauguacaacagacggaguccuacucgguacaacacaacuaucuccagucaauauuugcacauuuagaggagacguuacccauauagcuggaaguagaaacuauacaaugaauuuagcuucacuuaacuggaauaacuaugauccuacagaagaaauccccgcaccacuagggaccccagauuucgucgguaaaauacaaggaguauuaacacaaacaacaaaaggugacggaucuacaagaggucacaaagcuacaguuuacacaggaucugccccuuuuacuccaaaacuuggaucaguacaauucucaaccgauacagaaaaugauuuugaaacacaucaaaauacaaaauucacaccaguuggcguaauacaagauggagguacuacccauagaaaugaaccacaacaauggguucuaccauccuauucaggaagagauguacacaacguacacuuagcaccagcagucgcaccaacuuuuccaggagaacaacuauuauuuuuuagaaguacuaugccaggaugcucaggcuauccaaauauggaccucgacugcuuacuaccacaagaauggguacaacauuuuuaucaagaagcagcaccagcacaaucagacguagcccuauuacgauuuguaaauccagauacaggaagaguauuauuugaauguaaauuacacaaauccggauauguuacaguagcacauaccggacaacaugauuuaguaauaccaccaaacggauauuuccgauuugacagcuggguuaaucaauuuuauacacuagcgccuaugggaaauggaacuggacgacgacgugcauuauaa

SEQ ID NO: 30959 - RNA, 1623 nt, Artificial Sequence
  derived and/or modified sequence opt6 from capsid_protein_VP1__Norovirus__AGE89454
augaaaauggcauccaacgacgcaaacccaucagaugguucagcagcaaaccuagucccagaaguauccaacgaagucauggcauuagaaccuguugucggagccgcaauagcugcaccaguagccggccaacaaaauguaauagacccauggaucagaaauaacuuuguacaagcaccaggaggagaauuuacaguaucaccuagaaaugcaccaggugaaaucuuauggggagcacccuuaggaccagaucuaaauccauauuuaucacacuuagcacgaauguauaacggauaugcaggaggauucgaaguacaaguaauauuagcaggcaaugccuuuacagcaggaaaaauaauauuugcagcaguaccaccaaauuucccaacagaggggcuuucaccuucacaaguaacaauguucccacauauuauaguagacgucagacaacuagaacccguauuaauuccauuaccagauguaagaaauaacuucuaucacuauaaccaaacaaaugauucaacuauaaaauuaauagcuauguuauauacaccuuuaagagcaaauaaugcaggagaagacguauucacaguuucuuguagaguuuuaacuagacccucaccagauuuugacuuuauauuucuaguaccaccaacaguagaaucaagaacaaaaccauucacaguaccaauacuaacaguugaagaaaugacaaacucaagauucccaauaccauuagaaaaacuauuuacaggaccaucaggagcauucguaguacaaccacaaaacggacguuguacaacugacggaguauuacuagguaccacacaauuaagccccgucaauauaugcacauuucgaggggacguaacucauauagcaggaaguagaaauuacacaaugaacuuagcaucacuaaacuggaacaauuaugacccuacagaagaaauaccugcaccacucggaacacccgacuuuguaggcaaaauucaaggcguuuuaacacaaacaacaaaaggagacggaucaacaagaggacauaaagcuacuguauauacuggaucagcaccauuuacaccaaaauuaggaucaguccaauuuucuacagauacagaaaaugauuuugaaacccaucaaaauacaaaauucacccccguaggaguaauucaagacggaggaacaacacaucgaaaugaaccacaacaauggguuuuacccaguuacagugggagagauguucacaauguucaccuagcaccugcaguagcaccaacauuuccaggagaacaacuauuauuuuuuaggucuacaaugccaggauguuccggauacccaaacauggaucuugauugucuacuaccacaagaauggguacaacauuuuuaccaagaagcagcaccagcacaaucagauguugcacuacuaagauuuguaaauccugacacaggaagaguauuauucgaauguaaacuacacaaaucagguuacgucacuguagcacacaauggacaacacgaucuaguaauaccaccaaacggauacuucagauucgauagcugggucaaucaauucuacacucuagcaccaaugggcaacggcacaggcagacgaagagcauuauag

SEQ ID NO: 30960 - RNA, 1623 nt, Artificial Sequence
  derived and/or modified sequence opt6 from capsid_protein_VP1__Norovirus__AGE89457
augaaaauggcaucuaacgaugcaaauccuucagauggaucagcugcaaaucuaguaccagaaguaucaaaugaaguuauggcauuagaaccaguaguaggcgcagcuauugcugcaccaguugcaggacaacaaaacguaauagacccauggauaagaaauaacuuuguacaagccccaggaggagaauuuacaguuucaccaagaaaugcuccuggagaaauauuauggucagcaccccuagguccagaucuaaaucccuacuuaucacacuuagcaaggauguauaauggauacgccgggggauucgaaguacaaguaauauuagccggaaaugcauuuacagcaggcaaaauaauauucgcagcuguaccaccuaauuucccaacugaaggucuaagcccaucucaaguaacaauguuuccccacauuauaguugauguaagacaauuagaaccuguacuaauuccacuacccgauguaagaaacaauuucuaucacuauaaucaaacaaacgacucuacaauuaaauuaauagccauguuauauacuccauuaagagcaaauaaugcaggagaagauguuuuuacaguuucauguagaguacuaacaagacccucuccugauuuugauuuuauauuuuuaguaccaccaacaguagaaucacgaacuaaaccuuuuacaguaccaauauuaacaguugaagaaaugaccaacucaagauucccaauuccauuagaaaaauuauucaccggaccaucuggggcauucguaguccaaccacaaaacggacgcuguacaacagacggaguacuauuaggaacaacacaauuaagcccaguaaacaucuguaccuuuagaggagacguaacacauauagcuggaucaagaaauuacacgaugaaucuagcaagcuuaaacuggaauaauuaugacccuaccgaagaaauaccagccccauuaggaacaccagauuuuguuggaaaaauucaaggagucuuaacccaaacaacaaagggugacggauccacuagaggacacaaagcaacugucuauacaggaucagcacccuuuaccccaaaauuaggaucaguacaauucagcacagacacagaaaacgauuuugaaacccaccaaaauacaaaauuuacaccaguaggcguaauccaagacgguggaacuacccaucguaaugaaccacaacaauggguauuaccaucauauuccggacgagacguacauaacguacacuuagcaccugcaguagcaccaacauucccaggagaacaauuacuauucuuuagaucaacaaugccaggauguagcggauacccaaauauggaucuagauugcuuauuaccacaagaauggguacaacauuucuaucaggaagcagcaccagcacaauccgauguugcauuacuacgauuuguuaacccagacacuggaagaguacuauuugaauguaaacuacacaaaucaggcuaugucacugucgcacauacaggacaacaugacuuaguaauaccaccaaacggauauuucagauucgauucauggguaaaucaauuuuacacacuagcaccgauggguaauggaacaggcagaagaagagcucucuaa

SEQ ID NO: 30961 - RNA, 1623 nt, Artificial Sequence
  derived and/or modified sequence opt6 from capsid_protein_VP1__Norovirus__AGE89460
augaaaauggcaucuaacgacgcaaacccaucugauggaucagcagccaauuuagucccagaaguaucaaaugaaguuauggcacuugaaccaguaguuggcgcagccauagcagcaccuguagcaggucaacaaaauguaauagacccauggauaagaaacaacuuuguacaagcaccaggcggagaauucacaguuuccccacgaaacgcaccaggagaaauacuuugguccgcaccauuaggaccagaucucaauccuuauuuaucacaccuugcuagaauguacaacggauaugcagguggauuugaaguucaaguaauauuagcuggaaacgcuuuuacagcaggaaaaaucauauucgcagcaguacccccaaauuuuccaacagaaggucuaucuccaucacaaguaacaauguucccucacauaauuguugauguaagacaauuagaaccuguccuaauaccccucccagaugucagaaauaauuucuaccacuacaaccaaaccaaugauucuacaauaaaacuaauagccaugcuuuauacaccauuaagagcaaacaacgcuggugaagauguauuuacaguaucauguagaguuuuaacaagaccaucaccagacuucgauuuuauauuucuaguaccacccacaguagaaucacgcacaaaaccauucacagucccuauucuaaccguagaagaaaugacaaacucaagauuuccaauaccauuagaaaaauuauucacaggucccuccggagcuuucguaguccaaccgcaaaacggaagauguacuaccgacggaguccuacuagguacaacacaacuaagcccaguuaacauaugcacauucagaggagacguaacacauaucgccggaucuagaaauuauacaaugaacuuagcaucucuaaauuggaauaauuacgauccaacagaagaaauaccagcaccacuagguacaccagacuuuguuggaaaaauacaaggaguucuaacacaaacaacaaaaggagauggauccaccagaggacacaaagcuacaguauauacagguucagcaccauucacgccuaaacucggcucaguacaauucucaacagacacugaaaacgacuucgaaacccaucaaaacacaaaauucaccccuguuggcgugauacaagauggaggcacaacacauagaaaugaaccacaacaaugggucuuaccaucauacuccggacgagauguacauaacguacacuuagcaccagcaguagcaccuacuuuucccggagaacaacuccucuucuuuagaucaacaaugccaggaugcucaggauauccaaauauggauuuagauuguuuacuaccacaagaauggguacaacauuuuuaucaagaagcagcaccagcucaaucugacguagcauuacucagauucguaaaccccgauaccggaagaguacuuuuugaaugcaaauuacauaaaucaggauauguaacaguagcacacacuggacaacacgauuugguaauaccaccaaauggcuacuucagauucgauucaugggucaaccaauucuauacauuagcacccaugggaaauggaacaggaagaagaagagcauuauaa

SEQ ID NO: 30962 - RNA, 1623 nt, Artificial Sequence
  derived and/or modified sequence opt6 from capsid_protein_VP1__Norovirus__AGE89463
augaaaauggcauccaaugaugcaaauccuuccgauggauccgcagcaaacuuaguaccagaaguaucaaaugaaguaauggcacuugaacccguaguaggugcagcaauagcagccccagucgcaggucaacaaaacguaauagauccuuggauaagaaauaauuucguccaagcaccagggggagaauuuacaguaucaccaagaaaugcaccaggcgaaauacuauggucagcacccuuaggcccagaucuaaacccauauuuaucacaucuugcucgaauguauaauggcuacgcaggcggauucgaaguccaaguuauuuuagcaggcaacgcauuuacagcaggaaaaauaauuuucgcagccguaccaccaaauuuuccuacagaaggccucaguccuucucaaguaacaauguucccacauaucauaguagauguacgacaacuagaaccaguacucauuccguuaccagauguacgaaacaauuucuaucacuacaaucaaacuaacgauucaacaauaaaauuaaucgcaauguuauauaccccacuaagagcuaacaaugccggagaagauguauuuaccguuagcuguagaguucuaaccagaccuuccccagauuuugacuuuauauuuuuaguacccccuacagucgaaucgagaaccaagccauucacaguuccaauccuaacaguagaagaaaugacaaacucuagauuuccuauaccacuagaaaaacuauucacaggaccaucaggcgcuuucgucguccaaccacaaaauggaagauguacuacagacggagucuuauuaggaacaacacaacuauccccaguaaauauauguacauuucgaggagacguuacacacauagcaggaucaagaaauuauacuaugaacuuagcuagcuuaaacuggaacaauuacgaucccacagaagaaauaccggcacccuuagguacaccugacuucgucggaaaaauccaaggcgucuuaacucagacaacuaaaggagauggaucuacuagaggacauaaagcaacuguauacacaggaucagcuccuuuuaccccaaaauuaggaucuguacaauucucaacagacacagaaaacgacuuugaaacacaucaaaacaccaaauuuacaccaguaggaguaauacaagacggagguacaacacaucgcaaugaaccacaacaauggguucuaccaagcuauucaggaagagauguacacaauguacaccuagcccccgcuguagcacccacguuccccggagaacaauuacuuuuuuuuagaucaacuaugccaggauguucagguuauccaaauauggauuuagauugccuacuaccucaagaauggguucaacauuucuaucaagaagcagcaccagcacaaucagacguagcauuacuaagauuuguuaacccugacacaggacgaguguuauucgaaugcaaacuacauaaaucuggauacguaacaguagcacauacaggucaacacgaucuaguaauaccaccaaauggcuauuucagauuugacucaugggucaaccaauucuacacacuagcaccuaugggaaauggaacaggaagaagaagagccuuauaa

SEQ ID NO: 30963 - RNA, 1623 nt, Artificial Sequence
  derived and/or modified sequence opt6 from capsid_protein_VP1__Norovirus__AGE89466
augaaaauggcaaguaacgacgcuaauccaucagauggaucagcagcuaaucuuguaccagaaguaaguaacgaagucauggcauuagaaccagucguuggagcagccauagcagcaccuguagccggacaacaaaauguaauagacccauggauacgcaacaauuuuguccaagcaccuggaggagaauucaccguaucuccaagaaaugcacccggagaaauauuauggucugccccauuaggaccagauuuaaaucccuaucuaucacaccuagcaagaauguauaacggauacgcaggagguuucgaaguucaagucauacucgcaggaaaugcauuuacugccggaaaaauuauauuugcugcaguaccaccaaauuucccuacagaaggauuaucaccuucacaaguuaccauguuuccucacauaauagucgacguaagacaacuagaaccaguacuaauaccauuaccagauguaagaaacaacuucuaucacuauaaccaaaccaaugacuccacaauuaaauuaauagcaaugcuauacacaccacuaagagcuaacaaugcaggugaagauguauuuacaguaucaugcagaguacucacacgacccucaccagauuuugacuuuauauuuuuaguuccaccaacaguagaaaguagaacuaaaccauuuaccguaccaauacuaacaguagaagaaaugaccaacucaagauuuccaauaccauuagaaaaacuauucacaggaccaucaggagcuuucguaguacaaccacaaaacggacgauguacaaccgauggugucuuacuuggaacuacacaauuaucaccaguuaauauauguacauuccguggugacguuacucauauagcagguucacguaacuacacuaugaaucucgcaucauuaaacuggaacaauuacgauccaacugaagaaauaccagcaccauugggaacaccugacuucguaggaaaaauacaaggcguauuaacacaaacaacuaaaggcgaugguuccaccagaggccacaaagcaacaguauacacugguucagcacccuuuaccccuaaacucggcucaguacaauuuucaacagacacagaaaacgauuuugaaacacaucaaaauacuaaauuuacaccaguuggaguuauacaagauggaggaacaacacauagaaaugaaccccaacaauggguucuaccaucuuacucaggacgagacguccacaauguccaccuggcaccagccguugcacccacauuuccaggugaacaacuauuauucuuuagaucaacaaugccaggauguucuggauauccaaauauggaucuagauugcuuacuaccccaagaauggguucaacauuucuaucaagaagccgcuccugcacaauccgauguagcuuuauuaagauuuguaaacccugacacaggacgaguccuuuuugaaugcaaauuacauaaaucaggauacguaacuguagcccauacuggacaacaugauuuaguaauaccaccaaaugguuauuuuagguuugacagcuggguaaaucaauucuauacacuagcaccaaugggaaacggcaccggcagacguagagccuuauaa

SEQ ID NO: 30964 - RNA, 1623 nt, Artificial Sequence
  derived and/or modified sequence opt6 from capsid_protein_VP1__Norovirus__AGE89472
augaaaauggcaucaaacgaugcuaauccauccgauggaagcgcagcuaacuuaguaccagaagucucuaaugaaguaauggcacuugaaccaguaguuggagcugccauagcagcaccaguagcuggacaacaaaauguuauagaucccuggauaagaaacaacuuuguacaagccccuggaggagaguuuacgguaagcccuagaaaugcacccggugaaauauuauggggugcaccacucggcccagauuuaaacccauauuuaucacauuuagcaagaauguauaacggcuaugcagguggauuugaaguccaaguaauauuagcaggaaaugcauuuacagcuggcaaaauaauuuucgcagccgucccaccuaauuuucccacugaaggauuaucuccaucucaaguaaccauguucccucacauaauaguagauguaagacaacuagaaccuguauuaauaccauuaccagauguacgaaacaauuucuaucacuauaaucaaacaaacgacucaacaauaaaauuaauagcaauguuauacacaccuuuacgagcuaauaaugcaggugaagacguauucacaguaucaugucgaguacuaacuagaccuucaccagauuucgacuuuauauuuuuagucccuccuacaguagaaucaagaacaaaaccauucacuguaccaauacuaacaguagaagaaaugacaaauucaagauuuccaauaccuuuagaaaaacuauuuaccgguccuagcggagcauuuguaguacaaccccaaaacggcagaugcacaacagacggaguauuacuagguacaacacagcuaagcccaguaaacauaugcacauuccgcggagacguaacacauauagcaggaucaagaaacuacacuaugaaccuagcaucuuuaaauuggaauaauuaugacccaacagaagaaauaccugcaccccuuggcacuccugacuuuguagguaaaauucaaggaguauuaacccaaacaacaaaaggagauggaucaacacgaggucacaaagcaacuguauauacagggucagcuccuuuuaccccuaaacuaggaucaguacaauucucuacagauacagaaaaugauuucgaaacacaucaaaauacuaaauucacaccaguuggaguaauacaagauggaggaacaacacauagaaaugaaccucaacaaugggucuuaccuaguuacucaggaagagacguucacaauguccacuuagcaccagccguugcuccaacauuuccuggugaacaauuacuauucuuuagauccaccaugccaggauguucaggcuauccaaacauggacuuagacuguuuacucccccaagaauggguccaacauuucuaccaagaagcagcaccagcacaaucagacguugcacuucuaagauucguaaauccagauacaggacguguacuauuugaaugcaaauuacacaaaucaggauauguuacaguugcacauaauggacaacaugaccuuguaauaccaccaaauggcuauuuccgauucgauucuuggguaaaucaauuuuacacuuuagcacccaugggaaacggaacuggaagacgaagagcauuauaa

SEQ ID NO: 30965 - RNA, 1623 nt, Artificial Sequence
  derived and/or modified sequence opt6 from capsid_protein_VP1__Norovirus__AGE89475
augaaaauggcaucuaacgacgcaaacccuucagauggaucagcagcuaauuuaguacccgaagucagcaaugagguuauggcacuagagccaguagucggagcugcaauagcagcaccaguagcaggacaacaaaaugucauugauccauggauaagaaauaauuuuguacaagcaccaggaggagaauucacaguaagcccacgaaaugccccuggugaaauucuauggucagccccccuaggaccugacuuaaacccauaucuaucucacuuagcaagaauguacaacggauaugcagguggauucgaaguaagaguaauauuagcaggcaaugcauucacugcagguaaaauaauauucgccgcaguaccaccaaacuucccaacugaagggcuaucaccaucacaaguaacuauguucccccacauaauagucgacguaagacaauuagaaccaguacuaauucccuuaccugaugucagaaauaauuucuaucauuauaaccaaacaaacgacucaacaauaaaacuaauagcgauguuauauacaccauuaagagcaaauaaugcaggagaagacguauucacaguaucaugcagaguucuaacaagaccaucaccugauuucgacuucaucuucuuaguaccacccacuguagaaucuagaacuaaacccuucacaguaccaaucuuaacaguugaagaaaugacaaacucaagauucccaauaccauuagaaaaacuauuuacugguccaucuggcgcuuuuguaguacaaccacaaaacgguagauguacaacagauggaguauuacuaggaacaacacaauuauccccaguaaacaucugcacauucagaggagacguaacucacaucgccgguucucgaaauuauacuaugaaucuugcaucacucaauuggaacaauuaugaucccacagaagaaaucccagcaccucuaggcacaccagauuucgucgguaaaauacaaggaguacuaacacaaacaacaaaaggagacggaucaacgcgcggacauaaagcuacaguauauacaggaucagccccauucaccccaaaauuaggaaguguacaauucucaacagacaccgaaaacgauuuugaaacacaucaaaacacuaaauucacaccaguaggaguaauacaagacgguggaacaacacaccguaaugaaccucaacaauggguacuaccuagcuauucaggacgcgauguccauaacguacauuuagcaccagccguugcaccuacuuucccaggugaacaacuacuuuuuuuuagauccaccaugccaggauguucaggauauccaaacauggauuuagauugcuuauuaccccaagaauggguacaacauuuuuaucaagaagcugcacccgcucaaucugauguagcauuacucagauucgucaacccagacacaggucguguacucuucgaaugcaaacuacauaaauccggauauguaacaguugcacauacaggacaacacgaucuaguaauaccuccuaacggauauuucagauuugauagcuggguaaaucaauuuuauacucuagcacccaugggcaaugguacuggaagacgacgagcauuauaa

SEQ ID NO: 30966 - RNA, 1623 nt, Artificial Sequence
  derived and/or modified sequence opt6 from capsid_protein_VP1__Norovirus__AGE89478
augaaaauggcaucaaacgacgcaaacccuuccgacggcucagcagcaaaucucguuccugaaguaucaaaugaaguaauggcacuagaaccuguaguuggagcugcaauagcugcuccagucgcuggucaacaaaauguaauagauccauggauacgcaacaacuuuguacaagcccccgguggagaauucacaguaucaccaagaaaugcacccggagaaauacuauggucagcuccacuaggcccagauuuaaaccccuaccuaucacacuuagcaagaauguacaacgguuaugcuggugguuuugaaguacaaguaauacuagcaggaaaugcauuuaccgcaggcaaaauaauuuucgcagcuguaccaccuaacuuucccacagaaggucuaucuccuucccaaguaacaauguuuccacacauuauuguagacguaagacaauuagaaccaguccuaauaccucuaccugacguaagaaauaauuuuuaucauuacaaucaaacaaaugacucaacaauuaaacuaaucgcuaugcuuuacacuccuuuaagagcuaacaaugccggagaagauguauuuacaguaucuugcagaguauuaacacgaccgucacccgacuuugauuucauauuccuaguaccacccacaguagaaaguagaacuaaacccuuuacaguaccaauccuaacaguagaagaaaugacuaauucuagauuuccaaucccacuagaaaaauuauuuacaggaccuaguggagcauucguaguccaaccacaaaauggucgauguacaaccgacggagucuuauuaggcacaacacaauuauccccaguaaauauauguacuuuuagaggcgauguaacacacauagccgguucacgcaacuauacaaugaaucucgccucucuaaauuggaauaauuacgauccaacagaagaaauaccagccccuuuagguacacccgauuuuguaggaaaaauacaaggaguauuaacacaaacuacaaaaggagacggaucaacaagaggacacaaagccacuguauacaccggaucagcacccuuuaccccaaaauuaggaaguguacaauucucaacugacacagaaaacgauuuugaaacacaccaaaauacaaaauucaccccaguugguguaauacaagauggaggaacaacccaccgaaacgaaccacaacaauggguacuuccauccuacucaggaagagauguucauaacguucaucuagccccagcaguugccccuaccuuuccaggcgaacaauuauuauucuuucgcucaacaaugccaggauguucaggauauccaaacauggacuuagauugccuucuaccacaagaauggguacaacauuucuaucaagaagcugcuccagcacaauccgauguugcacuacuaagauucgucaacccagacacaggaagaguccuuuucgaaugcaaacuacauaaaucaggauauguuaccguugcacacacaggacaacacgauuuaguuauccccccaaauggauauuuccgauuugauuccuggguaaaucaguuuuauacacuagcccccaugggaaauggaaccggaagaagaagagcacucuaa

SEQ ID NO: 30967 - RNA, 1623 nt, Artificial Sequence
  derived and/or modified sequence opt6 from capsid_protein_VP1__Norovirus__AGE89481
augaaaauggcuucaaaugacgcaaaccccucagacggcucagccgcaaacuuaguaccagaagucuccaaugagguaauggcacuagaaccaguaguaggugcagccaucgcagccccaguagccggacaacaaaauguaauagaccccuggauacgaaauaacuuuguacaggcaccaggaggcgaauucaccguaucuccacgaaaugcacccggagaaauacuuuggucagcuccucuaggaccagacuuaaaucccuaucuaucucacuuagcaagaauguacaacggauacgcaggaggauucgaaguucaaguaauacuagcaggaaaugcauuuaccgccggcaaaauaauauucgcagcaguaccacccaacuuuccaacagaaggacuauccccaucucaaguuacaauguucccccacauaauaguagacguuagacaacuagaacccguacuuauaccacuaccagauguacgcaacaauuucuaccacuauaaucaaacaaacgauucuacaauaaaacuaauagcaauguuauacacaccauuaagagcaaacaaugcaggagaagauguauucacaguaagcuguagaguuuuaacacgcccauccccugacuuugacuuuauauuucuaguuccaccuacagucgaaucacgaacuaaaccauucaccgugccaauccucacuguagaagaaaugacaaacucuagauuccccauuccacuugagaaacuauuuacaggucccucuggagcauuugucguacaaccccaaaaugguagaugcacaaccgacgguguauuauuaggaacaacacaauuaucacccguaaauauuugcaccuuuagaggcgacguaacacauauagcaggaucaagaaauuauacuaugaacuuagcaucauuaaacuggaacaauuacgauccaacagaagaaauaccagcaccccuaggaacaccugacuucguuggaaaaauucaagguguccuaacacaaacaacuaaagaagacggaucaacccgaggacacaaagcuacaguauacacaggaucagccccauuuacuccuaaacuuggcucuguacaauucucaaccgauacugaaaaugauuucgaaacacaucaaaacacaaaauucacuccagucggaguaauacaagauggugguacgacacaccgaaaugaaccacaacaauggguuuuaccuuccuauucaggcagagacguacacaacguccauuuagccccagcuguagcuccaacauucccuggagaacaacuauuauuuuuuagaucaacuaugccaggauguucaggauauccaaauauggaucuagauugucuacuaccccaagaauggguacaacauuuuuaccaagaagcugcaccagcucaaucagacguagcacuauuaagauucguuaaucccgacacaggaagaguauuauucgaauguaaacuacauaaaucagguuauguaacaguugcucacacaggacaacaugacuuaguaaucccucccaacgguuacuuccgcuuugauucauggguaaaccaauuuuacacucuagcaccaaugggaaauggaacuggaagaagaagagcauuauaa

SEQ ID NO: 30968 - RNA, 1623 nt, Artificial Sequence
  derived and/or modified sequence opt6 from capsid_protein_VP1__Norovirus__AGE89490
augaaaauggcaucaaaugacgcaaaccccucagauggaucugccgcuaaucuaguuccugaaguaaguaacgaaguaauggccuuagaacccguagucggagcagcaauagccgccccaguugcaggacaacaaaacguaauugauccauggauaagaaauaacuucguucaagccccaggcggagaauuuacaguaucaccaagaaaugcaccaggagaaauauuauggucagcaccacuaggaccugaccuaaaucccuaccuaucacaucucgcaagaauguauaacgguuacgcaggaggcuuugaaguccaaguaauauuagcaggaaaugcuuuuaccgcugguaaaauaauauuugcugcuguaccacccaauuuuccaacagaaggucuaucuccaucacaaguuaccauguuuccucacauuaucguugacguuagacaacucgaaccaguauuaauaccccuaccagacguuagaaauaauuuuuaucauuauaaccaaacuaaugacucaacuauuaaauuaaucgcaaugcucuauacucccuuaagagcaaacaaugccggagaagauguauuuacaguuagcuguagaguuuuaacaagacccucaccagauuuugauuucauuuuucuaguaccccccacaguagaaucaagaacaaaaccauuuaccguaccaauauuaaccguugaagaaaugacaaacucaagauuucccauaccacuugaaaaauuauuuacaggaccaucaggagcauucguuguacaaccacagaauggcagauguacgacagauggugucuuauuagguacuacacaacuaucaccaguaaauauauguacauuuagaggugauguaacacauauagccggaaguagaaauuauacaaugaaucuagcauccuuaaacuggaacaacuaugauccaacagaagaaauaccugccccauuaggaaccccagauuuuguaggaaaaauacaagguguacuaacccaaacuacaaaaggagaugguuccacaagaggacacaaagccacugucuacacaggaucagcuccauuuacaccuaaacuuggcuccguucaauuuucaacagacaccgaaaacgauuucgaaacacaccagaauacaaaauucacacccguaggaguaauacaagacggaggaacaacacaccguaaugaaccucaacaauggguacuaccaucauacucuggaagagauguacauaauguucacuuagcaccagcaguagcuccaacauucccgggagaacaauuauuauucuuuagaucaacuaugccuggaugcucuggcuacccuaauauggaccuagauugcuuacuaccacaagaauggguacaacauuuuuaucaagaagcagcaccagcacaaucugacguagcacuacuuagauucgucaaucccgacacaggaagaguauuauucgaaugcaaauuacauaaaagcgguuaugucaccgucgcacacacaggacaacaugauuugguaauuccaccuaauggauauuuuagauucgauucuuggguaaaccaauuuuacacauuagccccaaugggaaauggaacuggaagaagaagagcacuauaa

SEQ ID NO: 30969 - RNA, 1623 nt, Artificial Sequence
  derived and/or modified sequence opt6 from capsid_protein_VP1__Norovirus__AGE89493
augaaaauggcaucaaacgaugccaacccaucagacggaucagcagcuaaucuagucccagaaguaucaaaugaaguaauggcacuagaaccaguuguaggcgccgcaauagcagcaccaguagcaggacaacaaaacguaauagaccccuggauaagaaacaacuuuguccaagcaccaggaggugaauuuaccguaucaccaagaaaugcaccaggagaaauacuauggucagcaccccuuggaccagaucuaaauccauaucuaucacaccuugcaagaauguauaaugguuacgcaggagguuuugaaguacaaguaaucuuagcugguaaugcauuuacagcaggcaaaauaauuuuugcagcuguucccccaaacuuuccuacagaaggacucucuccaucacaagucacuauguucccacauauuauagucgauguaagacaauuagaaccaguauuaauccccuuaccugauguaagaaauaauuucuaccacuauaaucaaacaaaugacucaacaauuaaacucauagcuauguuauacaccccauuaagagccaauaacgcaggagaagauguuuucaccguauccuguagaguacucacuagacccagcccugauuuugacuuuauauuucucguaccacccacaguagaaaguagaacaaaaccauucacagucccaauauuaacaguagaagaaaugacaaacucaagauucccaauuccacuugaaaaacuauuuacuggaccaagcggcgcauucguaguccaaccacaaaacggaagauguaccacagacggaguauuauuaggaacuacacaacuaaguccagucaacauauguacauuucgaggagacguuacccauauagcaggaucaagaaauuauacaaugaaccucgcaucauuaaacuggaauaauuacgauccaaccgaagaaauacccgcaccacuagguacaccagacuucgugggaaaaauacaaggaguacuuacacaaacaacaaaaggagauggaucaacaagaggacauaaagcaacuguauacacuggaucugcaccauuuacaccaaaauuaggaucaguacaauuuucuacagauacagaaaacgauuuugaaacacaucaaaacacaaaauucacuccaguaggaguaauacaagauggaggaaccacacauagaaacgaaccacaacaauggguuuuaccauccuauucuggaagggacguucauaacguucaccuagcaccagcaguagcaccaacauucccaggagaacaauuauuauucuuuagauccaccaugccuggaugcagcggcuauccuaauauggaucuagauugcuuacuaccacaagaauggguccaacauuucuaucaagaagccgcaccugcucaaagugacguugcauuacuaagauuuguaaauccugacacuggacgaguauuauucgaaugcaaacuacacaaaucaggauacguaacaguagcacauacaggacaacaugaucucguaauaccacccaauggauauuuccgauucgauucuuggguaaaccaauuuuauacgcuagccccaaugggaaauggaacugguagaagaagagcauuauaa

SEQ ID NO: 30970 - RNA, 1623 nt, Artificial Sequence
  derived and/or modified sequence opt6 from capsid_protein_VP1__Norovirus__AGE89496
augaaaauggcauccaaugaugcuaacccaucugacgguucugcugcaaaucuaguaccagaaguuucaaaugaaguaauggcucuugaaccaguaguaggugcagcaauugcugcaccagucgcaggucaacaaaaugucauagacccauggauuagaaauaacuucguacaagcaccaggaggagaauuuaccguauccccuagaaaugcaccaggagaaauacuauggucagcaccacuaggaccagaccuaaauccauaucuaucacaccuagcaagaauguauaacggauacgcaggaggauuugaaguacaaguaauauuagcaggcaaugcauuuacagcaggaaaaauaauauuugcugcaguacccccuaacuuuccaacagaaggucuaaguccaucacaaguaacaauguucccccauaucauaguugauguucgucaacucgaaccaguacuaauuccacuuccagacgucagaaauaacuucuaucacuauaaucaaaccaacgacucaacaauaaaacucauagcaauguuauacacacccuuaagagccaacaacgcaggagaagauguauuuacaguuucaugcagaguucuuacaagaccuucaccagacuucgacuucauauucuuaguuccaccaacaguagaaucaagaacuaaaccauucacaguaccaauauuaacagucgaagaaaugacaaacucuagauuuccuauuccacuagaaaaauuauucaccggccccucaggagcuuucguaguccaaccacaaaacggaagauguacaacugacggaguacuucucggaacaacucaacuauccccgguaaauauauguacauuucguggugauguaacacauauagcaggcucaagaaacuauacaaugaaucucgcaucauuaaauuggaauaauuaugacccaacugaagaaauaccagcaccacuagguacaccagacuucguagguaaaauacaaggaguauuaacacaaacaacaaaaggcgacgguaguacaagaggacauaaagcaaccguauauacuggaucugcaccauucacacccaaacuuggcucaguacaauucuccacagacacagaaaacgauuuugaaacacaucaaaacaccaaauucacaccaguaggaguaauacaagauggaggaacuacacauagaaaugaaccacaacaauggguucuuccaucauauaguggaagagauguccacaacguacaccuagcaccagcaguugcaccaaccuuucccggagaacaauuauuauucuuucgaucaacaaugccagggugcucaggauacccaaauauggacuuagauugcuuacuaccucaagaauggguacaacacuucuaucaagaagccgcaccagcucaaucagacguagcauuauuaagauucguaaaccccgacacaggucgagucuuauucgaaugcaaacuacacaaacccgguuauguaacaguagcacacacuggacaacaugauuuaguuaucccaccuaauggauacuuuagauucgauucuuggguaaaccaauucuacacucuagcaccaauggguaauggaacugguaggagaagagcauuauaa

SEQ ID NO: 30971 - RNA, 1623 nt, Artificial Sequence
  derived and/or modified sequence opt6 from capsid_protein_VP1__Norovirus__AGE89499
augaaaauggccuccaaugacgcuaacccuucagacgggucagcagcaaaucuaguaccugaaguaucuaacgaaguaauggcauuagaaccuguugugggagcagcuaucgcugcaccaguugcuggacaacaaaacguaauagauccuuggaucagaaauaauuuuguccaagccccuggcggagaauuuacaguaucaccuagaaacgcacccggcgaaauacuauggucagcaccauuaggcccagaccuaaacccauaucuuucacacuuagccagaauguacaacggcuaugcaggaggauucgaaguacaaguaauauuagcagguaaugcauuuacagccgguaaaauaauauuugcugcugugccaccaaacuucccuacagaaggucuuagcccaucccaaguaacaauguucccacacauaauagucgacgucagacaacuagaacccguuuuaauaccauuaccagauguaagaaauaacuuuuaucauuauaaucaaacaaacgacucaacaauaaaacuuauagcuauguuauacacaccuuuaagagcaaauaaugcaggugaagacguauuuaccguauccuguagaguacuaaccagaccaucaccagauuucgacuucauauuuuuaguuccccccacuguagaaucacgaacaaaaccauuuacuguaccaauacucacuguagaagaaaugacaaauucacgauucccaauaccacuagaaaaacuauuuaccggaccaucaggcgcauucguuguacaaccccaaaacggacgauguacuacagauggaguucuucuaggaacaacacaauuaucacccguaaauaucugcacauucagaggagacguaacacauauugcaggaucaagaaacuacacaaugaauuuagcuucucuuaacuggaacaacuacgauccaacugaagaaauaccagcaccucugggaaccccagauuuuguaggaaaaauacaaggaguccuaacucaaacaacuaaaggcgauggaucaacacgaggacacaaagccacuguauauacagguagugccccauuuacaccuaaauuaggaagcguacaauucucaacagauacagaaaaugauuuugaaacacaccaaaauacaaaauucacaccaguagguguaauccaagacggagguaccacacacagaaaugaaccacaacaauggguacuaccaucauauucuggaagagauguacauaauguacacuuagcaccagccguugcaccaacauuucccggagaacaacuacuauucuucagauccaccaugccagguugcucaggauauccuaauauggaucuagacugcuuauuaccucaagaauggguacaacauuuuuaccaagaagcagcaccagcucaauccgacguagcauuauuaagauucguaaacccagauaccggacgaguuuuauucgaaugcaaacuacacaaauccggauacguaacuguagcucauacaggacaacaugaucuaguuaucccaccaaauggcuauuuuagauucgauucuuggguaaaucaauuuuacacacucgcucccaugggaaauggaacaggaaggagaagagcauuauaa

SEQ ID NO: 30972 - RNA, 1623 nt, Artificial Sequence
  derived and/or modified sequence opt6 from capsid_protein_VP1__Norovirus__AGE89502
augaaaauggcaucgaaugacgcuaacccaucagauggaucagcagccaauuuaguaccagaaguauccaaugaagucauggcacuagaaccaguaguaggugcagcaaucgcagccccuguugcuggacaacagaauguaaucgacccauggauacgaaacaauuuuguacaagcaccaggcggagaauuuaccguuucacccagaaacgcaccaggagaaauacuuuggucugcuccauuaggcccagauuuaaauccauaucuaucacaccuugcuagaauguauaacgguuacgcuggaggauuugaaguacaaguaauacucgcagguaacgcauucacagcuggaaaaauaauauuugccgccguaccaccuaauuuuccaacagaaggacuuucaccaucacaagucacuauguuuccacacauaauuguugauguaaggcaauuagaacccguauuaauuccacuaccagacguacgaaauaacuucuaucauuacaaccaaacaaacgacucaacaauuaaauuaauagcaaugcuauacacaccacuaagagcaaacaaugcaggagaagauguauuuacaguaucauguagaguacuaacacguccaucuccagacuuugacuuuauuuucuuaguaccuccuaccguagaaucuagaacuaaaccuuucacuguaccaaucuuaacaguagaagaaaugacaaauuccagauucccaauaccauuagaaaaacuauuuacagguccaucaggagcauucgucguacaaccccaaaauggacgauguacaacagauggaguacuuuuaggaacaacucaacuaucaccuguaaauaucugugccuuuagaggagacguuacacauauagcugguucaagaaauuauacaaugaaucuagccucacucaacuggaacaauuaugauccaacagaagaaauucccgcuccauuagguacuccugacuucguaggaaaaauacaaggcguauuaacacaaacaacaaaaggagacggcucuacaagaggccacaaagcaacaguuuauacagguucagcaccauuuacuccaaaauuaggaucaguacaauuuucaacugauacagaaaacgauuuugaaacacaucaaaauacuaaauucacaccuguagguguuauacaagauggaggaacaacacauagaaaugaaccccaacaauggguucuaccuucuuauucaggacgagauguccauaacguucauuuagcuccagccguagcaccaacauucccaggagaacaacuauuauucuuucguaguacaaugccaggauguucaggauauccaaauauggauuuagacugucuccuaccacaagaauggguucaacacuucuaccaagaagcagcaccagcacaaucagauguugcccuacuuagauuuguaaauccugauacaggaagaguacuauucgaaugcaaauuacacaaaucaggguaugucacaguagcacauacaggacaacaugacuuaguaauaccaccaaauggauauuuuagauucgacaguuggguaaaccaauuuuacacgcucgcacccaugggaaauggaacaggaagaagaagagcauuauaa

SEQ ID NO: 30973 - RNA, 1623 nt, Artificial Sequence
  derived and/or modified sequence opt6 from capsid_protein_VP1__Norovirus__AGE89505
augaaaauggcauccaacgaugcuaauccaucugauggaucugcagcaaacuuaguaccagaaguaucaaaugaaguaauggcauuagagccaguaguaggcgccgcaauagcagcaccagucgcuggccaacaaaauguuauugacccauggauucgcaauaacuuuguucaagccccagguggagaauuuaccguaucaccaagaaaugcaccaggugaaauauuaugguccgcuccauuagguccagauuuaaaccccuacuuaucacaucuagcaagaauguauaacggauaugcaggaggauuugaaguacaaguaauacuagcagguaaugcauuuacagccggcaaaauaaucuuugcagcuguaccaccaaacuuuccaacagaaggacuaucccccagucaaguaaccauguuuccacauauuaucguugacguucgccaacuagaaccuguacuaaucccacucccagauguaagaaauaauuuuuaccacuauaaccaaacaaaugacucuaccauaaaauuaauagcuauguuauauacaccucuaagagcaaacaaugccggagaagacguauucaccguuucaugucgagucuuaacacgcccaucaccagacuuugauuuuaucuuccuaguuccaccaacaguagaaucacgaacaaaaccauuuacuguuccaauccuaacuguugaagaaaugacaaauucaagguuuccaaucccacuugaaaaacuauucacaggaccaucaggagcauuuguaguacaaccacaaaacggaagauguacaacagauggcguacuacuuggaacuacacaacuuuccccaguaaacauuuguacuuuuagaggugauguaacacauauagcaggaagucgcaauuacacuaugaaucuagcaucuuuaaauuggaacaauuaugacccaacagaagaaauaccagcaccacuaggaacuccugacuucgucgguaaaauucaagguguacucacacaaacaacaaaaggagaugguucuacaagaggacauaaagcaacuguauauacaggaucagccccauuuacaccaaaauuaggaucuguacaauucucaacagacacagaaaaugacuucgaaacucaucaaaauaccaaauucacacccguaggaguaauacaagaugguggaacuacucauagaaacgaaccacaacaauggguucuaccaaguuauuccggacgagauguacauaauguccaucuugccccagcaguagcaccgacauucccaggagaacaacuucuauucuuccgaucaacaaugccagguugcuccggauaccccaacauggaucuagauugccucuuaccacaagaauggguacaacauuuuuaucaagaagcagcaccagcucaaucagacguagcauuauuacguuucguaaacccagacacagguagaguucuuuuugaauguaaacuucauaaaucuggauacguaacaguagcacacacaggucaacacgaccucguaauaccaccaaauggauauuucagauuugauuccuggguaaaucaauuuuacacucuugcacccaugggaaauggcacaggaagacgacgagcucuauaa

SEQ ID NO: 30974 - RNA, 1623 nt, Artificial Sequence
  derived and/or modified sequence opt6 from capsid_protein_VP1__Norovirus__AGE89508
augaaaauggcauccaacgacgcaaacccaucagauggaucagcugccaacuuaguaccagaaguaaacaaugaaguaauggcauuagaaccuguagucggugcagcaauagcagccccugucgccggccaacaaaauguaauagacccuuggauaaggaauaacuuuguccaagcaccaggcggagaauuuacaguuuccccuagaaaugcaccaggagaaauauuauggucugccccauuaggaccagaucuaaacccuuauuuaucacacuuagcacgaauguauaaugguuaugcuggcggauucgagguacagguaauucuagcagguaacgcauucacagcaggaaaaauuauuuuugcagcaguuccaccaaacuucccaaccgaaggacuaucaccaucacaaguaacaauguucccacauauuauaguugacguuagacaauuagaaccaguucuuauaccucucccggacguaagaaacaacuucuaucacuauaaccaaucaaaugacucuacaauaaaacucauagcuaugcuuuacacuccccuacgagcaaacaaugccggagaagacguauuuacaguaaguugcagaguacuaacaagaccauccccagacuuugacuuuauuuuuuuaguacccccaacaguugaaucacgaacaaaaccuuucacagucccaauauuaacuguugaagaaaugacaaacucaagauucccaauuccacuugaaaaacuauuuacagguccaucaggugcauucguaguccaaccacaaaauggacguugcacaacugauggaguauuauugggaacuacacaacuuucuccgguaaacauauguacauuucgcggugacgucacacauauagcuggaaguagagauuacacuaugaauuuagcaucuuuaaacuggaauaauuaugauccaaccgaagaaauacccgcaccuuuaggaacuccagacuuuguaggaaaaauacaagguguuuuaacacaaaccaccaaaggcgauggaucuacacguggacauaaagcaacaguauauacuggaucagcaccauuuacaccaaaacuaggaucaguacaauucucuacagacacagaaaaugauuuugaagcacaucaaaacacgaaauucacaccagucggaguaauucaagauggcggaacaacacauagaaacgaaccacaacaauggguacuacccucauauucaggaagagauguucacaauguacauuuagcaccugccguagcaccaaccuuuccaggugaacaacuacuauuuuucagaucuacaaugcccggauguucagguuacccaaauauggaucuagauugucuacuaccucaagaauggguucaacacuuuuaucaagaagcagccccagcacaaucugauguugcacuccuaagauuuguuaauccagauacuggaagaguauuauuugaaugcaaacuacacaaaucugguuauguaacaguagcucacacaggucaacacgaucuuguaauaccaccaaauggauauuuccgcuucgacucauggguaaaucaguuuuauacuuuagcuccaauggguaacggaacaggaagacgacgagcacuauaa

SEQ ID NO: 30975 - RNA, 1623 nt, Artificial Sequence
  derived and/or modified sequence opt6 from capsid_protein_VP1__Norovirus__AGE89511
augaaaauggccucaaacgaugccaauccaucagauggaucugcagcuaaucuaguaccagaaguaucaaacgaaguuauggcacuagaaccaguagucggugcagcuauagcugcaccuguagcaggacaacaaaauguaauagacccuuggauuagaaauaacuucguacaagcacccggaggugaauuuacaguaucaccaagaaaugcaccaggagaaauauuauggucagccccucuaggaccagaucucaacccauauuuaucucaucuagcaagaauguauaauggauaugcaggaggauucgaaguucaaguaauacuagcaggaaaugcauuuacagcaggaaaaaucaucuucgcagccguaccuccuaauuuuccaacagaaggacuaucccccucccaagugacaauguuuccacacaucauaguagauguaagacaacuagaaccaguacuaauaccauuacccgauguacgaaacaacuuuuaucacuauaaccaaacaaaugacucaacaauuaaacuaauagccauguuauacacaccacuccgcgcaaauaaugcaggagaagacgucuuuaccguaucaugccgcguucucacuagaccaucaccagacuucgacuuuauuuuccucgucccuccuacaguugaaucaagaacaaaaccauucacaguaccaauauuaacaguagaagaaaugacuaauucccgauuuccaaucccacuugaaaaauuauuuacaggcccuucuggagcauuugucguacaaccacaaaacgguagauguacuacagacggaguuuuacuaggcacaacucaauuaucaccaguaaacaucugcaccuuccgaggugauguaacacauauagccgguucaagaaauuauacuaugaaucuagcauccuuaaacuggaacaauuaugauccaaccgaagaaauaccagccccuuuaggaacaccagauuucguagguaaaauacaaggagucuuaacacaaaccacaaaaggagauggauccacacgaggacacaaagcaacaguauauacaggaagcgcaccuuuuacaccaaaacuaggaucuguacaauucucaacagauaccgaaaaugauuucgaaacucaucaaaauaccaaauuuacacccguaggcguaauccaggacggagguacuacacauagaaaugaaccacaacaauggguacucccaucauauagugguagagacguacacaacguacaccuagcaccagcaguagccccaacauuuccaggagaacaacuacuauuuuuccgaucaacuaugccaggauguuccggcuaucccaauauggaucuagacugcuuauuaccacaagaauggguccaacauuucuaucaagaagcagcucccgcucaaucugacgucgcacuacuacgauuuguaaauccagauacaggacgaguacuauuugaaugcaaacuacacaaaucuggauacgugaccguagcucacaccggacaacacgaucuaguaauaccaccuaauggauauuucagauucgauucauggguaaaucaauucuacacauuagcaccaaugggaaauggaacaggaagaagaagagccuuauaa

SEQ ID NO: 30976 - RNA, 1623 nt, Artificial Sequence
  derived and/or modified sequence opt6 from capsid_protein_VP1__Norovirus__AGE89514
augaaaauggcuucaaaugacgcaaacccauccgauggcucagcagcuaaucucguaccagaaguuucaaaugaaguaauggcacuagaaccagucguaggagcagcaauagcugcaccaguagcaggacaacaaaauguuauagacccauggauaagaaacaacuuuguacaagccccaggcggagaauuuacaguaagcccacgaaaugcaccaggagaaauuuuauggucagcaccuuuaggcccagaucuaaauccauaucuaucucauuuagccagaauguauaacggauacgcaggagguuucgaaguccaaguaauauuagcuggcaacgccuucacagcaggaaaaauaauauuugcugcaguaccacccaauuucccaacagaagguuuaucuccaucucaaguuacaauguucccacacauaauaguagauguaagacaauuagaacccguacuaauaccacuaccugauguacgaaacaauuuuuaucauuacaaccaaacaaaugacucaacaauuaaacuaauagcaaugcucuacacaccccuaagagcaaacaaugcgggagaagacgucuucacuguuucuuguagagucuuaacaagaccaucaccugauuucgacuuuauauuuuuaguuccaccaacaguugaaucgcgaacaaagccuuucacagucccaauauuaacaguagaagaaaugacaaauucaagauucccuauaccacucgaaaaacuauuuacaggacccuccggagcauuuguaguacaaccacaaaacggacgauguacaacugauggaguccuacuaggaacaacccaacuaucacccguaaacauauguacauucagaggagauguuacacauauugcaggauccagaaauuauacuaugaauuuggcuucccuaaacuggaacaauuacgauccaacagaagaaaucccagcuccacuuggaacaccagacuucguaggaaaaauucaaggaguauuaacacaaacaacaaaaggcgauggauccacuagaggacacaaagcaacaguauauacaggaucagcaccauuuacaccuaaauuaggcucgguucaauucucaacagauacagaaaacgauuuugaaacacaucaaaacacaaaauuuacaccagucgguguaauacaagauggagguacuacacauagaaacgaaccucaacaauggguauuaccuucauauuccggacgagauguacacaacguucaucuugcaccagcaguagccccuaccuucccaggagaacaacuacuauuuuuuagaucaacuaugccugguuguucagguuaucccaauauggaccuagauugcuuauuaccacaagaauggguacaacauuuuuaucaagaagcagcaccagcacaaucagacguagcacucuuaagauucguaaacccagacacuggaagaguacuauuugaaugcaaacuacacaaauccggcuaugucacaguagcacacacaggucaacacgacuuaguaauuccaccuaauggauauuucagauuugacuccugggucaaucaauuuuacacauuagcucccaugggaaauggaacaggccgaagacgcgcacuauaa

SEQ ID NO: 30977 - RNA, 1623 nt, Artificial Sequence
  derived and/or modified sequence opt6 from capsid_protein_VP1__Norovirus__AGE89517
augaaaauggcaucaaaugacgcaaacccaucugacggauccgcagcaaaccuugucccagaagucucgaacgaaguaauggcauuagaacccgucguaggagccgcaaucgcagcuccaguagcaggacaacaaaauguaauugacccuuggaucagaaauaauuuugugcaagcacccggaggcgaauuuacaguaucuccuagaaacgcuccaggcgaaauacuuuggucugcaccauuagguccagacuuaaacccauaccucucacaccuagcaagaauguacaacggcuacgcaggagguuuugaaguccaagucauacuagcaggaaaugcauucacagcagguaaaaucauauuugccgcaguaccccccaacuuuccaacagaaggccuaucaccaucacaaguaacaauguucccacacauuauaguugauguucgacaauuagaacccguucuaauuccacuaccugacguacguaauaauuucuaucacuacaaucaaacaaaugacuccacaauuaaacuaauagccauguuauacacuccauuaagagcaaacaaugcaggugaagauguauucacaguaaguugucgaguacuuacaagaccauccccagacuuugacuuuauauuucuaguacccccaacaguagaaucuagaacaaaaccuuucaccguaccgauauuaacaguagaagaaaugacaaacucccguuuucccauaccccuugaaaaacuauuuacaggacccucaggcgcuuuuguaguacaaccacaaaacggaagaugcacaacagaugguguauuacuaggcaccacccaauuaucaccaguuaauauauguacauuucgcggagaugucacacauauagcaggaaguagaaauuauacuaugaaucuagcaucauuaaauuggaacaauuacgaucccacagaagaaauaccugccccacuagguacaccagacuucguaggaaaaauccaaggaguauuaacacaaacaacaaaaggagacgguucuacaagaggacacaaagcaacaguauauacaggaucugcacccuuuacaccaaaauuaggauccguacaguucucaacagacacagaaaacgauuucgaaacacaucaaaauaccaaauucacaccaguagguguaauacaagacggaggaacaacccacagaaacgaaccccaacaauggguucuaccuuccuauucaggaagagacguacauaacguacacuuagcaccagcuguagcaccaaccuuuccuggagaacaacuacucuucuuuagaucaacaaugccaggaugcuccggauauccaaauauggacuuagauugccuacuaccccaagaauggguacaacauuucuaucaagaagcagcaccagcacaaucugauguagcauuauuaagauuugucaacccugauacaggaagaguacuauucgaaugcaaacuccacaaaucaggcuauguaacaguagcccacacuggacaacacgauuuaguaauaccuccaaacggcuauuucagauuugauucauggguaaaccaauuuuacacauuagcaccaaugggaaacggcacaggacgaagaagagcauuauaa

SEQ ID NO: 30978 - RNA, 1623 nt, Artificial Sequence
  derived and/or modified sequence opt6 from capsid_protein_VP1__Norovirus__AGE89520
augaaaauggcaagcaaugacgcaaaccccuccgauggaucagcagcuaauuuaguaccugaaguuucuaaugagguuauggcacuugaacccguuguuggagcagcuauagcagccccaguagcaggucaacaaaauguaauagauccauggauaagaaauaacuuuguacaagccccaggaggugaauucacaguaucuccaagaaaugcacccggagaaaucuuaugguccgccccacuaggaccagaucuuaacccuuaucuaucucauuuagcaagaauguacaauggauacgcaggaggauucgaaguacaaguuauacuagcaggaaacgcuuuuaccgccggaaaaauaauauucgcagcaguaccacccaauuuuccaacagaaggucucaguccaucucaaguaacaauguucccacacauaauaguugacguaagacaacuagaaccaguccucauaccuuuaccagauguaagaaacaauuuuuaccauuauaaccaaacaaaugacucaacaauaaaauuaauagcuauguuauacacuccauuaagagcaaauaaugcaggagaagauguuuucacaguaucauguagaguauuaacaagaccaagcccugacuuugauuucauuuuuuuagucccccccacaguagaaucaagaacaaaaccauucacaguaccaauacuaacaguagaagaaaugaccaacucccguuuuccaauaccacuugaaaaacuauuuacaggaccaucuggcgcuuuuguaguucaaccucaaaacggaagauguacuacagacggcguuuuacuaggaaccacacaacuuucaccaguaaacauuugcgcauucagaggugacguaacacacauagcuggaucaagaaauuacaccaugaauuuagcaucauuaaacuggaacaauuacgauccaacagaggaaauaccugccccacuagguacuccagauuucguaggaaaaauucaaggaguacuuacacaaacaacuaaaggagauggaucuacucguggacauaaagccacuguauacacugguucugcacccuucacaccuaaacuaggaucaguacaauucuccacugauacagaaaaugacuucgaaacacaccaaaauacaaaauucacaccaguaggaguuauacaagacggaggaacaacacauagaaacgaaccacaacaauggguacuaccauccuauucaggcagagauguacauaacguacacuuagcacccgccguagcaccuacauucccaggagaacaacuacuauuuuuuagaucaaccaugccagguugcucaggauacccaaauauggaucuagauugucuacuaccccaagaauggguccaacauuucuaucaagaagcagcuccagcacaauccgacguagcauuacuuagauuuguaaaccccgacacuggcagaguauuauuugaaugcaaacuacacaaaaguggauauguaacuguagcacacacuggacaacaugauuuaguaauaccaccaaaugguuacuuucgauucgauucuuggguaaaucaauucuacacuuuagcaccaaugggaaacggaacaggaagaagaagagcauuauaa

SEQ ID NO: 30979 - RNA, 1623 nt, Artificial Sequence
  derived and/or modified sequence opt6 from capsid_protein_VP1__Norovirus__AGE89523
augaaaauggcuucaaaugaugcuaauccaagugauggaucagccgcaaacuuagucccugaaguauccaacgaaguaauggcacuagaaccaguagucggcgcagcaauagccgcaccaguagcaggacaacaaaauguaauagauccauggauuagaaauaacuuuguacaagcaccaggcggugaauuuacaguaucaccaagaaaugcaccaggugaaaucuuauggucugcacccuuaggaccagauuuaaaucccuaccuaucacauuuagccagaauguacaauggcuacgccggaggauucgaaguacaaguaauucuagcuggaaaugccuuuacagccggaaaaauaauauucgcagccguaccaccaaauuuuccaacagaaggacuaucaccaucacaaguaacaauguucccccauauaaucgucgauguaagacaacucgaaccaguacuaauaccacuuccagacguacgaaacaauuucuaccacuauaaucaaacuaaugacucaacaaucaaacuaauagcaauguuauacacuccuuuaagagcaaacaaugcaggagaagauguauuuacaguaucuugcagaguacucacucgucccagcccagacuucgauuuuaucuuucuuguuccaccuaccguagaaucaagaacuaaaccuuucacgguaccaauauuaacaguagaagaaaugacuaacaguagauuuccaauaccauuagaaaaacuauucacuggcccaucaggagcuuucgucguacaaccacaaaauggcagaugcaccacugacggaguucuccuaggaacaacccaacuaucaccaguaaacauaugcacauuucgaggagacgucacucauauagcuggaaguagaaauuacacaaugaaucuagcauccuuaaacuggaacaauuaugacccaacagaagaaauaccugcaccacucggcacaccagauuuuguaggcaaaauccaaggugucuuaacacaaacaacaaaaggagauggaucaacacgaggucacaaagcaaccgucuauacaggauccgccccuuuuacacccaaacuuggaaguguacaauucucuacagauacagaaaacgauuuugaaacacaccaaaauacaaaauuuacuccaguaggcguaauacaagacggaggaacuacccauagaaacgaaccucaacaauggguauuaccaucauacucuggccgagacguacauaacguacaucucgcaccagccguugcaccuacauuuccaggagaacaauuauuauucuuuagauccacaaugccaggcuguucaggauacccaaauauggaucucgacugcuuacuaccacaagaauggguccaacacuucuaucaagaagcagcacccgcacaaucagacguugcacuucuaagauuuguaaacccugacacaggaagagucuuauucgaaugcaaacuacacaaaagcggauauguaacuguugcacauaccggacaacaugauuuaguaauaccuccaaauggauacuuuagauucgauuccuggguaaaucaauuuuacaccuuagcaccaaugggaaacggaacaggacgaagaagagcuuuauaa

SEQ ID NO: 30980 - RNA, 1623 nt, Artificial Sequence
  derived and/or modified sequence opt6 from capsid_protein_VP1__Norovirus__AGE89526
augaaaauggcaucuaaugacgccaauccaucugauggaucagcagcaaaucuaguuccagaaguuuccaacgaagucauggcauuagaaccuguagucggugcagcuauagcagcacccguugcuggacaacaaaauguaauagacccauggauuagaaacaacuuuguacaagcaccaggaggagaauuuacuguaucuccaagaaaugcaccaggagaaauacuauggucagcaccucuagguccagaucucaauccauauuuaucucaucucgccagaauguauaacggauaugcaggaggauuugaaguucaaguuaucuuagcuggaaaugcuuuuacagcaggcaaaaucauauucgcagccguucccccaaacuuuccuacugaaggacuaucaccaucacaaguaacaauguucccacauauaaucguagacguccgacaacuagaaccugucuuaaucccacuaccagauguacgaaacaacuuuuaccacuauaaccagacuaaugauucaaccauaaaauuaauugcaauguuauauacuccgcuacgagcuaauaaugcaggagaagauguauuuacaguaucuuguagaguacuaacuagaccaucaccagauuucgacuucaucuucuuaguaccaccaacaguagaaucaagaacaaaaccuuuuacaguaccaauucucaccguagaagaaaugacaaauuccagauuuccaauaccacucgaaaaauuauuuacaggacccucaggagcauucguaguccaaccacagaacggaagauguaccaccgacggaguccuacuaggcacaacacaacuaucaccagucaacauauguacauucagaggagacguaacccauauagcaggaucaagaaauuacacaaugaauuuagcauccuugaacuggaacaauuacgacccuacugaagaaauaccagcuccauuaggaacaccagauuuuguaggaaaaauacaaggaguacucacacaaacaacaaaaggagacgguucaacaagaggacacaaagcaacaguauacaccggaucagccccuuuuacaccaaaacuaggaucuguacaauucucaacugauacagaaaaugauuuugaaacucaccaaaauacaaaauucacaccugucgguguaauacaagacgguggaacaacacaucgaaaugaaccucaacaauggguuuuaccaucauauucagguagagauguacauaacguacaucuugccccagcgguugcuccuacuuuuccaggcgaacaauuacuauuuuucagaaguacaaugccagguuguucaggauauccaaauauggaucuagauugccuauuaccacaagaauggguacaacauuucuaucaagaagccgcuccagcacaaucagacgucgcauuacuacguuucguaaacccagacacaggcagaguauuauucgaaugcaaacuacauaaaucaggauauguaacaguagcucacacaggacaacaugaucuaguaauaccaccaaaugguuauuuuagauucgauaguuggguaaaucaauucuacacacuugcaccaaugggaaauggaacaggaagacgcagagcucucuaa

SEQ ID NO: 30981 - RNA, 1623 nt, Artificial Sequence
  derived and/or modified sequence opt6 from capsid_protein_VP1__Norovirus__AGE89529
augaaaauggcaucuaaugaugcaaauccuucagacgguucagcugcaaaucuaguccccgaagucagcaaugaaguaauggcauuagaaccaguaguaggagccgcuauagcagcaccagucgcaggacaacaaaauguuauagauccauggauuagaaauaacuucguacaagcacccggcggagaauucacagucucaccaagaaaugcuccuggagaaaucuuauggucagcaccuuuaggcccagaucuaaauccauauuuaagucaucuugcaagaauguacaauggauacgcugguggcuucgaaguacaagucauucuagcaggcaacgcauuuacugcagguaaaauaauauucgcagccguaccaccaaacuucccaacagaaggacucucaccaucccaagucacaauguucccacacaucaucgucgauguaagacaauuagaaccaguucuuaucccauuaccagauguaagaaacaauuucuaucacuauaaccaaacuaacgacucuacaauaaaacuuauagcuaugcuauauacaccuuuacgagccaacaacgcaggugaagacguauuuacuguaucaugcagaguacuaacuagaccaucaccagacuuugacuuuauauuucuaguuccaccuacuguagaaucaagaacaaaaccuuuuaccguacccauccuuaccguagaagaaaugacuaacucucgauuuccaauuccauuagaaaaacuauuuacaggaccauccggagcuuuuguaguacaaccccaaaauggacgauguacaacagaugguguacuucuuggcacaacacaauuauccccuguuaauauaugcacauucagaggagacgucacacauauugcaggguccagaaauuacacaaugaaucucgcaucucuaaacuggaacaacuacgaccccaccgaagaaauaccagcaccucuagguacaccagacuuuguaggaaaaauacaaggaguuuuaacacaaaccacaaaagaagauggcagcacuagaggucacaaagcuaccguuuauacugguagcgcaccauuuacaccuaaauuaggauccguacaauuuagcacugacacugaaaacgacuucgaaacacaucaaaauacaaaauucacaccuguaggaguuauccaagauggagggacaacacaucgaaaugaaccucaacaauggguacuuccaucauauucaggaagagauguacauaauguacaucuagccccugcuguagcaccaacauucccaggagaacaauuauuauuuuuccgaucaacaaugccagguugcucaggauauccuaacauggacuuggauugccuuuuaccccaagaauggguacaacacuuuuaucaggaagcagcaccagcccaaagugauguagcauuauuacguuucgucaaucccgauacagguagaguauuauuugaauguaaacuacauaaaucaggcuauguaacaguagcacacacaggacaacaugaucuaguaauaccacccaacggauauuucagauucgacucauggguaaaucaauuuuacacacuagcacccaugggaaauggaacaggaagacgacgagcauuauaa

SEQ ID NO: 30982 - RNA, 1623 nt, Artificial Sequence
  derived and/or modified sequence opt6 from capsid_protein_VP1__Norovirus__AGE89532
augaaaauggcgucaaaugaugccaacccuucagacgguucagccgcaaaccuaguaccagaaguuucaaacgaaguuauggcccuagaaccgguaguaggugcugcaauagcagcaccagucgcaggccaacaaaacguaauagaucccuggauaagaaauaacuucguucaagcaccagguggagaauuuacaguauccccuagaaacgcaccuggagaaaucuuauggucagcaccauuaggcccagauuuaaacccauauuuaucacacuuagcacgcauguauaaugguuacgcaggaggcuucgaaguacaaguaauauuagcaggaaaugcauuuacugcuggcaaaauaauauucgcagcuguuccucccaacuuuccaacagaaggacucucaccuucucaaguaaccauguuuccucacauaaucguagauguuagacaacuugaacccguacuaauaccacuaccugauguaagaaacaauuucuaucauuacaaucaaaccaacgacucaacaauuaaauuaaucgcuaugcuauacacaccauuacgagcaaacaaugcgggagaagauguuuuuacaguuucaugucgaguacuaacaagaccuucuccagauuuugauuucauauuucucguuccaccaacaguagaaucaagaaccaaaccauucacaguuccaauacuuacuguagaagaaaugacaaauucacgauucccgaucccauuagaaaaauuauucacaggaccuucuggugcauucguaguacaaccacaaaacggucguugcacaacagacggaguacuauuaggaacaacucaauuaucaccaguuaauauauguacauuuagaggugacgucacacacauagcaggaucaagaaacuacacuaugaaucuagccucauuaaacuggaacaauuacgauccaacugaagaaauaccagcaccacuaggcacaccagacuuuguaggaaaaauacaaggaguacuaacacaaacaacaaaaggugaugguaguacuagaggacacaaagcaaccgucuacacaggcuccgcaccuuuuacaccaaaauuaggcucaguacaauuuucaacugauaccgaaaaugauuucgaaacacaucaaaauacaaaauuuacaccuguaggaguaauccaagacggcggaacuacacacagaaacgaaccucaacaauggguccuacccucauauucuggacgagauguacacaauguacacuuagcaccagccguagcaccaaccuuuccaggagaacagcuacuauuuuuucguucaaccaugccuggauguucaggauacccaaauauggaucuugacuguuuauuaccccaagaauggguucaacauuuuuaccaagaagccgccccagcucaaucagauguagcacuauuaagauuuguaaaccccgauacaggaagaguacuuuucgaaugcaaacuacauaaaucuggcuacguaacaguagcucacacuggccaacacgauuuaguaauaccaccaaauggcuauuucagauuugacucauggguaaaucaauucuacacacuagccccaaugggcaaugguacaggaagacgaagagcacuauaa

SEQ ID NO: 30983 - RNA, 1623 nt, Artificial Sequence
  derived and/or modified sequence opt6 from capsid_protein_VP1__Norovirus__AGE89535
augaagauggcaucaaacgacgcaaacccauccgauggaucagcagcuaauuuaguaccagaaguaucuaacgaaguaauggcucuagaaccuguaguaggagcugcaauagcagccccaguagcaggacaacaaaauguaaucgacccauggauaagaaacaacuuuguacaagcaccagguggagaauuuacuguaucuccuagaaaugcuccaggagagauacuauggucagcaccauuaggaccagaucucaauccauaucuaucacaccuagcaagaauguauaacggauaugcuggagguuuugaaguuagagucauacuagcaggaaaugcauucacugcagguaaaauaauauucgcagcaguuccaccaaacuuccccacagaaggacuaucuccaucacaaguaacaauguucccucauauaauagucgacguacgacaacucgaaccaguuuuaauaccucuuccagauguacgaaauaauuucuaccauuauaaucaaacuaaugacucaaccauuaaauuaauagcaauguuauacaccccacucagagcaaacaacgcaggugaagauguauucaccguuuccugucguguacuaacaagacccuccccagacuucgacuuuauauuucuaguaccuccaacaguagaaucaagaacuaaaccauucacagucccuauauuaacaguugaagaaaugacuaacuccagauucccaaucccauuagaaaaacuauuuaccggcccaucuggcgcauucguaguacaaccucagaacggaagauguacaacagacggaguacuuuuagguacaacacaauuaagcccaguuaacauauguacauuuagaggagacguuacacacauagcaggaucaagaaauuacacaaugaaucuagcaucauuaaacuggaauaacuaugauccaacagaagaaaucccugcaccauuaggaacaccugacuuuguaggaaaaauccaaggaguauuaacacaaacaaccaaaggugaugguaguacucgagggcauaaagccacagucuacaccgguucagccccauucacacccaaauuaggaagcguacaauucucaacagauaccgaaaacgacuucgaaacacaucaaaauacaaaauucacacccguaggaguaauacaagacggaggaacaacacauagaaaugaaccucaacaauggguacuacccucauauucagguagagacguucauaauguucacuuagcaccugccguagcaccaaccuuuccaggagaacaauuauuauuuuuuagaucaacaaugccagguugcuccggcuacccaaauauggacuuagacuguuuacuaccacaagaauggguacaacauuucuaucaagaagcugcaccagcacaauccgauguugcucuuuugagauucguaaauccagauacuggacgcguauuauucgaaugcaaacuacauaaaucugguuauguaacaguagcacauacugggcaacacgaucuaguaauaccuccuaaugguuauuuucgauuugacuccugggucaaucaauuuuacacucucgcacccaugggcaauggcaccggacgaagacgagccuuauaa

SEQ ID NO: 30984 - RNA, 1623 nt, Artificial Sequence
  derived and/or modified sequence opt6 from capsid_protein_VP1__Norovirus__AGE89538
augaaaauggccucuaaugacgcaaacccuucagauggaucagcugcaucuuuaguucccgaagucucaaacgaaguaauggcacucgaacccguaguaggcgccgcaauagcagcaccagucgcuggucaacaaaaugucauagaccccuggaucagaaacaacuuuguucaagcaccaggaggggaauuuacaguaucuccacgcaaugcuccuggcgaaauacuauggucugcaccacuaggaccagaucuaaauccauaccuaucccaccuagcuaggauguacaacgguuaugcaggaggcuucgaaguccaagucauacuagcaggaaacgcauuuacagcaggaaaaauuauauucgcagcaguucccccaaacuuuccuacagaaggacuaucuccuucacaagucacaauguuuccacacauaauaguugauguucgacaacucgaaccaguuuuaauaccacucccagauguacgaaauaauuuuuaccauuauaaccaaaccaaugacucaacaauaaaacucauagcuauguuauauacuccacuacgcgcaaauaaugcaggugaagaugucuuuacaguuuccugccgaguucuaacaagaccaucaccagacuuugauuuuauuuuucucguaccaccaacaguugaaucaagaacaaaacccuuuacaguuccuauauuaacuguagaagaaaugacaaauucacgauuccccauaccauuagaaaaacucuuuacaggcccuucaggcgcauucgucguccaaccacaaaaugguagaugcacaacugacggaguacuacuaggaacuacacaauuaucaccaguaaacauuuguacauuucgaggagacguaacacacauagcagguaguagaaauuacacaaugaaucuagcaucauuaaauuggaacaauuacgacccaacagaagaaauaccagccccacuagguacaccugacuuuguaggaaaaauacaagguguacuuacccaaacaacuaaaggagacggaucaacuaggggacacaaagcaacugucuauacagguuccgcaccauuuacaccuaaacuaggaucaguacaauuuucuacugauaccgaaaaugauuuugaaacacaucaaaauacaaaauucacucccguuggcguaauacaagaugguggaacuacacaucgaaacgaaccacaacaaugggucuuaccaaguuacucuggacgcgauguacauaauguacaccuagcaccagcagucgcaccaacauuuccaggagaacaacuacuauuuuuccgcucaacaaugccagguuguuccggauauccaaauauggaucuugacugcuuauuaccacaagaauggguacaacauuuuuaucaagaagcagcaccugcacaaucagacgcugccuuacuccgauucgucaaucccgacacaggcagaguacuauucgaaugcaaacuacacaaaucuggcuauguaacuguugcacacacuggacaacacgauuuagucauucccccaaaugguuauuucagauucgauuccugggucaaccaauuuuacacacuugcucccaugggaaauggcacaggaagaagaagagcauuauaa

SEQ ID NO: 30985 - RNA, 1623 nt, Artificial Sequence
  derived and/or modified sequence opt6 from capsid_protein_VP1__Norovirus__AGE89541
augaaaauggcuucaaaugacgccaauccuucagauggcucagcagcaaacuuaguaccagaaguaaguaaugaaguaauggcccuagaaccaguuguaggcgcagcaaucgcugcaccaguagcuggacaacaaaauguaauagaucccuggauuagaaauaauuuuguacaagcaccuggaggagaauuuacagucucaccccguaaugccccaggagaaaucuuauggucagcaccccuuggaccagauuuaaauccauaucuaucacaucuagcaagaauguacaacggauaugcuggcggauucgaaguacaagucauucuugcaggaaaugcuuucacagcaggaaaaauaauauucgcugcugucccuccaaacuuuccaaccgaaggauuaucaccaucucaaguuacaauguucccacacauaauaguagacgugagacaacucgaaccaguauuaauaccacuuccagauguuagaaauaauuucuaucacuacaaccaaacaaaugauucaacaauaaaauuaauagcuaugcucuacacuccacuacgagcuaacaaugcaggugaagauguuuuuacaguauccugccgaguucuaacacgaccuucaccagacuuugacuuuauauuucuaguuccuccuacaguugaaucaagaacuaaacccuucacuguuccaauauuaacagucgaagaaaugacaaauuccagauucccuauaccauuagaaaaacuauuuacagggccaucuggugcauucguuguacaaccacaaaacggaagauguacaacagauggcguccuacuaggaacaacacaacucucaccaguaaacauaugcacauucagaggagacguaacacauauagcuggaucaagaaacuacacaaugaaucuagcauccuuaaacuggaauaauuaugauccaacugaagaaauaccugcaccacuaggaacaccagacuuuguaggaaagauacaaggaguauuaacacaaacaacaaaaggagacgguucaacaagaggacauaaagcaacuguuuauacaggauccgcacccuuuacaccaaaauuaggcucaguacaauucucaacugacacagagaacgacuucgaaacacaccaaaauacaaaauucacuccagucggagucauacaagacggagguacuacacauagaaacgaaccccagcaauggguacuuccuucauauagcggaagagauguacacaacguacaccuagcaccagcaguugcuccaacauucccaggagaacaacuacuauucuuucgaaguacaaugccuggcuguucaggauacccaaauauggauuuagauugcuuacuaccccaagaauggguacaacauuucuaucaagaagcagcuccggcccaaucagauguugcauuauuaagauucguaaacccugauacaggaagggucuuauucgaauguaaacuacauaaaucuggauauguaacaguagcucacacuggacaacaugauuuaguaauuccaccaaacggauauuuucguuuugacagcuggguaaaucaauucuacacacuagcaccaaugggaaauggcacaggacgaagaagagcauuauaa

SEQ ID NO: 30986 - RNA, 1623 nt, Artificial Sequence
  derived and/or modified sequence opt6 from capsid_protein_VP1__Norovirus__AGE89544
augaaaauggcuucaaaugaugcaaauccaucagacggcucugccgcaaaccuaguuccagaaguuaguaacgaagucauggcacuagaaccaguaguaggcgcagcaauagcggccccaguagccggacaacaaaauguaauugacccauggauaagaaauaauuuuguacaagccccaggcggagaauuuacaguaagcccacgaaacgcaccaggagaaaucuuauggucagcaccucuagguccagaucuuaacccauaucuaucacacuuagcacgaauguauaaugguuacgcaggagguuuugaaguucaaguaauacuagcagguaacgccuuuaccgcaggaaaaauaauuuucgcagcaguaccuccuaauuucccuacagaaggauuaucuccaucacaaguuacaauguucccacauauaauuguagacguucgacaacuagaacccguauuaauaccauuacccgauguuagaaacaauuuuuaucacuauaaccaaaccaacgauucuacaaucaaauuaaucgcaauguuauacacaccauuaagagcgaauaaugccggagaagacguauuuaccguuucuugccggguucuaacacgcccaucaccugauuucgauuuuauuuuuuuaguaccucccaccguagaaucuagaacaaaaccuuucacaguuccuauacuaacaguggaagaaaugacaaacucaagauuuccaauaccauuagaaaaauuauuuaccggaccaucaggagcauuuguaguucaaccucaaaacggaagauguacaacagauggaguauuacuagguacaacacaauuaucuccagucaacauauguacauucagaggagacguuacacauaucgcaggaucacgaaauuacacaaugaacuuagcaucauuaaauuggaacaauuacgauccuacagaagaaauuccagcaccacuuggcacaccagauuucguaggcaaaauacaaggcgucuuaacacaaacaacuaaaggcgacggcuccacccgagggcauaaagcaacaguauacacaggaucagcaccauuuacaccaaaauuaggaucaguacaauuuucaacagauacagaaaacgauuucgaaacacaccaaaauacaaaauuuacaccuguaggaguaauacaagacggaggaacuacacauagaaacgaaccucaacaauggguauuaccuucauauucaggaagagacguucacaauguccauuuagccccugcaguagcaccaacauucccaggagaacaacuauuauuuuucagaucaacaaugccuggcugcucugguuacccaaauauggaucuagacuguuuacuaccacaagaauggguacaacauuuuuaucaagaagccgcaccagcgcaaucugauguggcauuauuacgauucguaaacccagauacaggaagaguuuuauucgaaugcaaauuacacaaaucaggcuacguaacagucgcacacacuggacaacaugauuuaguaauaccaccaaauggauauuuccgauucgauucauggguaaaucaauuuuacacgcuagcaccaaugggcaacggaacaggaagaagaagagcuuuauaa

SEQ ID NO: 30987 - RNA, 1623 nt, Artificial Sequence
  derived and/or modified sequence opt6 from capsid_protein_VP1__Norovirus__AGE89547
augaaaauggccuccaacgaugcaaacccaucugauggaucagccgcaaauuuaguaccugaaguaucaaacgaagucauggcacuagaaccaguaguaggugccgccauagccgcaccaguagcaggacaacaaaauguaauagacccuuggauaagaaauaauuucguacaagcaccuggaggugaauuuaccguaucaccacgaaaugcaccuggugaaauacuaugguccgcaccucuuggaccugaucucaacccauaucuaucacauuuagcaaggauguacaacggauacgcgggcggauuugaaguacaagucauacuagcagguaaugcuuuuacagcaggaaaaauaauauuugcagcaguccccccuaacuuucccacagaaggcuuaucaccaucacaaguuacaauguucccucauauaauuguagauguaagacaacuagaaccaguacuaauaccucuacccgacguacgaaacaauuucuaccauuauaaucaaaccaaugauucaacaauaaaacuaauagcaaugcuauacacaccacuaagagcuaacaacgcaggggaagaugucuuuacaguaucaugucgaguccuaaccagaccaucaccagacuuugacuuuauauuuuuaguuccaccuacugucgaaucccgaacuaaacccuuuacugucccuauauuaacaguagaagaaaugacaaacucaagauucccaauaccauuagaaaaauuauucacaggcccauccggagcuuucguaguacaaccucaaaauggaagaugcaccacugaugguguacuucucggaacaacacaacuaucaccuguaaacaucuguacauuuagaggagacguaacacauauagcaggcucacguaacuacacaaugaauuuagcaucacuuaacuggaauaauuacgacccaacugaagaaauaccagcaccauuaggaaccccagauuuuguugguaaaauacaaggaguacuuacacaaacaacuaaaggugauggcucaacuagaggacauaaagccacaguauacacagguuccgcacccuuuacaccaaaacuaggaucaguacaauucaguacagacacugaaaaugauuucgaaacacaucaaaauacuaaauucacccccguuggaguuauacaagacggauccacaacacauagaaaugaaccucaacaauggguucuaccauccuauucagguagagauguccauaacguccaccuagcaccugcuguagcaccuacauuuccaggagaacaacuacucuucuuuagaucaacaaugccaggcugcucaggguaccccaauauggaucuagauuguuuacuaccucaagaauggguacaacauuucuaucaagaagcagcuccagcacaauccgacguagcauuauuaagauuugucaacccagauacaggaagaguauuauucgaaugcaaacuacacaaaucaggcuaugucacagucgcacauacaggacaacacgaucuaguaauccccccuaauggauacuuccgauucgauucaugggucaaucaauucuauacacucgcaccaaugggaaaugguacuggacgccgcagagccuuauaa

SEQ ID NO: 30988 - RNA, 1623 nt, Artificial Sequence
  derived and/or modified sequence opt6 from capsid_protein_VP1__Norovirus__AGE89550
augaaaauggcaucaaaugaugcaaacccauccgaugguucagcagcaaacuuaguaccagaaguuuccaacgaaguaauggcacuagaaccaguaguuggagcagcaauugcagcaccaguagccggccaacaaaauguaauagauccauggauaagaaacaacuucguccaagcaccuggaggagaauuuacaguauccccacgaaaugcccccggagaaauauuauggucggcuccacucgguccagaucucaaccccuauuuaucacaucuugcaagaauguacaacggauacgcuggaggauucgaaguccaaguaauauuagcaggcaacgcuuuuacagcaggcaaaauaauauuugccgccguaccaccuaauuuuccuacagaagguuuaucaccaucacaaguuacuauguucccacacauaauaguagauguaagacaacuagaaccaguacuaauaccauuaccagacgucagaaacaauuuuuaccacuauaaucaaaccaaugacucuaccauaaaauuaaucgccauguuauauacaccauuaagagcaaacaaugcaggagaagaugucuucacuguuuccuguagaguacuuacaagaccauccccugauuuugauuucauauuccuagucccaccaacagucgaaucacgaacaaaaccauuuacaguacccauauuaacagucgaagaaaugacaaauucacgauuuccaauaccacuugaaaaauuauuuacuggccccucaggagccuuuguaguacaaccccaaaacgguagauguacaacugauggaguccuacuaggaacuacacaacuaucuccagucaacauaugcacauuuagaggagacguuacucacauagcaggaucuagagauuauacaaugaaccuagcuucacuaaauuggaacaauuaugauccaaccgaagaaauaccagcuccacuuggaacaccagauuucguaggaaaaauccaaggaguccuaacacaaacaacuaaaggagauggaucuacaagaggacacaaagcuacggucuauacugggucugcaccauucacaccaaaauuaggaucaguacaauuuuccacagauaccgaaaacgacuucgaaacacaccaaaacaccaaauuuacacccguaggaguuauacaagacggcggaacaacccacagaaaugaaccacaacaaugggucuuaccaucuuacagcgguagagauguacauaauguucacuuagcaccagcaguagccccaacauuucccggagaacaacuucuauucuuccgaucaacaaugccaggaugcucagguuauccaaacauggauuuagauugccuacuaccacaagaauggguacaacacuuuuaucaagaagccgcacccgcccaaucagacguagcuuuacuuagauuugucaacccagacaccggacgaguauuauuugaauguaagcuacauaaauccggauauguaacagucgcacacacaggccaacaugaccucguaauaccaccaaacggauauuucagauucgauucauggguaaaucaauuuuacacucucgcaccuaugggaaauggaacaggaagaagaagagcauuauaa

SEQ ID NO: 30989 - RNA, 1623 nt, Artificial Sequence
  derived and/or modified sequence opt6 from capsid_protein_VP1__Norovirus__AGE89553
augaaaauggcaucuaacgaugcaaauccgucugaugguucugccgcuaaucucguaccugaaguaaacaaugaaguaauggcacuggaaccaguaguaggugcagcaauugcugcaccuguagcuggacaacaaaacgucaucgacccuuggauacgaaacaauuucguacaagcaccaggaggcgaauuuaccguaucaccuagaaacgcaccaggagaaauauuauggucagcaccauuaggaccagaucucaauccuuaccuaagccacuuagcccgaauguauaacggcuacgcaggcggauucgaaguucaaguaaucuuagcaggcaacgccuucaccgcaggcaaaauaauauuugcagcaguaccaccuaacuuuccuacugaaggauuaucuccuagucaaguaacaauguuuccacacauaauaguagacguuagacaauuagaaccaguauuaauuccauuaccagaugucagaaacaacuuuuaccauuauaaucaaucaaacgauucuacuauaaaacuaauagcaauguuauauacaccacucagagcuaauaacgcaggagaagauguuuucacaguaucuugucgaguauuaacaagaccaucaccagacuuugacuucauauuuuuaguaccaccaacaguagaaagccgaacaaaaccauucacaguaccuauccuaacaguugaagaaaugacaaauuccagauuuccaauacccuuagaaaaacuauucaccggucccucuggagcauucguuguacaaccacaaaacggaagaugcacaacugacggaguucuuuuaggaacaacacaacuuuccccugucaauauauguacauuucgaggagauguaacacacauugcaggaucucgaaauuacacaaugaauuuagcaucacuaaacuggaacaauuacgauccaacagaagaaauaccagcuccacuaggaacaccugacuuuguaggaaaaauacaagguguucucacacagacuacaaaaggagacggcucuacucgaggccacaaagccacaguauauacagguagcgcacccuuuacaccaaaacuaggaucaguucaauucuccacagauacagaaaaugauuucgaagcucaccaaaacacaaaauucacaccaguuggagucauacaagacggaggaacaacacacagaaaugaaccucaacaauggguucuaccaucauacagcggaagagacguacauaauguccaccuagcaccagcaguugcuccuacuuuucccggagaacaauuacuauucuuuagaucuacaaugccaggauguuccggauauccaaacauggacuuagauugucuucuaccucaagaauggguacaacauuuuuaucaagaagcagcaccagcacaaucugaugucgccuuacuaagauuuguaaauccugacacaggcagaguacuauuugaaugcaaauuacacaaaucuggcuacguaacuguagcucacacaggacaacacgauuuaguaauaccaccuaacggauauuucagauuugauucauggguuaaucaauuuuacacauuagcaccaaugggaaauggaacaggaagaagaagagcccuuuaa

SEQ ID NO: 30990 - RNA, 1623 nt, Artificial Sequence
  derived and/or modified sequence opt6 from capsid_protein_VP1__Norovirus__AGE89556
augaaaauggcaucaaacgaugccaacccaagcgacggaucugcugccaacuuaguuccugaaguaucaaacgaaguuauggcacuagaaccaguuguaggagcugcaauagcagccccaguagcaggacaacaaaacguuaucgauccuuggauaagaaauaacuuuguacaagcaccuggcggugaauuuacaguaucaccucgaaaugcuccaggagaaauacuuuggucagcaccucucggaccagaucuaaauccauauuuaucgcauuuagcacgaauguauaacggauaugcaggugguuucgaaguacaagugauacuugcaggaaacgcauuuacagcaggaaaaauaauuuucgcugcaguaccacccaacuuuccaaccgaaggucuaucaccaucacaaguaacuauguuuccucauauuauaguagauguaagacaacuagaaccaguacuuauaccucuaccagacguacguaacaauuuuuaucacuauaaucaaacaaaugauuccacuaucaaacuaauagcaauguuauacacaccacuacgagcaaauaacgcaggagaagauguauuuacaguaucauguagaguauuaacuaggccauccccagacuuugauuuuauauuuuuaguaccacccaccgucgaaucacgaacaaaaccauucacagucccaaucuuaacagucgaagaaaugacaaauucuagauuucccauaccacucgaaaaacuauuuacaggaccaucuggagcuuucguuguacaaccccaaaacgguagaugcacuacagacggaguacuauuaggaacaacucaauuauccccaguaaacauuuguacauuuagaggugauguaacacauauagcaggcucaagaaauuauacaaugaaccuagcuucacuaaacuggaacaacuaugaucccacagaagaaauaccagcuccucuaggcacaccagauuuugucgguaaaauacaaggaguucucacucaaacaacaaaagaagauggaucaacaagaggccauaaagcuacagucuauacaggcucugcaccauucacacccaaauuaggaucaguacaauuuucaaccgauaccgaaaaugauuucgaaacacaucaaaauacaaaauucacaccaguaggcguaauacaagauggaggaacaacacauagaaaugaaccacaacaauggguacuacccagcuacucaggaagagauguacauaauguucauuuagcaccagcugucgccccaacauuuccaggugaacaacuacuauucuucagaucaacaaugccaggaugcuccgguuauccuaauauggacuuagauugccuucuaccucaagaauggguccaacacuucuaucaagaagcagcaccugcacaaucugacguagcacuuuuacguuucguuaacccagauacugguagaguacuauuugaaugcaaacuacauaaaucaggcuacguaaccguagcacauacaggacaacacgaucuaguuauacccccaaauggcuauuucagauucgauucauggguuaaccaauuuuacacacucgcaccaaugggaaauggaacaggcagaagacgagcuuuauaa

SEQ ID NO: 30991 - RNA, 1623 nt, Artificial Sequence
  derived and/or modified sequence opt6 from capsid_protein_VP1__Norovirus__AGE89559
augaaaauggcuucaaaugaugcaaacccuucugaugguuccgcugcaaaccuaguaccugaaguaucaaacgaaguaauggcuuuagaaccaguuguaggagcagcuauagcagcaccaguagcaggacaacaaaaugucauagacccuuggauacgcaauaacuuuguccaagcacccgguggagaauuuacaguaucaccaagaaaugccccaggagaaauauuauggucagccccacuaggaccugaucuaaaccccuaucuaucacaccuugcacgaauguacaauggguacgccggaggauuugaaguacaaguaauauuagcuggaaaugccuucacagcagguaaaauaauauucgcagccguaccuccaaacuucccuacagaaggacuaucaccaucccaaguaacaauguuuccacauauaauaguagauguaagacaacuagaaccaguauuaauaccuuuaccagacgucagaaacaacuuuuaccacuauaaucaaacuaaugauucaaccauaaaacuaauagcaauguuauacacccccuuaagagcaaauaaugcuggagaagauguauucacaguuucuuguagagucuuaacaagaccuucaccagacuucgacuuuaucuuucuagugcccccaacaguagaaucuagaaccaaaccauucacaguacccauuuuaacaguagaagaaaugacaaacucaagauuuccuauuccacuagaaaaacuauuuaccggaccuucuggagcuuucguaguacaaccacaaaacggucguuguacaacagauggcguauuauuaggaacaacacaacuaucucccguuaacaucugcacuuuuagaggugacguuacacauauagcaggaucaagaaauuacacaaugaaucuagcaucauuaaacuggaacaauuaugauccaacagaagaaauuccagcaccacuuggaacuccagacuucgucgggaaaauucaaggagucuuaacacaaacaacaaaagaagacggcuccacacguggacauaaagcaacaguauacaccgguucagcaccauuuacaccaaaauuagguaguguucaauuuucaacagauacagaaaaugauuucgaaacacaucaaaacacaaaauucacaccaguuggcguaauacaagacggagguacuacacacagaaaugaaccccaacaauggguuuuaccaucauacucaggcagagacguacauaacguacauuuagcuccagcaguagcaccaaccuuuccaggagaacaaauacuuuuuuuccgaucuacaaugccaggaugcucaggauauccaaauauggauuuagauugccuucuaccacaagaauggguacaacauuucuaucaagaagcagcuccagcacaaucagauguagcccuccuuagauucguaaacccugauacaggaagaguuuuauuugaaugcaaauuacacaaaucuggauacguaacggucgcacacacuggacaacacgaucuuguuauaccacccaacggauauuucagauuugauucauggguuaaucaauucuacacauuagcaccuaugggaaauggaaccggccgacgaagagcauuauaa

SEQ ID NO: 30992 - RNA, 1623 nt, Artificial Sequence
  derived and/or modified sequence opt6 from capsid_protein_VP1__Norovirus__AGE89562
augaaaauggcaucaaacgaugcuaacccaucagacggaucagccgcuucacuaguaccagaagucucaaaugaaguaauggcguuagaaccaguuguaggagcagcaauagcagcuccuguagcuggacaacaaaacgucaucgacccuuggauuagaaacaauuuuguacaagcaccaggaggugaauuuacaguaucaccaagaaaugccccaggagaaauauuauggucagcacccuuagguccagauuugaauccauauuuaucacacuuagcacgaauguacaauggauaugcuggaggauucgaaguucaaguaauacuagcuggaaaugcauucaccgcaggaaaaauaauauucgcagcaguaccaccuaauuuuccaacagaaggauuaucuccaucccaaguaaccauguucccccacauaauaguagacguaagacaauuagaaccuguucuaauaccacuaccagaugucagaaauaauuucuaucauuacaaccaaacaaaugacccaacaauaaaauuaauagccauguuauacacaccacuaagagcuaacaaugcaggagaagauguauucacaguaucauguagaguccuaaccagaccaucaccugacuuugacuuuaucuuuuuaguaccaccaacaguagaaucaagaacaaaaccuuucacaguaccaauacuaacaguagaagaaaugacaaacucccgauucccaauaccccuagaaaaauuauucacuggaccaucaggcgcuuuugucguccaaccacaaaauggaagauguacuacagacggaguauuauuagguacaacucaacuaucaccuguaaauaucugcacauuuagaggagauguaacacauauagcaggaucuagaaauuacacaaugaacuuagcuucauuaaauuggaacaauuaugaucccacugaagaaauacccgcacccuuaggaacaccagacuuuguuggaaaaauucaaggaguacuuacacaaacaacuaaaggagauggcucaacaagaggacauaaagcaacaguauauacaggauccgccccauuuacaccaaaauuaggcucaguucaauuuucaacagauacagaaaacgauuuugaaacucaucaaaauacaaaauucacaccaguuggcguaauccaagacggaggaaccacacacagaaaugaaccacaacaauggguacuaccuucauauucaggucgugauguccacaauguacaccuugcccccgccguagcacccacuuuuccaggagaacaacuccuauucuuuagauccacaaugccaggauguucaggauaccccaacauggacuuagauugccuacuaccacaagaauggguacaacauuucuaucaagaagccgcaccagcacaaucagacguagcuuuacuccgauuuguaaaucccgacacagguagaguauuauucgaaugcaaacuacauaaauccggcuauguaacugucgcacauaccggacaacaugaccuaguuauaccaccaaauggauauuucagauuugauucauggguaaaucaauuuuacaccuuagccccaaugggcaacggaacaggaagaagacgagcauuauaa

SEQ ID NO: 30993 - RNA, 1623 nt, Artificial Sequence
  derived and/or modified sequence opt6 from capsid_protein_VP1__Norovirus__AGE89565
augaaaauggcaaguaaugaugcaaacccaagcgaugguucagcagcaaaccuuguaccagaaguaucaaaugagguaauggcauuagaaccaguugucggagcagcaaucgcagcacccguagcaggucaacaaaaugucauagacccuuggaucagaaacaacuuuguacaagcaccaggcggcgaauucacaguaucaccaagaaaugcaccaggagaaauacuaugguccgcaccccuaggaccagaucuaaaucccuacuuaucacacuuagcaagaauguauaauggauaugcagggggauuugaaguccaaguaauauuagcaggaaaugcauuuacagcaggaaaaauaauauucgcagcaguaccaccaaauuucccuaccgaaggauuaucacccucccaaguaacaauguucccacacauaaucgucgauguaagacaacuagaaccaguacuaaucccauuaccagacguaagaaacaauuuuuaccauuauaaccaaacuaaugacucaacaauaaaacuuauugcaauguuauauacaccuuuacgagcuaacaaugcaggugaagacguauuuacaguaucauguagaguacuaacaagaccaucaccagacuuugauuuuauauuucuaguaccuccaaccgucgaaucaagaaccaaaccauuuacaguccccauacuaacaguagaagaaaugacaaacucacgauuucccauuccauuagaaaaauuauucacuggcccaucuggagcauuugucguccaaccacaaaacggaagauguacaacugauggaguauuauuaggaacaacacaauuaucaccaguaaacauauguacauucagaggagauguaacccauauagcagguucuagaaauuauacaaugaaucuagccucacuuaauuggaacaacuacgauccuacagaagaaacaccagcaccacuuggcaccccugacuuuguaggaaaaauacaaggaguccuaacccaaacuacaaaaggagacgggucaacaagaggucauaaagcaacaguauacacaggaucagcccccuuuacaccaaaacuaggcuccguacaauucucaacagacacagaaaacgauuucgaaacccaccaaaauaccaaauucacucccguaggaguaauccaagauggcggcacaacacaucgaaacgaaccacaacaauggguauuaccaucauacucaggacgcgauguacauaauguucacuuagcaccagcaguagcacccacauuuccaggcgaacaacuacuuuuuuuucgaucuacaaugccaggaugcucaggcuacccaaauauggaccuugauugcuuacuaccucaagaauggguccaacacuucuaccaagaagcagcaccagcacaaucagauguagcccuauuacgcuuugucaacccagacacugguagaguucuauucgaguguaaauuacacaaaucaggauacguaacugucgcccacacuggucaacaugaucuaguaaucccuccaaauggauauuuucgauucgauuccuggguaaaccaauuuuauacacuagcaccuaugggcaacgguacagguagaagacgagcauuauaa

SEQ ID NO: 30994 - RNA, 1623 nt, Artificial Sequence
  derived and/or modified sequence opt6 from capsid_protein_VP1__Norovirus__AGE89568
augaaaauggcuucuaaugaugcuaauccaucugauggaucagcagcaaacuuaguaccagaaguuucuaaugaaguuauggcacuagaaccaguaguaggagccgccauagcugcuccaguagcaggccaacaaaauguuauugauccauggauacgaaacaacuuuguccaagcaccaggaggagaauuuacaguaucaccaagaaacgcaccaggcgaaauccuauggucagcaccauuagggccagauuuaaauccauauuuaucccaucuagcccgaauguauaacgguuacgcaggaggcuuugaaguccaaguaauauuagcaggaaaugcauucacagcuggaaaaauaauauuugcagcaguuccaccuaacuuccccacugaaggauuaucuccaucacaaguuacaauguucccucacauuauaguugaugugagacaacuagaaccuguacuaauuccauuaccugacguaagaaauaauuucuaucacuauaaucaaacuaaugauucuaccauaaaacucauagccaugcucuauacacccuuacgugcaaauaacgccggagaagacguauuuacagucucuugcagaguacuaacacgcccuucgccugauuuugacuuuaucuuucucguuccaccaaccguagaaucaagaacuaaaccauuuacaguaccaauauuaacaguagaagaaaugacaaacuccagauuuccaauaccccuagaaaaauuauuuaccgguccaucaggagcauuugucguucaaccacaaaacggacgaugcaccacagacgguguacuacuagguacaacucaguuaucacccguuaacauauguacauuuagaggugacguaacacacauugccggaucccguaauuauacaaugaacuuagcaaguuuaaauuggaauaacuacgauccaacagaagaaauaccagcaccuuuagguacuccagacuucguaggaaaaauacaagguguacuaacucaaacgacgaaaggagacggaucaaccagaggacacaaagccacaguuuauacaggaagugcaccauuuacaccaaaacuaggaucaguacaauucucaaccgauacagaaaacgauuuugaaacccaucaaaauacaaaguucacgccaguuggaguaauacaagacggaggcacaacacacagaaaugaaccacaacaaugggugcuaccuucauauucaggcagagauguacauaauguacauuuagccccagcaguagcacccacauuuccaggugaacaauuauuauuuuuuagaucaacaaugccuggauguucaggauacccaaauauggaucuagacuguuuauuaccacaagaauggguacaacacuucuaccaagaagcagcuccagcacaaucagacgucgcauuauuacgauuuguaaacccagacacaggaagaguucuauuugaauguaaacuacauaaaucaggauauguaacagucgcacauacaggacaacacgaucuaguuauaccuccuaauggauauuuuagauuugauucauggguaaaccaauuuuacacauuagcacccaugggcaauggcacaggaagaaggagagcuuuauaa

SEQ ID NO: 30995 - RNA, 1623 nt, Artificial Sequence
  derived and/or modified sequence opt6 from capsid_protein_VP1__Norovirus__AGE89571
augaaaauggccucaaaugacgcaaauccaucagauggauccgccgcuaauuuaguaccugaaguaucuaaugaaguaauggcccuugaaccaguaguaggagcagcuauagcugcaccaguagcaggacaacaaaauguaauagauccuuggauaagaaauaacuuuguacaagcaccaggaggugaauucacaguaaguccuagaaacgcuccaggugaaaucuuaugguccgccccccuaggcccugauuuaaauccuuaccuaucucaccuagcaagaauguauaaugguuacgcgggcggauucgaaguacaaguaauauuagcaggaaaugcguuuacugcagguaaaauaauuuucgcagcaguaccaccaaauuuuccaacagaaggauuaucaccaucacaaguaacaauguuuccacacaucauaguagauguuagacaacuagaaccugucuuaauaccacucccagacguaagaaacaauuuuuaucacuacaaucaaacuaacgacucaacaauaaaauuaauagcaaugcuauacacacccuuaagagcaaauaacgcaggcgaagacguauucacaguaagcuguagaguacuaacuagaccuucaccagacuuugauuucauuuuucucguucccccaacaguagaauccagaacaaaaccauuuacuguuccaauauuaacaguagaagaaaugacuaauucuagauuuccuauaccauuagaaaaacuauuuacaggacccuccggcgcuuucguaguacaaccacaaaacggcagaugcacaacagacgguguacuacucggaacaacacaacuaucacccguaaacauauguacauuucgaggugacguaacacauaucgcaggaucacgaaacuacaccaugaaccucgcuucacucaacuggaauaauuacgaccccacagaagaaauaccagcaccauuaggcaccccagacuuuguuggaaaaauacaagguguacuaacacaaacgacaaaaggcgacgguuccacaagaggacacaaagcuacaguauacacuggaucagccccauuuacaccuaaacucggcucaguacaauuuucaacagauacagaaaacgauuucgaaacacaccaaaauacaaaauucacaccagucggaguaauacaagauggaggcacaacccauagaaaugaaccucaacaauggguauuaccaucauauuccggacgagauguacacaacguacaccucgcaccagcaguagcaccaacuuuucccggagaacaacuauuauuuuuuagaucaacaaugccaggauguucaggcuauccaaauauggaucuugacugucuauuaccacaagaauggguacaacauuucuaucaagaagccgcaccagcccaaucagauguagcuuuacuacguuucgucaacccagauacugguagaguccuauucgaauguaaacuacauaaaucaggauauguaacaguagcucacaccggacaacaugauuuaguaauaccaccaaauggcuauuuccguuuugauucaugggucaaucaauucuauacauuagcaccaaugggaaacggaacaggcagaaggcgagcuuuauaa

SEQ ID NO: 30996 - RNA, 1623 nt, Artificial Sequence
  derived and/or modified sequence opt6 from capsid_protein_VP1__Norovirus__AGE89574
augaaaauggcaucaaaugaugcuaacccauccgacggcagugccgcaaauuuaguaccugaaguuucaaaugaaguaauggcucuagaaccgguaguaggagcagcaauagcagcacccguagcuggccaacaaaauguaauagacccauggauuaggaauaacuucguacaagcaccuggaggagaauuuaccguuuccccaagaaaugcaccaggagaaauauuauggucagcaccacuaggaccugauuuaaacccauacuuaucacaccuagcaagaauguauaaugguuacgcaggcggauuugaaguacaaguaauacuugcaggaaacgcuuuuacagcuggaaaaauaauauucgcagcaguaccaccaaauuucccaacagaaggacuuagcccaucacaaguaacaauguuuccucacauaauaguagacguaagacaacuugaaccaguauuaaucccacuaccagauguaagaaauaauuuuuaccacuauaaccaaacaaaugacucaacuauuaaauuaauagcaaugcuauacacaccauuaagagcuaauaacgcaggagaagacguauucacaguaucaugcagaguucuaacaagacccagcccagacuuugauuuuauauuccuaguaccaccuacaguagaaucucgaacuaaaccauuuacaguaccaauauuaacagucgaagaaaugacaaacuccagguuuccaauaccucuagaaaaauuauucaccggaccaucuggagcauucguuguacaaccacaaaacggaagauguacaacugaugguguauuacucgguacaacacaauuaucaccagucaauauaugcacauuuagaggagauguuacacauauagcaggcucaagaaauuacacaaugaaucuagcuucucuaaacuggaauaauuacgaccccacugaagaaauacccgcaccucuaggaacaccugacuuuguagguaaaauacaagguguacuaacucaaacaaccaaaggagacggaucuacaagaggucacaaagcaaccguauauacagguagugcaccauucacaccaaaauuaggaaguguccaauuuaguacugacacagaaaacgauuuugaaacacaucaaaacacaaaauucacuccaguuggagucauccaagacggaggaaccacacaccgaaacgagccacaacaauggguacuaccaucauacuccggaagagauguacauaauguacaccuagcaccagcaguugcaccaacuuucccaggugaacaacuauuauuuuuuagaucaacaaugccaggaugcucugguuacccaaacauggaccucgauugcuuauuaccacaagaguggguacaacauuucuaucaagaagcagccccugcacaaucagacgucgcauuauuacgauucguaaacccagacacuggaagaguacuauucgagugcaaacuacauaaaucuggcuaugucacagucgcccacacaggccaacacgaccuaguaauaccaccaaaugguuauuucagauucgauuccuggguaaaucaauuuuauacauuagcaccaaugggaaauggaacuggaagaagacgcgcauuauaa

SEQ ID NO: 30997 - RNA, 1623 nt, Artificial Sequence
  derived and/or modified sequence opt6 from capsid_protein_VP1__Norovirus__AGE89577
augaaaauggcuucaaacgaugcaaauccaucugaugguucugccgcaaaccuaguaccagaaguuucuaaugaaguaauggcacuagaaccaguagucggagccgcaauagcagcaccuguagcaggacaacaaaacguaaucgauccauggauacgaaacaacuucguacaagcuccaggaggagaauucacaguaucaccaagaaacgcaccuggagaaauccucuggucagccccacuagggccagaccuuaauccauaucuuucucauuuagcaagaauguauaaugguuaugcaggagguuucgaaguacaaguuauauuagcaggaaaugccuucacagcuggaaaaauaauauuugcagccguaccucccaauuuccccacugaaggauuaucaccaucacaagucacaauguucccacacauaauuguugauguacgacaacuagaaccaguacuaauaccccuuccagacguucguaacaauuuuuaucacuauaaccaaacaaacgacucuacaauaaaauuaauagcuaugcuuuacacuccauuacgcgcaaauaaugcaggagaagauguuuuuacagucucauguagaguuuuaaccagaccauccccugacuuugauuuuauauuucuaguaccucccaccguugaaucaagaacaaaaccauucacuguuccaauauuaacaguagaagaaaugacaaauucuagauucccaauuccucuugaaaaacucuuuacuggacccucaggagccuucguaguucaaccccaaaacggaagaugcacaacagacggaguacuacuagguacuacucaauuaucaccaguaaacaucugcacauuucgaggagauguaacacacauagcaggaucacgcaauuauacaaugaacuuagcuucacuaaacuggaacaauuaugaucccacagaagaaauaccagccccacucggaacaccagacuuuguagguaaaauucaagguguacucacucaaacaacuaaaggcgacgguucaacaagaggucacaaagcuacaguauauacaggaucugcuccauuuacacccaaacuaggcaguguacaauuuucuacugacacagaaaacgacuuugaaacacaucaaaauacaaaauuuacaccuguaggcguaauacaagacggaggcacaacacauagaaacgaaccacaacaauggguucuuccuucauacagcggacgagauguacacaauguacacuuagcuccagcaguagcaccaacauuucccggugaacaacuacuauuuuucagaucaacaaugccaggaugcagcggauauccaaauauggaccucgacugccuauuaccacaagaauggguacaacauuucuaucaagaagccgcaccugcacaaagcgauguagcacuacuacgcuuuguuaauccagacacugguagagucuuauuugaaugcaaauuacacaaaaguggauaugucacaguagcacacaccggacaacacgauuuaguuauaccccccaacggauacuucagguucgauucauggguaaaccaauuuuacacacuagcaccaaugggcaacggcaccggaagaagaagagccuuauaa

SEQ ID NO: 30998 - RNA, 1623 nt, Artificial Sequence
  derived and/or modified sequence opt6 from capsid_protein_VP1__Norovirus__AGE89580
augaaaauggcaagcaaugacgcuaauccuucagauggaagugcagcaaaccuagucccagaaguaucaaaugaaguaauggccuuagaaccaguaguaggagcagcaauugccgcaccaguagcuggacaacaaaacguaauugacccauggauaagaaauaacuucguacaagcaccuggaggugaauuuacaguaucgccaagaaaugcaccuggugaaauauuauggucagcaccacucggacccgaucuaaauccauaccuaucucacuuagcccgaauguauaacggauacgcuggaggauucgaaguucaaguaauucuagcaggaaaugcauuuaccgcaggaaaaauaauauucgccgcaguaccacccaauuucccaacagaaggacucucaccaucacaagucacaauguucccacacauaauaguugauguaagacaacuugaacccguacuaaucccauuacccgauguuagaaauaacuucuaccacuacaaccaaacaaaugauaguacaauaaaacucauagccaugcuauauacuccacuucgagcaaauaaugcaggcgaagacguuuucacuguaucaugcagaguacuaaccagaccuucaccugauuuugauuucauuuuuuuaguacccccuaccguagaaucuagaacuaaacccuuuacaguuccuauacuaacaguagaagaaaugacaaauucuagauuuccaauuccacuagaaaaauuauucacaggaccaucuggagcuuucgucguacaaccacaaaacggcagauguacaacagacggaguucuucuaggaacaacacaauuaucaccuguaaauauauguaccuucagaggcgauguuacacauaucgcugguuccagagacuacacuaugaaccucgcaucacuuaauuggaacaauuaugacccaacugaagaaaucccugcuccacuagguacacccgauuuugucggaaaaauacaaggcguacuaacacaaacaacaaaaggugauggaucaacaagaggacauaaagcaacuguuuacacagguucagcaccauucaccccuaaauuaggaagcguacaauuuuccacagauacagagaacgauuucgaaacacaccaaaacacaaaauucacaccaguagguguaauacaagacggaggaacaacacacagaaaugaaccacaacaauggguacuaccgucauauuccggacgagauguacauaacguacacuuagcaccagcaguugcuccaacauuuccaggagaacaacuauuauuuuuuagaucaacaaugccagguuguucaggauacccaaauauggauuuagauugucuacuuccacaagaauggguacaacauuucuaucaagaagcagcaccagcacaaucagauguagcacuuuuaagauucguaaauccagacacaggaagaguuuuauucgaauguaaauuacacaaaagcggauauguaacaguagcucacacaggucaacacgaucuaguaauaccaccuaauggauauuuucguuuugacuccuggguaaaccaauuuuauacauuagcaccaaugggaaauggcacaggaagacguagggcuuuauaa

SEQ ID NO: 30999 - RNA, 1623 nt, Artificial Sequence
  derived and/or modified sequence opt6 from capsid_protein_VP1__Norovirus__AGE89583
augaaaauggcuagcaacgaugcaaacccuucugacggaucagcagcaaauuuaguaccagaaguuucaaaugaagucauggcuuuagaaccaguaguaggugcagcaauagcagcaccuguggcaggucaacagaauguuauagacccauggauuagaaauaacuuuguccaagcuccugguggagaauucacuguauccccacgaaaugcaccaggugaaauauuauggucagcaccucuaggaccugaucuaaaccccuaccuaucccauuuagcacguauguauaauggauacgcaggaggauucgaaguacaaguuauauuagcaggaaaugcauucacugcaggaaaaauaauauucgcugcaguacccccaaauuucccaaccgaaggacuaucaccaucacaaguaacuauguuuccacauauaauaguugauguuagacaacuagaaccaguauuaaucccauuaccagauguacgaaauaauuucuaucacuauaaucaaaccaacgauucaacaauaaaacuaauagcaaugcuauauacacccuuaagagcaaacaaugcaggagaagacguauuuaccguuucaugccgaguucucacacgaccaucaccagacuuugauuucaucuuccuaguaccaccaacaguagaaucacgaacuaaacccuucacaguaccaauacuuacaguugaagaaaugacaaacucaagguucccaauaccacuagaaaaacuauuuacaggaccgucuggagccuuugucguacaaccacaaaauggaagauguacaacagacggaguacuccucggaacaacacaacucucaccaguaaauauuugcacauuccgaggagauguaacccacauagcugguucuagaaauuacacaaugaauuuagcuuccuuaaacuggaauaauuacgauccaacugaagaaauaccagcaccucuaggaacaccugauuuuguaggaaaaauacaaggaguucuaacucaaacaacaaaaggagauggauccacacgaggacauaaagcuacaguauauacuggaucagcaccauuuacaccaaaauuaggauccguccaauucagcacagauacagaaaaugauuuugaaacacaucaaaacacaaaauuuacacccguuggaguaauacaagacgguggaacuacucaccguaacgaaccacaacaauggguacuaccaucauauucuggaagagauguucauaacguucacuuagccccagcuguugcaccaacauucccaggugaacaauuauuauucuuucgauccacuaugccagguuguucaggauacccuaauauggaucuagacugucuacuaccucaagaauggguucaacacuucuaucaagaagcagcaccagcccaaucagacguagcacuuuuacgauuuguuaauccagacaccggaagaguacuauuugaauguaaacuacacaaaaguggauaugucacagucgcacacacuggccaacacgaucuaguuauaccuccaaauggauauuuuagauuugauucaugggucaaucaauuuuacacacuagcaccaaugggaaacggaacaggaagaagaagagcucucuaa

SEQ ID NO: 31000 - RNA, 1623 nt, Artificial Sequence
  derived and/or modified sequence opt6 from capsid_protein_VP1__Norovirus__AGE89586
augaaaauggcuucaaaugacgcaaauccaucagauggcuccgcagcaaacuuaguaccugaagucucaaacgaaguuauggcacuagaacccguaguaggagcagcaauagcugcaccuguagcaggacaacaaaaugucauagauccauggauacgaaauaacuuuguucaagcaccaggaggagaauuuacuguaucuccuagaaaugcaccuggagaaauacuaugguccgcaccacucggaccagauuugaacccauauuuaucucacuuagcaagaauguauaacgguuacgcaggaggauucgaaguacaagucauacuagccgguaaugcuuuuaccgcuggaaaaauaauauuugcagcaguaccuccaaauuucccuacagaaggacuaucuccaucacaaguaaccauguucccucacauaauaguagacguucgacaacuugaaccaguccucauaccauuacccgauguuagaaacaauuuuuaucacuauaaccagacaaacgacccaaccauuaaacuaaucgcuaugcucuacacaccauuaagagcaaacaacgcaggcgaagacguuuucaccguuucuugcagaguauuaacacgaccaucaccagauuucgacuuuauauuuuuaguacccccaacaguagaauccagaacuaaaccuuucacuguaccaauauuaaccguagaagaaaugacuaauuccagauuuccaauuccucuagaaaaacuauucaccggaccaucaggugcauuuguaguacaaccccaaaacggcagaugcacaacagauggaguauuauuaggaacaacucaauuaucaccuguuaauauauguacauuuagaggagauguuacacauaucgcuggaucaagaaacuauacuaugaaucuagcaucacuaaauuggaauaacuaugauccaacagaagaaguuccugccccauuaggaacaccugacuucguaggaaaaauacaagguguacuaacccaaacuacaaaaggagauggaucuacaagaggacauaaagcaacagucuacacaggaucugcucccuucacuccaaaacuaggaucaguacaauuuucuaccgacacggaaaacgacuuugaaacacaccaaaauaccaaauuuaccccaguaggagugauacaagauggaggcacuacccauagaaaugaaccacaacaauggguuuuaccauccuauaguggaagagacguccauaauguacauuuagcaccagcaguagcuccaacauuucccggugaacaauuacuauuuuuucgaucuaccaugccaggaugcucagguuauccaaauauggauuuagauuguuuacucccacaagaauggguucaacauuucuaccaagaagcagcgccugcccaaucagauguagcuuuacuaagauucguaaacccagauaccggacgaguauuauuugaaugcaaacuacauaaaucaggauacguuacuguagcucacacuggacaacacgacuuaguaauacccccaaacggauauuucagauucgauucauggguuaaucaauuuuauacuuuagcaccaaugggaaacggaacaggcagaagaagggcauuauaa

SEQ ID NO: 31001 - RNA, 1623 nt, Artificial Sequence
  derived and/or modified sequence opt6 from capsid_protein_VP1__Norovirus__AGE89589
augaaaauggcaucuaaugaugcaaacccaucugauggaucagcagcuaaccuaguaccagaaguaucuaaugaaguaauggcauuagaaccaguaguaggugcagcaaucgcagcaccaguugcuggacaacaaaacguaauagacccauggauaagaaauaauuuuguacaagcaccagguggcgaauuuacaguaucaccacgaaaugcaccuggagaaauauuauggucagcuccucucggcccagaucucaacccauaccuaucacaccuagcaagaauguauaacggauaugcaggaggcuuugaaguacaaguuauauuagcuggaaacgcauucacagcuggaaaaauaauauuugccgcaguaccaccaaacuuccccaccgaaggacuaucucccucucaaguaacaauguuuccucacauuauagucgacguucgacaacuagaaccaguuuuaauaccucucccagacgucagaaacaauuucuaccauuauaaccaaacuaaugacucaacaauuaaacuaauagccauguuauacacaccauuaagagcaaacaaugcaggagaagauguauuuacaguuucuugucguguuuuaacucgccccuccccugauuucgacuuuaucuuucuuguuccaccuacugucgaaucaagaacuaaaccauucacugucccaauacuuacugucgaagaaaugacuaauucaagauucccaauaccucuagaaaaacuauuuacaggaccaucaggagccuuuguuguacaaccacaaaacgguagauguaccacugauggaguacuacucgguacaacucaacuuucaccaguaaauaucuguacauuucgcggagacguaacacauauagcuggaucuagaaauuauacaaugaacuuagcuucuuuaaacuggaacaacuacgauccaacagaagaaauacccgcaccauuagguacacccgauuuuguagguaaaauucaaggaguacuaacacaaacaaccaaaggcgacggauccacaagaggucauaaagcaacaguuuacaccggaucagcuccauuuaccccaaaauuaggaucuguccaauuuuccacagauaccgaaaacgauuucgaaacacaccaaaauacuaaauuuaccccaguaggaguaauccaagauggagguacuacacaccgcaacgaaccucaacaauggguccuaccaucuuauucaggacgagauguacacaauguucaucuagcaccagcuguagcaccaacauuucccggcgaacaauuauuauucuuucgauccaccaugccaggaugcucaggauauccaaacauggaucuagauugccuauuaccucaagaauggguacaacauuuuuaccaagaagcagccccugcacaaucagacguagcccuacuacgcuucguaaauccugauaccggaagaguacuauucgaaugcaaacuacauaaauccggauauguaacaguugcucauaccggacaacaugaccuaguaauacccccaaauggauacuucagauucgauuccuggguaaaucaauucuauacucuagcaccaaugggaaauggaacuggaagaagaagagcauuauaa

SEQ ID NO: 31002 - RNA, 1623 nt, Artificial Sequence
  derived and/or modified sequence opt6 from capsid_protein_VP1__Norovirus__AGE89592
augaaaauggcaucaaaugaugcaaacccauccgauggaucagcugcaaaccuugucccagaaguaucaaacgaaguaauggcauuagaaccaguuguaggagcugcaauagcagcaccuguugcuggucaacaaaaugugauagauccauggauaagaaauaacuuuguucaagcaccuggaggagaauuuaccguaucuccaagaaacgcaccaggagaaauacuuuggucagcaccauuaggcccagaucuaaauccauaucuaagucauuuagcucgaauguauaacggauaugcaggcgguuuugaaguacaaguaauuuuagcaggaaaugcauuuacugccggcaaaauaauauucgcagcaguaccucccaacuuucccacagaaggacuaucaccaucucaagucacaauguucccccauauaauaguagauguuagacaacuagaaccugucuuaaucccccuuccagauguaagaaacaauuuuuaccauuauaaucaaacaaacgauucuacuauaaaacuaauagccauguuauauacacccuuaagagcaaacaacgcaggagaagacgucuuuacaguuucuuguagaguucuaacacgaccuucaccagauuuugauuuuauauuccuaguaccaccaacugucgaaucaagaaccaaaccauucacaguaccaauauuaacaguagaagaaaugacaaauucacgauuuccuauaccauuagaaaaacuuuucacaggaccaaguggagcauuuguaguacaaccacaaaauggaagauguacaacagacggaguacuccugggaacuacacaauuaucuccagucaauauauguaccuucagaggcgacguaacacacauagcaggaucgcgaaauuacacuaugaauuuagcuucacuuaauuggaacaauuacgauccaaccgaagaaauaccagcuccacuagguacuccagauuuugucggcaaaauacaaggcguuuuaacucaaacaacaaaaggugaugguucuaccagaggacauaaagccacaguauacacaggauccgcaccauuuacaccaaaauuaggaucagugcaauucucaacugauaccgaaaacgauuuugaaacacaucaaaacacaaaauuuacaccaguaggaguuauacaagacgguggaacaacacauagaaacgaaccacagcaauggguauuaccaucuuauucaggacgugauguucacaacguccaccuagcaccugcaguagcacccacauucccaggagaacaacuacuuuuuuuuagaucuacaaugccaggaugcuccggcuacccaaauauggaccuagauuguuuauuaccacaagaauggguacaacauuuuuaucaagaagcagccccagcacagucugauguagccuuacuccgauuuguaaacccagacacaggacgaguccuauucgaauguaaacuacacaaaucuggauauguaacuguagcacauacuggacaacaugacuuagucauuccaccaaauggauauuuucguuucgauucauggguaaaccaauuuuacacacuagcaccaaugggcaauggaacagguagaagacgagcacuauaa

SEQ ID NO: 31003 - RNA, 1623 nt, Artificial Sequence
  derived and/or modified sequence opt6 from capsid_protein_VP1__Norovirus__AGE89595
augaaaauggcaucaucagacgcaaauccaucagacggaucaaccgcaaacuuaguaccugaaguaaauaacgaaguaauggcauuagaacccguaguaggcgcagcuauugcagcaccuguagccggacaacaaaauguaaucgacccauggauacgcaauaacuuuguacaagccccaggaggagaauucacagucucaccaagaaacgccccaggagaaauacuauggagcgcaccuuuagguccugaccuaaacccauauuuaucccaucuagcaagaauguauaauggauacgcaggugguuuugaaguccaaguaauucucgcaggcaacgcauuuacagcuggcaaaauaauauuugcagccguuccaccaaauuucccaacagaagguuuaucaccuucucaagucaccauguuuccacauauaaucguugauguccgacaacuagaaccaguacuaauaccacucccagacguccgaaacaauuuuuaucacuacaaccaaucaaaugacccaacaauuaaacuaauagcaauguuauauacuccccuucgcgcuaacaacgcaggugacgacguuuuuacagucuccugcagaguacucacaagaccaucaccagacuuugauuuuauauuucuagucccacccacaguugaaagccgaacaaaaccauuuucaguaccaguacuaacaguggaagaaaugacuaacucaagauuuccaauaccacuagaaaaacuuuucacaggaccaagcucagcauucguaguacaaccucaaaauggcagaugcacaacagauggaguucuauuaggaacaacacaauuaucaccuguaaauauauguaccuuccgaggagaugucacccacauacccggaucuagaaacuauaccaugaauuuagcaucacaaaauuggaauuccuaugaucccacagaagagauaccugcaccacuaggaacaccagauuuuguaggaaaaauacaaggaguacuuacacaaacaacccgaaccaauggcucuaccagaggacacaaagcaacagucuacacaggaucagcugacuuuucuccaaaacucggaagaguacaauucgcaacagauacagacaacgauuucgaaacaaaucaaaacacaaaauucacaccaguaggaguuauacaagacggaucaacaacaccacgaaacgaaccacaacaauggguacuuccaucauauucaggacgaaacauacauaacguacaccuagcacccgcaguagcaccuacauuuccaggcgaacaauuacucuuuuuucgaucuacaaugccaggaugcucaggauauccaaacauggaucucgacugucuuuuaccucaagaauggguacaauauuuuuaucaagaagcagcaccagcacaaagugauguugcucuauuaagauucguaaauccagauacaggaagaguacuauucgaauguaaacuacacaaaucuggcuaugucacaguagcacacacaggacaacaugaccuuguuauaccaccaaaugguuacuuccguuuugauucauggguaaaucaauuuuacacauuagcacccaugggaaauggcacaggaagacgaagagcacuuuaa

SEQ ID NO: 31004 - RNA, 1623 nt, Artificial Sequence
  derived and/or modified sequence opt6 from capsid_protein_VP1__Norovirus__AGE89598
augaaaauggcauccaaugacgccaacccaucagacggaucagcagccaacuuaguaccugaaguaucaaaugaaguuauggcauuagaacccguaguaggcgcagcaauagcagcacccguagccggacaacaaaauguaauagacccauggauaagaaauaauuuuguacaagcaccugguggagaauuuacuguauccccacgcaacgccccaggagaaauucucuggucugcaccacuuggaccagaucuaaauccauaucuaucacaccuagcacgcauguauaacgguuacgccggaggauuugaaguacaaguaauucuagcagguaaugcauuuacagcaggcaaaauaauauucgcugcaguaccacccaauuuucccaccgaaggauuaucucccucccaaguaacaauguucccacauauuauaguugauguaagacaauuagaaccagucuuaauaccacuaccagauguuagaaacaauuucuaucauuauaaccaaaccaacgauaguacaauuaaauuaauagcaauguuauauaccccacuucgcgcaaacaaugcaggagaagacguauuuacaguaucauguagagucuuaaccagaccaucaccagauuuugacuuuauauuuuuaguacccccaacaguugagucuagaacuaaaccauuuacaguaccaauauuaaccguagaagaaaugacaaauucaagauuuccaauaccacuagaaaagcuauuuacaggacccucuggagcauucgucguucaaccucaaaacggaagauguacaacagacggugucuuacuugguacaacacaacuuucuccaguaaauauauguacauuuagaggagacguaacccacauagccggaucucgcaauuacaccaugaauuuagcaucauuaaacuggaacaauuaugauccaacagaagaaauaccagcaccauuaggaaccccagacuuuguaggaaaaauacaaggaguacucacccaaacuacaaaaggcgauggauccacaagaggacacaaagccaccguauauaccgguagcgccccauuuacaccaaaacuaggauccguacaauucucuaccgauacagaaaaugauuucgaaacucaccaaaauacaaaauuuacuccagucggcguaauacaagauggagguacaacacaucguaaugaaccacaacaauggguacuaccaucauauuccggucgagauguacaaaauguacaccuagcaccagcaguugcaccaacauuuccaggggaacaacuauuauucuuccgauccacuaugccaggaugcucugguuauccaaacauggaucucgauugccuacuuccacaagaauggguucaacauuucuaccaagaagccgcaccagcacaaucagacguagcuuuacuaagauucguuaacccugacacaggaagaguauuauucgaaugcaagcuucacaaaucaggauacgucacuguagcacauaccggacaacacgaucuaguaauaccacccaauggauauuuuagauucgauuccugggucaaucaauuuuauacuuuagcaccgaugggaaauggaaccgguagaagacgcgcccucuaa

SEQ ID NO: 31005 - RNA, 1623 nt, Artificial Sequence
  derived and/or modified sequence opt6 from capsid_protein_VP1__Norovirus__AGE89601
augaaaauggccucaaaugaugcuaacccaucagacggaucugcagcaaaccuuguaccugaaguuucaaaugaaguaauggcacuagaaccuguaguaggagcagcaauagcagccccaguagcuggacaacaaaaugucauagauccauggauaagaaacaacuuuguacaagcaccuggaggugaauuuacaguaucccccagaaacgcacccggugaaauacuauggucagcaccacuaggaccagacuuaaacccauacuuaucccaucuagcacgcauguauaacggauacgccggcggauucgaaguacaaguaauacuagcaggaaaugcauuuacagcaggaaaaauaauauuugcagcagucccaccaaauuuuccaacagaaggcuuaucccccucccaaguaaccauguucccacacauuauuguagacgucaggcaacuagaaccaguacuuauuccacuaccagauguacgcaauaauuuuuaccauuauaaucaaacaaaugacucaacaauaaaacuaauagcuauguuauacacaccauuaagagcaaacaaugccggugaagauguauuuaccguaucaugcagaguauuaacaagaccaucaccagauuucgacuucaucuuuuuaguaccaccuacaguugaaucacgcacuaaacccuuuacaguuccaaucuuaaccguugaagaaaugacaaacucaagauuuccaauaccauuagaaaaacuauucacaggcccaucaggagccuuuguuguacaaccacaaaacggucgauguacaacugacggaguucuauuaggaacaacacaauuaucaccuguaaauauauguacauuuagaggcgauguuacucacauugcuggcucaagaaacuauacaaugaauuuagccucacuaaacuggaacaacuaugauccuacagaagaaauaccagcaccucucgguaccccagacuuuguaggaaaaauacaaggaguacuaacacaaaccacaaaaggugacggguccacacgaggucauaaagcaacugucuauacaggaagcgcacccuuuacuccaaaauuaggaucaguacaauucaguacagauacagaaaaugauuucgaaacccaucaaaauacaaaauucacaccuguaggugucauacaagacggagguacaacacauagaaaugaaccucaacaauggguacuaccuucauauucagguagagauguacacaauguacauuuagcuccugcuguggcaccuacuuuuccaggcgaacaauuauuauucuuuagauccacuaugccagguuguucaggcuauccaaacauggaccuugauugcuuacuaccacaagaauggguacagcauuucuaccaagaagccgcacccgcccaauccgauguagcauuacuaagauucguaaacccagauacuggaagaguauuauucgaaugcaaacuccauaaauccggauaugucacuguugcacacacaggccaacaugaucucguaauuccaccaaauggcuacuucagauucgauuccuggguaaaccaauuuuacacacucgcaccaaugggaaauggcacaggaagaaggagagcacuauaa

SEQ ID NO: 31006 - RNA, 1623 nt, Artificial Sequence
  derived and/or modified sequence opt6 from capsid_protein_VP1__Norovirus__AGE89604
augaaaauggcaucaaaugaugcaaacccaagcgaugguucagcagcaaauuuaguaccugaaguaucaaacgaagucauggccuuagaaccagucguaggagcagcuauugcagcaccagucgcagggcaacaaaauguaauagacccauggauucguaauaacuuuguacaagcaccaggaggcgaauucacaguuucuccuagaaaugcaccaggugaaauacuauggucagcaccauuagguccugaucuuaauccauaucuaucucacuuagcaagaauguauaauggauacgccggcggauuugaaguccaaguuauccucgccggaaacgcauuuacagcaggcaaaauaauuuuugcagcaguaccacccaauuuuccaacagaaggucuaagcccaucucaaguaaccauguucccucacauaauaguugauguaagacaacuugaaccaguauuaaucccacuaccagacguucgcaauaacuuuuaucauuauaaccaaacaaaugauagcacaauaaaacuaauagcaaugcucuacacuccucuaagggcaaauaacgcaggagaagauguauuuacaguaucuuguaggguacucacaagaccaucaccugauuuugacuuuauuuucuuagucccuccaacaguagaaucacgaacaaaaccuuuuacugucccaauucuaacuguagaagaaaugacaaauaguagauuuccaauaccauuagaaaaauuauucacaggaccauccggagcauucguaguacaaccacaaaacggaaggugcacaacagacggaguacuacucggaacaacacaacuaucccccguaaauauauguacuuuuagaggagacguuacacauauagcaggcuccagaaacuacaccaugaaccuugcuucauuaaauuggaauaauuacgauccaacggaagaaauuccagcuccacuaggaaccccagacuuuguaggaaaaauacaaggcguauuaacucaaaccacuaaaggcgacgguucaacaagaggacacaaagcaacaguuuacacuggaucagcaccauuuacuccaaaacucggcucuguucaauuuucaacugauacagaaaacgacuuugaaacacaucaaaacacaaaauuuacucccguaggagucauucaagauggaggaacuacacacagaaaugaaccccaacaauggguacuaccuuccuauuccggaagagacguacauaauguacauuuagcaccagcggucgcaccaacauucccaggagaacaauuacuauuuuuuagaucaaccaugcccggauguucaggauauccaaauauggaucuagauugccuauuaccacaagaauggguucaacauuuuuaucaagaagcagcaccugcccaaucagacguagcacuacugagauucguaaacccugauacaggaagaguuuuauucgaaugcaaacuacauaaauccggauauguaacaguagcccacacaggucaacacgauuuaguaauuccaccaaaugguuauuuccgauuugauucuugggucaaucaauuuuauacauuagcaccaaugggaaauggaacaggaagaagacgugcucucuaa

SEQ ID NO: 31007 - RNA, 1623 nt, Artificial Sequence
  derived and/or modified sequence opt6 from capsid_protein_VP1__Norovirus__AGE89607
augaaaauggccucaaacgaugcaaacccuucagauggaucagcugcaaacuuagucccugaagucaguaacgaaguaauggcacuugaaccaguaguaggcgcagcaauagcagccccuguagcuggucaacaaaacguaaucgacccauggauacgaaacaauuuuguacaagcaccaggaggugaauuuaccgugaguccaagaaaugcaccaggcgagauauuauggucagccccucuuggaccagacuuaaaucccuaccuaucacacuuagccagaauguacaauggauacgcagguggauuugaaguacaaguaaucuuagcaggaaaugcauuuacagcaggcaaaauaauauucgcagccguaccaccaaauuucccaacagaagguuuaagccccucucaaguuacaauguucccucauauaauuguagacguaagacaauuagaaccaguauuaauuccauuaccagauguacgaaacaauuucuaucacuauaaucaaacaaaugacucaacaauaaaauuaauagcuauguuauacacaccacuacgagcaaauaaugccggagaagaugucuuuaccguaucuuguagagucuuaacaagaccaucaccagauuuugauuucauauuccuuguaccuccaaccguagaaucuagaacaaaacccuuuaccguuccuauauuaacuguagaagaaaugacuaacucacgauuucccauaccacuagaaaaacuauuuacaggcccaagcggagcauuuguuguacaaccacaaaacggccgauguacaacagauggaguacuucuagguaccacacaauuaucaccagucaauauauguacauuuagaggcgacguaacccacauagcaggaaguagaaacuacacaaugaauuuagcaucauuaaacuggaacaauuacgauccaaccgaagaaauacccgccccucuaggcacucccgacuuuguagguaaaauccaaggaguauuaacacaaacaacuaaaggagacggcaguaccaggggucauaaagcuacuguauacacagguuccgccccauuuacaccaaaauuaggaucaguccaauucucaacggacacugaaaacgauuuugaaacacaccaaaauacaaaauucacaccaguaggugucauacaagauggagguaccacucacagaaaugaaccucaacaauggguccuaccaucuuacucaggacgagauguacacaauguacacuuagcaccagcaguugcuccuacauuccccggagaacaauuacuauucuuuagaucaaccaugccagguuguucuggauaucccaauauggacuuagauugccucuuaccucaagaauggguacaacauuucuaccaagaagcugcaccagcacaaucagacguagcacuacuaagauuuguuaauccagauaccggaagaguacuauucgaaugcaaacuacauaaaucaggauaugucacuguagcacauacaggacaacacgacuuaguaauaccaccaaacggauacuucagauucgacucauggguaaaccaauucuacacauuagcaccaaugggaaauggcacaggaagaagaagagcacuuuaa

SEQ ID NO: 31008 - RNA, 1623 nt, Artificial Sequence
  derived and/or modified sequence opt6 from capsid_protein_VP1__Norovirus__AGE89610
augaaaauggcaagcaaugacgcaaaccccucagauggaucagcagcaaauuuagucccagaaguaucaaaugaaguaauggcacuagaaccaguaguaggagcagcaauagcagcacccgucgcuggacaacaaaauguaauagauccauggauaagaaauaauuuuguacaagcaccagguggagaauucacaguuucaccaagaaacgcacccggagaaauacuauggucagcaccauuaggaccagaucuaaauccuuaccuaucacaccuagcucgcauguacaauggauacgcaggaggauuugaaguucaaguaaucuuagcaggaaaugcauucacugcuggaaaaauaauauucgcagcaguacccccaaacuuuccaacagaaggucuaucaccaucgcaaguaacaauguucccacacauaauaguagauguaagacaacucgaaccaguauuaaucccccuaccagacguaagaaacaauuucuaucacuauaaccaaacaaaugauuccacaauaaaauuaauagcaauguuauacacaccauuaagagcaaacaaugcaggagaagauguauuuacaguaucauguagaguacuaacaagaccuucaccagacuucgacuucaucuuccuuguaccaccaacaguugaaucaagaacuaaacccuuuacaguaccaauuuuaacaguagaagagaugacuaacuccagauuucccauaccucuugaaaaauuauuuacaggaccaagcggagcauucguuguucaaccacaaaauggaagauguaccacagauggcgucuuauuagguacaacacaauuaagcccugucaauaucugcacauuucguggugacguaacacauaucgccggaucuagaaacuacacaaugaaucuagcuagccuaaacuggaacaacuaugauccuacagaagaaauaccagcuccuuuagguacaccugacuuuguaggaaaaauacaaggcguauuaacacaaacaacaaaaggugauggaucuacacgaggucacaaagcaacuguguauacaggauccgcaccauuuaccccaaaauuaggaucuguacaauucucuaccgauacagaaaacgauuucgaaacacaucagaauacaaaauuuacaccaguuggaguaauacaagacggaggaaccacacauagaaaugaaccucaacaauggguacuccccuccuacucaggacgagauguacacaacguacauuuagcuccagcaguagcacccacauucccuggagaacaacucuuauuuuucagaucaacgaugccaggauguucagguuauccaaauauggaccuagacugccuauuaccacaagaauggguacaacauuuuuaccaagaagcagcucccgcacaaucugauguagcauuacuucgauuuguaaacccagauacaggaagaguauuauucgaauguaaacuacacaaaucuggguauguaacaguagcucacacuggacaacaugaucucguaauaccaccaaauggauauuuuagauuugacuccuggguaaaccaauuuuacacacuagcuccaaugggaaauggaacaggaagaagaagagcauuauaa

SEQ ID NO: 31009 - RNA, 1623 nt, Artificial Sequence
  derived and/or modified sequence opt6 from capsid_protein_VP1__Norovirus__AGE89613
augaaaauggcaucaaaugacgccaauccuuccgacggauccgccgcuaaccuuguaccagaaguuaguaaugaagucauggccuuagaaccaguagucggagcagcuauagcagcaccaguagcaggccaacaaaauguaauagacccauggauaagaaauaacuucguccaagcaccaggaggugaauuuacagucucaccaagaaaugccccuggcgaaauauuauggucagcaccucucggacccgaucuaaaucccuauuuaucacacuuagccagaauguauaacggauacgccggaggauucgaaguacaaguaauuuuagccggcaaugccuuuacagccggaaaaauuaucuucgcagcaguacccccaaacuuuccaacagaaggucuauccccaucucaagucacaauguucccacacauuauaguagauguacgacaacuagaaccaguacuaauaccacuaccagauguaagaaacaauuuuuaccacuauaaucaaacaaaugacuccacaauaaaauuaauagcaaugcuauacacuccauuaagagcaaauaaugcaggagaagacguauucacaguaucaugucgaguacuaaccagaccuucaccagacuucgauuuuauauuccugguuccuccuacagucgaaucaagaacaaaacccuuuacaguacccauauuaacaguugaagaaaugacaaauagcagauuuccaauaccguuagaaaaacuauucacaggcccaucaggagccuucguaguucaaccccaaaauggaagauguacaacugacggagucuuauuaggaaccacacaacuaucaccaguaaacauauguacauuuagaggagacguaacacauauagcaggaucaagagauuacacaaugaaucuagcgucacuuaacuggaacaacuacgacccuacagaagaaaucccugccccuuuagguacaccagacuuuguaggaaaaauacaaggcgucuuaacacaaacaacaaaaggugacggaucuacaagaggacauaaagccacaguauacacaggaucagccccauuuacaccaaaauuaggcucaguacaauucucaacagauacagaaaacgacuuugaaacacaucaaaacacaaaauucacuccuguaggaguuauacaagauggagguaccacacacagaaacgaaccucaacaauggguucucccaucauacucugguagagauguacauaacguacaccuagcccccgcaguagcaccaacauucccaggagaacaacucuuauucuuuagaagcacaaugccaggauguucaggcuacccaaauauggaucuagauugccuacuaccacaagaauggguacaacauuucuaucaagaagccgcaccugcacagucagauguugcacuacuaagauuuguaaacccugauaccggcagaguacuauuugaaugcaaauuacacaaaucagguuaugucacaguagcacacacuggucaacaugauuuaguaauaccacccaacgguuauuuucgauuugacuccugggucaaccaauucuacacucuagcaccuaugggaaauggaaccggccgaagacgugcacucuaa

SEQ ID NO: 31010 - RNA, 1623 nt, Artificial Sequence
  derived and/or modified sequence opt6 from capsid_protein_VP1__Norovirus__AGE89616
augaaaauggcaaguucugaugcuaacccaucagauggcagcacagcaaacuuaguaccagaaguaaacaacgaaguuauggcauuagaaccuguagucggugcagcaauagcagcaccugucgcaggacaacaaaauguaauagacccauggauaagaaauaauuuuguacaagccccaggaggagaauuuacagucucuccacgcaacgcaccaggagaaauacuaugguccgcaccuuuaggaccagauuuaaacccuuauuuaucccacuuagcuagaauguauaaugguuacgcaggaggauucgaaguacaaguaauucuagcgggaaaugcauuuacagcaggaaaaauaauauucgcagccguucccccuaacuuuccgacagaaggacuuucaccuucacaagugacuauguucccacauauaauuguugauguacgacaacucgaaccaguuuuaauaccacuaccugauguaagaaacaauuuuuaucauuacaaucaaagcaaugauccaacaauaaaacucauagccauguuauauacaccacuuagagcaaauaaugcaggagaugauguauuuacaguaaguugcagaguauuaacacgaccaaguccagauuuugacuucauauuccuaguaccaccuacagucgaauccagaacaaaaccauuuucaguuccuguauuaacaguagaagaaaugacaaacucuagauuccccauaccucuugaaaaacuauuuaccggaccaucaaacgccuucgucguacaaccacaaaauggccgauguacuacagacggagucuuacuuggcacaacacaauuaucuccaguaaacauauguacuuuuagaggugaugucacccacauaccaggaucaagaaauuauacaaugaaccuagcuucacaaaacuggaauucuuacgauccaacagaagaaauuccagccccucucggcacaccagacuucguuggaaaaauacaaggaguccuaacacaaacaacaagaacuaacgguucaacccguggacacaaagcaacaguauauacuggaucagcagacuucucuccuaaacuaggaagaguacaauucgcaacagauacagauaacgauuuugaaacaaaccaaaauacuaaauucacaccaguaggaguaauacaagacggaagcacuacaccaagaaacgaaccacaacaauggguacucccuucauacucuggaagagacguccauaacguacacuuagcaccugccguagcacccacauuuccgggagaacaacuacuauuuuuccgaucaaccaugccaggauguucaggauaucccaauauggaucuagauugucuccuuccccaagaauggguacaauacuuuuaucaagaagcagcaccagcacaaucagacgucgcauuacuaagauucguaaacccugauacaggaagaguacuuuuugaaugcaaacuacauaaaucaggcuauguuacagucgcucauacaggacaacacgaucuaguaauaccacccaauggauauuuccgauucgauucuuggguaaaucaauuuuacacacuagcacccauggguaaugguacuggaagacgaagagcacucuaa

SEQ ID NO: 31011 - RNA, 1623 nt, Artificial Sequence
  derived and/or modified sequence opt6 from capsid_protein_VP1__Norovirus__AGE89622
augaaaauggcaucauccgacgccaauccauccgaugguucaaccgcaaaucuaguaccugaaguaaacaacgaaguaauggcauuagaaccuguaguaggcgcagcuaucgcugcuccuguugcuggacaacaaaauguuauugacccauggauacgaaacaacuucguucaagcaccaggaggagaauucacaguaucucccagaaacgccccuggagaaauacuauggucagcaccacuaggucccgauuuaaauccguaucucucucaucuagcccgaauguacaacggauaugcaggcggauuugaaguacaaguaauacuagcaggaaacgcuuuuacagcaggaaaaauaauauuugcagcaguuccaccaaauuuuccuacagaaggacucucacccucucaaguaacuauguucccacacauaaucguugacguccgacaacuagaaccaguuuuaauaccacuaccagacguacgaaauaauuuuuaccacuauaaucaaucaaaugauccaacuauaaaauuaaucgcuauguuauacacaccauuaagagcaaacaaugcaggagaugauguauucacaguaucauguagaguauuaacuagaccuucaccugauuucgacuuuauauuccuaguaccaccaacaguugaaucacguacaaaaccauuuucaguaccaguccuaacaguagaagaaaugacaaacucaagauuucccauaccacuugaaaaauuauuuacagguccaucaucagcauucguaguacaaccacaaaacggaagauguacaacagacggaguccuacuaggaacaacacaacuaucaccaguaaauauaugcacauuccgaggugauguaacacacauaccaggaucaagaaauuacacuaugaaucuagcaucacaaaauuggaauaguuacgauccaaccgaagaaauaccagcaccucuaggaacuccagauuucguaggaaaaauacaaggaguauuaacucaaacuaccaggacaaacggaucaacacgaggacacaaagcuacaguauauacagguagugcagacuuuagcccuaaauuaggaagaguccaauucgcaacugacacagauaacgacuuugaaacaaaucaaaauacaaaauucacaccaguuggagucauacaagacggauccacuaccccaagaaaugaaccacaacaauggguacuaccaagcuauucaggaagaaauauacacaacguccacuuagcacccgcaguagcaccuacuuuccccggagaacaacuacucuucuucagaucaacaaugccaggaugcuccggcuaucccaauauggacuuagauugcuuacuaccacaagaauggguucaauauuucuaccaagaagcagcaccagcucaaagugauguagcacuacuaagauuuguuaauccagauacaggccgagucuuauucgaaugcaaacuacauaaauccggauauguaacaguugcacauacaggacaacacgaccuaguuauacccccaaauggauacuucagauucgauucauggguaaaccaauuuuacacacuagcacccaugggaaauggaaccggccgaagacgagcacuauaa

SEQ ID NO: 31012 - RNA, 1623 nt, Artificial Sequence
  derived and/or modified sequence opt6 from capsid_protein_VP1__Norovirus__AGE89625
augaaaauggccucaucagacgcuaacccaucagauggaucuacagcaaaucucguaccugaaguaaacaacgaaguaauggcacuagaaccaguaguaggagcagcaaucgcagcaccaguugcaggccaacaaaauguaauagacccuuggauaagaaauaauuucguccaagcacccggaggagaauuuacaguaucaccucgcaacgcccccggagaaaucuuauggucugcaccauuagguccagacuuaaauccauauuuaucucacuuagcaagaauguauaacgguuacgcugguggauucgaaguucaaguaauacuagcaggcaaugcauucacagcugguaaaaucauuuuugcagcaguaccaccuaauuuuccaacagaaggucuaucaccaagucaaguuacaauguucccacauaucauugucgacguuagacaauuagaaccaguacuaaucccuuuaccugauguaagaaauaauuucuaucacuacaaccaaaguaaugacccaacaauaaaauuaaucgcaauguuauacacaccauuaagagcuaacaaugccggagaugacguauuuacuguuucaugcagagucuuaacaagacccucgccagauuuugacuuuaucuuucuaguaccaccaacaguugaaucaagaacuaaaccauuuucaguaccaguauuaaccguagaagaaaugaccaacucuagauuuccuauccccuuagaaaaacuauuuacaggcccaucaucagcauucguaguccaaccacaaaauggacgaugcacaacagacggaguacuuuuaggaacuacacaacuaucaccaguaaacauauguacauucagaggcgacguuacacauauaccuggaucgagaaauuauacaaugaauuuagcuucccaaaauuggaacuccuacgauccaacugaagaaauaccugcaccucuaggaacacccgacuuuguagguaaaauacaaggaguauuaacucaaaccacaagaacaaacgguucaacacgaggucacaaagcuacugucuauacaggaucagcagacuucucacccaaacuaggcagaguacaauuugcuacagauaccgauaaugauuucgaaauuaaucaaaauacaaaauuuacaccaguaggcguuauacaagacgguaguacaacaccuagaaacgaaccacaacaauggguauuaccaucauauuccggccgcaauauucauaacguacaucuagccccugccguagcuccaacauuucccggugaacaauuauuauuuuuucguucaacaaugcccggauguucagguuauccaaacauggaucuagauugccuucuaccacaagaauggguucaauauuucuaccaagaagccgcuccagcacaaucugauguagccuuacuacgauucgugaauccagacacuggaaggguucuuuuugagugcaaacuucauaaauccggauauguaacaguagcacacacuggacaacaugaucuuguaauaccuccaaauggauacuucagauucgacaguuggguaaaccaauuuuacacucuagcuccuaugggaaacggaacaggcagaagaagagcacuuuaa

SEQ ID NO: 31013 - RNA, 1623 nt, Artificial Sequence
  derived and/or modified sequence opt6 from capsid_protein_VP1__Norovirus__AGE89628
augaaaauggcaucaucagacgcuaacccaucagauggaucuacagcaaaucuuguacccgaaguuaacaaugaagucauggcacuagaaccaguaguuggagcugcuauagcagcuccaguugcaggacaacaaaauguuauugacccauggauaagaaauaacuuuguccaagcaccaggaggugaauuuacaguaucuccaagaaaugccccuggagaaauauuauggucagcacccuuaggcccagaucucaauccauaucuaucacaucuagcucgaauguacaauggauaugcaggaggauuugaaguccaaguaauacuagcagguaaugcauuuacagcaggaaaaauuauauucgccgcugugccuccaaacuucccaacagaaggacuuucacccucacaaguaaccauguucccacauauaauaguagauguacgacaauuagaaccaguauuaauaccauuacccgauguacgaaauaauuucuaucauuauaaucaauccaaugacccuacaauaaaacuaauugcaaugcucuauacaccauuaagagcaaacaaugccggagacgauguuuuuacaguaucaugcagaguccuaacaagaccaucaccagacuuugauuuuauauuucucguacccccuacaguagaaucuagaacaaaacccuucucaguaccuguauuaacaguugaagaaaugacaaacuccagauucccuauaccauuagaaaaacuuuuuacuggacccucgucagcuuuuguaguacaaccacaaaauggaagauguaccacagacggagucuuacuaggaacaacacaacuaucaccaguaaauauauguaccuuuagaggcgacguaacacauaucuccggaucaagaaacuauacaaugaacuuagcaucacaaaacuggaauucauacgauccaacugaagaaauaccagcaccacuaggaacaccugauuuugucggcaaaauacaaggcguucuuacucaaacaacucgaacugauggaucuacuagaggacauaaagccacaguauauacaggaucagccgauuucagucccaaacuaggacguguccaauucgcaacagauacagauaaugacuuugaaacuaaucaaaacacaaaauucacaccaguaggaguaauacaagauggaggaacaacacauagaaacgaaccacaacaauggguacuacccucauauucaggaagaaauauacauaauguacacuuagcaccugccguagcuccaacuuuucccggagaacaacuauuauucuucagaucuacuaugccaggcuguucaggauauccaaauauggaccuagacuguuugcuaccucaagaauggguacaauauuucuaccaagaagcugcaccugcacaauccgacgucgcauuacuacguuucguuaacccagacacagguagagucuuauuugaauguaaacuccauaaguccggauauguaacaguagcacacacuggacaacaugaccucguaauuccaccaaauggauauuuuagauucgauucaugggucaaucaauuuuacacacuugccccaaugggaaauggaacuggccgacgcagagcauuauaa

SEQ ID NO: 31014 - RNA, 1623 nt, Artificial Sequence
  derived and/or modified sequence opt6 from capsid_protein_VP1__Norovirus__AGE89631
augaaaauggcaucaaaugacgcuaauccaucagauggcucagcagcaaauuuaguaccagaaguauccaaugaaguaauggcauuagaaccaguuguaggagcagcaauagcagcacccguagcaggacaacaaaauguaauagacccuuggauucgaaacaauuuuguacaagcaccaggaggagaauucacaguaucaccuagaaaugccccaggugaaauacuuuggucagcaccacuaggucccgauuuaaauccauaccuaagccaucuagcacgaauguauaacggauaugccggaggauucgaaguacaaguaauauuagcaggaaaugcauuuacagccggaaaaauaaucuucgcugcaguaccuccaaacuuuccaacugaaggacuaucaccaucacaagucacaauguucccacacauaaucguagacguucgacaauuagaacccguacucauaccauuaccagacguuagaaauaauuuuuaucacuacaaucaaacaaacgauucuacaauaaaauuaauagcaaugcuauacacaccauuacgugcaaacaaugcuggugaagauguuuuuacagucucaugucguguauuaacaagaccaucaccugacuucgauuuuauauuucuuguaccaccuacaguagaaucucgaacuaaaccuuuuacaguaccuauacuuacuguugaagaaaugacaaacuccagauuuccaauaccacucgaaaaauuauucacagguccaucaggagcauucguaguacaaccacaaaacggacguuguacaaccgauggcguacuauuaggaacaacacaacuaucaccaguaaauaucuguacauucagaggagacguaacacauaucgcaggaucaagaaauuacacaaugaacuuagcuucauuaaacuggaauaauuacgacccuacugaggaaauaccagcaccauuaggaacaccagacuucguagguaaaauacaaggaguauuaacucaaacaacaaaaggcgauggaagcacuagaggccauaaagcaacaguauauacgggaucagcaccuuucacaccaaaacucggcucaguccaauucucgacagacacugaaaaugauuuugaaacacaucaaaauaccaaauucacuccaguaggcguuauacaagauggagguacaacacauagaaacgaaccacaacaauggguacuucccucauauucugguagagauguacacaauguacaccuagcaccagcagucgcaccaacauucccaggagaacaauuacuauuuuuucgaucaaccaugccuggaugcucuggauacccaaauauggauuuggauugccuuuuaccacaagaauggguccaacauuucuaccaagaagcagcaccagcacaaucagacgucgcccuauuaagauucguaaauccagacacaggacgaguauuauucgaaugcaaauuacauaaauccggauacguaacaguagcucauacaggacaacacgacuuaguaauaccuccaaauggcuacuuuagauuugauucauggguaaaccaauuuuacacacuugcucccaugggaaaugguacaggcagaagacgugcuuuauaa

SEQ ID NO: 31015 - RNA, 1623 nt, Artificial Sequence
  derived and/or modified sequence opt6 from capsid_protein_VP1__Norovirus__AGE89634
augaaaauggcaucaaacgaugccaacccaagugacggcucagcagcuaaccuaguuccagaaguuucaaacgaaguaauggcucuagaaccaguaguaggagcagcuauagcagcaccagucgcaggccaacaaaauguaauagaccccuggauaagaaauaacuuuguacaagcaccaggaggagaauucaccgucagcccuagaaacgcacccggagaaauauuauggucagccccucuaggaccagauuuaaauccauauuuaucacauuuagcccguauguauaacggauaugcaggaggauuugagguacaaguaauccuagcaggcaaugcauuuacagcaggaaaaauaauauuugcagcaguaccccccaacuuucccacagaaggacuaucaccaucccaaguaaccauguuuccacauauaauaguugacguucgacaacuagaacccguacuaauuccauuacccgauguaagaaacaauuucuaucacuauaaccaaacaaaugacucaaccaucaaauuaaucgcaauguuauauacaccuuuaagagcuaauaaugcaggagaagauguauuuacaguaucauguagaguucuuacaagaccaaguccagauuuugauuuuauauuucuaguaccaccuacugucgaaucaagaacaaaaccauucacaguaccgauccuuacaguugaagaaaugacaaacucuagauuucccauaccacucgaaaagcuauucacaggaccaucuggcgcuuuugugguacaaccacaaaacgguagauguacaacagauggaguacuacuaggaacaacacaauuaucaccuguaaauauaugcacauucagaggagacgucacacacauagcuggauccagaaacuacacaaugaauuuagcuucacuaaauuggaacaauuacgaucccacagaagaaaucccagcuccauuagguacaccagacuuuguaggaaaaauucaaggcguucuaacacaaacaacaaaaggcgacggaagcacaagagggcacaaggcuacaguuuacacagguucagcuccuuuuacaccaaaacuaggaucuguacaauucucuacagauacagaaaaugauuucgaaacacaucaaaauacaaaauuuaccccaguuggaguaauacaagacggaucaacaacacauagaaaugaaccacaacaauggguuuuaccaagcuacucuggaagagacguccacaacguucaccuagcaccagcaguugcaccuaccuuuccaggcgaacaauuauuauucuucagaucaacaaugccuggauguucaggauacccaaauauggaucuagacugcuuacuuccucaagaauggguucaacauuucuaucaagaggcagcuccagcucaaucugauguagcacuucuaagauuuguaaacccagacacaggcagaguacuauucgaaugcaaacuccauaaaucaggcuauguaacaguagcucacacuggccaacacgaucuagucauaccacccaauggauauuucagauuugauagcuggguaaaccaauucuacacacuagcaccuaugggcaacggaaccgguagacgaagagcauuauaa

SEQ ID NO: 31016 - RNA, 1623 nt, Artificial Sequence
  derived and/or modified sequence opt6 from capsid_protein_VP1__Norovirus__AGE89637
augaaaauggcaucuaaugacgcaaauccaucagauggaucagcugcuaaucucguaccugaaguauccaaugaaguuauggcacuagaaccaguugucggagcagcaaucgcagccccaguagccggucaacaaaauguaauagacccauggauacguaacaacuuuguucaagcaccaggaggcgaauuuacuguaucacccagaaacgcaccaggcgaaauauuauggucagccccauuaggaccagaccuaaacccauaucuuucacauuuagcucgaauguacaacgguuaugcaggaggauucgaaguacaaguaauauuagcuggcaaugcauuuacagcaggaaaaauaauauucgcagcaguaccaccaaauuuuccaacagaaggauuauccccuucacaaguaacuauguucccucacauaauuguagacguccgucaacuagaacccguucuaauaccuuuaccugaugucagaaacaacuuuuaucacuauaaccaaacaaaugauucaacuauaaaauuaauagcuaugcuauacaccccccuaagagcaaauaacgcaggcgaagauguauuuacaguaucauguagaguauuaaccagaccaucaccagauuucgacuuuauuuuucucguacccccaacuguagaaagucggacaaaaccauuuacaguuccaauacuaacaguagaagaaaugacuaacucaagauuuccaauaccacuagaaaaauuauuuacaggacccaguggagcauuuguaguacaaccacaaaauggaagaugcaccacagacggaguauuacuaggaacaacccaacuaucucccguaaauauauguacauuccgcggagauguaacacacauagcuggaucuagaaauuacacaaugaaucucgcuucuuuaaacuggaauaauuaugacccaacagaagaaauccccgcaccucuaggcaccccugacuuuguuggaaaaauucaaggaguauuaacccaaacuacaaaaggugacggcagcaccagaggccauaaagcaacagucuauacaggaucugcaccauuuacaccaaaacuaggaucuguucaauucucaacugacacagaaaacgauuucgaaacacaccaaaauacaaaauuuaccccaguaggaguaauacaagacgguggaacuacccauagaaaugaaccacaacaauggguauuaccaucauauucaggucgagauguacacaauguucaucucgcaccagcuguagccccaaccuucccaggcgaacaacuacuauuuuuuagaaguacaaugccagguugcucugguuacccaaacauggaccuagauugcuuauuaccacaagaauggguacaacauuucuaccaagaagccgcaccagcacaaucagacguagcacuauuacgauucguaaauccugacacaggaagaguauuauuugaaugcaaacuacauaaaucaggauacguaacaguagcucacacgggucaacacgacuuaguaauuccuccuaauggauacuucagauuugacucauggguaaaccaauucuauacucuagcucccaugggaaauggaacaggccgacgaagagcacuauaa

SEQ ID NO: 31017 - RNA, 1623 nt, Artificial Sequence
  derived and/or modified sequence opt6 from capsid_protein_VP1__Norovirus__AGE89640
augaaaauggccagcaacgaugcuaauccuucagaugggucagcagccaacuuaguaccagaaguaucaaaugaaguaauggcacuagaaccaguugucggagcagcaaucgcagccccaguagcagggcaacaaaaugucauagacccauggauacgaaauaacuuuguucaagcaccuggaggagaauuuacaguauccccuagaaaugcaccaggagaaauauuauggucugcuccauuaggaccugaccuaaacccauaccuuucccaccucgcaagaauguauaacggauacgcaggagguuucgaaguacaaguaaucuuagcaggcaaugcauucacugcgggaaaaauaauauuugcagcaguuccuccaaacuuuccaacagaaggucuaucaccuucacaaguuacuauguuuccacauaucaucguagacguaaggcaacuagaaccaguguuaaucccauugccagacguuagaaauaauuuuuaucacuauaaccaaacaaacgacuccacaauaaaacuaauugcaaugcuuuacacacccuuacgagcaaacaacgccggugaagauguauuuacaguauccugcagaguacuaacacgaccaucaccagauuuugauuucauauucuuaguaccaccaacaguugaaaguagaacaaaaccuuucaccguaccaauacuaacaguagaagaaaugacaaacucuagauuuccuaucccauuagaaaaacuauuuacagguccaucuggagcauuuguaguacaaccacaaaauggucgauguacuacugacggagucuuacuaggaacaacccaacuauccccuguaaauauaugcacauuucgcggcgacguaacccacauagcaggaucuagaaacuauacuaugaacuuagccucacuaaauuggaacaacuacgaucccacugaagaaauaccugccccacuaggcacaccagauuuuguagguaaaauacaaggaguacuaacacaaacaacaaaaggagacggaucaacccguggacauaaagcaacuguauacacaggaucugcaccauuuaccccuaaacuaggaucaguccaauucucaaccgacacagaaaacgauuucgaaacacaucaaaauacuaaauucacaccuguaggaguaauacaagacggaggaacaacacaucgaaacgaaccucaacaauggguauuaccuuccuauagcggaagagacguacauaacguucaccuagccccagccguagcucccacauuuccaggugaacaacuauuauucuuccgaucaacaaugccaggcugcucaggauauccaaauauggaccuugauuguuuauuaccucaagaauggguacaacauuuuuaccaagaagccgcuccagcccaaucagauguagccuuacucagauuuguaaauccugacacaggucgaguacuuuucgaaugcaaauuacacaagucaggauacguaacagucgcacacacaggccaacacgauuuaguuauaccacccaaugguuacuucagauucgauucaugggucaaucaauuuuacaccuuagcacccaugggaaauggcacaggacgccgaagagcauuauaa

SEQ ID NO: 31018 - RNA, 1623 nt, Artificial Sequence
  derived and/or modified sequence opt6 from capsid_protein_VP1__Norovirus__AGE89643
augaaaauggcauccaaugaugcaaauccuucagauggauccgcagcaaacuuaguaccugaaguaucaaaugaagucauggcccuagaaccuguaguaggugcugcaauagccgcaccaguugcaggacaacaaaauguaauagauccuuggauaagaaauaacuuuguacaagcaccaggaggagaauuuacaguauccccuagaaacgcaccaggagaaauauuauggucagccccacucggaccagacuuaaauccauacuuaucacacuuagcaagaauguauaacgguuaugcuggcggauucgaaguccaaguaauacucgccgguaaugccuucaccgcugguaaaauaauuuuugcugcagucccaccuaacuuuccaacugaaggacuaucaccuucacaaguaacaauguuuccacauauaauaguagacguaagacaacuugaaccgguccuaauaccacuuccugacguaagaaacaauuucuaucacuauaaccaaacuaaugauuccacaauuaaauuaaucgcaauguuauacacaccauuacgagcaaacaaugcaggcgaagauguauuuacgguaucauguagaguacuaacacgacccuccccugacuucgauuuuauauuuuuaguacccccuacaguagaaucuagaacuaaaccauucacaguaccaauuuuaacagucgaagaaaugaccaacuccagauuuccaauaccacuugaaaaacuuuucacaggaccuucaggcgcauucguaguacaaccccaaaauggaagauguacaacagacggcguuuuauuaggaacaacacaacuaucaccagucaauauauguacuuuuagaggagacguaacacauauagcaggaucaagaaauuauacaaugaaucuagcuucccuuaauuggaacaauuaugauccaacagaagaaauaccugcaccauuagguacaccugacuucgucggaaaaauacaaggaguguuaacccaaaccacuaaaggcgacggaucaacccgagggcacaaagccacaguauauacaggaucugcacccuuuaccccaaaacuaggcucuguacaauucucaacagauaccgaaaaugauuucgaaacacaucaaaauacaaaauucacaccaguagguguaauacaagacggcgguacaacucauagaaaugaaccucaacaauggauguuaccaucauauucagguagagauguccacaacguacauuuagcaccagccguagcacccacuuuuccaggugaacaauuacuuuucuucagaucaacuaugcccggauguaguggauacccuaauauggaucuagacuguuuacuuccacaagaguggguccaacauuucuaucaagaagcugcuccagcacaaucagaugucgcauuauuaagauucguaaacccagacacuggccgcguacuauucgaauguaaauuacauaaaucaggauacguuacaguagcacacacaggacaacacgaucuagucaucccaccaaaugguuauuuccguuucgauuccuggguaaaucaauuuuacaccuuagcucccaugggaaauggaacaggccgacgaagagcacuauaa

SEQ ID NO: 31019 - RNA, 1623 nt, Artificial Sequence
  derived and/or modified sequence opt6 from capsid_protein_VP1__Norovirus__AGE89646
augaaaauggcuucaaacgacgcaaaccccuccgacggaucugcagcuaacuuaguaccagaaguaucaaaugaaguaauggcuuuagaaccugucguaggagcagcuauagcagcaccaguagcaggccaacaaaacguuauagacccauggaucagaaauaauuucguacaagcaccaggaggagaauuuaccguaucuccacgaaaugcaccuggagaaauucuauggagugcaccauuaggaccagaucuaaaucccuaucuaucucaccuugcaagaauguacaaugguuacgccggagguuucgaaguccaaguaauauuagcaggaaaugcauuuacagcaggcaaaauaauauuugcugcagucccaccuaacuuuccaacagaaggauuaucuccaucccaaguaacaauguuuccucacaucauaguugacguaagacaacuagaaccaguccuuauaccauuaccagacguccgaaacaacuucuaccacuacaaucaaacaaaugauucaacgauaaaauuaauagcaaugcuuuacacuccacuacgagcuaacaaugcaggagaagaugucuucacuguuuccuguagaguccucacccgucccagcccagacuuugacuucauauuccuagucccaccaacuguagaaucccgaacaaaaccauuuacaguacccauacucacaguagaagaaaugacaaauucaagauuuccuaucccacuagaaaaauuauuuacagguccaucaggagccuuuguuguacaaccucaaaacggucguuguacaacugacggaguacuauuaggaacuacucaacuaucaccaguaaauauauguacuuucagaggugauguuacacacauagcuggaaguagaaauuacaccaugaaccuagcaucacuaaacuggaauaauuaugauccaacagaagaaaucccugcaccauuaggaacaccagauuuuguaggaaaaauacaaggugucuuaacacaaacuacaaaaggugauggaucaacacgaggucauaaagcaacuguauacacaggaagugcuccauuuacaccaaaacuaggaucuguacaauucucaacagauacugaaaacgauuucgaaacccaccaaaacaccaaauucacaccaguuggaguaauacaagauggaggaacaacacauagaaaugaaccucaacaauggguauuaccuuccuacucuggaagagauguacauaauguacauuuagcuccagcaguagcaccaaccuucccaggagaacaacuauuauucuuuagaagcaccaugccuggaugcucaggauauccaaacauggauuuagacugccuauuaccacaagaauggguacaacacuuuuaucaagaagcagcucccgcucaaucagacguagcacuauuaagauucguuaacccagacaccggaagaguauuauuugaaugcaaacuccauaaaucaggauauguuacagucgcacauacaggacaacacgaucuaguaaucccacccaauggauauuucagauucgauucauggguaaaucaauuuuauacauuagcuccaaugggaaacggaacaggaagaagaagagcauuauaa

SEQ ID NO: 31020 - RNA, 1623 nt, Artificial Sequence
  derived and/or modified sequence opt6 from capsid_protein_VP1__Norovirus__AGE89649
augaaaauggcaucaaacgacgcuaacccauccgacggaucagcagcaaacuuaguaccagaaguaagcaaugaaguuauggccuuagaaccaguaguaggagcagcuauagcagcuccaguagcaggacaacaaaauguuauagacccuuggauucguaacaacuuuguccaagcaccuggaggagaauucaccguaaguccuagaaaugcaccaggagaaauauuguggucagccccauuaggaccugauuuaaacccauaccuaucacaccuugcaagaauguauaacgguuaugcugguggauucgaaguacaaguuauauuagcaggaaaugcuuuuacagcaggaaaaauuauauucgcugcaguaccuccaaauuuuccuacugaaggauuaucucccucacaaguuacaauguuuccacacaucauaguagacguuagacaacuagaacccguacuaauuccccuuccagauguaagaaacaauuucuaucauuauaaucaaacaaaugaucccacaauaaaacucauagccauguuauauacaccacuuagagcaaacaacgcuggagaagauguauuuacaguuucaugucgaguacuaacaagaccaucaccugacuucgacuucaucuuucuaguucccccaacuguagaaucgagaacaaaaccuuucaccguaccuauacuuacaguagaagaaaugacaaacucuagauuuccaaucccacuagaaaaacuuuucacuggaccaucuggagcauuuguaguucaaccacaaaauggucguugcacaacagauggagucuuauuaggaaccacacaacuaucuccaguuaauaucuguacuuuuagaggcgacguuacccauauagcaggauccagaaauuacacuaugaauuuagcuucauuaaacuggaacaauuacgaucccaccgaggaaauuccagcuccauuaggaacucccgacuuuguaggaaaaauacaaggaguauuaacacaaacaacaaaaggagacggaucaacacguggccacaaagcaacuguauauaccggauccgcuccauuuacaccuaaauuagguucaguacaauucucaacagauacagaaaacgacuucgaaacacaccaaaauacuaaauucacaccaguaggugucauacaagacggaggcacaacacacagaaaugaaccacaacaauggguacuaccauccuauucuggaagagauguacacaacguacaucuagcgccugccguugccccuacguuccccggagaacaacuucuauucuuucgaucaacuaugccaggauguucaggauacccaaauauggaucuugauugcuuacuaccacaagaauggguacaacauuuuuaucaagaagcagcaccugcacaaucagauguagcacuuuuaagauuuguaaacccagacacagguagaguuuuauucgagugcaaacuacauaaaaguggauacguaacaguugcacauacuggccaacacgacuuagucauacccccaaauggauauuucagauucgauucuuggguuaaucaauuuuacacccuugcuccaaugggcaacggaacaggcagaagacgagcacuauaa

SEQ ID NO: 31021 - RNA, 1623 nt, Artificial Sequence
  derived and/or modified sequence opt6 from capsid_protein_VP1__Norovirus__AGE89652
augaaaauggccucaucugaugcaaauccaagugauggaucuacagcuaaccucgugccagaaguaaauaaugaaguuauggccuuagaaccaguaguaggagcggcaauagcugcaccaguagcaggccaacaaaaugucaucgauccauggauaagaaacaacuucguacaagcuccaggaggagaauucacaguaaguccucgcaacgcuccaggagaaauacuaugguccgcucccuuaggaccagacuuaaauccuuaccuuucucaucuugcaagaauguauaacggauacgcaggagguuuugaaguacaaguaguacuagcuggaaaugcuuuuaccgcuggaaaaaucauauucgcagcaguaccaccuaauuuuccaacagaaggauuaucaccuucucaaguaacaauguuuccucacaugauaguagaugucagacaacuagaacccgucuuaauuccucuaccugauguacguaauaauuucuaucacuauaaccaauccaacgauccuacuauaaaauuaauagcaaugcuauauacaccauuaagggcaaauaacgcaggagacgauguauuuacugucucuuguagaguauuaacaagaccuucucccgacuucgacuuuauauuucuaguaccccccacagucgaauccagaacaaaaccauuuagcgucccaauccuaacaguugaagaaaugacaaacucaagauuuccaauaccuuuagaaaaauuauuuacaggaccaucaucugcuuucguaguucaaccacaaaacggaagauguaccacagacggaguacuauuaggaacaacacaacuuuccccaguuaauauauguacauuccgcggcgauguuacacauauaacaggcucucacaacuacacaaugaaucuagcuacacaaaauuggaacucuuacgaucccacagaagaaauaccagccccccuaggaacacccgauuuuguuggaaaaauacaaggcguacuaacacaaacaacaagagcugauggaucaaccagaggacauaaagcaacuguauauacuggaucagcagacuucgcaccaaaacugggaagaguccaauuugcaacagauacgaauaacgaccuaggcgcaaaucaaaauacaaaauuuacacccguaggggucauacaagauggaggaacagcacauagaaaugaaccacaacaauggguacucccaucauauucaggaagaaauucacauaauguacaccuagcaccagcaguagcaccuacauucccuggcgaacaauuacuuuucuuuagaucaacaaugccaggaugcucaggauaucccaauauggauuuagauugucuacuaccacaagaauggguucaauacuucuaucaagaagcugcuccagcacaaucagacguagcacuacuuagauuuguaaauccugauacaggacgaguauuauuugaaugcaaacuacauaaauccgguuauguuaccguagcccacacaggacaacacgaucucguaauacccccaaaugguuauuucagauucgacucauggguaaaucaauuuuacacacuagcaccaaugggaaacggaacaggaagaagaagagcacuauaa

SEQ ID NO: 31022 - RNA, 1623 nt, Artificial Sequence
  derived and/or modified sequence opt6 from capsid_protein_VP1__Norovirus__AGE89655
augaaaauggcuaguaaugacgcaaaucccucagauggcucagcagcaaauuuaguacccgaaguaagcaaugaaguaauggcguuagaaccaguaguaggagccgcaauagcagcaccaguagcaggacaacaaaauguaauagacccauggauuagaaauaacuuuguacaagcuccaggaggagaauucacagucuccccucgaaaugcaccuggagaaauauuauggucagcaccuuuagguccagauuuaaaucccuaccuaucucaucuugcaagaauguacaacggauacgcaggagguuucgaaguacaaguaauacuagcugguaacgcauuuacagccggaaaaauaauuuuugcugcaguacccccuaacuuuccuacagaaggauuaucacccucacaaguaacuauguucccucauauuaucgucgacguacgacaacucgaaccagucuuaauuccauuaccagauguacgaaacaauuuuuaccacuauaaucaaaccaaugauucaacaauuaaauuaaucgcaaugcuauacacuccacuaagagcaaauaaugcaggagaagauguuuuuacuguaagcugucgcguacuaacuagaccaaguccagacuuugauuucaucuucuuagucccaccgacaguagaaucccgaacaaaaccauucacagucccaauauuaacaguagaagaaaugacaaacucuagauuuccaauaccauuagaaaaacuauuuacaggaccaucaggagcauucguuguccaaccucaaaacggaagauguacaacagacggaguauuauuaggaacuacacaacuaucaccagucaauauauguaccuuuagaggggauguaacacauaucgcuggcucaagaaacuauacuaugaacuuagccucauuaaacuggaacaauuacgauccaacagaagaaauaccugcaccacuaggaacaccugacuuuguaggaaaaauacaaggaguuuuaacacaaacuacuaaaggagacggaucaacuagaggacacaaggccacagucuauacaggaucagcaccauucaccccaaaacuagguucaguacaauucuccacugauacugaaaaugauuuugaaacacaccaaaauacaaaauucaccccaguuggagucauacaagacgguggaacaacacauagaaaugaaccucaacaauggguuuuaccaucauauucagguagagauguacacaauguucauuuagccccagccguagcaccuacauuucccggugaacaauuauuauuuuuuagaucaacaaugccagguugcucuggauauccaaacauggaccucgauugccuucucccucaagaauggguacaacauuuuuaucaagaagcagcacccgcacaaucagacguugcacuacuacguuucguaaacccagacacuggaagaguauuauuugaauguaaauuacauaaaucaggauauguaaccguagcacacacaggacaacacgacuuaguaauaccaccaaacggauacuuucgauuugauucauggguaaaccaauucuauacacuagcaccaaugggaaacggaacaggaagacgcagagcuuuauaa

SEQ ID NO: 31023 - RNA, 1623 nt, Artificial Sequence
  derived and/or modified sequence opt6 from capsid_protein_VP1__Norovirus__AGE89658
augaaaauggccucuaacgacgcuaacccaucagacgguucugcagcuaaucuaguuccagagguuucuaaugagguaauggcauuagaaccaguaguaggagcagcaauagcugcuccaguagcaggacaacaaaaugucauagauccauggauaagaaauaacuucguacaagcuccaggaggugaauuuacuguaucaccacguaaugcacccggagaaauauuauggucugcaccacuuggucccgacuuaaauccauauuuaucucaccucgcaagaauguacaacggauacgcuggcggcuuugaaguacaaguaauucuagccgguaaugcauucacagcaggaaaaauaauuuucgcagcaguacccccaaacuuuccaacagaaggacuaucaccaucccaaguuacaauguuuccucauauaauaguagacguaagacaacuagaaccaguacuaauaccacucccagacguaagaaacaacuuuuaccacuauaaccaaacaaacgauucaacuaucaaauuaaucgcaauguuauacaccccacuaagagcaaacaaugcaggugaagacguauuuacaguaucauguagaguacuaacacgaccguccccagacuucgacuuuauauuucuaguacccccaacaguagaaucaagaacaaaaccauuuacuguaccaauuuuaacaguagaagaaaugacaaauucucgauuuccaauaccacuagaaaaauuauuuacaggacccucuggugcuuuuguaguacaaccucaaaacggacgauguaccacagauggaguacuucuagggacaacacaauuaucuccaguaaauauauguacauuucgaggcgauguaacccauauagcaggaucucgaaauuacacuaugaaucuagcaaguuuaaauuggaacaauuacgaucccacugaagaaauaccagccccacucggaacaccagauuuuguuggaaaaauacaaggaguuuuaacucaaacaacaaaaggagauggcucuacacggggacacaaagccacugucuauacaggaucagcaccauucacaccuaaacuaggaucaguacaauuuucaacugauacagaaaacgacuucgaaacacaucaaaauacuaaauuuacuccaguaggaguaauucaagacggaggaacaacucacagaaaugaaccccaacaauggguauuaccaucauacucaggaagagauguucauaacgugcaccuagcaccugcuguagcaccaacauuuccaggagaacaauuauuauuuuuuagaucuacaaugccaggauguucaggcuauccaaacauggaucuugacugcuuacucccacaagaauggguacaacauuucuaucaagaagcugcaccugcacaauccgauguugccuuauuaagauucguaaauccugauacuggaagaguccuuuucgaaugcaaauuacauaaaucaggauaugucaccguugcacacacaggacaacacgacuuaguaauaccaccuaauggauauuuccgauuugacucuuggguaaaucaauucuauacacuagcaccaaugggaaauggaacaggacgacgcagagcacucuaa

SEQ ID NO: 31024 - RNA, 1623 nt, Artificial Sequence
  derived and/or modified sequence opt6 from capsid_protein_VP1__Norovirus__AGE89661
augaaaauggcaucaaaugaugccaacccaucagauggaucagcggcuaacuuagucccagaaguaucuaaugagguaauggcauuagaacccguaguaggagccgcuauagcugccccaguugccggacaacaaaauguaauagacccuuggauaagaaacaacuucguacaagcaccuggaggagaauuuaccguaucaccucgaaacgcaccuggagaaauacucuggucagcaccuuuagguccagauuuaaauccauaucuaucacauuuagcaagaauguacaaugguuaugcuggcgguuuugaaguacaaguaauccucgcaggaaacgcauuuacagcugguaaaauaauauucgccgcaguuccaccaaacuuuccaacagaaggauuaucaccaucacaaguuacaauguucccacauauaauuguagauguaagacaauuagaaccaguauuaauaccacuaccagauguuagaaacaauuucuaucauuacaaccaaacaaaugacucaacaauaaaauuaauugcaauguuauacacaccauuacgagccaacaaugcuggugaagauguauucacaguuucauguagaguucuuacaagaccaucaccagacuuugacuuuauauuuuugguaccuccuacaguagaaucaagaacaaaaccauuuacaguaccuauacuaacuguagaagaaaugacuaacucacgauuuccaauuccauuagagaaacuauucacagguccaaguggcgcauucguaguucaaccacaaaauggacguugcacaacagacggaguauuacuaggaacaacacaacuaucaccugucaauauaugcacauuuagaggugacguaacacauauagcaggaucacgaaauuauacuaugaaucuugcaucauuaaauuggaacaauuaugauccaacagaagaaauuccugccccauuaggaacaccagauuuuguagguaaaauacaaggaguauuaacacaaacaacuaaaggugacggaucaacacgcggacacaaagcaacuguuuauacaggcucagcaccauuuacaccaaaacuaggaucaguacaauucucaacagauacagaaaacgacuucgaaacacaucaaaauacaaaauuuacaccaguuggcguaauacaagaugguggaacaacccacagaaaugaaccacaacaauggguucuaccaucauauucaggacgagacguacacaacguacaucuagcaccagcaguagccccuacauucccuggcgaacaacuauuauucuuuagaucuacaaugccaggaugcucaggauauccaaauauggaccuugacuguuuacuaccccaagaauggguacaacauuucuaucaagaagcagcaccagcacaaucagacguugccuuauuaagauuuguuaauccagauacaggcagaguauuauuugaauguaaauuacauaaaucuggauauguuacuguagcucacacaggacaacacgaccuaguuaucccaccaaauggauauuuucguuucgauuccugggucaaucaauuuuauacucucgccccuaugggaaauggcacuggacgaagacgagcucuauaa

SEQ ID NO: 31025 - RNA, 1623 nt, Artificial Sequence
  derived and/or modified sequence opt6 from capsid_protein_VP1__Norovirus__AGE89664
augaaaauggcaucuaacgacgcaaauccuagcgauggcucagcagcuaacuuaguuccagaaguauccaaugaaguaauggcacuagaacccguuguaggagcagcaauugcugcaccaguagcaggacaacaaaauguaauagacccauggauaagaaacaauuucguacaagcacccggcggcgaauuuacaguuucaccccguaaugcaccuggagaaauuuuauggagcgcaccauuaggaccagaccuuaacccauaccuaucacaucuagcaaggauguauaacggauacgcuggaggcuucgaaguacaaguaauuuuagcaggaaacgcauucacagcaggaaaaauaauauucgcugcaguacccccaaauuuuccaacagaagggcuauccccuagucaaguaacaauguuuccacacauaauagucgauguuagacaauuagaaccuguacuaauuccacuaccugauguaagaaacaauuuuuaccauuauaaucaaacaaaugauucaaccauaaaacuaauagcaauguuauacacuccacucagagcaaacaaugcaggagaggacgucuucacaguaagcuguagaguccucacuagaccuucaccagacuuugauuuuauauuccucgucccuccuacaguagaaucaagaacaaaaccauuuacaguaccuauauuaacaguagaagaaaugacuaauucuagauucccaauuccauuagaaaaacucuuuaccggcccuuccggagccuuuguaguacaaccacaaaacgguagauguaccacagacggagucuuauuaggaacaacacaacuaucuccuguaaauauauguacauuucgaggagauguaacucauaucgcaggaucacgaaauuacaccaugaaccuagcuucacuuaacuggaauaauuacgauccaacagaagaaauaccugccccacuaggaaccccagacuuuguaggaaaaauacaagguguccuuacacaaacuaccaaaggagacggaucuacuagaggucacaaagcaacaguauauacaggaagugcuccauuuacacccaaacuaggaucuguacaauucucaacagauacugaagacgacuuugaaacacaucaaaacacaaaauucacaccagugggaguaauacaagacgggggaacaacccauagaaacgaaccccaacaauggguacuaccauccuauucaggaagagauguacauaauguacaccuugcaccugcuguagcaccaacauuuccaggcgaacaacuauuauucuuucgaucaacaaugcccggaugcucaggauacccuaauauggauuuagacuguuuacuaccacaagaauggguucaacauuucuaucaagaagcagcuccagcacaaucagacgucgcauuacuacgauucguaaacccugacacuggacguguauuauucgaaugcaaauuacauaaaucaggauauguuacuguagcccacacaggacaacaugaucuaguaauaccaccaaauggguauuucagauuugacucaugggucaaucaauucuauacuuuagccccuauggguaaugguaccggacgucgaagagcauuauaa

SEQ ID NO: 31026 - RNA, 1623 nt, Artificial Sequence
  derived and/or modified sequence opt6 from capsid_protein_VP1__Norovirus__AGE89667
augaaaauggccuccaacgaugcaaacccaucagauggaucagcagcuaacuuaguaccagaaguuucaaaugaaguaauggcacuagaaccuguaguaggagccgcuaucgcagcaccagucgcaggccaacaaaacguaauagacccuuggaucagaaauaacuucguacaagccccaggaggagaauuuacagucucaccaagaaaugcaccaggagaaauacuauggucugcaccacuaggaccugacuuaaauccuuaucuaucucacuuagcacgaauguauaacgguuacgcaggcggauucgagguacaaguuauauuagcaggaaaugcuuuuacagcaggaaaaauaauauucgcugcaguaccaccaaacuuuccaaccgaaggccuaucaccaucucaaguaacaauguucccacauauuauaguagauguaagacaauuagaaccuguauuaauaccauuaccagacguuagaaauaacuucuaucacuauaaccaaacaaacgauuccacuauuaaauuaauugccauguuauauacuccuuuaagagcuaacaaugcaggagaggauguauuuacugucucuugucgaguauuaacacgaccaucaccagauuuugauuuuauauuccuagucccaccaacaguagaaucaagaacaaaaccauucacaguaccaauacucaccguagaggaaaugacaaacucaagauuuccaauaccccuagaaaaacucuucacagguccaucaggagcuuucguaguacaaccacaaaauggaagauguacuacugacggagugcuacuaggaacaacacaauuaucaccaguaaauaucuguacauuucgaggcgacguaacacauauugcaggaagcagaaacuauacaaugaaucuagcaucacuuaacuggaauaauuaugauccuacagaagaaaucccagcaccacuaggcacaccagacuuuguaggaaaaauacaaggaguauuaacacaaacaacaaaaggagacggcucaaccagaggacauaaagcaacuguauauacuggaucagccccauuuaccccaaaacuaggaucaguccaauuuucaaccgauacagaaaaugacuuugaaacucaucaaaauacaaaauuuacaccuguaggaguuauacaagauggaggaacaacacacagaaacgaaccacaacaauggguacuaccaucauauucaggaagagauguacacaauguacaccucgcuccagcuguugcaccaacauuuccaggagaacaacuccuauuuuuuagaucaacaaugcccggcugcucaggauauccaaauauggaucuagacugccuauuaccucaagaauggguacaacacuucuaccaagaagcagccccagcacaaucugauguugcauuacucagauuuguuaacccagauacaggucgagucuuauuugaaugcaaacuacauaagucaggauacgucacaguagcucauaccggacaacaugaucuuguuauacccccaaauggauauuucagguucgauucaugggucaaucaauuuuacacucucgcaccaauggguaacggaacuggccgaagacgagcacuauaa

SEQ ID NO: 31027 - RNA, 1623 nt, Artificial Sequence
  derived and/or modified sequence opt6 from capsid_protein_VP1__Norovirus__AGE89673
augaaaauggcuucaaaugacgcaaauccaagcgauggcucagcugcaaaccuuguacccgaaguauccaacgaagucauggcacuagaacccguaguaggagcagcaauagcagccccaguugcuggacaacaaaaugucauagauccauggauacgaaauaauuuuguccaagcaccuggaggugaauuuacuguaucaccaagaaaugcaccaggagaaauucuauggucagcaccauuaggaccugauuuaaauccauaccuaucacauuuagcaagaauguauaacggauaugcaggaggauucgaaguacaaguaauacuagcaggcaacgccuuuacagcagguaaaauuauauuugcagcagucccuccaaauuuuccaacugaaggacuaucaccgucucaaguaacaauguucccucauauaauaguagacguaagacaacuagaaccaguucuaauaccuuuaccagaugucagaaacaauuucuaucacuacaaccaaacaaaugauaguaccauaaaauuaauagcuauguuauacacaccacuacgcgcaaauaaugccggugaagauguuuuuacaguauccuguagaguucuaacucguccaucuccagauuuugacuuuauauuccuuguaccaccaacuguagaaucaagaacaaaaccauuuacuguaccuauucuaacuguugaagaaaugacaaauucacgcuucccaauaccauuagaaaaauuauuuacaggaccauccggcgcauuuguuguacaaccgcaaaauggucgauguacaacugacggaguauuacuuggaaccacacaacuaucaccagucaauauauguaccuuuagaggugacguaacucauauugcuggaucaagaaauuauacaaugaaucucgcaucacuaaauuggaacaacuaugaccccacagaagaaauaccugccccucuaggaacuccagauuucguagguaaaauacaaggcguacuaacucaaacaacuaaaggugacggaucaacacgaggacauaaagcaacagucuauacaggauccgcucccuuuaccccaaaauuaggaucaguucaauuuucaacugauacagaaaaugauuucgaaacacaccaaaauacaaaauucacaccuguaggaguaauacaagauggaggcacaacacaucgaaaugaaccacaacaauggguauuaccuucauauagcggaagagauguacauaacguacauuuagcuccagcaguagcaccuacauuuccaggugaacaacuacucuuuuuucgaucaacuaugccaggaugcuccggauauccaaauauggaucuagacugccuuuuaccacaagaauggguucaacauuuuuaucaagaagcugcuccagcacaaucagauguagccuuauuaagauuuguaaauccugacacuggaagaguccuauucgaauguaaacuccauaaaucaggcuacguaaccguagcucacacaggacaacacgaucuaguaauaccuccuaauggauauuuuagauucgacucauggguaaaucaauucuacacauuagcuccaaugggaaauggaaccggacgaagacgagcauuauaa

SEQ ID NO: 31028 - RNA, 1623 nt, Artificial Sequence
  derived and/or modified sequence opt6 from capsid_protein_VP1__Norovirus__AGE99603
augaaaauggcaagcaacgacgcuaaccccucagacggaucagcagcuaauuuaguaccagaaguaaauaaugaagucauggcccuagaaccaguaguuggagcagccauagccgcccccgucgcaggacaacaaaauguaauagaucccuggauaagaucuaacuuuguacaagcuccaggaggagaauuuacaguaucuccaagaaaugccccaggagaaauacuuuggucagcuccacuuggaccagaccuaaauccauaucuaucucaccucgcaagaauguacaacggauacgccggaggauucgaaguacaaaugauucuagcagguaaugcauuuaccgcaggcaaaauaauauuugcagcaguaccaccaaacuucccaacugaaggauuaucaccaucacaagucacaauguuuccacacaucauaguugauguaagacaauuagaaccaguauuaauaccguuacccgaugucagaaacaauuucuaucacuauaaccaaucaaaugacccaacaauaaaacuaauagcaaugcuauacacaccacuaagagcaaacaaugcaggagaugauguauucaccguaucaugccgaguacuaacacgacccucuccagauuucgauuucauauuuuuaguuccaccaacagucgaaucaagaacuaaaccauucaccgucccaguauuaacaguugaagaaaugacaaacucaagauucccuaucccauuagaaaaacuauuuaccggaccaucuucugcauucguaguucaaccacagaacggccgauguacaacugacggcguauuauuaggaacaacacaacuuucaccaguaaacaucuguacauuucgcggagaugucacccauaucgcaggauccagaaauuacacaaugaauuuagccaguuuaaacuggaacaauuacgauccaacagaagaaauacccgcaccauuaggaacuccagacuucguaggaaaaauacaaggaguuuuaacccaaacaaccaaaggugacggcucaacacguggacacaaagccacaguauauaccggcucagccgauuuuacuccuaaacucggaucuguccaauuuggaacagauacagauaaugacuuugaaacacaccaaaauacaagauuuacaccaguaggaguaauucaagauggagcaacaacacaucgcaaugaaccacaacaaugggucuuaccaucauacuccggaagaaacguacauaauguacaucuagcuccugcaguugcaccaaauuucccaggugaacaacuauuauucuuuagaaguacaaugccaggauguuccggauauccaaauauggaccuagauugcuuacucccucaagaauggguucaacauuuuuaucaagaagcugcuccagcccaaucugauguagcacuauuacgauucguaaacccugauaccggcagaguacuauuugaauguaaauuacauaaaagcgguuacgucacaguugcacacacaggacaacaugauuuaguaauaccacccaacggauacuucagauucgauuccuggguaaaccaauuuuauacauuagccccaaugggaaauggaacaggacgaagacgagcucucuaa

SEQ ID NO: 31029 - RNA, 1623 nt, Artificial Sequence
  derived and/or modified sequence opt6 from capsid_protein_VP1__Norovirus__AGI17592
augaugauggcuucaaaugaugccgcacccuccaaugauggugccacaggacucguaccagaaauaaaccaugaaacauuaccauuagaaccaguagcaggugccgcaaucgcugcuccaguaacaggacagaauaauauuauagauccauggauacgaacaaacuuuguacaagcaccaaauggagaauucacaguuucaccacguaauucaccuggagaaauauuacuaaaccuagaauuaggcccagaucuaaaucccuaucuagcucauuuaucaagaauguacaaugguuaugcaggaggcguagaaguucaaguuuuauuagcuggcaacgcauuuacagcuggaaaaauacuuuucgcagcaguaccccccaacuuuccaguagaauuucuaucacccgcacaaauaaccaugcucccucauuuaauaguagacguacgcacauuagaaccaauuaugauaccacuuccagauguacgaaacacauucuuccacuacaauaaucaacccgcaaacagaaugagacuagucgcaaugcuauauacaccacuucgaucaaacggaucuggugacgacgucuuuaccguaucaugccgaguccuuacccgcccaacaccagauuuugaauucaccuaucucguaccacccucaguagaaucaaaaacaaaaccauucucucuaccaauacuaacaauauccgaacuaacuaacucacgauuucccgcuccaauagacucauuauauacagcccaaaauaauaaucuaaauguucaaugccaaaacggacgauguacauuagacggagaacuccaaggaacaacucaauuacucccaucaggcauuugugcauuuagaggaaaacuaacagcugauguacaccaaucacaugaugauagauggcauaugcaacuuaccaaucuuaauggcacaccauuugacccaacagaagacguacccgccccacucggaacaccagacuucacaggauuauuauuuggaguugcaucacaacgcaacguaguuucuaacccaaacacaacaagagcacaugaagccguaauaaguacaaccucuucacaauuuguuccuaaauuagguucaauaaauuuugguucaacaucagacgacuuccaacuacaacaaccuacaaaauucacacccguaggaauaaaaguagaaucaggacacgacuuugaccaaugggcacuaccucgauauucuggacauuuaacccuuaauaugaaucuugccccaccgguagcuccaaacuucccaggugaacaauuauuauucuucagaucaaacguaccaugugcaggcggagucuccgacggcguaauugacugccuacucccacaagaauggauucaauacuucuaucaagaaagugcaccuucacaauccgaugucgcauuaauaagauauguaaacccagauacaggacgaaccuuauuugaagccaaacuacaucgaacaggauacauaacagucgcccacucaggagacuauccacucgucguccccucaaauggcuauuuccgauucgacuccuggguaaaucaauuuuacucacuagccccaaugggcacaggcaauggaagacgaagaguacaauaa

SEQ ID NO: 31030 - RNA, 1650 nt, Artificial Sequence
  derived and/or modified sequence opt6 from capsid_protein_VP1__Norovirus__AGI17594
augaaaauggcuuccaacgacgcagcaccaucuaacgacggcgcagccggacucgucccugaaauaaacucagaagcaauggcuuuagaacccguagcaggugcagcaaucgcugcacccuuaaccggucaacaaaauauaaucgacccauggauaaugaauaauuucguccaagcaccuggaggugaauuuacaauaucaccaagaaauggcccaggagaaguauuacucaauuuagaacuaggaccagaaauaaauccuuauuuagcacaccuugcuagaauguauaauggauacgccggcggauuugaaguccaaguuguacuagcuggaaacgcauuuacagccggaaaaauaauauuugcagcaauuccuccuaacuuuccaauagauaaucuaagugcagcccaaguaacaaugugcccucacguaauaguagacguacgucaauuagaaccaguaaauuuaccaaugccagacguacgcaacuccuuuuuucacuauaaccaagguacagauuccagacucagacuaauugcaauguuauauacuccacuaagagcaaacaacagcggagaugauguauucacaguaucauguagaguauuaacaagaccuucaccagacuucucauucaacuuucuaguaccaccaacaguagagaguaaaacaaaaccauucaccuuaccaauacuaacaauaucugaaaugucuaacucacgauuuccaguaccaauagacucauuacacacaagcccuacagauaacauaguaguucaaugccaaaacggaagaguaacauuagauggcgaauuaaugggaacaacacaauuacuacccucccaaauuugcgcauuuagagguguccucacacaaagaacuucccgugcaucagaccaagcagauacagcaguaacacccagagccuucgaucaccgauggcauauacaacuagauaauuuaaacggaacucauuaugacccaucagaagacauuccaggaccacucggaauaccagauuuucguggacgaguauauggaguugcaucacaaagaaauucugacggcuccacaagagcacacgaagcaaaaauagacacaacaucuucacgauuuacgccaaaacuaggaucauuagaaauaaguacugaaucagaugauuucgaugaaaacaaaccuacaagauuuacaccaguaggaaucggaguagauaaugaacgagaauuucaacaaugguccuuaccagauuauuccggacaauucacucacaauaugcaucuagcaccagcuguagcaccuaacuuuccaggagaacaauuauuauuuuucagaucacaucuaccaucaucaggcggaugggucgauggaacuuuagacugucuucuaccacaagaauggauacaacacuuuuaccaggaaucagcacccucacaaacacaaguagcuuuaguuagauauguuaaucccgauacggguagaguacuauuugaagccaaacuacacaaauccggauuuaugacaauagcaagaucaggagauucaccuauuacagucccaccuaaugguuauuuuagauuugaaucauggguaaacccauuuuauacacuagcaccaaugggaacaggaaacggaagacgaagaauacaauaa

SEQ ID NO: 31031 - RNA, 1623 nt, Artificial Sequence
  derived and/or modified sequence opt6 from capsid_protein_VP1__Norovirus__AGK36311
augaaaauggcaucaaaugaugcaaauccaucagauggaucagcagcuaauuuagucccggaaguaaguaacgaagucauggcauuagaaccaguaguaggagccgcuauagccgccccaguggcuggacaacaaaauguaaucgacccauggauaagaaacaauuuuguacaagcacccggaggagaauuuacaguauccccucgcaaugcaccuggagaaauauuaugguccgcaccauuaggaccagaccuaaauccauaccuaucacauuuagcaagaauguacaauggauacgcuggagguuuugaagucagaguaauauuagcaggaaacgcauucacugcaggaaaaauaauauucgcagcaguaccaccaaacuuuccaacugaaggucuuucaccaucacaaguuacuauguucccucauauuaucguagacguccgucaacucgaaccaguacuaauaccacuccccgauguaagaaacaauuuuuaccacuauaaucaaacuaacgacucuacuauuaaauuaauagcuauguuauacacuccacuuagagcaaacaaugcaggcgaagacguauuuaccguaucauguagaguacuaacccgaccaucaccagacuuugacuuuauauuucuaguaccaccaacaguggaaucaagaacaaaaccauuuacaguaccuauuuuaacuguagaagaaaugaccaauuccagauuucccauaccauuagagaaacuuuuuaccgguccaaguucagcuuuuguaguacaaccacaaaauggcagaugcacuacagauggaguacuucuaggaacaacacaauuaucaccaguaaauauuuguacauucagaggcgacguaacccauauagcaggaucuagaaauuacacaaugaauuuagcaucacuaaauuggaacaacuaugauccaacagaagaaaucccagcaccacuaggaacacccgacuuuguaggaaaaauacaaggaguauuaacacaaacaacuaaaggugacggaucuacaagaggacauaaagcaacaguauauacuggaucagcaccauucacuccaaaauuaggaucuguacaauucucaacagacacagaaaacgauuuugaaauucaucaaaauaccaaauucacaccuguaggcgucauacaagacggcggcacuacacacagaaacgaaccacaacaauggguauuaccauccuauaguggaagagacguacauaauguacauuuagccccagcaguagcuccuacauuuccaggcgaacaacuacuauuuuuuagaaguaccaugccagguuguucagguuauccaaacauggacuuagauugccuacuaccacaagaauggguucaacauuuuuaccaagaagcagccccagcucaaucagauguagcacuucuucgauuugucaauccugauacaggacgaguauuauucgaaugcaaacuccacaaaucaggauauguaacaguagcacacacaggacaacaugacuuaguuauaccgccaaauggauauuucagauuugauuccuggguaaaucaauucuacacuuuagcuccuauggguaacggaacaggacguagaagagcccuauag

SEQ ID NO: 31032 - RNA, 1623 nt, Artificial Sequence
  derived and/or modified sequence opt6 from capsid_protein_VP1__Norovirus__AGK36314
augaaaauggcuucaucagacgcaaacccaucagauggaucaacagcuaaccuagucccagaaguaaauaacgaaguaauggcacuagaaccaguuguaggcgccgcuauagcagcuccuguugcaggacaacaaaauguaauugauccauggauaagaaauaacuuuguacaggcaccaggaggugaauuuacaguuucacccagaaaugcaccuggagaaauacuauggucugcaccuuuaggaccugaccucaauccauauuuaucucaccuagcuagaauguauaacggauacgcuggcgguuuugaaguacaaguaauuuuagcaggaaaugcauuuacagcaggaaaaauaauuuucgcugcaguaccaccaaauuuuccaacugaaggacuuucaccaucucaaguaacaauguucccacauauaauagucgauguucgccaauuagaaccaguacucaucccacuuccagacguccgaaauaauuuuuaucacuacaaccaaagcaacgauccuacaauaaaauuaauagcuauguuauacaccccacuaagagcuaauaaugcaggagacgacguuuucacaguaucaugucgaguacuaacaagaccaucaccugacuuugauuuuauauuucuaguuccaccuacaguagaaucuagaacaaaaccuuucuccguaccaguauuaacaguugaagaaaugacaaacucucgauuuccaauaccauuagaaaaauuauuuaccggcccaucaucagcauucguuguccaaccacaaaacggaagauguacuacagacgguguacuuuuaggaacaacccaacuauccccaguaaacauauguacauuuagaggagacgucacacauauaccaggaucaagaaauuacacaaugaacuuagcuucccaaaauuggaauuccuaugaucccacugaagaaauaccagccccuuuaggaacaccugacuuuguaggcaagauacaaggaguacuuacccaaacaacaagaacaaacggaucuacaagaggucauaaagcaacugucuacacuggaucagcagacuuuucaccuaaauuaggacgaguacaauucgcaacagauaccgauaacgauuucgaaacuaaucaaaacacuaaauuuacaccagucggagucauacaagacgguagcacaacaccccguaaugagccucaacaaugggucuuaccaucauauucaggaagaaauauacacaacguacaucuagcacccgcaguagcacccacuuuucccggagaacaacuauuauucuuuagauccacaaugccuggaugcucuggauacccuaacauggaucuagacugccuucucccacaagaauggguccaauacuuuuaucaagaagcagcaccagcccaauccgauguugcauuacuaagauucguaaacccagauacaggccguguacuuuuugaaugcaaacuacauaaaucagguuauguaacugucgcacacacaggacaacacgaucuagucauuccaccuaacgguuauuuucgauucgauuccuggguaaaucaauucuauacacuagcaccaaugggaaauggaacuggcagaagacgugcauuauaa

SEQ ID NO: 31033 - RNA, 1593 nt, Artificial Sequence
  derived and/or modified sequence opt6 from capsid_protein_VP1__Norovirus__AGM33208
augaugauggcaucaaaagacgcaacaucuuccguagauggugcuucaggugcaggacaacuaguaccagaaguaaacgccucagauccacuugcaauggaccccguagcaggaucuucaacugcaguugcaacagcuggucaaguuaacccaauugacccauggauaaucaacaacuuuguacaagcuccacaaggagaauuuacuauaucaccaaacaauacaccuggcgauguacuauuugaccucucauuaggaccacaccuaaacccuuucuuauuacauuuaucacaaauguacaauggauggguagguaauaugcgaguaagaaucauguuagcaggaaaugcuuuuacagcaggaaaaauaauuguuucaugcauacccccugguuuuggaucucacaauuuaacaauagcacaagcuacacuuuuuccacauguaaucgcugacguaagaacacucgauccaauugaaguaccuuuagaagacguaagaaacguauuauuucauaacaaugacagaaaucaacaaacuaugagauuaguuuguauguuauacacuccauuaagaacaggaggagguacuggagauucuuuuguaguugcaggacgaguaaugacuuguccauccccagauuuuaacuuuuuauuccuaguacccccaacaguagaacaaaaaacaagaccuuuuacauuaccaaauuuacccuuauccucuuuaucuaacucccgagcacccuuaccuaucaguucaaugggcauaucuccagauaacguacaaucaguucaauuucaaaauggaagaugcacuuuagauggucgauuaguaggaacuaccccuguaucauuaucucauguugcaaaaauuagaggaacuucaaaugguacaguaauaaaucuuacggaauuagaugguacaccauuucacccuuuugaaggaccugcacccauaggauuuccugaucucggaggaugcgauuggcauaucaauaugacacaauuuggacauucaucacaaacacaguaugauguagacacuaccccagauacauuugucccucauuuaggauccauccaagcaaaugguaucggaucuggcaauuacguaggaguucuaucauggauuucaccaccaucccauccaucaggaucucaagucgauuuauggaaaauaccaaauuauggcuccucaauaacugaagcaacacaucuagcuccaucaguauauccaccaggauucggagaaguacuaguauucuucaugucaaaaaugccagguccaggcgcauauaaucuaccuugucucuuaccucaagaauacauaucacaucuagcaucugaacaagcaccaacaguaggagaagcagcccuccuacauuacguagacccagacacaggacgaaaccuaggugaauuuaaagcuuacccagauggauuuuuaacauguguaccuaauggagcaucuucaggaccacaacaacuaccaauaaaugguguuuucguuuuuguuaguuggguaucuagauuuuaucaauuaaaacccguugguacagcaucauccgcacgaggaagauuaggccuacgacguuaa

SEQ ID NO: 31034 - RNA, 1593 nt, Artificial Sequence
  derived and/or modified sequence opt6 from capsid_protein_VP1__Norovirus__AGM33214
augaugauggcaucaaaggacgcuacaucuagcguagacggcgcaucuggcgcaggccaacucguaccugaaguaaaugcaucagauccuuuagcaauggauccaguagccggaucaagcacagcuguagcaacugcaggacaagucaauccaaucgauccauggauaauaaauaacuuuguucaagcaccccaaggugaauuuacuauaucuccaaacaauacaccuggagaugucuuauuugaccucagcuuagguccacaucucaauccauuuuuauuacauuuaucccaaauguauaaugguugggucggaaauaugagaguuagaauaaugcuugccggcaaugcuuuuacugcagguaaaauuaucguauccuguauuccaccaggauuuggaucacacaaucuaacaaucgcacaagcuacacucuuuccacacguaauugcagacguucguacauuagauccuauagaaguaccauuagaagauguaagaaaugugcuuuuccauaauaacgaccgaaaucaacaaacaaugagauuaguaugcaugcuuuacacuccauuaagaacaggagguggaacuggagauucuuuuguaguagcaggacgaguaaugacauguccaucuccagacuuuaauuuuuuauuucuuguuccaccaaccguugaacaaaaaacaagaccuuucacauuaccuaaccuaccauuauccucucuaucaaauuccagggcaccauuaccaauaucuuccauggguauaucaccugauaauguucaaucaguccaauuucaaaauggaagauguacuuuagauggacgcuuaguuggaacaaccccuguaucucuaucacacgucgcaaaaauccgaggaacuucuaauggcacaguaauuaacuuaacugaacucgauggaacaccauuucacccauuugaaggaccagcaccuaucgguuuuccagaccuagguggaugugacuggcacauaaacaugacacaauuuggucacucaucacaaacacaauacgauguuaauacaaccccagauacauuuguaccucacuuaggaucaauacaagcaaauggaauaggauccggaaacuauguaggaguauuauccuggauaucccccccaucacauccuucaggaucucaagucgauuuauggaaaauuccaaacuauggaucaucuauuacagaagcaacacaucuagcaccaucaguauauccuccaggauuuggagaaguauuaguauuuuucauguccaaaaugccaggcccuggugcauacaaucucccaugccucuuaccacaagaauauauaucacauuuagcaucagaacaagcacccacaguaggagaagcagccuuacuccacuauguugacccagauacaggaagaaauuuaggagaauucaaagcauacccagaugguuuucuaacaugcguaccaaauggugcauccuccggaccccaacaauuaccuaucaauggagucuuuguauucguaucuuggguaucucguuuuuaucaacuuaaaccaguaggaacagcaucauccgcacgugggcguuuaggauuaagacguuaa

SEQ ID NO: 31035 - RNA, 1593 nt, Artificial Sequence
  derived and/or modified sequence opt6 from capsid_protein_VP1__Norovirus__AGM33217
augaugauggcaucaaaagaugcaacuuccucaguagauggagccucaggagcaggacaacuuguaccugaaguaaaugccuccgauccacuugcaauggauccaguagcuggaucuucaacugcaguagcaacugcaggacaaguaaaccccauagauccauggauuauuaauaauuuuguacaagccccacaaggagaauuuacuauaucuccuaauaacaccccaggggauguauuauucgauuuaucuuuaggaccccaccuuaauccauuccuauuacauuuaucacaaauguauaaugguuggguuggaaauaugcgaguucgaauaaugcuagcaggcaaugcauucacagcagguaaaauaauaguuucaugcauaccacccgguuucggaucacacaauuuaacaauagcucaagcaacuuuauucccacaugugauagcagauguacgaacguuagacccaauagaaguuccucuagaagauguuagaaaugucuuauuucauaauaacgaucguaaucaacaaacaaugagacuagucugcaugcuauauacuccuuuaagaacaggaggcgguacaggugauuccuuuguaguagcuggucgaguuaugacaugucccuccccagauuuuaauuuucuauuccuaguaccaccuacugucgaacaaaaaaccagaccauucacauuaccaaaucuucccuuaucaagucucucaaacucucgcgcccccuuaccuauaucaucuaugggaauauccccagacaauguacaaucuguucaauuccaaaauggaagaugcacccuagacggacgacuaguagguacuacacccguaucucucagucacguugcaaaaauaagaggaacuuccaauggaacaguaauaaaucuaacagaacuagauggaacuccauuccacccuuuugaaggacccgcaccaauaggauuuccugaucuaggagguugugacuggcauaucaauaugacucaauuuggacauucaucacaaacacaauaugaugucgacacaacaccagauacauuuguuccacaccuagguucaauacaagcaaauggaaucggaucaggaaauuaugucgguguacuuucuuggauaucaccaccaucacauccaucuggaucacaaguagacuuauggaaaauuccuaacuauggaucuucaauaacagaagcaacacaucuagcacccucagucuauccaccugguuuuggcgaaguucuaguauuuuucaugucuaaaaugcccggaccaggcgccuacaauuuaccaugccucuuaccacaagaauacauuucacaccuagcaucagaacaagcaccaaccgucggagaagcugccuuacuacauuauguugauccagauacaggacgaaaucuaggagaauuuaaagccuacccagaugguuuuuuaacauguguuccuaauggcgcaucuucaggaccucaacaauuaccuauuaauggaguauuuguauuuguuagcuggguuucccguuuuuaccaauuaaaaccaguagguacagcuucaucagcuagagguagacuaggauuacgacgauaa

SEQ ID NO: 31036 - RNA, 1593 nt, Artificial Sequence
  derived and/or modified sequence opt6 from capsid_protein_VP1__Norovirus__AGM33220
augaugauggcuagcaaagaugcuacaucaagcguagacggagccaguggugcaggacaguuaguaccugaaguaaaugccucagacccuuuggcuauggacccaguagccgguucaucaacugccguagcaacagcaggacaaguaaauccaauugauccauggauaauuaauaauuucguacaagcaccacaaggcgaauuuacaauuucaccaaacaauacuccaggugauguucuauuugaucuaucauuagguccucaucuaaauccauuucuauuacaccuuucacaaauguauaauggauggguuggaaacaugcgaguaagaauuaugcuagcaggaaaugcauuuaccgcugguaaaauaauaguauccugcauaccccccgguuuugguucccauaauuuaacuaucgcccaggcuacauuauucccucacguaauagcagacguaagaaccuuagauccaauagaaguaccacuagaagauguacguaauguuuuauuccauaauaaugauagaaaucaacaaacuaugcgacucguuuguauguuauauacaccacuacgaacuggaggcggcacuggagacucauucguaguagccggaagaguuaugacaugcccauccccugacuucaauuuuuuauuucuuguaccaccaacaguagaacaaaaaacaagaccuuuuacauuacccaauuuaccauuaucaagcuuaucaaauucuagagccccacuaccaauuucuucaaugggaauuucaccagauaauguucaaucaguacaauuccaaaacgguagaugcacauuagauggaagacuuguaggaacaacacccguaucacuaucacauguagccaaaauacgaggaacaucaaacggaacaguuauuaaucuaacagaauuagacggaacaccauuucaucccuuugaagguccugcaccuauaggauuuccagauuuaggaggcugugacuggcauauuaacaugacacaauucggacauucaucucaaacacaauacgauguagauacaacaccagacacuuuuguaccgcacuuaggaucaauacaagcaaacggaguagguucaggaaauuacgucggaguauuaucauggauaucaccuccaucacauccauccgguucccaaguagaucuauggaaaauaccuaauuacggaucauccauaacugaagcaacucauuuagcaccaucugucuauccuccaggcuuuggagaaguccucguauucuuuaugaguaaaaugccaggaccaggcgccuacaaccucccuugccuacuuccacaagaauauauaucacacuuagcaucagaacaagcaccaacuguuggugaagcugccuuauuacacuacgucgacccagacacaggacgaaaucuaggugaauucaaagcauauccagauggauuucuaacauguguaccaaauggagcuucuuccggaccucaacaacuaccaauaaauggaguauuugucuuuguuucuuggguaucacgcuuuuaucaauuaaagccuguuggcacugcaucaucagcaagaggucgccuuggacuaagaagauaa

SEQ ID NO: 31037 - RNA, 1593 nt, Artificial Sequence
  derived and/or modified sequence opt6 from capsid_protein_VP1__Norovirus__AGM33226
augaugauggcuucaaaagacgcaaccucaucaguagauggagcaucaggugcaggucaacucguucccgaaguaaaugccuccgauccuuuagcaauggauccaguagcaggaucaucaacagcaguagcaacagcaggccaagucaauccaauagauccuuggauuauaaacaacuuuguacaagcaccucaaggagaauuuacuauaucaccaaacaauacaccuggggauguauuauucgaucuaucauuaggaccacaccuaaauccuuucuuacuacaccuaagucaaauguauaauggauggguuggaaauaugagaguuagaauaauguuagcaggaaacgcauuuacagcaggaaaaauaauaguaucauguaucccaccugguuuuggaucacauaauuuaacuauagcacaagcaacuuuauuuccucauguaauugcagacguaagaacacuagaucccauagaaguaccucucgaagauguaagaaauguauuauuccacaauaaugaccgcaaucaacaaacaaugagacuuguauguaugcuuuauacccccuuaagaacaggaggaggaacaggugacucauuuguuguagcaggaagaguuaugacaugcccaucaccugacuuuaauuuuuuauuccucguaccaccaacaguagaacaaaaaacuagaccauucacauuaccaaauuuaccauuauccucuuuaucaaauucucgagcaccucuacccauaucaucaaugggaauaucaccagauaauguacaaucgguucaauuucaaaacgguagauguacuuuagacggaagauuaguaggaacaacaccuguaucacuuagccauguagcaaaaauuagagguacaucaaauggaacuguaauuaaucuuacugaauuagacggaacaccauuucauccuuucgaaggaccagccccuauaggauuuccagauuuaggaggaugcgauuggcauauaaauaugacacaauucggacacaguucacaaacccaauaugauguagauacaacaccugauauauuuguaccacauuuaggaucaauccaagcaaacggaauaggcucuggaaacuacguagguguacucucguggauaucacccccaucacauccaucaggaucacaaguagaucuuuggaaaauaccuaacuacggcuccucaauaacggaagcaacucaccuagcaccaaguguauauccaccuggauuuggagaaguauuaguuuuuuucaugucaaaaaugccaggaccuggagcauacaacuuaccaugucuacuuccacaagaauauaucagucacuuagcaagugaacaagcuccuacagucggagaagcagcauuauuacauuauguagauccagacacaggaagaaaucuaggagaauucaaagcuuauccagauggcuuucuaacauguguaccuaauggagcauccucaggaccacaacaauuaccuaucaauggcgucuuuguauuuguaagcuggguaucucguuucuaucaauuaaaacccguaggcacagcuucaucugcacgcggacgauuaggacuaagaagauaa

SEQ ID NO: 31038 - RNA, 1593 nt, Artificial Sequence
  derived and/or modified sequence opt6 from capsid_protein_VP1__Norovirus__AGM33229
augaugauggcaucaaaagacgcaacaucaucaguagauggagccucaggcgcaggccaauuaguaccagaaguaaacgccuccgauccacuugcaauggauccuguagcaggaucaaguacagcagucgcuacugcaggacaagugaauccaauagaccccuggauuauuaauaacuucguacaagcuccacaaggagaauuuacaauaucaccaaacaauacaccuggagacguauuauucgaucucucauuagguccccauuuaaacccauuccuacuacauuuaucucaaauguauaauggauggguagguaauaugagaguaagaauuaugcuagcaggaaaugcauuuacagcaggaaaaauaauagucucauguauaccaccaggauuugguucacacaaucuaacaauagcacaagcaacucucuucccacauguaauagcagauguacgaacacuagauccaauagaaguuccucuagaagauguuagaaauguacuuuuucauaauaaugaucgaaaucaacaaacuaugcgauuaguauguaugcuauauacuccccuaagaacaggugguggaacaggagauucauucguagucgcaggaagaguaaugacuugcccaucaccugauuuuaauuuucuuuuuuuaguaccaccaacaguagaacaaaaaacacgaccuuucacccuuccaaaucuuccacuaagcucuuuaucaaauucucgcgcaccacuaccaauaaguagcauggguaucuccccagacaauguacaaucaguucaauuucaaaacggaagauguacauuagacgguagacuagucggaacuacaccaguaaguuuaucucauguugcaaaaauaagagggacaucaaauggcacuguaauuaauuuaacugaacuagauggcacaccuuuccauccauuugaaggaccugcaccaauagguuucccugaccucggaggcugugauuggcauauaaacaugacucaauucggacauucaucacaaacacaauaugauguagauacuacaccaguaacauuuguuccacauuugggcucaauacaagcaaauggaauaggcucagguaacuauguugguguccuaucauggauauccccuccuucacauccaucuggaucacaaguugacuuauggaaaauuccaaacuauggauccuccauuacagaagcaacccauuuagcaccaucuguuuacccaccaggauucggagaaguauuaguauucuucaugucaaaaaugccaggaccaggagcauauaaccuuccuuguuuacuaccucaagaauauauaucucacuuagcaucugaacaagcuccaacuguuggagaagcagcauuacuacauuacgucgacccagacacaggaagaaauuuaggcgaauucaaagcauaucccgauggauucuuaaccuguguaccaaauggugcaucuucaggcccucaacaauuaccaauaaacggaguauuuguauuuguaucauggguaucuagauucuaccaauuaaaaccaguagguacugcauccucagcaagaggaagacuaggacuucgaagauaa

SEQ ID NO: 31039 - RNA, 1593 nt, Artificial Sequence
  derived and/or modified sequence opt6 from capsid_protein_VP1__Norovirus__AGM33232
augaugauggcuucuaaagaugcaacauccucaguagauggagcaucaggugcuggacaacuaguaccugagguaaaugcuucagauccacuagcuauggauccagucgcuggaucuucaaccgcagucgcaacagcagggcaaguaaauccaauagacccauggauaauaaauaauuucguucaagcaccacaaggagaauuuacaauuucuccaaacaacaccccaggagacguauuauuugaucuaucucuaggaccacaccuaaacccuuuuuuauuacacuuaucacaaauguauaacgguuggguaggcaauaugagaguuagaaucaugcuagccggaaaugcauucacagcaggcaaaauaauuguuucauguauuccaccugguuuuggaucacacaacuuaacaauugcacaagcaacuuuauucccacacguaaucgcagauguaagaacacuagaccccauagaaguuccauuagaagacguaagaaacgucuuauuccauaacaacgacagaaaucaacaaaccaugagacuaguauguaugcuuuacacaccuuuacgcacagguggaggaacuggagacuccuucguuguagcaggacgaguuaugacaugccccucaccagauuucaauuuucuuuuuuuaguuccuccaacugucgagcaaaaaacccguccuuuuacauuaccaaauuuaccucuaucuucauuaucaaauucacgagcaccuuuaccaauaucuucuaugggaauauccccagacaacguucaauccguccaauuucaaaauggccgauguacauuagauggacgucuaguuggaacuacaccaguaucacuaucacauguugcuaaaauaagagguacaucaaaugguacaguaauaaauuuaacagaauuagauggaacaccuuuucaucccuuugaaggaccagcaccuauaggcuucccagaucucggugguugugacuggcacauuaauaugacucaauuuggacauucaucacaaacacaauacgauguagauacaacaccagauaccuuuguaccucacuuaggaucuauacaagcuaauggaauuggaucaggaaacuacguaggaguacuaucauggauaucaccaccuucuagaccaaguggcucacaaguugaucuuuggaaaauaccaaauuauggaagcucgauaacagaagcaacacaccuagcaccaucaguauaucccccaggauucggagaaguacuuguauuuuucaugucuaaaaugccuggaccaggcgccuauaaccuaccauguuuauuaccucaagaauacauuucacaccuagcuucagaacaagcacccacaguaggagaagcagcccuauuacauuaugucgacccagauaccggaagaaaucuaggugaauuuaaagcauaucccgacggauuuuuaacaugcguaccaaauggagcaucaucaggaccacaacaacuuccaauaaauggaguauucguauuuguaucauggguauccagauuuuaucaauuaaaaccuguuggaacagccucgucagcacgaggaagauuaggacuaagaagauaa

SEQ ID NO: 31040 - RNA, 1593 nt, Artificial Sequence
  derived and/or modified sequence opt6 from capsid_protein_VP1__Norovirus__AGM33235
augaugauggcaucaaaagaugcaacuucuucaguugacggagcaucaggagcaggucaauuaguacccgaagucaaugcaucagacccacuagcaauggacccaguugcuggaucuucaacugcagucgcaacagcaggacaaguaaauccuauugauccauggauuauaaauaauuuuguacaagccccacaaggugaauuuacaauaucaccaaauaauacaccaggugauguacuauuugaccuaucucuuggaccacacuuaaauccauuucuguuacaucuuucacaaauguauaaugguuggguaggcaacaugagagucagaauaauguuagcagguaaugcauuuacugcaggaaaaauaauaguauccuguauucccccugguuuugguucucauaacuugacuauagcacaagcuacuuuauucccucauguaauagcagauguaagaacauuagacccaaucgaaguaccacuagaagacguuagaaauguuuuauuucauaacaaugauagaaaucaacaaacaaugagacuugucuguauguuauauacaccauuaagaacaggaggcggaacaggugauuccuuuguuguagcaggaagaguaaugacauguccuucaccagauuucaacuuucuauuccuuguaccaccuacugucgaacaaaaaacuagaccauuuacacucccaaauuuaccacuaucuucacuaucaaacaguagagcuccacuaccaauuucuucaaugggaauaucaccugacaauguacaaucuguacaauuucaaaauggacgauguacauuagaugguagauuaguagguacaacaccuguaucacuaucucauguagccaaaauacgaggaacuucaaacggaacagucauaaaucuuacagaauuagauggaacaccauuucauccuuuugaaggaccagcaccaauaggauuuccugaucuaggaggaugugauuggcacauuaacaugacacaauuuggacauucuucacaaacccaauaugauguugauacuacccccgauacauucguuccacacuuagguucuauacaagcaaauggcauaggaucaggaaauuacguaggcguucuaucuuggaucucaccaccaucaagaccaucuggaucucaagucgauuuauggaaaauaccaaauuacggaagcucuauuacagaagcaacccacuuagcaccaaguguauacccuccuggauuuggagaaguauuaguuuuuuuuaugucuaaaaugccagguccaggcgcauacaauuuaccauguuuauuaccucaagaauauauaucacacuuagccucagaacaagcaccaacagucggagaagcugcacuucuacauuauguagacccagacacaggacgaaaccuaggagaauucaaagcauauccagauggauuuuuaacauguguaccaaauggagcauccaguggaccacaacaacucccaauaaacggaguauucguuuucguaucauggguaucaagauuuuaccaacuuaaaccuguaggaacagcaucauccgcucgcgggcgacucggauuaagaagauaa

SEQ ID NO: 31041 - RNA, 1593 nt, Artificial Sequence
  derived and/or modified sequence opt6 from capsid_protein_VP1__Norovirus__AGM33238
augaugauggcaucaaaagacgcaacuucauccguagacggagcaucaggagcaggacaacuuguaccugaagucaaugcaucagauccacuagcaauggacccaguugcuggaucaaguacagcuguagcaacuacuggucaaguuaacccuauagauccauggauuauaaauaacuuuguccaagccccacaaggagaauucacuaucucaccaaauaauacaccuggcgauguauuauuugaucucucacuaggaccccaucuuaacccauuccuauuacaccuaagucaaauguauaaugguuggguaggaaauaugagaguaagaaucauguuagcaggaaacgcauuuacugcaggaaaaauaauuguaaguuguauaccaccaggauuuggaucucacaaccuuacaauagcacaagcaacauuauuuccacacguaauagcagacguaagaacauuagacccaauagaagucccucuagaagauguaaggaauguucuauuucauaacaacgaccguaaucaacaaaccaugagauuagucuguauguuauauacaccauuaagaacaggcggagguaccggagauucguuuguaguagcaggaagaguaaugacauguccaucuccagacuucaauuuuuuauuuuuaguaccuccaacuguagaacaaaaaacaagaccauuuacauuaccaaauuuacccuuaucaucacuaucaaauucaagagcaccacuuccaauaucaucaaugggcauaucccccgauaauguacaaucaguccaauuccaaaacggaagauguacauuagacggaagacuaguuggaacuacaccaguaucuuuaucccauguagcaaaaauaagaggaacaucaaauggaacaguaauaaauuuaacagaauuagauggcacaccuuuucauccauuugaaggucccgcaccaauaggauuuccagaccuaggaggaugugauuggcauauuaauaugacccaauucggucauaguucucaaacacaauacgauguagauaccacuccagauacuuuuguaccacacuuaggaucaauacaagcaaauggaauuggaagcggaaacuauguagguguacucucauggauaaguccaccaucccacccaucaggaucacaaguagauuuauggaaaauuccaaauuacgguucuucaaucacagaagcuacacacuuagcaccuucaguauauccaccagguuuuggagaagucuuaguuuucuucaugucuaaaaugccaggaccaggagcauauaauuuaccaugcuuacuuccucaagaauauauaagccauuuagccucugaacaagcuccaacaguaggugaagcagcacuauuacauuacguagaccccgacacuggaagaaauuuaggagaauuuaaagcuuacccugacggauuucuuacauguguaccaaacggagcaucaucagguccacaacaauuaccaauaaauggaguauuuguauuuguaucauggguaucaagauucuaucaacuaaaaccuguaggaaccgcgucaucagcaagaggaagauuaggauuaagaagauaa

SEQ ID NO: 31042 - RNA, 1593 nt, Artificial Sequence
  derived and/or modified sequence opt6 from capsid_protein_VP1__Norovirus__AGM33241
augaugauggcaucaaaagacgccacaucaagcguagauggagcaucaggcgcuggacaauuaguaccagaaguaaaugccucagacccacuagcaauggauccaguagcaggaagcucuacagcaguagcaacugcaggacaaguaaauccaauugauccuuggauuaucaauaauuuuguucaagcaccucaaggcgaauuuacaauaucuccaaauaauacaccaggagauguucuauuugaucuuucuuuaggaccucacuuaaacccuuuucuauuacaucuuucucaaauguauaaugguuggguaggaaauaugagagucagaaucaugcuagccggaaaugcauucacagcaggaaaaauaauuguaucauguauaccacccgguuuugguucucauaaccuaacuauagcacaagcuacauuauucccccauguaaucgcugauguaagaacauuagaccccauagaaguaccacuagaagauguaagaaacguauuauuucauaauaaugauagaaaccaacaaacaaugagauuaguauguauguuauauacaccuuuacgaaccgguggaggaacaggagauucauucguuguagccggucgaguaaugacuugcccuucaccugauuuuaauuuuuuauuuuuagucccaccuaccguagaacaaaaaacucgaccauuuacauuaccaaauuuacccuuauccucacucucuaacuccagagcuccacuucccauaucaucuaugggaauauccccagauaauguacaaucaguacaauuucaaaacggaagauguacacuugacggaagacucguaggaaccacaccuguaucacuuucacauguagcaaaaauaagaggaacuucaaacggcaccguaaucaaucuaacugaauuagauggaacaccauuucauccauucgaaggaccugcaccaauuggauuuccagauuuaggagguugugauuggcauauaaacaugacacaauucggacacuccucacaaacacaauaugacgucgauacaacuccagauaccuuuguaccacacuuaggaucaauccaagccaacgggauagguucaggaaauuauguaggaguauuaucauggauuucaccaccuucacacccaucaggcucacaaguagauuuauggaaaauacccaauuauggaucaucaauaacagaagcaacacaucuugcaccauccguauauccaccaggauucggagaaguacuuguauucuucauguccaaaaugccuggcccaggugcauacaacuuacccugucuucuaccacaagaauauauuucacauuuagcuucagaacaagcaccaacaguaggagaagcagcauuauuacacuauguagauccagauacaggacgcaauuuaggagaauucaaagcuuauccagaugguuuucuuacauguguaccaaauggugcauccucaggaccacaacaauuaccuauuaacggaguguuuguuuuuguaucauggguaucaagauuuuaucaauuaaaacccguaggaacagccucuagcgcccggggccgcuuaggccuacgaagauaa

SEQ ID NO: 31043 - RNA, 1593 nt, Artificial Sequence
  derived and/or modified sequence opt6 from capsid_protein_VP1__Norovirus__AGM33244
augaugauggcuucaaaagaugcaacaagcuccguagacggugcauccggcgcaggucaauuagucccagaaguaaaugcaucugauccauuagcuauggauccuguugcaggcucaucuacagcagucgcaacagcaggucaaguaaauccaauagaucccuggauuauaaauaauuuuguacaagcaccacaaggugaauucacaauuucaccaaacaauacaccaggcgauguuuuauucgaucuaucauuaggaccacacuuaaaucccuuucuacuacacuuaagccaaauguauaacggauggguuggaaauaugagaguacgaaucauguuagcagguaacgcauuuacagcaggaaaaauuauaguaucauguauuccuccaggauuugguucucacaacuuaacaauagcacaagcaacauuauuuccucacguaauagcagacguucguacauuagacccaauugaagucccauuagaagauguaagaaauguacuauuucacaauaacgaucgaaaucaacaaaccaugagauuaguauguaugcuauauacuccauuaagaacaggaggaggaaccggagauucuuuuguaguagcuggacguguuaugacauguccaucaccagacuuuaacuuuuuauuucucguacccccaacuguagaacaaaaaacaagaccauucacacugccaaacuuaccauuaucuucauuauccaacucaagagcuccauuacccauuucauccaugggaauaucuccagacaauguacaauccguccaauuucaaaaugggagauguacauuagacggucgcuuagucggaacaacaccaguuucacuaucacauguagcaaaaauacggggaacuaguaacgguaccguaauaaaccuaacagaacuagauggaacaccauuccauccauuugaagguccagcuccaauaggauuuccagauuuaggcggaugcgacuggcauauuaacaugacacaauucggacacucaucacaaacucaauacgacguaaauacaacaccagauacauuuguaccacaccuaggaucuauccaagccaacgguauaggcucaggaaacuacguaggaguacuaucuuggaucagcccaccaucacacccaucaggcucucaagucgauuuauggaaaauaccaaauuauggcaguucuauaacugaagcaacacaucuagcuccaucaguuuauccaccuggauuuggagaaguauuaguauucuucauguccaaaaugccaggaccaggagcauacaaccuaccaugcuuacuuccacaagaauauauuucacaucuagcauccgaacaagcaccaacagucggagaagcagcacuauuacacuacgucgacccagauacaggaagaaaccuaggcgaauucaaagcuuauccagauggauuccuaacauguguuccaaacggagcauccucaggaccacaacaauuaccuauaaauggaguauucguuuucguaucauggguaucgagauuuuaccaacuuaaaccaguaggaacugcaucuagcgcuagaggcagacuaggauugagacgauaa

SEQ ID NO: 31044 - RNA, 1626 nt, Artificial Sequence
  derived and/or modified sequence opt6 from capsid_protein_VP1__Norovirus__AGO59890
augagaaugucugauggagcagcaccaaaagcaaaugguucugaagcaucaggacaagacuuaguaccagcagccguagaacaagcaguaccaauucagccuguagcaggugccgcauuagcagcaccagcugcaggacaaauaaaucaaauagauccuuggauuuuucaaaauuuuguacaauguccauuaggagaauucuccauuucaccaagaaauacacccggugaaauuuuauuugaucuagccuuaggaccaggauuaaaucccuacuuagcacaucuuucagcaauguauacaggguggguagguaauauggaaguacaauuaguacuagcuggaaaugcauuuacagcaggcaaaguaguaguagccuuaguaccucccuauuuuccaaaaggaucacuaacuacagcacaaaucacuugcuuuccucauguuaugugcgaugucagaacacuagaaccuauacaacucccacuauuagacguacgaagaguacuauggcacgccacacaagaucaagaagaaucaaugagacuaguuuguaugcuauauacaccgcuaaggacaaacucuccuggagaugaaaguuucgucguuucuggcagauuauuaaguaaaccugccgcagauuuuaauuucguuuaccuaacuccaccuauagaaagaacaauauauagaaugguagauuuaccaguaauacaaccucguuuaugcacucaugccagauggccugcaccaguauauggacuacuaguugaucccucacuaccaucuaauccacaauggcaaaauggacgcguacauguugauggaacacuacuaggaacaaccccuauaucuggaucaugggucucaugcuucgcagcagaagccgcauauaaauuccagucuggaauaggagaaguggcaacauuuacauuaauagaacaagauggaucagcauauguacccggagacagagcagcuccauuagguuauccugauuuuucuggacaguuggaaauagaaguacaaacagaaacuacaaaaacaggugauaaauuaaaaguaacaacuuuugaaaugauuuuaggaccaaccacaaacgcagaccaagcaccauaccaaggacguguuuuugcaaguguaacagcagcagcaucauuagauuuaguagauggacgaguuagagcaguaccaagaucaauauaugguuuccaagacacuauuccagaauauaacgaugguuuauuagucccuuuagcaccuccaauaggacccuuucucccaggagaaguucuuuuaagauuuagaacauauaugagacaaauagauacagcagacgcagcagcugaagcuauugacugcgcuuuaccucaagaauuuguaagcugguucgcaucaaacgcauuuaccguacaauccgaagcuuuauuauuaagauauagaaauacauuaacaggacaacuccuauuugaaugcaaacucuauaaugaaggauacauagcuuuaucauauucaggaucagggccuuuaacauuuccaacugauggaauauucgaaguuguaaguuggguaccuagacuauaucaacucgcaucuguagguucauuagccacaggaagaaugcuaaaacaauaa

SEQ ID NO: 31045 - RNA, 1620 nt, Artificial Sequence
  derived and/or modified sequence opt6 from capsid_protein_VP1__Norovirus__AGT17782
augaaaauggcaucaaacgaugcuacaccaucagaugguucauccgcaaauuuaguacccgaaguaaauaacgaaguaauggcccucgaacccguagcaggagcugcaaucgcagcaccaguugcuggacaacaaaauguaauagauccuuggauacgaaauaauuuuguucaagcucccggcggcgaauucaccguaagcccaagaaaugcacccggagaaauccucuggucugcuucacuaggaccagaucuaaacccauaucuaucgcaucuuucaagaauguauaauggauacgcaggaucauuugaaguccaaguaauauuagcaggaaaugcauucacugcagguaaaauaauauuugccgcaguuccaccaaauuuuagaacagaaggauuaucccccucacaaauuacaauguucccacacauaauaacugauguucgacaacuugaaccuguauuaauaccccuucccgauauaagaaauaauuuuuaucauuauaaucaaucuaaugauccuacuauaaaacuaauagcaaugcuauauacaccauuacgagcuaacaaugcuggcgaugacguauuuacaguuuccuguagaguauuaacacgaccaucaccagauuuugacuuuauauucuuaguaccaccaacaguagaaucaagaacgaaaccauuuucaguaccaguacuaacaguagaagaaaugacuaauucaagauuuccaauaccacuagaaaaacucuuuacaggaccaucaucagcuuucguuguacaaccacaaaaugguagaugcacaaccgauggaguauuauugggaacaacucaauuaucaccaguaaauauauguacauucagaggugauguuacuagaauaggaaauucuagggaauacagaaugaaucuagccaguuuaaauuggaauaauuaugacccuacugaagaaauaccagcaccauuagguacuccagacuuugcagguaaaauacaaggaguuuuaacacaaacuacacgacaugacgguucaacaagaggacacaaagccacuguuuauacaggauccgcaggauuuacacccaaauuaggaaguguccaauucaguacagacacugauaaugacuuagaagccaaccaaaauaccagauuuacuccaguaggaguuauucaagauggaaacgcucaucaaggugaaccacaacaguggguauuacccaauuacgccggaagagacggacauaauguacaucuagcaccugccgucgcccccacuuuuccuggagaacaacuauuauuuuucagaagcacuaugccaggauguucaggcuauccaaauaugaauuuagauugcuuacuuccacaagaauggguucaacacuucuaucaagaauccgcuccagcacaauccgacgucgcauuacuacgauuuguaaauccagacaccggaagaguucuuuucgaaugcaaacuacauaaaucuggauacguaacaguagcacauacaggaccacacgaucuuguaauaccuccaaacggauacuucagauuugacucauggguaaaccaauuuuauaccuuagcaccaaugggcaauggagcaggcagacgaagagcauuauaa

SEQ ID NO: 31046 - RNA, 1593 nt, Artificial Sequence
  derived and/or modified sequence opt6 from capsid_protein_VP1__Norovirus__AGT17785
augaugauggcauccaaagaugcuacuucaucaguagauggagcaucaggagcaggccaauuaguaccagaaguaaaugcuucagacccauuggcaauggaccccguugcagguuccucgaccgcaguugcaaccgcaggucagguuaaucccauagauccuuggauuaucaauaacuucguccaggcuccucaaggagaauuuaccauauccccuaauaauacacccggagauguauuauuugaucuuucacuugguccacauuuaaacccauucuuacuacauuuaagucaaauguauaacggauggguagguaauaugagagucagaauaaugcuagccggaaaugcuuuuaccgcaggaaaaauaauaguuucauguauaccaccugguuucggaucucacaaucuaacaauagcucaagcuacauuauuuccacauguaauagcugauguucgaacauuagauccaauagaaguuccucuagaagauguacguaacguacuuuuccauaauaacgaucgaaaucaacaaacaaugcguuuagucuguaugcuauauacaccccuaagaaccggcggagguacaggugauucuuucguaguagccgguagaguaaugacaugucccucuccagacuuuaauuuucuauuccuagucccaccaacaguagaacaaaaaacucguccauuuacauuaccaaaucuaccacuaucaucauuauccaauucuagagcaccuuuaccuauauccucaaugggaauaucaccagauaacguacaaucaguacaauuccaaaauggacgauguacuuuagauggucgauuagucggaacaacaccaguauccuuaucacauguugcuaaaauaagaggaacuucaaacggaacaguaauaaaucuaacugaacuagacggaacaccauuucacccuuuugaagguccugcgccuauaggauucccugaucuuggaggaugugacuggcauauaaauaugacacaauuuggucacucaucacaaacacaauaugacguagauacaacaccagauaccuucguuccacaccucgguucaauucaagcaaauggaauaggaucaggaaauuacguaggaguauuaucauggaucucaccucccucacauccaucgggaucucaaguagauuuauggaaaauaccaaauuacggaaguucuauaacagaagcaacucauuuagcacccucaguuuacccaccuggauuuggagaaguauuaguauuuuuuaugucaaaaaugccugguccaggugcauacaaucuaccauguuuauuaccacaagaauauauuagucaucuagcaucagaacaagcaccuacaguuggagaagcagcucucuuacauuaugucgauccugauacuggaagaaaucuuggagaauucaaagcuuacccagacgguuuucuaacaugcguaccuaacggggcaucaucaggcccacaacaacuccccauuaacggaguuuuuguauuuguaucauggguuucaagauuuuaccaauuaaaaccaguaggaacagccucaagcgcaagaggacgacuaggauuaagaagauaa

SEQ ID NO: 31047 - RNA, 1623 nt, Artificial Sequence
  derived and/or modified sequence opt6 from capsid_protein_VP1__Norovirus__AGT17788
augaaaauggcuucaaaugaugcaaacccaucagauggaagcgcagccaaucuaguaccugaaguuaacaaugaaguaauggcauuagaaccaguagucggagcugcaaucgcagcacccguugcaggacaacaaaauguaauagacccauggaucagaaacaacuuuguacaagcacccggaggagaauuuacaguuucaccaagaaaugcaccaggagaaauauuauggucagcaccacuaggacccgauuuaaauccuuaccuaucccauuuagccagaauguauaaugguuacgccggagguuuugaaguccagguaaucuuagcaggaaaugcauuuacagcaggaaaaauaauauucgcagcaguuccaccaaauuucccaacagaaggacuaucuccuucacaaguuacaauguucccucauaucauaguagauguaagacaacuagaaccuguccuaauuccacuaccagacguacgaaacaauuuuuaucacuacaaucaaucaaaugauucaacaauuaaauuaauagcaaugcuauacacaccacuaagagcaaacaacgccggagacgauguauuuacaguaagcugucgaguccuaacaagaccaucaccugacuuugauuuuauauuccuaguucccccaacaguagaaucaagaacaaaaccauucucuguaccuaucuuaacuguugaagaaaugacgaauagccgauucccaauaccacuagaaaaacuuuucacaggaccaucaagcacauuuguaguacaaccacaaaacggaagauguaccacagacggugucuuacuagguacaacccaacuaagucccguaaauaucuguacuuuccgaggagauguuacccauauaacaggaucccgaaauuacacaaugaauuuagcaucacaaaauuggaacucuuaugauccaacagaagaaaucccugcaccacuagguacaccagacuuugucggaaaaauacaaggcguauuaacucaaacaaccagaaccgacggaucaacacgaggucauaaagccacaguauacacagguucagcagauuuuucuccaaaacuaggaagaguacaauucgcaacagauacagacaacgauuucgaugcaaaucaaaauacuaaauucacuccaguaggcgucauacaagauggaggaacuacccacagaaaugaaccacaacaauggguauuacccucauauagcggaagaaauacccauaaugugcacuuagcaccggcuguugcaccaacauuuccaggagaacaacucuuauucuucagaucaacaaugccuggaugcuccggauacccaaauauggacuuagacugucuucuaccacaagaauggguucaacauuuuuaccaagaagcagcaccagcucaaucagacguagccuuauuaagauucguaaacccagauacaggacgcguccuauucgaauguaaacuacauaaauccggauauguaacuguugcacauacuggacaacacgauuuaguuauaccaccaaaugguuauuucagauucgauuccuggguaaaucaauuuuacacauuagcaccaaugggaaauggaaccggaagaagaagagcugucuaa

SEQ ID NO: 31048 - RNA, 1593 nt, Artificial Sequence
  derived and/or modified sequence opt6 from capsid_protein_VP1__Norovirus__AGT17792
augaugauggcaucaaaagacgcaacuuccucuguugacggagcaucuggagccggacaacuaguaccagaagucaaugcuucagacccacuagcaauggauccaguugcuggauccucuaccgcaguagcaacagcuggacaaguaaacccaauagauccauggauaauaaacaauuuuguucaagcuccacaaggagaauucacaaucucaccuaauaauacuccaggagauguacuauucgaccuuucauuaggaccacaccuuaauccuuucuuauuacaucucucucaaauguauaacggcugggucgguaauaugcgaguaagaauaauguuagcaggaaacgcauucacugcaggaaaaauaauugucucauguauacccccaggauuugguucacauaauuuaacaauagcucaagcaaccuuauucccacacguaauagcagauguuagaacauuagauccaauugaaguaccacucgaagauguuagaaauguacuauuccauaacaacgaucguaaucaacaaacaaugcgacuuguauguaugcuauauacuccucuuagaaccggaggaggaacaggugacucauuuguuguugcuggacgaguaaugacauguccaucuccagauuuuaauuuuuuauuucuaguaccaccuacuguagaacaaaaaacuagaccauucacauuacccaauuuaccuuuaaguucuuuaucaaacucaagagcuccucuacccauaucaaguaugggcauuucaccugauaauguacaaucaguacaauuucaaaauggaagauguacccuagauggucgacuaguagguacuacaccugucucauuaucacacguagcaaaaauacgaggaacaucaaauggaacaguuauaaaccuuacagaacuagauggaacaccuuuccauccauuugaaggaccugcaccuauaggauuuccagauuuaggaggaugugauuggcauauaaauaugacccaauuuggacacucuagucaaacucaauaugauguugauacuacaccagacacauuuguaccacaccuaggaucaauacaagcuaauggcauaggaucagguaauuauguagguguacucucauggaucagcccaccaucucauccauccggcucccaaguugaucuuuggaaaauaccuaauuacggaucaucaaucacagaagcaacacaucuagcaccaucaguuuauccuccaggauucggcgaaguauuaguauucuuuaugucuaaaaugccaggcccaggagccuauaauuuaccuuguuuauuaccacaagaauauauuucacacuuagcaagugaacaagccccaacaguaggagaagcagcacuauuacauuacguugacccagauacaggaagaaaucuaggugaauuuaaagccuauccagaugguuuuuuaaccuguguaccaaauggagcaucuucaggaccacaacaauuaccaauaaauggaguauucguauuuguauccugggucucaagauucuaccaacuaaaacccguagguacagcaucaucagcuagaggaagauuaggauuaagacgauaa

SEQ ID NO: 31049 - RNA, 1623 nt, Artificial Sequence
  derived and/or modified sequence opt6 from capsid_protein_VP1__Norovirus__AGT17795
augaaaauggcaucaucugaugccaauccuuccgauggcucuacagcaaaccuaguaccagaaguaaauaacgaaguaauggcacucgaaccaguagucggagcagcaauagcagcaccaguagcuggccaacaaaacguuauugacccauggauaagaaauaacuucguacaagcaccugguggcgaauuuaccguaucaccaagaaaugcaccaggagaaauacuaugguccgccccauuagguccagaucucaauccauauuuaucacaccuagcaagaauguauaauggauaugcaggagguuucgaaguacaaguaauccuagcagguaacgcauuuacagcaggaaaaauaauuuuugcagcaguacccccaaacuuuccaaccgaagguuuaucuccaucucaaguaacaauguucccccauauaauaguagacguuagacaacuagaaccaguacuaauaccacuucccgacguacgaaauaauuuuuaucauuauaaccaaucaaaugacccuaccauaaaacuuaucgcaaugcuauacacaccauuacgagcaaauaaugcaggagacgauguauuuacagucaguugcagaguuuuaacaaggccaucaccugacuuugacuuuauauuuuuaguacccccuacaguagaaucaagaaccaaaccuuuuucuguaccuguauuaaccguagaagaaaugacaaauucaagauuuccaaucccauuagaaaaacuauucacuggaccaucaucugcauuuguaguccaaccacaaaauggaagauguacaacagacgguguacuacuaggaacaacccaacucuccccugucaacauuugcacauuuagaggagacguaacacauauaucaggaucacgaaauuacacaaugaaucucgcuucacaaaauuggaacaguuaugauccaaccgaagaaauacccgcaccauuaggaaccccugacuuuguuggaaaaauacaaggaguacuaacacaaacaacucgaacugacggaagcacaagagggcacaaagcaacaguauauacaggaucagcagauuuuucaccaaaauuaggaagaguucaauuugcaaccgauacagauaaugacuucguuaucaaucaaaauacaaaauuuacaccuguaggaguuauacaagaugguucaacuacaccacguaaugaaccccaacaauggguacuccccuccuauucaggaagaaauacccauaauguucaccuagcaccagcaguagcaccaacuuuucccggagaacaacuacuauucuuuagaucaacaaugccaggaugcucaggauauccaaauauggaucuagauugucuuuuaccucaagaauggguacaauauuucuaucaagaagcagcaccagcccaauccgacguagcauuacuacgauucguuaacccugacacaggacguguccuauucgaauguaaacuacauaaaucagguuauguaacaguugcucacacaggacaacaugaucuaguaauaccaccaaauggcuacuuuagauuugacucauggguaaaucaauuuuacacacuagcuccaaugggaaacggcacaggacgcagaagagcauuauaa

SEQ ID NO: 31050 - RNA, 1617 nt, Artificial Sequence
  derived and/or modified sequence opt6 from capsid_protein_VP1__Norovirus__AGT17798
augaaaauggccuccucugaugcaaauccgucugauggaucuacagccaacuuaguaccagaagcuaacaacgaaguuauggccuuagaaccuguagucggagcagcuauugcagcaccagucgcaggacaacaaaauguaauagacccauggauuagaaauaacuuuguacaagccccaggaggagaauuuacaguaucaccucgaaaugcaccaggagaaguuuuauggucagcuccacuaggaccagacuuaaacccauauuuaucacaucuugcacgaauguauaauggauaugcaggcggcuuugaaguccaaguaauuuuagcaggaaaugcuuuugcagcaggcaaaaucauuuucgcagcaguucccccaaacuuuucaacagaaggucucucaccaucacaagucacaauguucccacaucuaauagucgacguaagacaacuagaaccaguaaugauaccacuaccagacauaagaaauaauuucuaccauuauaaccaauccaaugacccaacaaucaaacuaaucgcaaugcuuuauacuccccuacgagcaaauaacguaggugaugauguauucacaguauccugcagaguccucaccagaccuuccccagacuuugauuucauauuucuaguuccgccaacaguagaaaguaaaacuaacccuuuuaguguaccuauauuaacaauagaagaaaugacaaacucacgauuuccuauaccccuagaaaaauuauuuacaggacccuccucagcacuaguuguacaaccacaaaacggcagauguacaacugacggaguacugcuuggaacaacacaauuaucuccaguaaacauauguacauuuagaggcgaugucacacauacaaccaaaacacauacauaccaaaugaaccuagcagcacaaaacuggaacucauacgaucccacagaagaaaccccugccccucuaggaacuccagacuuuguaggaaaaauccaaggcguacuuacacaaacuaccaaaggaaaugguuccacacgagcacacaaagcaacaguauauacagggacaguugaauucacaccaaaacuaggaagaauacaacuauuuacagacacagacaacgauuuagaagcuaaccaaaacacaaaauucaccccagucggaguaauacaagacggagaccaucaaaaugaaccucaacaauggguccuaccaucauacucaggaagaaauaaucauaacguucaucuagcaccugcagucgcaccaacauuuccaggagaacaauuauuauucuucagaucaacaaugccaggcugcucaggauaccccaauaugaauuuagauugccuccuuccccaagaauggguacaauauuuuuaucaagaagcagcuccagcacaaagugacguagcauuacuccgauucguuaauccagacacaggacguguauuauucgaaugcaaacuacauaaaucuggauauguaacaguagcucauaccggucaucaugaccuaguuauaccaccaaauggauacuucagauucgauucuuggguaucaccauuuuacacacuagcacccaugggaaauggaacaggaagaagaagagcacucuaa

SEQ ID NO: 31051 - RNA, 1593 nt, Artificial Sequence
  derived and/or modified sequence opt6 from capsid_protein_VP1__Norovirus__AGT17803
augaugauggcaucaaaagaugccacaucuaguguugacggugcaucaggcgcaggccaauuaguaccagaaguaaaugcuucugauccauuagcaauggacccaguagcaggcuccaguacagcaguagcaacagcuggacaaguaaauccaauagauccauggauaauuaauaacuuuguacaagcaccucaaggagaauucaccauuucaccuaacaauacacccggugauguauuauucgaucuaucacuaggaccccaucuuaacccauuucuacuacaccuaucacaaauguauaauggcuggguugguaauaugagaguaagaauaaugcucgcgggaaaugcauuuacagccggaaaaauaauuguaucuuguauuccaccagguuucggaucacacaaucuuacaaucgcucaagcaacacuauuuccacacguaauagcagacguuagaacauuagacccaauagaaguaccacuagaagauguaagaaauguuuuauuccacaacaacgaccgaaaccaacaaacaaugcgauuaguauguaugcuauacacaccacuacguacuggagguggaacaggagacuccuuuguuguugcaggcagaguuaugacuugcccauccccagacuucaauuuucuauucuuaguacccccaacaguugaacaaaaaacuagaccuuucacacuaccuaacuuaccacuuuccucauuaucaaauucacgagcuccuuuacccaucucaucaaugggcauuucuccagacaacguacaaucuguacaauuccaaaauggaagguguacauuagacggaagacuaguagguacaacuccuguaucauuaucacauguagcaaaaauaagaggaacaucaaaugguacaguuauaaaccuaacagaacuagauggaacuccguuccauccauuugaagguccagcaccaauagguuuuccagauuuaggcggaugugacuggcacauaaacaugacacaauuuggacacucuucacaaacacaauaugacguugauacaacuccagauaccuuuguaccccaccucggaucaauacaagcuaacggaauuggaucaggaaauuaugucggaguauuaucuuggauuaguccaccaucacacccaucuggaucacaaguagaucucuggaaaauaccaaauuacggaaguucgauuacugaagcuacccauuuagccccuucuguauauccaccaggcuuuggagaaguauuaguauuuuuuaugucaaaaaugccaggcccaggcgcauauaaucuuccauguuuauuaccacaagaauacauuucccaucucgcgagugaacaagcaccaacuguaggcgaagccgcauuacuccauuauguugacccagauacaggacgaaaccuaggagaauucaaagcauauccagauggauuucuuacauguguuccaaauggagcaucaucugguccacaacaacugccaauaaacggaguauuuguauucguuagcuggguauccagauuuuaucaacuuaaaccaguaggaacagcaucaucagcaagaggaagacuaggacuaagaagauaa

SEQ ID NO: 31052 - RNA, 1593 nt, Artificial Sequence
  derived and/or modified sequence opt6 from capsid_protein_VP1__Norovirus__AGT17806
augaugauggccucaaaagacgccaccucaaguguagauggagcaucaggugcuggacaacucguuccagaaguaaacgccucugaucccuuagcuauggauccaguugcaggcucaucaacagcagucgcaacugcuggacaagucaaccccauagacccauggauaauaaacaauuuuguccaagcaccucaaggagaauuuacaauaaguccuaacaauacacccggcgauguauuauucgauuuaucucuaggaccacaucuaaauccuuuucuucuacacuuaucccaaauguauaaugguuggguaggaaacaugagagucagaaucaugcuagcaggaaaugccuuuacagcaggaaaaauaauaguaucauguauuccaccaggauuuggaucacauaaccucaccauagcacaagcaacacucuucccccacguaauagcagacguacguacacuagaucccaucgaaguaccuuuagaagauguaagaaauguacuauuucauaauaacgauagaaaucaacaaacaaugagacuaguauguauguuauacacacccuuaagaacaggcggaggaacaggagacucauucguagucgcaggaagaguaaugaccugcccaucaccugacuuuaauuucuuauuccuaguaccaccaacaguagaacaaaaaacaagaccauucacacuaccuaaucuuccucuaucaucccuaucaaauucuagagcaccacuucccaucucaucaauggguauuucaccagacaauguacaaucuguacaauuccaaaacggaagauguaccuuagacggaagacuaguagguacaacacccguuucacuuucacaugucgcuaaaauaagagguacaucaaauggaaccguuauaaaucuuacagaauuagacggaacaccauuccauccauucgaagguccagcaccaauugguuucccagaucucggaggcugugauuggcacauaaacaugacucaauuuggacacuccucucaaacacaauaugauguagauacaacaccugacaccuuuguaccucacuuaggaucaauacaagcaaauggaauaggaucaggaaauuacguagguguauuaucuuggauauccccacccucucacccuucugguucacaagucgaucuauggaaaauaccaaacuacggaagcaguauuacagaagcaacacacuuagcaccaucaguauaucccccaggauucggagaagucuuaguauuuuucaugucaaaaaugccuggaccaggcgcauauaaucuuccaugcuuacuuccacaagaauacaucucacacuuagcaucugaacaagcuccaacuguaggagaagcagcucuccuacauuauguagacccagacacaggcagaaacuuaggcgaauuuaaagcauaccccgauggauuucuuacaugcguuccaaacggagcuucauccggcccucaacaacuacccauaaacggugucuuuguuuucguuuccuggguaucaagauuuuaccaauuaaaaccaguuggaacagcaucaucagcaagaggacgauuagguuuaagaagauaa

SEQ ID NO: 31053 - RNA, 1593 nt, Artificial Sequence
  derived and/or modified sequence opt6 from capsid_protein_VP1__Norovirus__AGT17809
augaugauggcauccaaagaugcaacuucaucaguagacggagccucaggagcaggccaacuaguaccagaagucaaugcaucggauccccuugcaauggauccuguagcgggaucaucaaccgccguagcaacagcaggacaaguaaaccccauagauccauggauuauaaauaacuucguccaagcaccacaaggagaauuuacaauaucuccuaauaauacaccuggagauguauuauucgaccucucuuuaggaccucauuuaaauccauucuuacuccacuuaucacaaauguacaauggauggguaggaaauaugcgaguaagaauuaugcuagcagguaaugccuuuacugcaggaaaaauaauagucucauguauuccacccgguuucggaucacacaauuuaacaauagcacaagcaacacucuucccacauguuauagcagauguacgaacauuagaucccauagaaguaccacuagaagauguaagaaacguacucuuccauaauaaugauagaaaucaacaaacuaugcgacucguuugcauguuauauacccccuuacgaacaggaggagguacaggagauucauucgugguagcugguagaguaaugacaugcccuucaccugauuuuaauuuucuauucuuaguaccaccaacaguagaacaaaaaacacgaccauuuacauuaccaaacuuacccuuaaguuccuuaucaaacucccgagcaccauuaccuauaucauccauggguauaucaccagauaacguucaaucaguacaauuccaaaauggacguuguacuuuggacggaagauuaguaggaacuacaccaguaucucuaucacaugucgcaaaaauaagaggaaccucuaauggaacaguuauaaaucuaacagaacuagauggaacaccuuuucacccauuugaaggaccugcaccaauaggcuuucccgaucuaggaggaugugauuggcauauaaacaugacacaauucggacauuccucucaaacucaauaugacguagauacaacaccagauacauuuguuccacauuuaggaucuauccaagcaaauggaauaggaucuggaaauuauguuggaguauuauccuggauauccccaccaucacacccuaguggaagucaaguagaccuauggaaaauaccaaauuacggauccucuaucaccgaagcgacucaucucgcaccauccguauauccuccugguuuuggugaaguauuagucuuuuuuaugucaaaaaugccagguccuggagcauacaaucucccauguuuauuaccacaagaauacauaucacaucuagcaucagaacaagcaccaaccguaggagaagccgcauuacuccacuaugucgauccagauaccggaagaaauuuaggugaauucaaagcauacccugacggauuccucacuuguguaccaaauggagcaucuuccggaccucaacaauuaccaaucaaugguguauuuguauuuguaucauggguaucaagauuuuaucaauuaaaaccaguagguacagcaucauccgcuagaggacgauuaggauuaagaagauaa

SEQ ID NO: 31054 - RNA, 1623 nt, Artificial Sequence
  derived and/or modified sequence opt6 from capsid_protein_VP1__Norovirus__AGT17813
augaaaauggccucuaaugaugcaaauccuucagacggaucugcagcaaauuuaguaccagaaguaaacaaugaaguaauggcucuagaaccagucguaggagcugccauagcugcaccaguugcaggucaacaaaauguuaucgauccuuggauaagaaacaauuuuguccaagcuccaggaggagaguuuacaguauccccaagaaacgcuccaggugaaauauuauggucugcccccuuaggacccgaccuaaacccauaucuaucacacuuagcaagaauguauaacggcuacgcaggcggauuugaaguacaaguaauauuagcaggaaaugcauucacagcaggaaaaauaauuuucgcagccguaccaccaaauuuuccaacagaaggauuaucucccucacaaguaacuauguuuccacacauaaucguagauguaagacaacuagaaccaguccuaauaccauuaccagacguaagaaacaauuucuaucacuauaaucaaucaaaugacucaacaauaaaacuuauagcaaugcucuacacuccauugcgagcaaacaacgcuggagacgauguuuuuacaguuucauguagaguacuaacacgcccgucaccagacuuugauuuuaucuuccuaguaccaccaacuguagaaucacgaacuaaaccuuuuucaguuccaauauuaacaguagaggaaaugacuaacucacgauuuccaauuccacuagaaaaacucuuuacuggaccaucaaguacauucguuguacaaccacaaaacggaagauguacuacagacggagucuuacuaggaacaacucaacucucaccugucaauauaugcacauuuagaggagacguaacccauauagcuggaagucgcaacuacacaaugaaucucgcaucccaaaacuggaacucguaugacccaacagaagaaauuccagcaccucucgguacuccugauuuuguaggaaaaauacaaggaguuuuaacccaaacuacaagaacugauggaucuaccagaggacacaaagcuacaguauacacaggcucagcugauuuuuccccuaaacuaggcagaguccaauuugcaacugauacagacaaugacuuugaugcaaaucaaaauaccaaauuuacaccaguaggaguaauucaagacggaggaacagcacauagaaaugaaccacaacaauggguauuaccauccuauucaggaagaaauacucauaauguucacuuagcuccagcaguagcaccaacuuucccaggagaacaacuauuauuuuuuagaucaaccaugcccggauguucaggauauccaaacauggaccuagacugucuauuaccucaagaauggguucaauacuucuaucaagaggcagcacccgcacaauccgacguagcacuauuaagauuuguaaauccagauacaggaagagucuuauuugaauguaaauuacauaaacccggcuauguaacaguagcacauacaggacaacacgauuuaguaauaccaccuaacggauauuuuagauuugauucauggguaaaccaauucuauacauuagcacccauggguaacggaacuggacgacgcagagcuuuauaa

SEQ ID NO: 31055 - RNA, 1623 nt, Artificial Sequence
  derived and/or modified sequence opt6 from capsid_protein_VP1__Norovirus__AGT17816
augaaaauggcauccucagacgcaaacccaucagauggcucugcagcaaaccuagucccagaaguuaauaacgaaguuauggcacuagaaccuguuguaggugcagcaauagcagccccaguagcaggacaacaaaauguaaucgauccauggauaagaucaaauuuuguucaagcgcccggaggcgaauuuacaguaucaccucgcaaugcccccggcgaaauucuauggucagccccauuaggacccgaucuuaauccauaucuaucucauuuagcaagaauguauaacgguuaugcagguggauuugaaguccaaguaauuuuagcagguaaugcauuuacugcuggaaaaauuauuuuugccgcaguaccaccaaacuuuccaacugaaggucucucccccucucaaguuacaauguucccacauauaauaguugacguucgucaacuagaaccaguauuaauaccauuaccagaugucagaaacaauuuuuaucauuacaaccaaucaaaugacucaacaauaaaauuaauagcaaugcuauacacaccauuaagagcaaauaaugcaggagaugacguauuuacaguaucaugucgaguacuaacacgaccuucaccugacuuugauuuuauauuccucguaccaccuacuguugaaucaagaacuaagcccuuuaccguaccaauauuaacaguagaagaaaugacaaacucacgauuccccauaccauuagaaaaacucuuuacuggaccaucuuccgcauuuguaguucaaccucaaaacggacgaugcacaacagauggaguacuuuuaggaacaacacaauuaucuccaguaaauauauguaccuuuagaggagacguuacacauauagcuggcuccagaaacuauacuaugaauuuagcaucccucaacuggucaaacuaugauccaacagaagaaauaccugcaccguuaggaacaccugauuuuguaggaaaaauacaaggaguacuaacacaaaccacaaaaggagauggaucaacaagaggacacaaagccacaguuuauacaggaucagcugauuuuacaccuaaacuaggaucuguacaauucgcaacugauacugaaaaugacuuugaaacucaccaaaacacuagauuuacuccaguagggguaauucaagauggaggaacaacacauagaaaugaaccacaacaauggguacuaccaaguuauucgggucgaaauguucauaauguucaucuagcaccagcuguagcacccaauuucccaggagaacaacuauuauuuuucagaucaacaaugccaggaugcaguggauauccaaauauggauuuagacuguuuauuaccacaagaauggguacaacauuucuaucaagaagcagcaccagcccaaucagauguagcucuauuaagauucguuaacccagauacaggaagaguucucuuugaauguaaacuacauaaaucagguuacguaacaguugcacacacuggacaacacgacuuaguaauaccacccaauggauauuuucgauucgauucauggguuaaucaauuuuauacacuugcuccaaugggcaauggaacaggaagacguagagcuuuauaa

SEQ ID NO: 31056 - RNA, 1623 nt, Artificial Sequence
  derived and/or modified sequence opt6 from capsid_protein_VP1__Norovirus__AGT17819
augaaaauggcuuccucagacgcaaauccuucagauggcucaacagcaaaccuagucccagaaguaaacaaugaaguaauggcucuagaaccaguagugggagcagcaaucgcagcaccagucgcaggccaacaaaacgucauagacccuuggauacgaaauaacuuuguacaagcaccuggaggagaauucacaguaucaccaagaaaugcaccaggagaaauauuauggucagccccauuaggcccagacuuaaauccauauuuaucacaccucgccagaauguauaacgguuacgcuggagguuuugaaguacaaguaauccuagcuggaaaugcuuuuacagcgggaaaaaucauauuugcagcagugccaccaaacuuccccacagaaggacucuccccaucccaaguaacaauguucccccacauaauaguugacguaagacaacucgaacccguucuaauuccccuuccugacguuagaaacaauuucuaccauuacaaccaaucaaacgacccuacaauaaaauuaauagcaaugcuuuauacaccuuuaagagcuaauaaugcuggagacgacguauucacaguaucuugcagaguacucacaagaccauccccagacuucgauuuuauauuuuuagucccucccacagucgaaucacgaacaaaaccuuucucuguucccgucuuaaccguagaagaaaugacaaauucaagauuuccaauaccauuagaaaaacuuuucacaggaccaucuucagcauucguaguacaaccucaaaacgguagauguacaacagacgguguauuauuaggaacaacacaauuaucuccagugaauauaugcacauuucgaggagacguaacccauaucgcaggaucuagaaauuacacaaugaaucuugcuucacaaaacuggaauucauaugaucccaccgaagaaauaccagcgccauuaggaacaccugacuucgucgguaaaauacaaggaguacuaacacaaacuacaagaacagacgguucaacaagaggucacaaagcaacugucuauacaggaucagcagacuuuagucccaaacuaggucguguacaauuugcaacagauacugauaacgauuuugucacaaaucaaaauacaaaauuuacaccaguaggagucauucaagauggaggaacaacuccacgaaacgaaccacaacaaugggucuuaccauccuauucuggaagaaacacccauaacguacacuuagcaccagcaguagcacccacauuucccggagaacaauuauuauucuuuagaucuacuaugccaggauguucaggauauccaaauauggaucuagauugccuccuaccacaagaauggguacaauacuucuaccaagaagcagcucccgcccaaucagauguugcacuucuaagauuuguaaacccagauacaggaagaguacucuucgaaugcaaacuccauaagucuggauaugucacaguagcacauacaggacaacacgaucuaguaauaccaccaaacggauauuucagauucgacuccuggguaaaccaauucuacacacuagcaccaaugggaaacggaacaggacgacgaagagcauuauaa

SEQ ID NO: 31057 - RNA, 1623 nt, Artificial Sequence
  derived and/or modified sequence opt6 from capsid_protein_VP1__Norovirus__AGT17823
augaaaauggcuaguucagaugcuaauccaagcgauggaucaacagcaaacuuaguucccgaaguuaauaaugaaguaauggcucuagaaccaguaguaggagcagcuauagccgcuccaguagcuggacaacaaaauguuaucgacccauggauaagaaacaacuucguacaagcacccggaggugaauuuacaguuucaccacgaaaugcuccuggagaaauauuauggucugcaccauuaggaccagauuuaaacccauaucuaucucacuuagcuagaauguauaauggauacgcuggaggauuugaaguucaaguaauuuuagcuggaaaugcauuuacagcaggaaaaauaauauuugcugcaguaccaccaaacuucccuacagaaggacuaagccccucacaaguaacuauguucccacacauaauagucgacguuagacaacucgaaccauuauuaauaccucuacccgacgucagaaauaauuuuuaucacuauaaccagagcaacgauccaaccauaaaauuaauugcaauguuauacaccccauuacgagcaaacaaugcaggugacgacgucuucacaguauccugccgaguucuaacaagaccaucaccagauuuugauuuuauauuucuaguaccacccacagucgagucuagaacaaaaccauuuucagucccuauucuaacuauagaagaaaugacuaacagucgauuuccaauaccacuagaaaaauuauucacgggaccaucaucagccuucguaguacaaccucaaaauggaagauguacuacagauggcguacuucucggaacuacucaauuaucuccaguaaauauaugcacauuucgaggugacguuacacacauuacuggaacacauaacuacgcaaugaauuuggcagcacaaaauuggaauucuuaugauccaacagaggaaauaccugcuccacuagguacuccagacuuuguaggaaaaauacaaggaguacuaacacaaacaacaagagcggacggaucuacaagagcccacaaagcaacaguauauacagguucagccgaauuugcaccaaaacuaggcagaguacaauucgcuacagacacagacucagauuucgauacaaaucaaaauacuaaauuuacaccaguaggaguaauucaagauggaaauacugcacaucaaaaugaaccacaacaaugggucuuacccucauacucagguagaaauaaucauaacguccaccuagcaccagcaguagcacccacuuucccaggagaacaauuacuauuuuuuagaucaacaaugccaggauguucagguuaccccaacaugaaucuagacugcuuauuaccacaagaauggguacaauauuucuaccaagaagcagcuccagcacaaucagacguugcccuacuacgauucguaaacccagauacaggacguguauuauuugaaugcaaauuacacaaaagcgguuaugucacaguagcacauaccggucaacacgaucuugucauaccaccaaauggauacuucagguuugacuccuggguaucacccuuuuacaccuuagcacccauggguaauggaacaggcagaagaagagcauuauaa

SEQ ID NO: 31058 - RNA, 1593 nt, Artificial Sequence
  derived and/or modified sequence opt6 from capsid_protein_VP1__Norovirus__AGT17826
augaugauggcaucuaaggaugcuaccuccucaguagacggagccucuggagcaggacaacuaguaccagaagucaaugccucagacccucuugccauggaucccguugccggcucaucaacagcaguagcaacugcaggccaaguaaaucccaucgauccauggauaaucaauaacuuuguacaagcuccacaaggugaauuuacaauuucuccaaacaauacuccaggagauguucuauucgauuuaucacucggaccacauuuaaaucccuuuuuacuacauuuaagucaaauguauaaugguuggguugguaauaugagaguaagaauaaugcuagcaggaaaugcauuuacagcagguaaaauaauagucucuuguauacccccaggauuuggcucacauaaucucacgauagcacaagcuacauuauucccacauguaauugcggauguacgaacacuugacccaauugaaguaccauuagaagacguaagaaacguucuauuucauaauaacgauagaaaucaacaaacaaugagacuaguaugcaugcuauauacaccauuaagaacugguggaggaacuggagacaguuucguuguagcaggcagaguaaugacauguccaagcccagauuucaauuuuuuauuuuuagucccaccgacaguagaacaaaaaacaagaccuuuuacacuaccaaauuuaccuuuaucaucacuaucuaauucaagagccccauuaccuauaucuuccaugggaauaucuccagauaacguucaaucaguacaauuucaaaacggacgcuguacauuagauggcagauuagucggaacuacacccguaucacuaucacauguugcaaaaauaagagggacaucuaacggaacagugauaaauuuaaccgaauuagauggaaccccauuucauccauuugaaggcccagcaccaauaggauucccagauuuaggaggaugugacuggcacauuaauaugacacaauuuggucauucuucucaaacacaauacgaugucgauacaacacccgacacuuucguaccacacuuaggcucaauacaagcaaauggaauagguucaggcaacuauguaggaguacuaucauggauaaguccaccuucacacccuucuggaagucaaguagaucuuuggaaaauaccuaauuauggaagcucaauaacagaagccacacaucuagcaccuucuguauauccaccuggauuuggagaaguacuagucuucuuuaugucuaaaaugcccggaccaggugcauauaaccuaccaugucuuuuaccucaagaauauauaagccaucuagcaucagaacaagcuccaacuguuggagaagccgcccuauuacauuauguagauccagacacaggacgaaaucuuggagaauucaaagcuuauccagauggauuucuaacuuguguaccaaauggagcauccucagguccacaacaacuaccuauaaauggaguauuuguauuuguaucauggguaucucgauuuuaucaacuaaaaccaguuggaacagccuccagugcucguggucgacuuggcuuaagaagauaa

SEQ ID NO: 31059 - RNA, 1620 nt, Artificial Sequence
  derived and/or modified sequence opt6 from capsid_protein_VP1__Norovirus__AGT17830
augaaaauggcaucaaacgaugcaacaccaucagauggcucaucagcaaacuuaguccccgaagcaaauaacgaaguaauggcauuggaacccguugcaggagcagcaaucgcagccccaguagcaggccaacaaaauguaauagauccuuggauaagaaauaacuuuguacaagcuccaggaggcgaauucaccgucucaccccgaaaugcaccaggcgaaauauuauggucagcaucauuagguccagauuuaaacccauauuuaucacauuuaucaagaauguauaacggauaugccgguucauuugaaguucaagucauacuagcaggaaaugcauuuacugccggcaaaauaauauucgcagcaguaccaccaaauuuuagaacagaaggucuuucaccaucacaaauaacaauguucccacauauaauuacagacguaagacaauuagaaccaguacuaaucccauuaccagauauaagaaacaauuucuaucacuauaaccaaagcaaugacccaaccauuaaauuaaucgcaaugcuuuauaccccacuuagagcaaauaaugcaggagaugacguauuuacagucucauguagaguucucaccagacccucaccugauuuugacuuuauauuucuaguaccaccaacuguagaaucacgaacaaaaccuuucucaguucccguacuaacaguugaagaaaugacaaauuccagauuucccauaccacuagaaaaacuuuuuacaggaccaucuucugcauuuguuguacaaccccaaaacgguagauguacaacagauggaguauuacuaggaacaacacaauuaucaccuguaaacauauguacauucagaggagacgucacaagaauaggaaauucaagagaauaccgaaugaaucuugcaucuuuaaauuggaacaauuaugauccaaccgaagaaauaccagcaccauuaggaacacccgauuucgcaggaaaaauucaaggcguauuaacacaaaccacccgucaugauggaucaacaagaggacauaaagcaacaguauauacuggcucagcaggcuuuacacccaaauuaggaucaguacaauucucuacagauacagacaaugaccuggaagcuaaucaaaauacaagauucacuccaguaggcguaauacaagauggaaacgcucaccaaggcgaaccacaacaauggguauuaccaaauuaugccggaagagacggucacaacguacauuuagcuccagccguugcaccaacuuuuccaggagaacaacuacuauucuucagauccacaaugcccggauguuccggauauccuaauaugaacuuagacugucuuuuaccacaagaauggguacaacacuucuaucaagaaagugcaccagcacaaucagacguugcccuauuaagauuuguaaaucccgauacaggaaggguauuauuugaaugcaaacuucacaaauccggauacguaacaguugcucauacagguccacaugauuuagucauaccacccaauggauacuucagauuugauucaugggucaaucaauucuauacacucgcacccaugggaaauggagccggcagacguagagcacuuuaa

SEQ ID NO: 31060 - RNA, 1623 nt, Artificial Sequence
  derived and/or modified sequence opt6 from capsid_protein_VP1__Norovirus__AGT17833
augaaaauggcaucaagugaugccaacccuagugacggaucaacagccaaccuaguacccgaagucaacaacgaaguaauggcauuagaaccagucguaggagcagcgauagcugccccaguugcaggacaacaaaauguaaucgauccauggauaagaaacaacuucguucaagcccccggaggagaauuuacaguaucaccaagaaaugcacccggcgaaauacucuggucugcacccuuaggacccgauuuaaauccuuauuuaucucacuuagccagaauguauaacgguuaugcaggcggauucgaagugcaaguaauauuagcuggcaacgcauuuacagcaggaaaaaucauauucgcugccguacccccaaauuuuccaacagaaggccuaucaccaucucaaguuacaauguucccacauauaauaguugacguaagacaauuagaaccaguuuuaauaccacuaccagauguaagaaacaauuucuaucauuacaaccaaucuaaugacucaacaaucaaacuaauagcuauguuauacacaccauuacgagccaacaaugcaggagaugauguauucacaguaucaugccgaguacuaacaagaccuucaccugauuucgauuuuauauuucuaguacccccaacaguagaaucucgaacuaaaccauuuucaguaccuguuuuaacaguagaagaaaugaccaacucuagauuuccaauuccacucgaaaaacuauucaccggucccucuucugcauucgugguucaaccacaaaaugguagaugcacaacagauggaguauuacuaggcacaacacaauuauccccagugaacauaugcacauuuagaggagauguaacucauauagcaggaucaagaaauuacacaaugaaucuagcuagccaaaacuggaauucauacgauccaacagaagaaauacccgcuccacucggaacaccugacuuuguaggaaaaauacaaggcgucuuaacacaaaccacacgaacugacggauccacacgcggacauaaagccacaguauauacaggaucagcagacuucuccccaaaauuaggaagaguccaauucgccacagauaccgauaacgauuuuguaaccaaccaaaacaccaaauuuaccccagucggaguaauacaagaugguucaacuacaccaaggaaugaaccacaacaauggguuuuaccuucauauaguggaagaaauacacauaacguucaccuugcaccugcuguagcaccaacauucccaggcgaacaauuauuauucuuuagaucuacaaugccuggauguuccggauacccaaauauggaucuagauugccuucuaccacaagaauggguacaauauuuuuaccaagaagcugcacccgcacaaucagacguugccuuacuacguuucguuaacccagauacuggacgaguacuauuugaauguaaacuacauaaaucaggauauguaacaguagcacauacaggccaacacgaucuaguaauaccaccaaacggauacuucagauuugauuccuggguuaaucaauucuauacauuagcaccaaugggaaauggaacuggaagaagacgagcauuauaa

SEQ ID NO: 31061 - RNA, 1593 nt, Artificial Sequence
  derived and/or modified sequence opt6 from capsid_protein_VP1__Norovirus__AGT17836
augaugauggcaaguaaagaugcuacuuccuccguagauggugccucaggcgcaggacaacuuguaccagaaguuaacgcaucugauccacuugcuauggaccccguagcaggaucuucaacugcuguagccaccgcugggcaaguaaacccaauagacccauggauaauaaacaauuuuguacaagccccccaaggagaauucacuaucucuccaaauaauacaccaggugauguucuuuucgaucuaucucucggaccacaucucaauccauuucuucuacaucuaagccaaauguacaacggauggguuggaaauaugagaguacgaauaaugcuugcagguaaugcauuuacagcaggaaaaauuauaguaaguuguauaccaccaggauucggaucacacaaucucacaauugcacaagcaacuuuauucccacauguaauagcagauguaagaacuuuagauccaauagaaguaccauuagaagacguaagaaauguacuauuccacaauaaugauagaaaucaacaaacaaugagauuaguauguauguuauauacaccauuacgaacaggaggagguacuggagacucauucguagucgcaggacgaguaaugacauguccuucaccagacuuuaauuucuuauucuuaguaccaccuaccguagaacaaaaaacacgaccauuuacacuaccaaauuuaccacuaucuucacuaucaaauucuagggcaccacuaccaauaaguucaaugggaauuucaccugauaauguacaaucuguacaauuccaaaauggaagauguacuuuagauggacgauuaguaggaacaacaccaguaucccuuagccauguagcuaagauacgagguacaucaaauggaacaguaauaaacuuaacagaauuagauggaacucccuuucacccauuugaaggaccagcaccaauaggauuuccugaucucggugguugugacuggcacauaaacaugacucaauucggccauaguucacaaacacaauaugacguugauaccacaccagauaccuuuguaccccauuuaggaucaauacaagcaaacggcauaggaucaggaaauuauguaggaguauuaucuuggauaagcccaccaucucauccauccggaucccaaguagauuuauggaaaauacccaauuacggaucaucuauaacagaagcuacucauuuagcacccucuguauaucccccaggcuuuggagaaguacuaguauuuuuuaugucaaaaaugccaggaccaggugcauauaauuuaccaugccuuuuaccacaagaauauauaucucaucuagcaucagaacaagcaccaacaguaggugaagcagcacuuuuacauuacguagauccagauacuggcagaaaucuaggagaauuuaaagcauaucccgauggcuuuuuaacauguguaccuaauggagcuucaucuggaccacaacaacuaccaauaaauggagucuuuguauuuguauccuggguaucaagauucuaucaacuuaaaccaguaggaacagcaucauccgcaagaggacgccuuggccuaagaagguaa

SEQ ID NO: 31062 - RNA, 1620 nt, Artificial Sequence
  derived and/or modified sequence opt6 from capsid_protein_VP1__Norovirus__AGT17842
augaaaauggcaucaucagacgcaaauccaucagacggauccacagcaaaucuaguaccugaaguaaauaacgaaguaauggcacuagaaccagucguaggagcagcaauagcagcaccaguagcaggacaacaaaacgucauagacccauggaucagaaauaauuucguucaagccccaggaggagaauuuacaguaucaccacgcaaugcuccaggagaaauauuauggucugcaccacuagguccugacuuaaauccauauuuaucucauuuagcuagaauguacaacggauacgcagguggauucgaaguucaaguuauauuagcuggcaaugcauucacugcaggaaaaauaauauucgcagcaguaccacccaacuucccuacagaaggacuaucuccuggacaaguuacaauguucccccacauuauaguagacgucagacaacuagaacccguacucauaccacuaccagacguucgaaacaacuucuaccauuacaaccaaaguaaugauccaacaauaaaacuuguagcaauguuauauacaccacucagagcaaauaacgcaggagaugacguauucacaguaucuugucgaguacuaacaagaccaucaccagacuuugacuucauauucuuaguaccaccaacuauagaaagcaaaaccaaaucauucucaguuccuaucuuaaccauagaagaaaugacuaauagcagauucccaauaccacuagaaaaacuauucacuggcccuucaucaacacuaguuguacaaccccaaaauggaagaugcaccacagacggaguucuacuaggaacaacacaacuauccccaguaaacaucugcacauuccgaggcgauguuacccaaaucacaaacacccauuccuacgaaaugaaccuagcugcccaaaacuggaacuccuacgacccuacagaagaaaucccagcgccucuaggaacuccagauuucgucgguaaaauucaaggaguacuuacacaaacuacaaaagaaaacgguuccaccagagcacacaaagcaaccguauacacaggaucaaccggauuuacaccuaaauuaggacgaguccaauuuguaacagauaccgaccgagauuuagaaacuaaccaagauacaaaauucacuccagucggaguaauacaagacggagaugcacaccaaaaugaaccacaacaauggguccuacccucauaccuaggaacaaacaaucacaacguacaccuugcucccgcaguagcaccaacauuucccggagaacaacuuuuauucuucagauccacaaugccaggaugcucagguuacccaaacaugaacuuagacugccuucuuccccaagaauggguacaauauuuuuaccaagaagcagcuccagcacaaucagacguagcucuauuaagauucguuaacccagacacgggcagaguacuuuucgaaugcaaauuacacaaaucagguuacguaacugucgcacacaccggcagacacgaucuaguaauaccaccuaacggauacuuucgauuugacuccuggguaucacccuuuuauacacuagcaccaauggguaauggaacuggaagaagaagagcucuauaa

SEQ ID NO: 31063 - RNA, 1623 nt, Artificial Sequence
  derived and/or modified sequence opt6 from capsid_protein_VP1__Norovirus__AGU68328
augaaaauggcaucaucagacgcaaacccaucagauggaucagcagcaaaccuuguaccugaaguaaauaaugaaguaauggcacuagaaccaguaguuggagcagcuaucgcagcacccgucgcaggacaacaaaauguaauagacccauggauaagaaauaacuuuguacaagcaccaggaggagaauuuacugugucaccacguaaugcaccaggcgaaauauuauggagugcuccacuaggaccugaucuaaauccauaucuaucucaucuugcacgaauguauaaugguuaugcaggaggcuucgaaguacaaguaauauuagcaggaaacgcauuugcagcaggaaaaauaauauuugcugccguaccaccaaacuuucccacagaaggauuaucaccaagucaaguaacaauguucccucacauaauaguagauguuagacaacuugaacccguuuuaauuccauuaccagauguacgcaacaauuuuuaucacuacaaucaaucaaaugacucaacaauuaaacuuauugcaaugcuguacacaccacuaagagccaacaacgcaggugacgauguauuuacaguaucauguagaguacuaacacgaccaagcccagauuuugauuuuauauuucuaguuccacccacaguagaaagcagaaccaaacccuucucaguccccguucucacagucgaagaaaugacaaacucacguuuucccauaccauuagaaaaauuauucacagguccaaguuccgccuuuguaguacaaccacaaaaugguagauguaccacagauggaguacuucuugguacuacucaguuaucaccuguaaauauaugcacacucagaggagacguaacucauaucacaggcucaagaaauuacacaaugaauuuagcuucccaaaauuggaauaauuaugauccaacagaagaaauaccagcucccuuaggaacuccggacuuuguagguaaaauacaaggcauguuaacacaaacaacaagaacagacggauccacaagggguuauaaagcuaccguuuauacuggaucagccgacuuugcaccaaaacuaggcagaguccaauuugaaacagacacagaucaugauuuugaagcaaaucaaaauacaaaauucaccccagucggaguuauacaagauggaucaacuacccauagaaacgaaccucagcaauggguuuuaccaucauauucaggacgcaauacacauaacguacacuuagccccugccguagccccuaccuuuccuggagaacaauuacuauuuuuuagaucuacaaugcccgguuguagcggauauccaaacauggaccuagauugucuauuaccacaagaauggguacaauauuucuaucaagaagcagcaccagcacaaucagacguagcacuauuaagauuuguaaacccugacacaggaagaguauuauucgaguguaaacuacauaaaucugguuacguaaccguagcucacacaggacaacaugauuuagucaucccaccaaacggauauuuuagauucgacucauggguaaaucaauucuacacuuuagcaccaaugggaaauggaacaggacgaagacgaguaguauaa

SEQ ID NO: 31064 - RNA, 1620 nt, Artificial Sequence
  derived and/or modified sequence opt6 from capsid_protein_VP1__Norovirus__AGX85889
augaaaauggcaucaucagacgcaaacccauccgacggcucuacagcaaaccuaguaccagaagcaaacaacgaaguuauggcucuagaaccaguaguaggugccgcaaucgcagcacccguagcaggacaacaaaauguaauagacccuuggauacgaaauaacuucguacaagcaccuggaggugaauucacagucucacccagaaaugcaccaggagaaauacuauggucagcaccacuaggcccagacuuaaauccauaucuaagucaucuaucaaggauguauaacggcuaugcaggaggcuucgaaguccaagucauccuagcaggaaacgccuuugcagcaggcaaaauaauauucgcugcaguaccaccaaauuucccaacagaaggacuaucaccaucacaaguaacaauguucccccaucuaauaguagacguaagacaauuagaaccaguaaugauaccauuaccugauauaagaaauaauuuuuaucacuacaaccaaucaaacgaccccacaauaaaauuaaucgcaaugcuauauacaccccuccgagcaaacaauguaggagacgauguauuuacaguaucaugcagagugcuaacccgaccaucaccagauuucgauuucauauuuuuaguacccccuacaguagaaucgaaaacaaaccccuucucaguacccauuuuaacaauagaagaaaugacaaacuccagauucccaaucccacucgaaaaacuauuuacaggcccaagcucagcuuuaguaguccaaccacaaaauggaagaugcacgaccgacggaguacuacuaggcacaacucaauuaucaccaguaaauaucugcacauuccgcggagaugugacccacaccacaaaaacacauacauaucaaaugaaucucgcagcacaaaacuggaacagcuaugauccaacagaagaaauaccagcaccacuaggaacaccagauuuugucggaaaaauacaaggaguacuaacacaaacaacaaaaggaaaugguucaacacgagcacauaaagcuacaguauauacaggauccgccgaauuuacaccaaaacuagguagaauacaacuauucacagacacugauaaugauuuagaagcaaaucaaaacacaaaauuuaccccaguaggaguuauccaagauggagauacucaccaaaacgaaccacaacaauggguauuaccaucauacuccggaagaaauaaccauaacguccaucuagcccccgcaguagcuccaacauucccuggagaacagcuauuauucuuccgaucuaccaugccaggauguucagguuacccaaacaugaaucuagauugucuccuaccacaagaauggguucaauacuucuaucaagaagcagcaccagcacaaucugauguugccuuacuaagauucguaaacccagauacaggaagaguacucuucgaauguaaacuacauaaauccggauauguaacaguagcacacacaggacaccacgauuuauucauuccaccaaauggcuacuuccgauucgacucuuggguaucuccuuuuuacacuuuagcaccaaugggcaacggaacaggaagaagaagagcucucuaa

SEQ ID NO: 31065 - RNA, 1620 nt, Artificial Sequence
  derived and/or modified sequence opt6 from capsid_protein_VP1__Norovirus__AGX85892
augaaaauggcuucuucagacgcuaauccauccgacggaucuacagccaaucucguaccagaagcaaacaacgaaguaauggccuuagagccaguaguaggagcagcaauagcagccccaguagcaggacaacaaaacguaauagaucccuggauaagaaacaacuucguacaagcaccuggcggcgaauuuacaguaucccccagaaaugcaccaggcgaaguacucugguccgccccuuuaggcccagaucuaaaucccuacuuaucccaccuagcacgcauguauaacggauaugcaggcggauuugaaguacaaguaauacuagcuggcaacgcuuuugcagccggaaaaauaauauucgcagcuguaccuccaaacuuuccuacugaaggacuaucaccaucacaaguaacaauguucccacaccuaauaguagacgucagacaauuagaaccaguuaugauaccauuaccagacauaagaaacaacuucuaccauuacaaccaaucaaacgacccaacaauuaaauuaauagcaaugcuauacacaccacuaagagcaaacaacguaggagaugacguauuuacaguaucaugccgaguacuaaccagacccucacccgauuucgauuuuauuuuccuagucccuccuacuguagaaucaaaaacuaaccccuucucaguuccaauacuaacaauagaagaaaugacaaacucccgauucccaauaccauuagaaaaauuauuuacaggcccaagcucagcuuuaguaguacaaccacaaaacggaagauguacaacagacggaguauuacuaggaacaacccaauuaucaccaguaaacauauguaccuucagaggagauguaacacacaccacaaaaacacacacauaccaaaugaaccuagcagcacaaaacuggaauucauacgauccuacagaagaaauaccugcaccacuaggcacaccagacuucguaggcaaaauacaaggugucuuaacacaaacaacuaaaggaaacgguucaacacgagcacauaaagcaaccguauacacaggaggagucgaauucaccccaaaacucggaagaauacaacuauucacagacacagacaacgaccuagaagccaaucagaacacaaaauucacccccguaggcguaauacaagauggagacacccaucaaaacgaaccucaacaauggguacuaccaucuuauucaggaagaaauaaucacaauguacaucuagcuccagccguugcaccaacauucccaggagaacaauuacucuucuucagaucaacuaugccaggauguucaggauacccuaacaugaaccuagauugcuuauuaccacaagaauggguacaauacuuuuaccaagaagcagcaccagcacaguccgacguagcauuacucagauucguaaacccagacacaggccgaguauuauuugaaugcaaauuacauaaaucuggcuacgucacaguagcgcacacaggacaucaugauuuauucauaccaccaaauggcuauuucagauucgauucauggguuucuccauucuacacacuugcaccaaugggaaacgguacagguagaagacgagcacuauaa

SEQ ID NO: 31066 - RNA, 1620 nt, Artificial Sequence
  derived and/or modified sequence opt6 from capsid_protein_VP1__Norovirus__AGX85895
augaaaauggcaucuucugacgcaaaccccucagacggaucaacagcuaaccuuguaccagaagccaacaaugaaguaauggcccuagaaccugugguaggcgcagcaauagcugcacccguagcuggacaacaaaacguaauagauccauggauaagaaauaauuucguucaagcacccgguggcgaauucacaguuucuccacgaaacgcaccuggugaaguauuaugguccgcaccacuaggaccagaccuaaaucccuacuuaucacacuuagcaagaauguauaauggauacgccggaggcuucgaaguacaaguaauuuuagcaggaaaugcauucgcagcaggaaaaauaauauuugcagcaguuccaccaaauuuccccaccgaaggauuaucaccaucacaaguaacaauguucccacaucuaauaauagacguaagacaacuagaaccuguuaugauaccacuaccagauguaagaaacaauuucuaucauuauaaucaaagcaaugacccuacaaucaaauuaauagccaugcuuuacacuccacuccgagcuaauaaugucggagacgauguauucacagucucaugcagagucuuaacaagaccaucaccagacuucgacuuuauauuucuuguuccacccacaguagaaaguaaaacaaauccuuuuucuguaccuauauuaaccauagaagaaaugacgaauucaagauuuccaauaccacuugaaaaauuauucacaggaccaucaucagccuuaguuguacaaccacaaaacggcagaugcacaacagacggaguacuacuaggaaccacacaacucucaccaguaaacaucuguacauuucgaggagacguuacacauauaacuaaaacacacucauaccaaaugaauuuagcugcacaaaacuggaauucuuaugaccccacagaagaaauaccugcaccauuaggaacaccugauuuuguagggaagauacaagguguucuuacacaaacaacuaaaggaaauggaaguacaagagcacauaaagccaccguauauacaggaucaacagaauucacaccaaaauuaggacgaauacaauuagucacagacacagauaacgaucuagaaacaaaucaaaacacaaaauucaccccuguagguguuauacaagacggugacacacaccaaaacgaaccacaacaauggguucucccaucauaccuaggacgaaauaaucauaauguucaccuagcaccagccguagcaccaacuuuuccuggagaacaacuuuuauuuuucagaucaacuaugccaggaugcucaggauacccgaacaugaauuuagacugucuauuaccacaagaauggguacaguacuuuuaccaagaagcagccccagcacaaucagauguagcucuacuaagauucguaaauccagauacagguagaguauuauuugaauguaaacuucauaaauccgguuacguuaccguagcacauacaggucaucaugaucuuuucauuccaccuaaugguuauuuuagauucgacaguuggguuucaccauucuauacauuagccccaaugggaaacgguacugguagacgacgcgcacuauaa

SEQ ID NO: 31067 - RNA, 1623 nt, Artificial Sequence
  derived and/or modified sequence opt6 from capsid_protein_VP1__Norovirus__AGX85904
augaaaauggcaaguucagaugcaaacccauccgauggaucagcagcaaaccuaguaccagaaguuaauaaugaaguaauggcauuagaaccuguaguaggagccgcuauagcugcaccaguugcaggccaacaaaauguaaucgauccauggauacgauccaauuuuguacaagcaccuggcggugaauuuaccguaaguccccgaaaugcaccaggagaaauauuauggucugcccccuuagguccagacuuaaacccauaucucucucacuuagcuagaauguauaacgguuaugcaggagguuuugaaguccaaguaauauuagcaggaaaugcauuuacugcuggcaaaaucaucuucgcagcaguuccacccaacuuuccaacagaaggauuaucaccaucacaaguuacuauguuuccacacauuauaguagacguaagacaacucgaaccuguacuaauacccuuaccagauguuagaaacaauuucuaucacuauaaucaaucaaaugacucuacaauaaaauuaauagcaaugcuauacaccccacuacgagcaaauaaugcuggagacgauguuuuuacaguauccuguagaguucucaccagaccaucaccagacuucgacuuuauauuccuagucccaccaaccguagaaucaagaacaaaaccauucacaguucccauauuaacagucgaagaaaugaccaacucaagauuuccaaucccauuagagaaacuauuuaccggaccaucaucagcguucguuguacaaccacaaaauggacguuguacaacagacggaguuuuacuagguaccacucaauuaucaccagucaauauauguacauucagaggcgacguuacacauauagcaggcuccagaaauuacacaaugaacuuagcaagccuaaacuggucaaauuaugauccaacagaagaaaucccagcuccauuagguaccccugacuuuguaggaaaaauacaaggaguauuaacacaaacaacaaaaggagacggaucuacuagaggucacaaagcaaccguauauacuggaagcgcagacuucaccccaaaauuagguucuauacaauucgcuacagacacagaaaacgauuucgaaacacaucaaaauacacgauucacaccagucggaguaauacaagacggaggcacaacacaucgaaaugaaccccaacaauggguucuaccauccuacucaggaagaaauguacacaacguacauuuagcaccugcuguugccccaaauuucccaggagaacaacuauuauuuuucagaucaacaaugccugguuguuccggauacccaaauauggauuuagacugcuuacucccucaagaauggguacaacauuucuaucaagaagcagccccagcacaaucagacguagcauuacuaagauucgucaaucccgauacagguagaguucuuuuugaauguaaauuacacaaaucaggauacgucacaguagcucacacaggacaacaugauuuagucauaccaccaaaugguuauuuuagauuugacucaugggucaaucaauuuuauacucuagcaccaaugggaaacggcacaggacgaagaagagcauuauaa

SEQ ID NO: 31068 - RNA, 1617 nt, Artificial Sequence
  derived and/or modified sequence opt6 from capsid_protein_VP1__Norovirus__AGX85913
augaaaauggcaucaucagaugcuaaucccucagacgguuccacagcaaacuuaguuccagaagcaaacaacgaaguaauggcacuugaaccaguaguaggugcagcaauagccgcaccaguugcaggacaacaaaauguuauugaccccuggauaaggaacaacuuuguacaagcaccuggaggugaauuuacaguaucaccacgaaacgcacccggagaaguccuauggucugcuccccuaggcccagaccuuaauccauacuuaucacaucucgcacgaauguauaauggcuaugcaggcgguuucgaaguacaaguaauauuagcaggcaaugcauuugccgcaggaaaaaucaucuucgcagccguuccaccuaauuuuucaaccgaagguuuauccccaucacaaguaacaauguucccacauuuaauugucgacguaagacaacuagaaccuguaaugauaccauuacccgacauaagaaauaauuuuuaccacuacaaucaaucaaaugacccaacaauaaaacuaauagcuaugcucuacacuccauuacgagcuaacaacguaggugacgacguuuucacaguaucuuguagaguacuuacaagacccucaccugacuuugacuucauauuccuaguaccaccuacaguagaaucaaaaacaaacccauucucaguacccauccuaacaaucgaagaaaugacaaacucucgcuucccaauacccuuagaaaaacuuuucaccggaccaucaucagcauuaguaguacaaccacaaaauggcagauguacaaccgacggaguacucuuaggcacaacacaacuauccccagucaacaucuguacauucagaggugacguaacacacacuacuaaaacacauacauaccaaaugaaucucgcugcacaaaauuggaauucauacgauccaacagaagaaauaccagcaccauuagguacaccagauuucguaggaaaaauacaagguguauuaacacaaacaacaaaagaaaauggaucuacaagagcacacaaagcaacaguuuacacaggaacaguagaauuuacaccuaaauuaggaagaauacaauuauucacagacaccgacaacgaucuagaagcaaaccaaaacaccaaauucacaccaguaggagucauccaagacggcgaccaccaaaaugaaccacaacaauggguucucccuuccuauucaggaagaaauaaccauaacguccaucuagccccagccguagccccaaccuuuccaggagaacaguuauuauucuuuagaucaacaaugcccggaugcucuggauacccuaauaugaaucuagauugcuuacucccccaagaauggguacaauacuucuaucaagaagcagcacccgcacaaucugacguugcucuccuaagauuuguaaacccagacacaggaagaguauuauuugaauguaaacuacauaaaucuggcuaugucaccgucgcccauaccggacaucacgaucuaguaauaccaccaaauggauauuuuagauucgacucauggguaucaccauuuuacacauuagcaccaaugggaaacggaacaggacgacgaagagcauuauaa

SEQ ID NO: 31069 - RNA, 1623 nt, Artificial Sequence
  derived and/or modified sequence opt6 from capsid_protein_VP1__Norovirus__AGX85916
augaaaauggcauccaacgacgccaaucccucagauggcucagcagcaaacuuaguaccagaaguaaacaaugaaguaauggcucuagaaccaguaguaggagcagcaauagcagcaccaguagcaggucaacaaaauguaauugauccauggauaagaaacaauuucguacaagcaccaggaggagaauuuacuguuucucccagaaaugccccaggagaaauacuuuggucugcaccacuaggcccugauuuaaauccauauuuaucucacuuagcacgaauguauaacggauacgcagggggauucgaaguacaagucauuuuagccggaaaugcauuuacagcagguaaaauaaucuuugcagcaguaccaccaaacuuuccaacagaaggacuauccccuucacaaguaacuauguucccacauauaauaguugacguaagacaauuagaaccaguucuaauaccauuaccugacguacguaauaauuucuaucacuauaaccaaagcaacgacucuacaauuaaauuaauagcaaugcucuacacaccacuacgugcuaacaaugccggagacgacguauucaccguuucaugccguguacuaacuagaccaucuccagacuuugacuucauuuuucuaguacccccaacuguugaaucacgaacaaaaccauucucaguaccaauccuaacaguagaagaaaugacaaauuccagauuuccaauuccauuagaaaaacuauuuacaggaccaucaucaacauuuguaguacaaccacaaaacggaagauguaccacagacggaguauuacuaggaacaacacaacuaucaccuguaaauauaugcacauuucguggagacguaacacauauuacaggaucaagaaauuacacuaugaacuuagcaagucaaaauuggaacucauacgaccccacugaagaaauaccagcuccacuaggaacaccagauuucguagguaaaauucaaggaguuuuaacacaaacaacaagaacagacggaucaacaagaggacauaaggcaacaguauauacaggaucugcugacuuuucaccaaaacucggacgaguacaauuugccacagauaccgacaacgauuuugacacaaaucaaaacacaaaauucacaccaguuggaguaauacaagacggcggaacuacacauagaaacgaaccacaacaauggguauuaccauccuauucagguagaaauacccauaacguacacuuagcaccugcaguugcaccgacauucccaggagaacaacuuuuauucuuucgauccacaaugccaggaucaagcggauauccuaauauggaucucgauugccuacuaccacaagaauggguccaauacuucuaccaagaagcagcuccugcacaaucagacguagcauuauuacguuucguuaacccagacacaggaagaguacucuucgaaugcaaauuacauaaaucaggcuacguaaccguagcacacacaggccaacacgaucuagucauaccaccaaaugguuacuucagauucgauucuuggguaaaccaauuuuacacacuagcaccuaugggaaacggaacaggaagaagacgagcaguuuaa

SEQ ID NO: 31070 - RNA, 1617 nt, Artificial Sequence
  derived and/or modified sequence opt6 from capsid_protein_VP1__Norovirus__AGX85931
augaaaauggcaucauccgacgcaaacccaucugacggcaguacagcaaaucuuguaccagaagcaaacaaugaaguaauggcacuagaacccguaguuggagcagcaauagcugcaccagucgcaggacaacaaaaugucauagacccauggaucagaaacaauuucguacaagcaccaggaggagaauuuacaguaucaccaagaaaugcaccaggcgaaguccucuggucagccccacuaggaccugaucuuaauccauacuuaucacaccucgcccgaauguauaauggcuaugccggcggauuugaaguccaaguaauauuagcaggaaacgcauucgccgcuggaaaaauaaucuucgcagcagucccaccaaacuucucaaccgaaggccuaucuccaucacaaguaacaauguucccucacuuaaucguagacguacgacaauuagaaccaguaaugauaccacuaccugauauacguaacaacuuuuaucauuauaaccaaucaaacgaccccacuauaaaacuaauugcaaugcuauacacuccacuuagagccaacaauguaggugaugacguauuuacaguauccugccgcguauuaacuagaccauccccagauuuugacuuuaucuuuuuaguaccaccuacaguagaaucaaagacuaaccccuuuuccguccccauucucaccauugaagaaaugacaaauuccagauuuccaauuccauuagaaaaacuauuuacaggaccaucaucagcacucguaguacaaccacaaaacgguagaugcacaacagaugguguacuacuagguaccacccaacuauccccaguuaauauaugcacauucagaggagacguaacucacacaacaaaaacccacacuuaucaaaugaaucucgcagcacaaaauuggaacucauaugacccaacagaagaaauaccagcaccauuaggaacuccugacuuuguaggaaaaauccaaggcguauuaacccaaacaacaaaagaaaacggaucaacacgcgcccacaaagcuacagucuacacaggcaccguagaauucacacccaaauuaggacgaauccaacuauucacugacaccgacaacgauuuagaagcaaaccaaaacacaaaauucacaccuguaggagucauacaagacggcgaucaucaaaacgaaccacaacaauggguacuaccuagcuacuccggaagaaauaaccacaacguacacuuagcuccagccguagcaccaacauuucccggagaacaacuuuuauuuuucagaucaacaaugccagguugcagugguuacccuaacaugaacuuagacugccuauuaccacaagaauggguacaauauuucuaucaagaagcagcaccagcacaaucagacguugcacuacuucgauucguaaaccccgacacaggaagaguacuauucgaaugcaaacuacauaaaucaggauauguaacugucgcccauacaggacaccacgauuuaguuauaccaccaaacggauacuuuagauuugacuccuggguaucaccauucuauacacuagcaccaaugggcaacggaacuggaagacgacgagcacuauaa

SEQ ID NO: 31071 - RNA, 1617 nt, Artificial Sequence
  derived and/or modified sequence opt6 from capsid_protein_VP1__Norovirus__AGX85934
augaaaauggcaucaagugaugcaaacccauccgacggauccacugcaaacuuaguaccugaagcuaauaacgaaguuauggcacuagaaccaguaguaggagcagcuauagcagcaccuguagcaggacaacaaaaugugaucgaccccuggauaagaaauaacuuuguacaagcucccggaggagaauuuacaguuucuccacguaaugcaccaggugaagucuuauggucagcaccacuaggaccagaucucaauccauaucuaucucauuuagcaagaauguauaacgguuaugccggaggcuucgaaguacaaguaauacuagcuggaaaugcauuugccgccgguaaaauaauauuugccgcaguaccaccaaacuuuucaacagaaggccugucucccagucaaguaacaauguucccacaccuaauaguagaugucagacaauuagaaccaguaaugaucccacucccugauaucagaaauaauuucuaucauuauaaccaaucaaaugacccuacaaucaaauuaauagcaauguuauacacuccauuaagagcuaauaacguaggcgaugauguuuuuacaguaucaugucgcguccuaacuagaccuucaccagacuuugauuuuauuuuucuaguaccaccuacaguugaaucaaaaacaaauccauucucaguaccaauacuuacuauagaagaaaugacaaacucacgauucccuauaccacuugaaaaauuauucaccggacccaguucagcacuaguaguccaaccacaaaacggcagauguacaacagacgggguauuauuaggcacaacacaacuauccccaguaaacauuuguacauuuagaggcgacgucacacauacaacaaaaacccauacauaucaaaugaauuuagcagcucaaaacuggaauuccuaugacccaacagaagaaauaccugcuccauuaggcacaccagauuuugucggcaaaauccaaggaguauuaacccaaaccaccaaaggaaaugggucaaccagagcacacaaagcaacaguauauacaggaacagucgaauuuacccccaaacuaggacgcauccaacuauuuacagacacagauaaugauuuagaagcuaaucaaaauacaaaauucacaccaguaggcguaauacaagacggagaccaccaaaaugaaccccaacaauggguauuaccaucauauucaggaagaaauaaccacaauguacaccuagcaccagcaguagcaccaacauuuccaggcgaacaacuacuauucuucagaucuacaaugccaggaugcucaggauauccuaauaugaaucuagauugucuacuaccacaagaauggguacaauacuuuuaucaagaagccgcuccagcacaaucagacguagcauuauuacguuucguaaacccugacacaggaagaguccuauuugaauguaaacuacauaaaucaggauacguaaccguagcacacacuggacaucaugauuuaguaauuccuccaaauggauauuuuagauucgacucauggguaucaccauucuacacauuagccccaaugggaaauggcacagguagacgcagagcacucuaa

SEQ ID NO: 31072 - RNA, 1644 nt, Artificial Sequence
  derived and/or modified sequence opt6 from capsid_protein_VP1__Norovirus__AHI59154
augaaaauggcgaguaaugacgcagccccaagcaaugauggagcagcaaaucuaguuccugaggcaaauaaugaaguaauggccuuagaaccaguuguaggagcaucgaucgccgcuccaguaguaggacaacaaaauauaauugauccauggaucagagaaaacuuuguccaagcaccacaaggagaauucaccguaucuccaagaaacucuccuggggaaauguuacucaauuuagaauuaggcccagaacuuaaucccuaccucucacaucuuucaagaauguauaauggauacgcgggcggaaugcaaguucaaguaguauuagcaggaaacgcauucaccgcugguaaaauuauauucgcagcagucccaccccauuucccaguagaaaauauaucagcagcacaaauuacuauguguccacauguaauaguagauguaagacaacuagaaccagugcuacuaccauuacccgauauuagaaacagauucuuucauuauaaccaagaaaauacuccuagaaugagauuaguugcaaugcuauacacuccucugagagcaaauuccggagaagauguauuuacaguaucaugucguguacucacaagaccagcaccagacuucgaauucacauuuuuaguaccaccaacaguugaauccaaaacaaaaccauuuacacuaccaauauuaacccuaggcgaauuaucaaauucuagauucccagcaccuauagauauguuauauacugauccaaaugaagguauaguuguacaaccacaaaauggaagauguacauuagacggaacauuacaagguacaacacaguuaguuccaacacaaauaugugcauuuagaggaacauuaauaggucaaacuuccagaucaucagacagcacagacucagcacccagacgacgagaucauccucuacacguacaauuaaaaaacuuagacggaacccaauacgacccuacagaugaaguuccagcaguacuuggagcaauagacuuuaaaggaacaguauucggcguagcaucacaaagagacguaucaggacaacaaguaggugcaacucgagcacacgaaguucacauaaauacaacagacccacgauacacaccaaaacuaggaucuauacucaugcauucagaaucugaugauuuuguaacaggacaaccaguacgauuuacaccaauaggaaugggagauaaugauuggcaucaaugggaauuaccagacuacaguggacauuuaacacuaaauaugaaccuugcaccagcaguagcaccugcauuuccaggagaaagaauauuauuuuucagaucaauggucccaucugcaggcggcuauggaucaggacaaauagacuguuuaaugccacaagaauggguacaacauuucuaucaagaagcagcgccaagucaaucagcuguagcauuaauacgcuauguaaaccccgauacaggcagaaauaucuuugaagcaaaauuacacagagaaggauucauaacaguagcuaauagcggaaacaauccuauaguaguuccaccaaacggauauuuuagauuugaagccuggguaaaccaauuuuauacacuaaccccuaugggaacuggccaaggacgaagaagaaaucaauaa

SEQ ID NO: 31073 - RNA, 1623 nt, Artificial Sequence
  derived and/or modified sequence opt6 from capsid_protein_VP1__Norovirus__AHI59157
augaaaauggccaguaacgaugcaaacccaucugauggaucaacugcaaacuuaguaccagaaguaaauaacgaagucauggcucuagaaccaguaguaggugcagcuauagcagcaccaguugcuggacaacaaaacguaauagauccauggauaagaaauaauuucguacaagcaccuggaggagaauuuaccguaucaccacgaaaugcaccuggagaaauauuauggucugcuccacuaggacccgaucuaaauccguaucuaucacaucuagcacgaauguauaacggauacgcagguggauucgaaguccaaguuauucuagcaggcaaugcuuuuacugcuggaaaaauaauauucgccgcaguaccaccaaacuuuccaacagaaggacucucaccaucacaaguaacaauguuuccacauauaauaguagauguaagacaacuugaaccaguauuaaucccauuaccugauguacgaaauaauuucuaucauuauaaucaaucaaaugacccaaccauaaaauuaauagccauguuauauacaccauuaagagcaaauaacgcaggagaugacguauucacuguuaguugcagaguccuaacacgaccaaguccagauuuugacuuuauuuuccuaguucccccaacuguugaaucaagaacaaaacccuuuucuguaccaguauuaacaguagaagaaaugacuaacucaagauucccaauaccauuagaaaaauuauuuacuggucccucaucagcauucguaguacagccccaaaaugggcgauguacaacagacggaguauuguuagguaccacacaacuaucaccaguaaacauaugcaccuuuagaggagacguaacacauauuacagguucaagaaauuacacaaugaauuuagcaagucaaaauuggaauucuuacgauccuacagaagaaaucccagcuccucuuggaacaccugacuuuguaggcaaaauacaagguguacuaacacaaaccacaagaacagacggaucaacaagaggacacaaagcaacaguauacacuggauccgcagauuuuucaccaaaacuaggaagaguacaauucgcaaccgauaccgauaacgauuuugaaacaaaccaaaauacaaaauucacucccguaggaguaauacaagaugguggaacuacccacagaaaugaaccucaacaauggguccuaccaucauacucaggaagaaauacccauaacguucacuuagcaccugccguugcaccaaccuuucccggagaacaacuacuauuuuuuagaucuacgaugcccggaugcucaggauauccaaauauggaucucgauugucuauuaccacaagaauggguucaauauuucuaccaagaagcagcaccagcacaaucugauguugcauuacuaagauucgucaauccagauacaggcagaguccuauucgaauguaaacuacauaaaucaggauauguuacaguugcacacacaggccaacacgauuuaguaauaccaccaaauggauauuucagauucgacucauggguaaaccaauuuuauaccuuagcuccuauggguaauggaacuggaagaagacgagccuuauaa

SEQ ID NO: 31074 - RNA, 1629 nt, Artificial Sequence
  derived and/or modified sequence opt6 from capsid_protein_VP1__Norovirus__AHI59159
augaaaauggcaucaaaugacgcagcucccagcacagacggagcugcgggauuagucccagaaucaaauucagaagucauggcacuagaaccaguagcaggagccgccuuagcagcucccguuacaggacaaacaaauauaauagauccauggauuagagcaaacuuuguacaagcaccaaacggugaauuuaccguaucaccaagaaaugcaccaggagaaguacuccuaaaccucgaacuagguccagaacucaacccauauuuagcucauuuagcacgcauguauaauggauaugcuggaggaauggaaguacagguaaugcucgcaggaaaugcauuuacagcaggaaaacuaguauuugcagcaguaccaccacauuucccagucgaaaacuuaucuccacaacaaaucacaauguucccacacguaauaauagacguacgcacccucgaaccuguauuauuaccauuaccagauguuagaaauaauuuuuuucacuauaaccaaaaagacgacccaaaaaugagaauuguugcuaugcuauauacaccacuuagaucuaauggaucaggugacgauguauuuacaguaucauguagaguacuuacaagaccaucaccagacuuugacuucacuuaucuaguuccaccaacagucgaaucaaaaacaaaaccauuuacccuaccaauauuaacacuuggagaauuaaguaauuccagauuuccaguaucaauagaccaaauguacacuucaccaaaugaaguuauaucuguacaaugccaaaauggcagauguacauuagacggagaauuacaagguacuacacaacuacaagucucagguauuugugcauucaaaggugaaguaacagcacaccuacaugauaacgaccaccuauacaauguaacuauaacaaauuuaaauggaucaccauucgacccaucugaagauguucccgccccacuugguguaccagauuuccaaggcagaguauucgguguaauaagccaaagagauaaacauaauucacccggacacaaugaaccagcaaauagaggacaugacgcaguaguaccgacauauaccgcacaauauacaccaaaauuaggacaaguucaaauaggaacuuggcaaaccgaugaucuaacaguaaaucaacccguaaaauucacucccguaggauuaaacgauaccgaacacuuuaaucaauggguagucccucgauacgcaggggcucuuaauuuaaauacaaaccuagcaccuuccguugcuccaguauuuccaggagaacgacuauuauucuuuagaagcuacguaccuuuaaaaggaggauauggaaacccagcuauugauugcuuacuaccacaagaauggguacaacauuuuuaucaagaagcagcuccaucaaugucagaaguagcacuuguacgauauaucaauccugauacaggacgagcacucuuugaagcaaaacuacauagagcugguuuuaugaccguauccucuaauacaucagcaccuguaguaguuccagcaaacggauacuucagauuugauucauggguaaaucaauuuuauucuuuagcaccaaugggaacaggaaauggaagacgacguguacaauaa

SEQ ID NO: 31075 - RNA, 1623 nt, Artificial Sequence
  derived and/or modified sequence opt6 from capsid_protein_VP1__Norovirus__AHK24788
augcgaaugucagauggggcagcaccuaaagcgaacggaucagaagcaucaggucaagauuugguaccaacagcuguagaacaagcuguaccaauccaaccaguagcaggagcaucuuuagcugcccccgcagcaggacaaauuaaucaaauagauccuuggauuuuccaaaacuuuguacaauguccacuaggagaauuuucaauauccccuagaaauacacccggagaaauacucuuugauuuagccuuaggaccaggacuaaauccauaucucgcgcaccucucagcuauguauacaggauggguaggaaacauggaaguacaauuaguauuagcaggcaacgccuuuacagcaggaaaaguaguaguagcacuaguaccuccauauuucccaaagggaucuuuaacagcugcacaaauaacuuguuuuccucacgucaugugugauguaagaacccuagaaccaauucaauuaccauuauuagauguaagaagaguacuuuggcaugcaacacaagaccaagaagaaucaaugagauuagucuguaugcucuauacuccacuuagaacuaauucaccaggugaugaaucauuuguaguuucugguagauuacuaaguaaaccugcagcagauuuuaauuuugucuaccuaacuccucccauagaaagaacaauuuauagaauggucgauuuaccaguacuucaaccucgcuugugcacucaugcaagauggccugcaccugucuacggacuacucgucgauccaucucuuccaucaaauccucaauggcaaaauggcagaguacauguugauggaacucuacucggaacaacaccugucucaggaucuuggguuaguugcuucgcagcugaagcagcuuacgaauuucaaucaggaacaggagaaguagcgacauuuacacuuauugaacaagacggaucugccuauguuccaggagacagagcugcgccuuuaggauauccugauuuuucaggucaauuagaaauagaaguacaaacagaaacaacaaaagccggugauaaauuaaaagucacaacuuuugaaaugauucuaggucccacaacaaauguagaucaagcuccauaucaaggucguguuuaugcaucacuaaccgcagcugcaagucuagauuuagucgauggaagaguaagagcuguaccacgaucuauauaugguuuucaagaucaaauacccgaauacaaugauggauuauuaguaccuuuagcaccaccaguuggaccauucuuaccaggagaauuacuauuaagauuuagaacauauaugaggcaaauugauucugccgaugcagccgcagaagcaauagauugugcauuaccacaagaauuuauuucaugguuugcaucuaaugcauucacaguacaauccgaagcauuacuacuccgauaucgcaauacacucacuggacaacuacuauuugaauguaaacuauauucugaaggauacauagcuuuaucuuauucaggaucuggaccacuaacuuuuccuacagacggauuuuuugaagugguaucauggguuccucgacuuuaccaauuagcuucaguuggaucacuagcgacagguagaacccucaaauga

SEQ ID NO: 31076 - RNA, 1623 nt, Artificial Sequence
  derived and/or modified sequence opt6 from capsid_protein_VP1__Norovirus__AHX22018
augaaaauggcgucaagugacgccaauccaucugauggaucagcagccaacuuaguaccagaaguaaacaaugaaguuauggcauuagaaccaguaguaggagcugcaauagcugcacccguagccggucaacaaaauguaauugacccauggauacgcaauaacuuuguucaagcaccaggaggagaauucacaguaucaccacgaaaugcaccaggugaaauacuaugguccgccccacuuggaccagaucuaaauccauacuuaucacaucuagcacgaauguauaacggauaugcaggaggcuuugaaguucaaguaauacuagcaggaaacgcauuuacagcuggaaaaguuauauuugcagcagucccaccaaacuuucccacagaaggauuaucuccaucacaagucacaauguucccacauauagucgucgauguuagacaacuugaacccguccuaaucccucucccagauguacgaaauaacuuuuaucauuauaaucaaucaaacgauccaaccaucaaacuuauagccaugcuauauacaccauuaagagcaaacaaugcaggagacgaugucuucacaguuuccugcagaguacuaacaagaccuagcccagacuuugacuucaucuuucuuguaccaccaacagucgaaucaagaacaaaaccauucucaguaccaguccuaaccguugaagaaaugacuaacucacgauuuccuauaccauuagaaaaacuauucacaggcccaucaggcgcuuuuguaguccaaccacaaaauggaagaugcacuacugacggcguuuuacuaggaacgacacaacuuucaccaguaaacauauguacauuucgaggagauguuacacauauaacaggaucaagaaauuauacaaugaaucuagcaucucaaaauuggaauaacuaugauccaacagaagaaaucccagccccuuuagguaccccagacuucguaggcaaaauacaaggcauguuaacccaaacaacaagaacagacggaucaacuagaggacauaaagcaacaguauauaccggaucagccgacuucgcuccaaaauuaggaagaguacaauucgaaacagauacagaccacgauuuugaagccaaucaaaacaccaaauuuacuccaguagggguaauucaagauggaagcacaacucacagaaacgaaccacaacaauggguuuuaccaucauauuccggaagaaauacucauaauguccacuuggccccagcaguugcaccaacuuuuccaggagaacaauuauuauuuuuucgaucuacaaugcccggauguagcgguuacccuaauauggaucuagauugccuauuaccucaagaauggguucaauauuucuaucaagaagcagcaccagcccaauccgacguagcacuacuaagauuuguuaaccccgauacaggcagaguauuauuugaaugcaaacuacacaaaaguggauauguaacuguugcacauacuggacaacacgaccuuguuauuccacccaauggauauuucagauucgauucauggguuaaccaauucuacacuuuagcaccaaugggaaauggaacuggaagaagaagaguaguauaa

SEQ ID NO: 31077 - RNA, 1623 nt, Artificial Sequence
  derived and/or modified sequence opt6 from capsid_protein_VP1__Norovirus__AHX22021
augaaaauggcaucaucagaugccaauccuucagauggaucuacagcaaaucuuguaccagaagucaacaaugaagucauggcauuagaaccaguagucggagccgcaauagcagcaccaguagcuggacaacaaaauguaauagacccauggauacgaaacaacuuuguacaagcaccaggaggagaauuuacaguaaguccuagaaaugcaccuggcgaaauauuauggucugcaccauuaggcccugaucuaaauccauaucuaucucaucuagcccgaauguauaauggauaugccggaggauuugaaguacaaguaauacuagccggaaacgcauucacagcuggaaaaauuauauuugcagcaguaccaccaaacuuuccuacugaaggacuauccccaucacaaguaacaauguucccacauauaauaguagacguuagacaacuagaaccaguccucauaccccuucccgacguaagaaacaauuucuaucauuauaaccaaucaaaugauccuaccauaaaacuaauagcaauguuauacacaccacuaagagcaaauaaugcaggagacgauguauucacaguuucauguagaguccuuacaagaccaagcccagacuuugacuuuauauuuuuaguaccaccaacuguagaaucacguacuaaaccauuuucaguaccaguacuaaccguagaagaaaugacaaacucgagauuuccaauaccauuagaaaaauuauuuacaggcccuucaucagcauucguaguacaaccacaaaacggaagauguaccacugacggaguauuacuagguacgacgcaguuaucuccaguuaacauauguacauuuagaggugauguaacacacauaucaggcucaagaaauuacacaaugaaucucgcaucccaaaauuggaauucauaugauccaacugaagaaauaccugcaccccuaggaacuccagacuuuguaggaaaaauccaaggaguacuaacacaaacaacccgaacugacggaucaacaagaggacacaaagcaaccgucuauacaggaucagcagacuucuccccuaaauuaggaagaguacaauucaccacagacacugauaacgauuuuguaaccaaucaaaacacaaaauuuacuccugucggcguuauacaagacggaucaaccacaccaagaaacgaaccacaacaauggguucugccaucauauucaggaagaaauacucauaauguccaccuugcaccagcaguagcaccaacauucccaggagaacaacuucuauuuuucagauccaccaugccaggaugcucaggcuauccaaauauggaccuagauugcuuguuaccucaagaauggguacaauacuucuaccaagaagcagcaccagcacaauccgaugucgcacuacuaagauuuguuaauccagacacaggaagaguacuauuugaauguaaacuacauaaaucaggcuaugucacuguagcucacacuggacagcaugaucuaguaauaccaccuaauggauacuuccgauucgauucauggguuaaucaauucuauacucuagcaccaaugggaaacggaacaggacgacgaagagccuuauaa

SEQ ID NO: 31078 - RNA, 1623 nt, Artificial Sequence
  derived and/or modified sequence opt6 from capsid_protein_VP1__Norovirus__AHX22025
augaaaauggcaucuucugaugcaaacccaucagauggcuccacagcuaacuuaguaccugaaguuaacaaugaaguaauggcauuagaaccuguuguuggugcagcaauagcagccccuguagcaggccaacaaaaugucauagaucccuggauaagaaacaacuuuguccaagcuccaggaggagaauuuacuguuucaccucgaaaugcaccaggcgaaauauuauggucagcaccacuuggacccgaucuaaauccauacuuaucacauuuagcuagaauguauaaugguuaugcaggagguuucgaaguacaaacaauuuuagcaggaaacgccuuuacagcaggaaaaauaauauuugcagcagucccaccaaacuuuccaacugaaggcuuaucaccaucacaaguuacaauguucccacauauaauaguagauguuagacaacuagaaccaguauuaaucccacuaccagauguacgaaacaauuucuaucauuauaaucaaacaaaugacccuacuauaaaauuaauagcaaugcuauacacuccacuacgagcaaacaaugcuggugaugauguauuuacagucucaugccgaguauuaacccgcccaucaccugauuuugacuuuauauuccucguuccacccacaguugaaucccguacuaaaccauuuucugucccuguccuaaccguagaagaaaugacaaauagcagauuuccaauacccuuagaaaaacuuuucacagguccuuccucagcauucgucguucaaccacaaaacggaagauguacuacagaugguguucuccuaggaacaacacaacuaucaccuguaaauauaugcacauuucguggagacguaacacauauaucaggaucuagaaauuauacaaugaaucucgcaucacaaaacuggaacaguuaugauccaacagaagaaauaccagcuccacuagguaccccugauuuugucggaaaaauacaagguguauuaacacaaacaacaagaacugaugguucaacaagaggccacaaagcaacaguauacaccggcucugcugacuuuuccccaaaacuaggaagaguccaauucgcaacagauacagacaaugauuucgaaacaaaucaaaauacaaaauucacaccagucggcguaauacaagauggcggaacaacacacagaaacgaaccucaacaauggguacuaccaucuuauucaggucgaaacacacauaacguacaccuugcaccugcaguagcaccaacauucccuggagaacaauuauuauuuuuccgaucaacuaugccagguugcuccggauauccaaauauggaucuagacuguuuauuaccucaagaauggguccaauauuucuaucaagaagcagcacccgcacaauccgacguagcacuacuacguuuuguaaaccccgauacagguagaguacuauuugaauguaaacuacacaaaucuggauacgucaccgucgcacauacaggccaacaugaucucguuauaccuccuaauggcuauuuucguuucgacucauggguaaaucaauuuuacacacuagcaccaaugggcaauggaacaggcagacgaagagccuuauaa

SEQ ID NO: 31079 - RNA, 1623 nt, Artificial Sequence
  derived and/or modified sequence opt6 from capsid_protein_VP1__Norovirus__AHX22028
augaaaauggcaucaucugacgcuaacccuucugacgguucagccgcaaauuuaguaccagaaguaaacaaugaaguuauggcucuagaacccguagucggugcagcuauugcagcaccaguagcaggccaacaaaauguuaucgacccauggauuagaaauaacuucguacaagcuccugguggagaauucacaguuucaccacguaacgcaccuggagaaauacuauggucagcaccacuaggaccugauuuaaacccuuaucuaucccaccucgcaagaauguauaacggauaugcuggaggauucgaaguacaagucauucuagcaggaaaugccuuuaccgcuggcaaaguaauauucgccgccguuccuccgaacuuuccaacagaaggcuuaucccccucacaagucacaauguucccccacauagucguugauguacgacaacuagaaccaguacucauuccucuuccagauguacgaaauaauuucuaucacuauaaccaaucaaaugacccaacaauaaaauuaauagcaaugcuuuauacaccacuaagagcaaacaaugcaggagaugauguauuuacaguuucauguagaguacuaacaagaccaucaccagacuucgauuuuauauuucuaguaccaccaacaguagaaucacgaacaaaaccauuuucuguaccaguacuaacaguagaagaaaugacuaauagccgauuuccaauuccauuagaaaaauuauucacagggccaucuucagcauucgucguucaaccacaaaacggaagauguacaacagauggcgucuuacuagguacaacacaacuauccccaguaaauauaugcacauucagaggagacguaacacacauaacagguucaagaaacuauacuaugaaccuagcaucacaaaauuggaacaacuaugacccaacagaagaaauccccgcaccucuagguacaccugacuuuguaggaaaaauacaagguguacuaacacaaacaacacguacagacgguucaacccguggacauaaagccacuguauacacaggaucagcagauuuugcaccaaaacuaggaagaguacaauucgagacugauacagaucacgauuucgaagcaaaccaaaauacaaaauuuacacccguaggaguaauccaagacggaggaacuacacacagaaacgaaccucaacaauggguacucccauccuauucuggaagaaauacacauaacguacacuuagcuccagccguagcaccaacauuuccaggagaacaacuauuauuuuuuagaucuaccaugcccggauguucugguuauccaaacauggauuuagauuguuuacuaccacaagaauggguacaauauuucuaccaagaagccgcuccagcacaauccgauguagcucuauuaagauuuguuaacccagauacaggaagaguauuauuugaauguaaauuacauaaaucaggauaugucaccguugcacauacaggccaacaugacuuaguaauaccaccaaauggcuacuuuagauuugauucauggguaaaucaauuuuauaccuuagcaccuaugggaaacggaacaggcagaagacgaguagucuaa

SEQ ID NO: 31080 - RNA, 1623 nt, Artificial Sequence
  derived and/or modified sequence opt6 from capsid_protein_VP1__Norovirus__AHX22032
augaaaauggcuuccucagacgcaaauccuucagauggcaguacugccaauuuaguuccagaagucaauaaugaaguaauggcuuuagaaccaguagucggagcagcaauagcagccccaguagcaggccaacaaaauguaauagaccccuggauacgaaauaauuuuguacaagcaccaggcggcgaauuuacaguauccccacgaaaugcaccuggcgaaauacuauggucagcaccacuaggaccugaucuaaauccauaucuaucacaucucgcaagaauguauaacgguuacgcaggaggauucgaaguacaaacaauacucgcaggaaaugcauucacagcuggaaaaauaauuuuugcagcaguacccccaaauuuuccaacagaaggccuaucuccaucacaaguaacaauguucccacacauuauaguagaugucagacaacuagaaccaguacuaauaccuuuaccagauguaagaaacaauuuuuaucauuacaaccaaacuaaugacccuacaauuaaacuaauagcuaugcuuuauacacccuuaagagcaaauaaugcaggggaugauguauuuacaguuucauguagaguacucacccguccaucuccagauuucgacuuuauuuuuuuaguuccuccaacaguagaaucuagaacaaaaccuuucuccguaccagucuuaacuguugaagaaaugacaaauucaagauuuccaaucccauuagaaaaacuauucacagguccaucaagcgcuuuuguaguacaaccacaaaacggcagauguaccacugauggaguccuccucggaaccacccaacuaucaccaguaaauaucugcacauuuagaggagauguaacacauauaucuggaucacgcaacuacacaaugaacuuagcaucacaaaacuggaauucauaugacccaaccgaagaaauaccugcaccacuaggaacuccugauuuuguuggaaaaauacaaggaguuuuaacccaaacuacacgaacagacggaucaacucguggucauaaagcaacaguauauaccgguuccgcagauuuuucuccuaaauuaggacgaguacaauuugcuacggauacagauaacgauuuugagacaaaucaaaauacaaaauuuacaccaguaggaguaauccaagauggcggaaccacccaccaaaaugaaccccaacaauggguacuaccaucauauucaggacgagauacccauaacguacaucuagcaccugcaguagcaccaacuuuuccaggcgaacaauuacuauuuuuucgcucaacuaugcccggcugcucaggauauccuaacauggaccuagauugcuuauuaccccaagaauggguacaauauuuuuaccaagaagccgcaccagcccaaucagacguagcauuauuaagauucguaaauccagauacuggaagaguucucuucgaauguaaacuacauaaaucaggauauguaacagucgcccauacaggucaacacgaucuaguaauaccaccaaacggauauuucagauucgauucauggguaaaucaauuuuauacacuugcaccaaugggaaacggaacaggaagaagaagagcauuauaa

SEQ ID NO: 31081 - RNA, 1623 nt, Artificial Sequence
  derived and/or modified sequence opt6 from capsid_protein_VP1__Norovirus__AHX22038
augaaaauggcaucuagcgacgccaacccaucugauggaucagccgccaaucugguaccagaaguaaacaaugaaguaauggcccuagaaccgguugucggcgcagcaauagcugcaccagucgcaggacaacaaaauguaauagacccauggauaagaaauaacuuuguacaagcacccggaggcgaauuuacaguuuccccaagaaaugcaccuggcgaaauauuauggucugcaccacuaggaccagauuuaaauccauaucucucccacuuagcaagaauguauaacggauacgcuggagguuucgaaguacaaguuauauuagcuggcaacgcauuuacagcugguaaaguaauauucgcagcaguuccaccaaacuuuccaaccgaaggacuaucuccaucacaaguaacuauguucccacauauaguaguagauguaagacaauuagaaccaguauuaauaccauuaccagauguaagaaacaacuuuuaucacuauaaucaaaguaaugacccaacaauaaaacuaauagcaauguuauauacaccucuaagagcuaacaaugccggagacgauguauuuacaguauccuguagaguacuaacaagaccuuccccagacuuugacuuuaucuuccuaguuccaccaacagucgaaucuagaacuaaaccuuucuccguaccaguauuaaccgucgaagaaaugacaaacucaagguucccaauaccucuagaaaaacuauuuacugguccuucaucagcuuuuguaguacaaccucaaaauggccgauguacaaccgacggcguacuacuuggaacaacucaauuaucaccaguaaauauauguacauuccgaggagacguuacacacauaacaggaucaagaaacuauacaaugaauuuagcaucacucaauuggaacaauuacgauccaacagaagaaauaccagcuccauuaggaaccccugacuuuguaggcaaaauccaaggcauguuaacacaaacaacacgaacagauggauccacuagaggucauaaggcaacaguauacaccggaucugcugauuuugcaccaaaauuaggacgcguacaauucgaaacagauacagaucaugauuucgaagcaaaucaaaauacaaaauucacaccaguaggaguaauacaagacgguuccacaacacaucgaaaugaaccacaacaauggguacuuccaucauauucagguagaaauacacacaacguccaccuagcccccgcaguagccccaacauuuccuggagaacaacuuuuauucuuucgauccacaaugccaggaugcucuggauacccaaauauggaccuugacugccuacuaccacaagaauggguacaauauuucuaucaagaggcagcucccgcacaauccgacguugcacucuuacgauucguaaauccugauacugguagaguauuauucgaauguaaacuacauaaaucuggauaugucacaguagcacacacuggacaacacgaccuuguaauaccaccaaacggauacuucagauucgauucauggguaaaccaauuuuacacacuagcuccaaugggaaaugguacaggaagaaggcguguaguauaa

SEQ ID NO: 31082 - RNA, 1623 nt, Artificial Sequence
  derived and/or modified sequence opt6 from capsid_protein_VP1__Norovirus__AHX22041
augaaaauggcuucuucugacgcuaacccuuccgauggaucagccgcaaaucucguuccagaaguuaacaacgaaguaauggcuuuagaaccuguaguaggugcagcuauagcagcaccaguagcaggacaacaaaauguaauagacccauggauuagaaauaauuuuguacaagccccaggaggcgaauuuacaguaucaccuagaaacgcaccaggagaaauauuguggucugccccacucggaccagaucuaaauccauaucuuucacauuuagcaagaauguacaacggauacgccggugguuucgaaguacaaguaauuuuagccggaaaugccuuuacagcagguaaaguaauuuucgcugcaguaccuccaaauuucccaacagaaggacuuucaccgucacaaguaaccauguuuccacauaucgucguagacguucgacaacuugaacccguacuaaucccacuaccagacguacgaaauaauuuuuaucacuauaaccaaucaaaugauccuacaauaaaacuuauagccauguuauauacaccccuaagagcaaauaacgccggugacgacguauucacagucucaugucgaguauuaacaagaccaaguccagauuuugauuuuauauuucuaguuccuccuacaguagaaucucgcacaaaaccuuucucaguaccaguacuaacaguagaagaaaugacuaauucaagauuccccauaccucuagaaaaacuauucaccgguccaaguuccgcauucguaguccaaccucaaaacggaagauguacuacagacggugucuuacuuggaacaacacaauuauccccaguaaauauuuguacauucagaggagacguuacacauaucacugguucacauaacuauaccaugaaucuagcaucacaaaauuggaacaauuaugacccaacagaagaaauaccagcaccuuuaggaacaccagacuuuguaggaaaaauacaaggaguuuuaacacaaacaaccagaacugauggauccaccagaggacacaaagcaacuguauacacuggaagcgcagauuuugcaccaaaauuaggaagaguacaauuugcuacagauaccgaucaugacuuugaagcaaaucaaaauacaaaauucacaccaguuggaguaauccaagauggagguacaacacauagaaaugaaccacaacaauggguuuuaccuaguuauucuggaagaaauacacauaauguacauuuagcaccugcaguagcaccuaccuuuccaggagaacaauuauuauucuuuagaucaacaaugccaggaugcucaggauauccaaauauggaucuagauuguuuguuaccccaagaauggguacaauauuucuaucaagaggccgcaccagcacaaucagauguagcuuuacucagauuuguaaauccagacacaggccgaguauuguuugaaugcaaacuacauaaaucaggauauguaacaguagcacacaccggacaacaugauuuaguaauaccuccuaauggauauuucagauucgauuccuggguaaaccaauuuuauacacucgcccccaugggaaacggcacaggaagaagacgaguaguauga

SEQ ID NO: 31083 - RNA, 1623 nt, Artificial Sequence
  derived and/or modified sequence opt6 from capsid_protein_VP1__Norovirus__AHX22047
augaaaauggcaucuuccgacgcaaacccauccgauggauccacugcuaaccuuguaccagaaguaaacaaugaaguaauggcacuagaaccaguugucggagcagcaauagcagcaccaguagcaggccaacaaaaugucauagauccauggauaagaaauaacuuuguacaagccccaggaggcgaauuuaccguauccccuagaaaugcacccggagaaauacuaugguccgcaccucuaggaccugaucuaaauccuuaucuuucacauuuagcacgaauguacaauggauacgcagguggauucgaaguucaaguaauauuagccggaaacgccuucacugcaggcaaaauuaucuucgcagcaguacccccaaacuucccaacagaaggauuaucaccaucacaaguaacaauguucccacacauaauagucgacguacgccaacucgaacccguccuaauaccacuccccgaugucagaaauaauuucuaucacuauaaucaaucaagugacccaacaauaaaauuaauagcaaugcuauauacaccuuuaagagccaacaacgcaggcgaugaugucuucacaguaucaugcagaguacuaacaagaccaucaccagacuucgacuuuauauucuuaguaccaccuacugucgaaucaaggacuaaaccuuucagcguaccaguucuaacaguagaagaaaugacuaauucaagauuuccaauaccauuagaaaaacuauucaccggcccauccucugcuuuugugguacaaccucaaaauggccgaugcacaacugauggagucuuacuagguacaacacaacuauccccaguaaauauaugcacuuuuagaggagauguaacccacauaccaggaucacguaacuauacaaugaaucuagcaucacaaaacuggaacucauacgaccccacagaagaaauaccagcaccacuaggcacuccagauuucguaggaaaaauacaaggaguauuaacacaaacuacacgaaccaauggaucaaccagaggacacaaagccacuguauauacaggauccgcagacuucucaccaaaacuuggaagaguucaauuugcaacagauacagauaacgacuuugaaacaaaucaaaauacaaaauuuacacccguaggaguaauucaagacggauccacaacuccacgcaacgaaccucaacaauggguucuuccauccuacucaggaagaaacauacacaauguucaccuagcaccagcaguagcaccaacuuucccaggagaacaauuacuauucuuccgaaguacaaugccuggauguucagguuacccaaauauggaccuagauugucuacuuccucaagaauggguacaauauuucuaccaagaagcagcaccagcacaaucagauguagcauuauuacguuuuguaaauccagauacaggaagaguauuauuugaauguaaauuacauaaaagcggauaugucacaguugcacacacaggacaacaugaucuaguaauaccaccuaacggcuacuuccgauuugacucauggguaaaucaauuuuauacacuagcaccuaugggaaacggaaccggccgaagaagagcauuauaa

SEQ ID NO: 31084 - RNA, 1623 nt, Artificial Sequence
  derived and/or modified sequence opt6 from capsid_protein_VP1__Norovirus__AHX22050
augaaaauggccucaucagacgcaaacccauccgauggaagcaccgcuaaccuagucccagaaguaaacaacgaaguaauggcccuagaaccaguaguaggagcagcaauagcugcacccguagcaggacaacaaaauguaauugauccauggauucguaauaauuuuguacaagcaccaggcggagaauuuacaguaucaccaagaaacgcuccaggagaaauauuauggucagcuccacucggaccagacuuaaauccauaccuaucccauuuagcaaggauguacaauggauaugcuggaggauuugaaguacaaguuauacuagcaggaaaugcauuuacagcaggaaaaauuauauuugcagcaguccccccaaacuucccaacagaaggauuaucuccgucacaaguaacuauguuuccacauauaauaguagacguacgacaacuagaacccguucuaauaccauuacccgauguacgaaauaauuucuaucauuauaaccaaagcaaugauccaacaaucaaauuaauagcuaugcuauacacaccacuaagagccaacaaugcuggagaugauguuuuuacaguuucaugucguguauuaacaagaccaucuccagauuuugacuuuauauuucuaguaccacccacaguugaaucaagaacaaaaccuuuuucaguaccaguacuaacaguugaagaaaugacaaacucucgauucccuauaccauuagaaaaacuauuuacaggacccucaucagcuuucguuguacaaccacaaaacggaagauguacaaccgacggaguacuauuaggaaccacgcaauuaucuccuguuaauaucuguacauuuagaggagauguaacucacaucuccggaucacgaaauuacacaaugaaucuugccucucaaaacuggaauucauaugauccaacugaagaaauaccagcaccauuaggaacucccgauuuuguaggaaaaauccaaggaguucuuacucaaacaacccgaacugacgguucaacccgaggacauaaagcaacaguauauacagguucugcagacuuuucaccuaaacuaggacgaguccaauuugcaacagauaccgauaacgauuucguaacaaaccaaaacacaaaauucacaccaguaggaguaauccaagauggcucaacaaccccuagaaaugaaccacaacaauggguacucccuucauauucagguagaaacacucauaauguacaccuugccccugccguugccccaaccuuuccaggagaacagcuauuauucuuuagauccaccaugccaggauguucaggauauccaaauauggaucuagacugcuuacuaccacaagaauggguacaauauuucuaucaagaggcagcaccagcacaaucagaugucgcauuacuaagauuuguaaauccagacacaggacguguuuuauuugaaugcaaacuacauaaaucaggauacguaacaguagcucacacaggacaacacgacuuaguaauaccacccaauggauacuuucgauuugauaguuggguaaaucaauuuuacacccuagcaccaaugggaaauggcacuggccgacgaagagcccuauaa

SEQ ID NO: 31085 - RNA, 1623 nt, Artificial Sequence
  derived and/or modified sequence opt6 from capsid_protein_VP1__Norovirus__AHX22054
augaaaauggcuuccucagaugcaaacccauccgacggaucuacagcaaacuuaguaccagagguuaauaaugaaguaauggcacuagaaccagucguuggugcagcaaucgcagcaccaguagcuggccaacaaaauguaauagauccauggauaagaaacaauuucguacaagccccaggaggugaauuuacuguuuccccaagaaaugcaccuggcgaaauacuaugguccgccccauuaggaccugaucuaaauccuuaucucucacacuuagccagaauguauaacggauacgcuggcggauuugaaguacaaguaauauuagcaggcaaugccuuuaccgcaggaaaaauaauauucgcagccguaccaccaaauuuuccaacagaaggauuaucaccaagccaaguaacaauguucccacacauaauaguugacguuagacaauuagaaccuguauuaauaccauuaccagauguaagaaauaacuucuaucauuacaaccaaucaaaugacucaacaauaaaacuaauagccaugcuauacacaccccuaagagcaaacaaugcaggagacgacguauuuacaguaucaugucgaguacuaacacgaccaucuccagauuuugacuuuaucuucuuaguuccaccaacagucgaauccagaacaaaaccauuuuccguaccaguauuaaccguagaagaaaugacgaacucacgcuuuccaauaccauuagaaaaauuauucacuggcccaucaucagccuucguaguacaaccacaaaacgguagauguacaacugacggcguccuauuagguacaacacaacuauccccaguaaacauauguaccuucagaggagacguuauacacauaucagguucaagaaauuauacuaugaauuuagcuucccaaaacuggaacuccuaugauccuacugaagaaauaccagcuccacucggaacacccgauuucguaggaaaaauucaaggaguacuaacacaaacaaccagaaccgauggaucaacccgaggacacaaagcuacaguauauacaggaucugcagauuucucaccaaaauuagggcgcguccaauucgcuaccgauacagacaacgauuucguuacaaaucaaaauacaaaauucacaccgguagguguaauucaagauggaaguaccacuccaagaaaugaaccccaacaauggguccuaccuuccuacucugguagaaauacacauaacguacauuuagcaccagcaguagcaccuacauucccaggcgaacaacuacuauuuuuccgaagcacaaugccaggaugcucuggauauccaaauauggacuuagauugcuuacuaccacaagaauggguucaauauuucuaucaagaagcagcaccagcucaaucagacguagcacuacuacguuuuguaaauccugauacuggacguguauuauuugaaugcaaacuacauaaauccgguuauguuacaguagcacauacaggacaacaugaucuuguaaucccuccaaauggauauuuuagauucgacucauggguaaaucaauuuuacacacuagcucccaugggaaacgguacaggacgacgaagagcauuauaa

SEQ ID NO: 31086 - RNA, 1647 nt, Artificial Sequence
  derived and/or modified sequence opt6 from capsid_protein_VP1__Norovirus__AIA96988
augaaaauggcuuccaacgacgccgcuccaucuaaugauggugcagcaggacucguacccgaaauuuccaaugaagcaauggcacuagacccagucgccggagcagcaauagcagcaccacuuacuggacaacaaaauauuauagacccuuggauaaugaauaauuucguacaagcaccaggaggagaauucacaguuuccccaagaaauuccccaggagaaauacuacuaaaucuugaacuaggcccagaaauaaauccauauuuagcacacuuagcuagaauguauaacggauacgcaggcggcuuugaaguacaaguugucuuagccggaaaugcauuuacagcaggaaaaguuauuuuugcagcuauaccaccaaauuuucccacagauaaucuaucggcagcacaaauaacaaugugcccacacguaauaguagauguucgacaacuugaacccauaaaucuaccaaugccugacguacgaaacaauuuuuuccauuauaaccaaggaucagacucccgauuaagacucauagcaauguuauacacaccauuaagagcaaauaauucuggagaugacgucuuuacagucucuugcagaguacuaacacguccuucuccagauuuuucauucaacuuuuuagucccuccaacuguagaaucaaaaacaaaaccauucacauuaccaauuuuaaccauaagugaaaugucaaacucuagguuuccaguaccaauagauucucuacauacaucuccaaccgacaacauaguuguccaaugccaaaacggaagaguuacccuagacggcgaauuaaugggaacuacacaacuccuuccgagucaaaucugcgcauuuagaggcguucuaacaagaucaaccaguagagcaucugaucaugcagauacagcaacaccacgacuauuuaauuauuauuggcacauccaacuagacaauuuaaaugguacaccauaugaucccgcagaagacauaccagcaccauuaggaacaccagauuuucgaggaaaaguuuuuggagucgcaucucaaagaaauccagacucaaccaccagagcucaugaagcuaaaguugauacaacuucaggaagauuuaccccuaaauuaggaucucuagaaauguccaccgaaucagaugauuucgaccaaaaucaaccaacacgauucacaccugucggaauuggcguagacaaugaagcagacuuccaacaauggaccuuaccagauuauucaggacaauuuacccauaauaugaaccuagcaccagcaguagcaccaaauuuucccggagaacaauuauuauucuuucgaucucaacuaccaagcucagguggaagaaguaacgguauuuuagacugcuuaguaccacaagaauggguacaacauuuuuaccaagaaucugcaccagcacaaacacaagucgcauuaguaagauacguaaauccagauaccggaagaguccuauucgaagcaaaacuucacaaauuaggauauaugacaauagcuaaaagcggagacucaccaauaacaguuccaccaaacggauacuucagauuugaaucauggguaaauccauuuuauacauuagcaccaaugggcaccggaaaugguagaagaagaauccaauaa

SEQ ID NO: 31087 - RNA, 1623 nt, Artificial Sequence
  derived and/or modified sequence opt6 from capsid_protein_VP1__Norovirus__AII02569
augaaaauggcaucaaaugacgcaaacccauccgauggaucagccgcuaauuuaguucccgaaguaucaaaugaagugauggcccucgaaccagucguaggagcagcuauagcugcaccagucgcuggccaacaaaauguaauugacccauggauacgaaauaacuuuguccaagcaccaggaggagaauuuacuguaucuccaagaaacgcaccaggagaaaucuuauggucagcaccacucggacccgauuuaaacccuuauuuaucacaccuugcacgaauguacaauggauacgcaggaggauucgaaguacaagucauuuuagcagguaaugcauucacagcaggaaaaauaauauucgcugcaguaccuccaaacuucccaaccgaaggauuaucaccaucccaaguuacaauguuuccacauauaauaguugauguccgccaacuagaaccaguauuaauaccucuaccagauguuagaaacaauuucuaucauuauaaccaaacaaacgacucuacaauaaaacuaauugcaauguuauacacaccuuuaagagcaaacaacgcaggagaagacguauuuacagucaguuguagaguuuuaacaagacccaguccagacuuugacuucauauuuuuaguaccacccaccguagaaucacgaacaaaaccauucacaguaccuauacucacaguugaagaaaugacaaacucaagauuuccaauaccauuagaaaaacuauuuacaggcccaucaggcgcauuuguuguacaaccacaaaacggacgauguacaacagacgguguauuacuagguacaacacaauuaagcccuguaaauauauguaccuuuagaggagacguuacucauauagcaggaucaagaaacuacacaaugaaucucgcaucacuaaacuggaauaauuaugaccccacagaagaaauacccgcaccacucggaacuccagacuuuguuggcaaaauacaaggcguacuaacacaaaccacaaaaggagacggcucaacccgaggucauaaagcgacaguauauacuggaucagcaccauucacaccaaaacuaggaucaguacaauuuaguacagauaccgaaaaugauuuugaaacacaucaaaacacaaaauucacuccaguaggaguaauacaagauggcggaacaacccauagaaaugaaccccaacaauggguacuacccucauauucaggaagagauguacauaacguacauuuagcaccagccguagcucccacauuuccaggggaacaacuauuauucuuuagaucuacaaugccaggauguuccggauauccaaauauggaccuagauugucuuuuaccacaagaauggguacaacauuucuaucaagaagcagcaccagcacaaucugacguagcacuccuaagauucguaaaccccgauacaggaagaguacuauucgaauguaaacuuuacaaaucuggauaugucacagucgcacacacaggacaacacgaucuuguaaucccuccaaacggauauuucagguuugauucauggguuaaucaauucuauacauuagcacccaugggaaacggcacagggagacgaagagcucuauaa

SEQ ID NO: 31088 - RNA, 1623 nt, Artificial Sequence
  derived and/or modified sequence opt6 from capsid_protein_VP1__Norovirus__AII02572
augaaaauggcaucaaaugacgccaacccaucagacggaucagccgcaaacuuaguaccagaaguaucaaacgaaguuauggccuuagaaccagucguuggagccgccauagcagcaccaguagcaggccaacaaaauguaauagacccuuggauuagaaauaacuuuguucaagcaccugguggcgaauuuaccguaucccccagaaacgcacccggagaaauauuauggagugcaccacuaggaccagauuuaaauccuuaucuaucucaucuugcaagaauguauaacggcuacgccggaggauucgaaguacaaguaauacuugccggaaaugcuuuuacagcagguaaaauaauuuuugcagcaguaccaccaaacuuucccacagaaggucuaucaccaucacaagucaccauguucccacacauaaucguagacguaagacaacuagaaccaguucucauaccauuaccggaugucagaaauaacuuuuaccauuauaaucaaacaaaugauucaacaauaaaacuuaucgcaauguuauauacaccauuaagagcaaacaaugccggagaagauguauuuaccguaucauguagaguccuaacaagacccucacccgacuuugauuuuaucuuuuuaguaccuccaacaguagaaucaagaacaaaaccauuuacaguaccuauacuaacagucgaagaaaugacaaauucaagauuucccaucccccuagaaaaacuuuucacaggaccaucaggcgcguucguaguacaaccccaaaauggacgauguacaacagaugguguauuacucgguacaacacaauuaucuccaguaaacauaugcacauuucgcggagacguaacacauauagcaggcuccagaaacuacacuaugaacuuagcaucucucaacuggaacaauuacgacccaacagaagaaauaccugccccauuaggaacgccagauuuuguagguaaaauacaaggaguauuaacacaaacaacaaaaggagacgguagcacaagaggacacaaagcaacuguauauacaggaagcgcuccauucacaccuaaacucggaucaguacaauucucaacagacacagaaaacgauuuugaaacucaccaaaauacaaaauuuacuccuguaggaguuauccaagauggaggcacaacucauagaaaugagccacaacaauggguacuaccuucauacucuggaagagauguacauaacguacaccuagcaccagcaguugcaccaacauuucccggagaacaacuacuauucuuuagaucaacaaugcccggcugcucuggauauccaaacauggauuuagacugcuuacuaccacaagaauggguacaacauuucuaucaagaagcagcucccgcucaaucagauguugcccuucugcgcuucguaaacccagacacaggaagaguacuuuucgaauguaaauuacauaaaucaggcuacguuacaguagcccacacaggacaacacgacuuaguaauaccuccaaauggcuacuuuagauucgauucaugggucaaucaauuuuacaccuuagcaccaaugggaaauggaaccggaagacguagagcccuuuaa

SEQ ID NO: 31089 - RNA, 1623 nt, Artificial Sequence
  derived and/or modified sequence opt6 from capsid_protein_VP1__Norovirus__AII02575
augaaaauggcauccaaugaugcaaaucccucagacggaucagcagcuaaucucguaccagaaguaucaaaugaaguuauggcauuagaaccaguaguaggagcugcaauagccgcaccaguagcaggacaacaaaacguaauagauccuuggauaagaaauaacuuuguacaagcaccagguggugaauuuaccguguccccucgcaaugccccaggcgaaauccuuuggucugcaccauuaggacccgaccuaaacccauaucuuucucauuuagcaagaauguacaacgguuacgcaggaggauucgagguacaaguaauacuagccggaaacgcauuuacugcuggaaaaauaauauucgcagcaguaccaccaaacuuuccaacagaaggacuaucacccagucaaguaacaauguuuccacauauuauaguagauguuagacaacucgaaccaguccuaauaccacuacccgauguaagaaauaauuucuaucauuauaaucaaaccaaugauucaacaauaaaauuaaucgcuauguuauauacaccuuuacgagcaaacaaugcaggagaagaugucuucacaguuucaugucgaguccuaacuagaccuucaccagacuucgauuuuauauuuuuaguaccaccgacaguugaaucccgaacaaaaccauuuacaguaccuauccucacaguagaagaaaugacaaacucccgauucccaauaccauuagaaaaauuauuuacaggaccaucaggcgcauuuguaguacaaccucaaaacggacgauguacaacagacgguguuuuauuaggcacaacacaauuaucaccaguaaauauaugcacauuuagaggcgauguaacacauaucgcagguucuagaaauuauacaaugaauuuagcuucacuuaacuggaacaauuacgauccuacagaagaaauaccagcaccucuaggaacaccagauuuuguaggaaagauacaaggaguauuaacacaaacaacaaaaggagacggaucaacaagaggacauaaagcaacagucuauacuggaucagcuccauuuacaccaaaauuaggaucuguacaauuuucaaccgacacagaaaaugauuucgaaacacaucaaaauacaaaauucacaccaguaggcguaauacaagacggaggaacuacccacagaaacgaaccacaacaauggguacuacccucauauucaggcagagauguacauaacguacacuuagcuccagcaguagcaccuacauucccuggcgaacaacuuuuauuuuuccguucaacaaugcccggaugcucaggauauccuaacauggaccuagacugcuuacuaccacaagaguggguacaacauuuuuaucaagaagcagcccccgcacaaucggauguugcauuauuaagauuuguaaauccagacacuggaagagucuuauucgaaugcaaacuucacaaaagcggcuauguaacuguagcacacacuggacaacacgaucuuguaauaccaccaaauggauacuuccgauucgauucauggguaaaucaauuuuacacacuagcacccaugggaaauggcacaggacgaagaagagcauuauaa

SEQ ID NO: 31090 - RNA, 1623 nt, Artificial Sequence
  derived and/or modified sequence opt6 from capsid_protein_VP1__Norovirus__AII02578
augaaaauggccucaucagacgcaaacccaucagauggauccacagccaauuuaguacccgaagucaauaaugaagucauggcauuagaaccagucgucggagccgcaauagcagccccaguugcaggccaacaaaacguaauagauccauggauaagaaauaacuucguccaagccccaggaggagaauucacaguaaguccuagaaaugcaccaggagaaauauuauggucugcuccauuagguccagaucuaaauccauauuuaucucaucuagcaagaauguauaaugguuacgcaggaggauuugaaguacaaguaauacucgcaggcaacgcauucacagccggaaaaauuauauucgcagccguccccccaaacuuuccuacagaaggccuaucaccuucacaaguaacaauguuuccacauaucauaguugauguccgucaacuagaacccguacuuauaccacuacccgauguacguaauaauuucuaucacuacaaucaaucaaacgauccaacaauaaaauuaaucgccaugcuauacacaccccuucgagcaaacaaugcaggagacgauguauuuacaguaucauguagaguauuaacacgaccaucaccugauuuugauuucauauuucucguaccaccaacaguugaaucaagaaccaaaccauucucaguaccuguccuaacaguugaagaaaugacuaauucacgauuuccuauaccauuagaaaaacuauuuacaggaccaucaucagcauuugucguacaaccacaaaacggaagaugcaccacagacgguguauuauugggaacaacacaauuaucccccgucaacauaugcacauucagaggagauguuacucauaucucaggaagcagaaauuacacaaugaaucuagcaucccaaaacuggaacucauacgaucccaccgaagaaauuccagccccauuaggaacaccugacuucguaggaaaaauucaaggagucuuaacacaaacaacuagaacaaacggaucaacacgaggacacaaagcuaccguauauacuggaucagcagauuuuucuccaaaauuaggacgaguacaauuugccacagacacagacaacgauuucgaaacaaaccaaaauacuaaauuuacaccaguaggagucauacaagacgggucaacaacaccacgaaaugaaccacaacaauggguauuaccuucauauaguggacgcaauauacacaacguucaccucgcaccugccguagccccaacauuuccaggugaacaacuacuuuucuuccgaucaaccaugccaggaugcucaggauauccaaauauggaucuagauugcuuacucccacaagaauggguacaauauuucuaucaagaagcugcacccgcacaaucagauguugcacucuuaagauuuguaaauccugacacuggcagagucuuauucgaauguaaacuucacaaaucugguuacguaacaguagcacacacaggccaacaugaucucguaauaccaccuaauggauauuucagauuugauucauggguaaaucaauuuuacacucuagcaccaaugggaaacgguacaggaaggcgacgagcuuuauaa

SEQ ID NO: 31091 - RNA, 1647 nt, Artificial Sequence
  derived and/or modified sequence opt6 from capsid_protein_VP1__Norovirus__AII02581
augaaaauggcaucuaacgaugcagcaccaucuaacgacggagcagcaggauuaguacccgaaauaaauucagaagcaauggcucuagaaccuguagcuggagcagcaauagcagcucccuuaacuggacaacaaaacauuauagaucccuggauaaugaauaauuuuguacaagcaccaggaggagaauucacuguuucaccacgaaauuccccuggagaaguuuuauuaaaucuagaacuaggaccagaaauuaauccauauuuagcacaccuagcccgaauguauaaugguuaugcaggaggauuugaaguacaaguccuacuugcaggaaaugccuuuacugcaggaaaaauuauuuuugccgcaauacccccuaauuucccaauugacaaucuaucugccgcccaaauaacaauguguccacauguaauaguagauguaagacaauuagaaccuguuaaucuaccuaugccagacguccguaacaacuuuuuccauuacaaucaaggaagcgauucaagacuaagacuaauagccaugcuauacacacccuuacgagcaaauaacucaggagacgauguuuucacaguuucuugccguguauuaacaagaccuaguccagacuucucauucaauuuuuuaguacccccaaccguagaaucaaaaacuaaaccauuuucauuacccauacuaacuauuucagaaaugucaaauucaagauuuccaguacccaucgauucauuacacacaucccccacagaaaauaucguuguccaaugucaaaauggaagagucacacuagauggugaacuaaugggaacaacccaauuauuacccucucaaauaugugcauuucguggaaugcuaacaagaucaacaucacgugcuuccgaucaagccgacacugccaccccaagacucuuuaauuauuacuggcacauucaacuagacaaucuaaacgguacacccuacgacccagcagaagacauaccagguccauuaggcacuccagacuuccguggaaaagucuucgguguagcuucucaaagaaaucccgaugcaacaacaagagcacacgaagccaaaauagacacuacaaguggaagauuuacucccaaauuaggaucacuagaaauaucaacugaauccggugauuucgaccaaaaucaaccuacacgauuuaccccaguagguauaggaguagaccacgaagcagauuuucaacaauggacacuccccgauuacgcaggucaauuuacccacaauaugaaccuagcaccugcaguugcacccaauuucccaggugaacaacucuuauuuuuccgaucacaacuaccauccucaggaggcagaucaaacggaauacuugacugucuaguaccgcaagaauggguacaacacuuuuaucaagaauccgcaccaagucaaacacaaguugcucuagucagauauguaaauccagauacagguagaguauuauucgaagccaaacuacacaaacuagguuucaugacaauagccaaauccggagauucaccuauaacaguaccacccaauggauacuuccguuuugaaucuuggguaaaccccuucuauacccuugcaccuauggguaccggaaauggcagacgaagaauucaauaa

SEQ ID NO: 31092 - RNA, 1623 nt, Artificial Sequence
  derived and/or modified sequence opt6 from capsid_protein_VP1__Norovirus__AII02584
augaaaauggcaucaaacgaugcaaaucccagugacggaucagcagcaaacuuaguaccagaaguaaacaacgaaguuauggcacuugaaccagucguaggagcugcaauagccgcaccaguagcuggacaacaaaacgucauagauccauggauaagaaauaauuuuguacaagcaccaggaggagaauuuacaguaucuccaagaaacgcaccuggagaaauacuuuggucugcaccccuuggaccagaucuaaauccauauuuaucacaccuagcaagaauguauaauggauacgcaggcggauuugaaguacaaguaauacuugccggaaaugcauuuacugcaggaaaaauaauauucgcagcuguaccacccaacuuccccacagaaggacucucaccuucacaagucaccauguuuccacauauuaucguugacgucagacaacuagaaccagucuuaauaccauuaccagauguuagaaacaauuuuuaccacuauaaccagacaaacgauuccaccauaaaacuaauugcaaugcuauauacaccauuaagagcuaauaaugcaggugaagacguauuuacaguaaguugcagaguacuaacaagaccuagcccagacuuugauuuuauauucuuaguaccaccaacaguagaaucuagaacaaaaccauucacgguuccaauauuaacugucgaagaaaugacaaauucacgauucccaauaccauuagaaaaacucuuuacuggaccauccucagcauuuguuguacaaccacaaaacggacgcugcacaaccgaugguguacuucuugguaccacacaauuauccccaguaaauauaugcacauucagaggugaugucacacacauagcuggcucaagaaauuauacuaugaaccuugcauccuuaaacuggaacaauuaugacccaacugaagaaauacccgcuccacuaggaacacccgacuucguaggaaaaauacaaggaguauuaacucaaacaacaaaaggagacggaucaacaagaggacacaaagcuacaguuuauacagguucagccccauuuacccccaaauuaggaucuguucaauucucuaccgacaccgaaaacgauuuugaaacacaucaaaauacaaaauucacaccaguaggaguaauacaagacggaggcacuacacaccgaaaugaaccucaacaauggguuuuaccaucauacucaggucgaaauguacauaauguccacuuagcacccgcaguugcuccuacauuuccaggcgaacaacuccuauuuuuucgaucaaccaugcccggcugcucaggauacccaaauauggaucuagauuguuuacucccacaagaaugggugcaacauuucuaucaagaagcagcucccgcacaaagugacguugcauuacuacgauuugucaauccugacacugguagaguccuauuugaauguaaauuacacaaaucaggauacguuacaguagcucacacaggacaacaugauuuaguaauaccaccaaauggauacuucagauucgacucauggguaaaccaauuuuauacacuagcaccaaugggaaaugguacuggcagaagacgcgcacuauaa

SEQ ID NO: 31093 - RNA, 1623 nt, Artificial Sequence
  derived and/or modified sequence opt6 from capsid_protein_VP1__Norovirus__AII02590
augaaaauggcaucaaaugacgcaaaccccucagauggaucagcagcaaacuuaguuccagaaguaucaaacgaaguaauggcacuagaaccuguaguuggcgcugccauagccgcuccaguagcuggccaacaaaauguaauugacccauggauacgaaauaauuuuguacaagccccaggaggagaauuuacuguaucaccucgaaacgcuccuggagaaauacuauggucagcaccauuaggaccagaucucaacccauauuuaagucaccuagcucguauguauaauggauaugcaggaggauucgaaguacaaguaauccuagcuggaaaugcauuuacagcuggaaaaauuauauucgcagcuguuccaccaaacuuuccaacugaaggucuaucaccaucacaagugacaauguucccacacauaauaguagacguaagacaauuagaaccaguacuaauccccuuaccagacguaagaaauaacuucuaccauuauaaccaaaccaaugauucgacuauaaaauuaauagcaaugcuuuacacaccauuaagagcaaauaacgcuggagaagaugucuuuacaguaucauguagaguauuaacacguccaucaccugacuucgauuucauauuucuaguaccacccacaguagaaagcagaacaaaaccauucacagucccaauauuaacagucgaagaaaugacaaacucuagauuucccauaccauuagagaaacuauuuacaggaccaucaggagcuuuuguaguccaaccacaaaauggaagaugcacaacagacgggguacuauuaggaacaacgcaauuaucuccaguuaauauauguacauuucgcggagacguaacacauauagcagguucaagaaauuacacaaugaaucuugcaucauuaaauuggaacaacuacgacccaacagaagaaaucccagcuccacucggaacaccagacuuuguuggaaaaauacaaggaguucuaacacaaacaacaaaaggagacggaucaacacgaggacacaaagcuacaguauacacuggaucugccccuuuuaccccaaaauuagguucaguccaauucucaacugacacagaaaaugauuuugaaacacaccaaaauaccaaauuuacaccaguuggaguuauacaagauggaggaacaacacaccgaaaugaaccccaacaauggguucuuccaucuuauucugguagagacguacacaacgugcauuuagccccagcaguugccccaacauuuccaggagaacaacuacuauucuuccgcucaacaaugcccggaugcuccggcuauccaaauauggauuuagauugucuucuaccacaagaauggguacaacacuucuaucaagaagcagcaccagcccaaucagacgucgcucuauuaagauuuguaaaccccgacacaggaagaguacucuuugaauguaaauuacauaaaaguggauauguaacagucgcacauacaggccaacacgauuuaguaauacccccaaauggauauuuccguuucgacaguuggguaaaucaauuuuacacuuuagcacccaugggaaauggcacaggucgccgaagagcacuauaa

SEQ ID NO: 31094 - RNA, 1623 nt, Artificial Sequence
  derived and/or modified sequence opt6 from capsid_protein_VP1__Norovirus__AII02593
augaaaauggcauccucagacgcaaacccauccgauggaucaacagcuaaccuaguccccgaaguaaacaacgaaguuauggcauuagaaccaguuguaggugcagcaauagcugcaccuguagcaggacaacaaaauguaauagacccuuggaucagaaauaacuuuguucaagcaccaggcggagaauucaccguaagcccacgaaaugcaccaggugaaauacuuugguccgccccacuuggcccagaucuaaaccccuacuuaucacauuuagcaagaauguauaauggcuaugcaggaggauucgaaguucaaguaauacuugcaggaaacgcauuuacugcuggaaaaauaauauucgcagcuguaccuccuaacuuuccaacagaaggacugucuccaucacaaguuacaauguuuccacauauuauaguagacguaagacaacuagaacccguacuaauuccccuaccagauguaagaaacaacuuuuaccauuauaaucaaagcaaugacccaacaaucaaauuaaucgcuaugcuauauacaccacuaagagcaaauaacgccggggaugauguauuuacaguaucaugcagaguacuuacaagacccucuccagacuuugauuucauauuccuaguaccaccaacaguagaaucaagaacaaaaccauucucaguaccuguauuaacaguagaagaaaugacuaauuccagauucccaaucccucuagaaaaacucuuuacaggacccucuucagcauuuguaguacaaccccaaaaugguagauguaccacagauggaguauuacuagguacaacccaguuauccccaguaaauauauguacauuuagaggagacguuacucacauacccgguucaagaaauuacacuaugaaucuagcaucccaaaauuggaauucauaugauccaacugaagaaauaccagcaccauuaggaaccccagauuuugucggaaaaauacaaggaguuuuaacucaaacaacuagaacuaauggaaguacaagaggacauaaagcaacaguauauacaggaucugcagacuucucaccaaaauuaggaagaguacaauucgcuacagauacagauaacgauuuugaaacaaaucaaaauacuaaauucacuccuguaggcguaauacaagauggauccacuacaccuagaaacgaaccccaacaauggguacuaccuucuuacagcggacgaaauauacacaacguacaucuagcuccagcaguugcaccuacauucccaggcgaacaauuauuauucuucagauccacuaugcccggaugcucaggauauccaaauauggacuuagauugucucuuaccucaagaauggguucaauauuucuaucaagaagcagcaccagcacaaucagacguagcacuacucagauucguaaauccagacacaggaagaguacuauucgaaugcaaacuucauaagucuggcuacguaacaguagcacacacaggacaacacgaucuaguuauaccaccuaauggcuauuuccgauucgauucauggguaaaucaauuuuauacauuagcaccaaugggaaacgguacaggccgcagaagagcacuauaa

SEQ ID NO: 31095 - RNA, 1623 nt, Artificial Sequence
  derived and/or modified sequence opt6 from capsid_protein_VP1__Norovirus__AII02596
augaaaauggcaucaaacgaugcuaauccaucagauggaucagcagcuaauuuggucccagaaguuucaaaugaaguaauggcauuagaaccagucguaggagcagcaauugcagcaccaguugcaggccaacaaaaugucauugauccauggauacgaaauaacuuuguucaagcucccggaggagaauuuacaguaucaccaagaaaugcaccaggagaaauucuauggucagcuccauuaggacccgaucuaaauccauaccuuucacacuuagcacguauguauaauggauacgcugguggauuugaaguacaaguaauacuagcaggcaacgcauuuacagcaggaaaaauaauauucgcagccguaccaccaaacuuuccuacagaaggacucucacccucucaaguaacaauguuuccacacauaauagucgauguacgacaacuagaaccaguccucauuccacuaccagacgucagaaauaauuuuuaucacuauaaucaaacuaaugacucaaccauaaaacuaauugccauguuauauacacccuuaagagcaaacaaugcaggagaagauguauucacagucucuuguagaguucuaacaagacccuccccagauuuugauuucauauuucuaguacccccaacaguagaaucuagaacuaaaccauuuaccguaccaauauuaacaguagaagaaaugaccaacucucgauuucccauaccacuagaaaaauuauuuacuggaccaucaggcgcauuugucguacaaccacaaaacggaagaugcacuacagauggaguuuuacuaggaacaacacaacucucaccaguaaacauuugcacuuuuagaggagacguaacccauauagcuggaucacguaauuacacaaugaauuuggcaaguuuaaauuggaacaauuacgaucccacagaagaaauaccagcaccacuaggaacaccagacuucguaggaaaaauucaaggaguauuaacccaaacaacuaaaggugacggaucuacacgcggacauaaagcaacagucuacacaggauccgcaccuuuuacuccaaaauuaggaucuguccaauucucaacagauacagaaaacgacuuugaaacacaucaaaauacaaaauucacuccaguagguguaauccaagacgguggaacaacacaccguaaugaaccacaacaauggguauuaccuaguuacucaggacgugacguacauaacguacacuuagcaccagcaguagcaccaacauucccaggcgaacaacuauuauucuuucguucaaccaugccaggauguucugguuauccaaauauggaccuagauuguuuacuaccucaagaauggguacaacacuucuaucaagaagccgcacccgcucaaucugauguagcucuacuccgauuuguaaauccugacaccggaagagucuuauucgaauguaaacuucacaaaucuggauaugucacaguagcacauacaggacaacaugacuuaguuauaccaccaaaugguuauuuccguuucgacagcuggguaaaucaauucuauacuuuagcacccaugggaaauggaacaggucguagaagagcacuuuaa

SEQ ID NO: 31096 - RNA, 1623 nt, Artificial Sequence
  derived and/or modified sequence opt6 from capsid_protein_VP1__Norovirus__AII02599
augaaaauggcaagcaaugaugcuaauccaagugauggaucugccgcaaacuuaguaccugaaguaucuaaugaaguaauggcguuagaaccaguagucggcgccgcaauugccgcaccaguagcaggucaacaaaauguaauugauccuuggauaagaaauaacuuuguccaagcaccaggaggagaauuuacaguaucuccuagaaaugcacccggagaaauauuauggucugccccacuuggacccgaccucaauccguaucuaucacauuuagcaagaauguauaauggcuacgcaggaggauuugaaguacaaguaauacuagcagguaacgcauuuacugcaggaaaaauaaucuuugccgcaguaccaccaaacuuuccaacagaaggacuaucuccaucgcaaguaacaauguucccacauauaauaguagauguacgacaauuagaaccaguucuaauaccauuaccagauguacgaaauaauuuuuaucauuauaaccaaaccaaugacucaaccauaaaauuaauagcaaugcuuuacacaccacuaagagcaaacaaugcuggagaagauguauucacuguaagcugucgaguacuuacaagaccaucaccggauuuugacuucauauucuuagucccaccaacaguagaaagccgaacaaaaccuuucacuguaccaauacucacaguagaagaaaugacaaauucacgcuuucccauaccccuagaaaaacuauucacaggaccaaguggcgcauucguaguacaaccacaaaauggucguugcacaacagauggaguacuucuagguacaacacaacuuucaccaguaaacauauguacauuucguggagacauaacacacauagcagguagccgagauuauacuaugaaucucgccucucuaaacuggaauaauuaugauccuacagaagaaauacccgcaccucuugguacuccagacuuuguaggaaaaauucaaggaguauuaacacaaacaaccaaacgugacggaucaacuagaggacacaaagcaacaguauacacgggaucagcacccuuuacaccuaaacuaggcucagucagauuuucaacugacacagaaaaugacuucgaaacacaucaaaauacaaaauuuacaccuguaggaguaauacaagacggaucaaccacccaccgaaacgaaccacaacaauggguauuaccaucauauucaggaagagacguucauaauguucacuuagcaccagcaguagcaccaacauuucccggugaacaacuuuuauucuuuagguccacaaugccaggaugcuccggauacccaaauauggaccuagauugccuacuaccacaagaauggguacaacauuuuuaucaagaagccgccccagcucaaucugacgucgcacuauuaagauuuguuaauccagacacaggaagaguucuuuucgaauguaaacuacacaaaagcgguuauguaacuguagcacauacaggccaacaugauuuaguaauaccaccaaauggauauuuuagauuugacucauggguaaaucaauucuauacuuuagcaccgaugggaaacggaaccggccgccgcagagcacuauaa

SEQ ID NO: 31097 - RNA, 1623 nt, Artificial Sequence
  derived and/or modified sequence opt6 from capsid_protein_VP1__Norovirus__AII02602
augaaaauggcaucaagugacgcaaacccaucagacggaucaacagcaaauuuaguaccagaaguaaacaacgaaguaauggcccuagaaccaguaguaggagcagcuauagcugcaccuguagcaggccaacaaaauguaauagaucccuggauacguaacaacuuuguacaagcaccuggcggagaauuuacaguuucaccccgaaaugcuccuggugaaauauuauggucagccccuuuaggacccgacuuaaacccauaucuaucacaccuagcaagaauguacaacggauaugcaggcggauucgaaguucaaguaauucuagccggaaaugcauucacagcgggaaaaauaauuuuugcugcagucccaccaaauuuuccaacagaaggacuaucuccaucucaaguuacaauguuuccacauauaaucguagauguuagacaacuagaaccuguacuaaucccacuaccagacguuagaaacaauuucuaccauuauaaucaauccaacgauccaacaaucaaauuaauagcaaugcuuuauacacccuuaagagcaaauaacgcaggagaugauguauuuacaguaucaugucgaguacuaacaagaccaucuccugacuuugauuuuaucuuucuuguaccucccacaguagaaucuagaacaaaaccuuucaguguuccagucuuaacaguagaagaaaugacaaacucuagauuuccaauaccauuagaaaaacuauuuacaggaccauccucagcuuucguaguucaaccacaaaauggcagauguacaacugauggaguacuacucggaacaacacaacuuuccccugucaacauauguaccuuuagaggagacguuacccacauuccaggaaguagaaacuauacuaugaauuuagcuucacaaaacuggaauucauacgauccaacugaagaaaucccagcaccuuuaggcacaccagacuuuguaggcaaaauucaaggugucuuaacacaaacaacacgaacaaauggauccacaagaggacauaaagcaacuguauacacaggauccgcagauuuuuccccaaaauuaggaagaguacaauucgcuacagauacagauaaugauuucgaaacaaaucaaaauacaaaauuuacaccaguaggaguaauacaagacgguuccacuacuccacguaaugaaccucaacaauggguauuaccaucauauucaggacgaaacauacacaacguacacuuagcaccagcagucgcaccuacauuccccggagaacaacuauuauucuuuagaucaacaaugcccggaugcuccggauauccaaauauggaccuagacugucuuuuaccucaagaauggguacaauauuucuaccaagaagcagccccagcacaaucagacguagcgcuacuacguuuuguaaauccagauacaggaagaguacuuuucgaauguaaacuacauaaauccggcuacgucacaguagcucacacaggucaacacgauuuaguaauaccaccaaauggcuauuuuagauucgauuccuggguuaaucaauucuacacacuagcaccaaugggaaaugguacaggaagaagaagagcauuauaa

SEQ ID NO: 31098 - RNA, 1608 nt, Artificial Sequence
  derived and/or modified sequence opt6 from capsid_protein_VP1__Norovirus__AII02605
augaaaauggccucuaacgacgcagcaccaagcaacgauggcgccgcaggacuaguaccagaaguaaauaacgaaaccauggcacuagaaccaguagcaggagcaucaauagcagcaccauuaacuggacaaaauaauguaauagauccuuggauuagauuaaacuuuguacaagccccaaauggagaauucacaguaucaccaagaaacaguccaggagaaguauuauuaaaucucgaacuugguccugaauuaaauccauacuuagcacacuuaucacgcauguacaauggauaugcaggcgguguagaaguacaagucuugcuugcugguaacgcauuuacugcagguaaacuaguauucgcagcuguacccccacacuuuccucuugaaaacauuucaccaggccaaauaacaauguucccucauguuauaauagacguacgaacucucgaaccaguacuauuaccauuaccagauguaagaaacaacuuuuuccacuauaaccaacaaaacgaaccacgaaugagacuaguagcaauguuauauacaccacuaagaucaaauggauccggugaugacguauucacaguaucaugccgaguacuaacaagaccuucuccagacuucgauuucaauuacuuagucccaccaacaguagaaucaaaaacaaaaccauucacacuaccaauacuaacuauaggagaauuaacaaauuccagauucccaguaccuauagaugaauuauauacuucuccuaacgaaagccucguaguacaaccacaaaauggaagaugugcauuagacggagaacuccaaggaacaacacaacuacuaccaacagcaaucuguucuuuccguggaagaauuaaucaaaaaguaagcggagaaaaucaugucuggaacaugcaaguaacaaauauaaauggaacacccuuugacccaacugaagauguaccagcgcccuuaggaacuccagauuucucuggaaaacuuuucggcguauuaucacagagagaucaugauaacgcauguagaucacacgacgcaguaaucgcuacaaauucagcaaaauuuacuccaaaacuaggagcaauccaaauaggaaccugggaacaagaugauguacauauuaaucaaccaacaaaauuuacacccgucgggcuuuucgaaucugaaggcuuuaaccaauggacauuaccaaacuacucaggagcacucacauuaaauaugggauuagcaccacccguagcaccaaccuuuccaggcgaacaaauacuauuuuuccgaagccacauaccccuaaaaggagguguagcagacccagucauagacugccuacucccucaagaauggauacaacacuuauaucaagaguccgcacccagucaaacagacguagcauuaauacgauuuacaaauccagacacaggccgaguauuauuugaagcaaaauuacacagauccgguuauauaacaguugcaaauacaggauccagaccuauaguaguuccagcaaacggauacuucagauucgauagcuggguaaaucaauuuuacucacuagcuccaaugggaaccgguaauggacgacgaagaguacaauaa

SEQ ID NO: 31099 - RNA, 1647 nt, Artificial Sequence
  derived and/or modified sequence opt6 from capsid_protein_VP1__Norovirus__AII02608
augaaaauggcaucaaaugacgccgcaccuagcaaugauggugcagcuggauuaguaccagaaauaaacucagaagcaauggcacuagaacccguagcaggcgcagcaauagcagcaccacuaacaggccaacaaaauauaauugauccauggauaaugaauaacuuuguacaagccccuggaggcgaauucaccguuucaccaagaaauucaccaggagaaguauuacuaaaccuagaacuagguccagaaauaaacccauaucuagcccaucuugcccgaauguacaacggauacgcaggaggcuuugaagugcaaguuguuuuagcagguaaugcauuuacagcaggaaaaauaauauucgcugcaauaccaccaaacuuucccauagacaauuuaucagcagcccaaauaacuauguguccacacguaauaguugacguuagacaacuagaaccgguaaacuuaccuaugcccgauguaagaaacaacuucuuccauuauaaucaaggaucagacucuagacucaggcuuauagcaauguuauacacuccauuacgagcaaauaauucuggagacgaugucuucacaguaucaugcagaguguuaacacgaccaucaccagauuuuucauuuaacuuuuuaguaccuccuacaguugaaucaaaaacuaaaccauucucacuaccaauacuaacuauaucagaaaugucuaacucacgauuuccaguuccaauagacagucuacacacaucaccaacagaaaauauaguaguacaaugccaaaacggaagagucacauuagauggagaauuaauggguacaacacaacucuuacccucucaaauuugcgcauucagaggaauguuaacacgaucaaccucaagagcaagugaucaagccgauacagcaaccccuagacuauucaacuacuauuggcauauacaacuagacaaucuaaacggaacaccuuacgacccugcugaagauauucccggaccacuaggaacuccugacuucagaggaaaagucuucggaguugcaucucaaagaaauccagacgcaacaacacgcgcacaugaagcaaaaauagacacaacaucaggacgauuuacaccuaaacucggaucacuagaaauauccacagaauccggugacuuugaucaaaaucaaccaacaagauuuacaccaguagguauaggaguagaucaugaagccgauuuacaacaauggacauuaccugacuacgccggacaauuuacacacaacaugaacuuagcaccagcaguugcaccuaacuuccccggagaacaauuacucuuuuuccgcucucaacuuccaucaagcggaggccgaagcaacggcauacucgacugcuuaguuccucaagaauggguacaacauuucuaucaagaaucagcaccuucacaaacucaagucgcauuaguacguuacgucaacccugacacaggccgaguauuauucgaagcaaaacuacauaaacuaggauucaugacaaucgcaaaaucaggugauucaccuauaacaguaccaccaaauggauauuucagguucgaaucauggguaaauccauucuauacacuagcaccuaugggaacaggaaauggacguagaagaauacaauaa

SEQ ID NO: 31100 - RNA, 1623 nt, Artificial Sequence
  derived and/or modified sequence opt6 from capsid_protein_VP1__Norovirus__AII02614
augaaaauggcaucaaaugaugcaaacccaucagauggaucugcagcaaacuuaguccccgaaguaucaaaugaaguuauggcacuagaaccaguaguaggugcagcaauagcugcaccagucgcaggacaacaaaauguuaucgacccauggaucagaaacaacuucguacaagccccaggaggagaauuuacaguaucuccacgaaaugcaccaggagaaauacucuggucugcaccuuuaggccccgaccuaaauccauauuuaucucaucuagcaagaauguauaacggauaugccggaggauucgaaguacaaguaauacuagcaggaaacgcauucacagccgguaaaauaaucuucgccgcaguaccaccaaacuuuccaacagaaggacuaucaccaucccaaguaacaauguucccacacauaauaguagacguacgccaauuagaaccaguacuuauacccuuaccagauguacgaaauaauuuuuaccauuauaaucaaacuaaugacucuacaauaaaacuaauagcuaugcucuauacaccuuuaagagcaaauaacgccggugaagauguuuuuaccguguccuguagagucuuaacuagaccaucuccagacuucgacuuuauauuuuuaguuccaccaacaguagaaucaagaacaaaaccuuuuacugucccaauauuaacaguagaagaaaugacaaacucccgauuuccaauuccacucgaaaaacuauuuacaggaccaucaggagcauucguaguacaaccacaaaacggaagauguacaacagacggaguauuacuuggaacaacucaacuaucuccuguaaauauauguacauuuagaggcgauguaacacauauagcaggauccagaaauuacacuaugaaucuagcaucauuaaacuggaacaauuaugacccuacagaggaaauaccugcaccacuagguacaccagacuuuguaggaaaaauacaaggcguacuuacccaaacaacaaaaggagauggaucuaccagaggacacaaagcaacaguauauacaggaucagcaccauuuacaccaaaauuaggcucuguccaauucuccaccgauacagaaaacgauuucgaaacucaucaaaauacgaaauuuaccccaguaggaguaauacaagaugggucaacuacccacagaaacgaaccccaacaauggguccuaccuucauauucaggcagagauguacauaauguucaucuagcaccugcagucgcaccaacauuuccaggugaacaacuauuauuuuucagauccacaaugcccgguuguucaggauauccaaauauggauuuagauugccuauuaccccaagaauggguucaacauuucuaccaagaagcugcaccugcacaaucugacguagcauuacucagauuuguaaacccagauaccggcagaguuuuauuugaaugcaaauuacauaaauccggauaugucacuguagcacacaccggacaacaugaucuuguaauaccaccaaauggauauuuuagauucgauaguugggucaaccaauuuuacacauuagcuccaaugggaaacggcaccggaagaagaagagcauuauaa

SEQ ID NO: 31101 - RNA, 1653 nt, Artificial Sequence
  derived and/or modified sequence opt6 from capsid_protein_VP1__Norovirus__AII02623
augaaaauggcaucaaacgaugcuacaccaucuaaugacggagcagcaaacuuagucccagaagcaaacaaugaaguaauggcucuagaaccugucgucggagcaucaauagcagcaccaguaguaggacaacaaaauauaauagacccauggauacgagaaaacuuuguacaggccccucaaggagaauucaccgucucaccaagaaauucuccaggugaaaugcuacuaaacuuagaacuaggucccgaauuaaaucccuaucuaucacacuuauccagaauguacaauggauacgcaggaggaaugcaaguacagguuguacuagcaggaaacgcauucacugcuggaaaaauaauauucgcagcaguacccccucacuucccaguagauaauauaucugcagcgcaaauaacaaugugcccacacguaauaguagacguuagacaacuugaacccguacuacuucccuuaccagauauaagaaauagauucuuucacuauaaccaagaaaacaccccuagaaugagauuggucgccauguuauauacaccauuaagagcaaacucaggagaagacguauuuacagucucuugccgaguauugacaagaccagccccggacuucgaauucacuuucuuaguaccaccaacugucgaauccaaaacaaaaccauuuaccuuacccauacuuacacuuggagaauuaucaaacucaagauuuccagcagcaauagauauguuauauacagauccaaacgaaagcauaguaguacaaccccaaaauggaagguguacacuugacggaacacuacaaggaacaacucaauuaguacccacacaaauaugcgcauucagaggaacccuaaucucacaaacagcacgcgcagcagauucaacagacuucccccaacgagcaagaaaucacccauuacauguacaaguaaaaaauuuagacgguacucaauacgauccuacagacgauauaccagcaguacuaggagcaauagacuuuaaaggaaccguauuuggaguugcaucucaacgagauguaaguggaacucaagaacaaggacacuacgcaacacgagcacaugaagcacauauagauacaacagacccaaaauaugccccaaaacuaggaacgauuuuaauaaaauccgaaagcacugauuucaacacuaaccaaccaaucagauuuacuccaguaggaaugggagacaauaacuggaggcaaugggaacuaccagacuauagcggaucacuaacauuaaauaugaacuuagcaccggcaguaucaccuaguuuccccggagaaagaauacuauucuucagaucgaucguaccuucagcagguggcuauggcuccggauauauagauuguuuaauaccacaagaauggguucaacauuucuaucaagaagcagcaccaucucaaucagcaguagcccuaguaagauacguuaacccagauacaggacgaaacauuuuugaagcaaaacuucauagagaaggauuucuaacuguagcuaacaguggaaauaacccaauaguugucccaccaaauggauauuuuagauucgaagcauggguaaaccaauuuuauacuuuagcaccaaugggaucaggacaaggaagacgaagagcucaauaa

SEQ ID NO: 31102 - RNA, 1623 nt, Artificial Sequence
  derived and/or modified sequence opt6 from capsid_protein_VP1__Norovirus__AII02626
augaaaauggcuucaaaugaugcaaacccaucagacggaucagcagcaaauuuaguccccgaaguaucaaacgaagucauggcucuagaacccguaguaggcgcagcaauagcagcaccuguagcaggacaacaaaacguaauugacccauggauaagaaauaacuucguucaagcacccggaggagaauuuaccguaucaccuagaaaugcuccaggugaaauacuauggucagcgccauuaggcccagauuuaaauccuuaucuuagccaucuugcaagaauguauaauggauaugcuggcggauuugaaguccaaguaauuuuagcuggaaaugcauuuacagcaggcaaaauuauauuugcagcaguuccaccaaauuucccaacagaaggauuaucuccaucccaaguaacaauguucccgcauauuauaguugaugucagacaacuagaaccaguauuaauucccuuaccagauguaagaaacaacuucuaucacuauaaccaaacaaaugauucaacaaucaaacucauagcuaugcucuacacaccauuaagagcaaacaaugcaggcgaagacguuuuuacaguuucauguagaguacuaacacgaccauccccagacuuugauuucauauuuuuaguaccaccaacaguagaaucacgaacaaaaccauuuacaguacccauacuaaccguagaagaaaugacuaacagucgauuuccaauaccucuagagaaacucuuuacaggaccaucuggagcauucguaguacaaccacaaaauggaagaugcacuacugacggcguauuauuaggaacaacacaacuuucuccagucaauaucugcacauuuaggggagaugucacucacauagcuggaucacgaaauuacacaaugaauuuagcuucguuaaauuggaacaacuacgauccaacagaagaaauaccugcaccacuagguacaccagauuucguaggaaaaauucaagguguauuaacacaaaccacuaaaggagacggaucuacacguggacauaaagcaaccguauauacaggaagcgcucccuuuacaccaaaacuaggauccguucaauucucaaccgacacugaaaacgacuuugaaacacaucaaaacacaaaauucacuccaguagguguaauacaagacggaggaacaacacauagaaaugaaccucaacaauggguacuaccuucauacucuggucgagauguacauaauguacauuuagcaccugcaguagcaccaacauuuccaggagaacaacucuuauuuuuuagauccacaaugccaggaugcucuggauauccaaauauggaucuagacugcuuacuaccacaagaauggguacaacauuucuaucaagaagcagcaccagcccaaucagacguagcacuacuuagauuuguaaacccagacacagguagaguauuauucgaauguaaacuacauaaaaguggauauguaacaguagcucacacuggacaacacgaccucguuauaccaccaaacggauauuuuagauucgacucauggguaaaucaauuuuacacacuagcacccauggguaaugguacaggcagacgcagagcacuauaa

SEQ ID NO: 31103 - RNA, 1647 nt, Artificial Sequence
  derived and/or modified sequence opt6 from capsid_protein_VP1__Norovirus__AII02629
augaaaauggcuuccaaugaugcagcuccaucaaacgauggcgcagccggcuuagucccagaaauaaauucugaagcaauggccuuagaaccaguagcuggagccgcaauagcugcuccauuaacaggucaacaaaauauaauagauccuuggaucaugaauaauuucguacaagcaccagguggagaauuuacugucucuccaagaaauuccccuggagaaguacuccuaaaucucgaacuuggacccgaaauuaauccauaucuagcacaccuagcacgaauguacaauggauacgcuggagguuuugaaguccaaguaguacucgcaggaaaugcuuuuaccgcaggaaaaauaauauuugcugcaauacccccaaauuuuccaaucgacaaucuauccgccgcacaaauuacaauguguccacauguaauaguagaugucaggcaauuagaaccagucaaucuucccaugccagacguuagaaauaauuuuuuucauuacaaucaagguucagauucaagauuacggcuaaucgcuaugcuuuauaccccccuuagagccaauaauucaggagaugacgucuuuacaguuucauguagaguccuaacuagaccaucaccagauuucucauuuaauuuucuaguaccuccaaccguugaaucgaaaacaaaacccuucucacuaccaauacuaacaauuucagaaaugucaaauucaagauucccuguaccaauugacucucuccauacauccccuacugaaaacauaguaguacaaugucaaaauggcagaguaacauuagauggagaacuaaugggaacaacacaauuauuaccaucccaaauuugcgcauucagaggaauguuaacacgaucuacaaguagagcaucugaucaagccgauacugcuacuccacgauuauucaacuacuauuggcacauccaauuagacaacuuaaaugguacaccauaugacccagcagaagauaucccugguccacucggaacacccgacuuucgaggaaaaguauuuggaguagcuucacaaaggaaucccgaugcuacaacccgugcacacgaagcaaaaauagauacuacuucaggaagauuuacaccaaaauuaggaucacucgaaauauccacagaauccggagauuuugaucaaaaucaacccacaagauucacaccaguuggaauaggaguagaccaugaagccgauuuucaacaauggacacuaccagauuacgcaggccaauuuacacauaauaugaaccuagccccugcagucgcaccuaacuuuccuggagaacaauuauuauuuuuuagaucacaacuaccuucauccggaggcagaucaaacgguauauuagacugucuaguaccacaagaauggguacaacauuucuaucaagaaucagcaccaucacaaacacaaguugcauuaguuagauauguaaauccagacaccggaagaguucuauuugaagcaaaacuacacaaacuuggcuucaugacaaucgcaaaaucaggagacucaccuauaaccgugcccccuaauggauauuuuagauuugaaucauggguuaacccauuuuauacacuagccccaaugggaacagguaauggaagaagacgaauacaauaa

SEQ ID NO: 31104 - RNA, 1623 nt, Artificial Sequence
  derived and/or modified sequence opt6 from capsid_protein_VP1__Norovirus__AII02632
augaaaauggccucaaaugacgcuaauccaucagauggaagugccgcaaaucuaguaccagaaguaucaaacgaaguaauggcauuagaacccguaguaggagcagcaauugcagccccagucgcuggacaacaaaacguaauugaccccuggauaagaaauaauuuuguacaggcacccggaggugaauuuacaguaucaccucgcaaugcaccaggagaaauauuauggagugcaccuuuagguccagauuugaacccauauuuaucacacuuagcacguauguauaacgguuaugcuggaggauucgaaguuagaguaauacuagcaggaaaugcauuuacagcagguaaaauaauuuuugcugcaguccccccuaacuuuccaacagaagguuuaucuccaucacaaguuacuauguucccccacauaauuguagacguaagacaauuagaacccguauuaauuccauuaccagacguucgaaauaauuucuaucacuauaaucaaaccaacgauucuacaauaaaacuuauagcaaugcuauacacaccauuaagagcaaauaaugcuggcgaagauguauucacaguaucauguagaguucuaacaagaccauccccugacuucgacuuuauauuuuuaguaccaccaacaguagaaucaagaacaaaaccauucacaguccccauacuaacaguugaagaaaugacaaacucaagauuuccaauaccauuagaaaaacucuuuaccggaccaucaggagcauuuguaguucaaccccaaaacggacgaugcacaaccgacggaguauuacuagguacaacacaacuaucaccaguaaauaucuguacauuuagaggagauguuacgcauauagcuggaucccgaaauuacaccaugaaccuagcaucacuaaacuggaacaauuacgacccaacagaagaaauaccagcaccacucgguacaccagacuuuguaggaaaaauucaaggaguacuaacacaaacuacaaagggagacggaucaaccagaggucauaaagcuacaguuuauacagguucagcaccauuuacuccaaaauuaggaucaguacaauuuucuaccgacacagaaaaugauuuugaaacucaucaaaacacaaaauucacuccaguaggaguuauccaagacggaggaacuacacauagaaaugaaccacaacaaugggucuuacccucauauucaggaagagauguacauaacguccacuuagcaccagcaguagcaccuacauuuccaggagaacaacuauuauucuucagaagcacaaugccaggauguucugguuauccaaauauggaccuagacugccuacuaccccaagaauggguacaacacuucuaucaagaagcagcaccagcacaaucagacguggcucuccuacgcuuuguaaacccagauacuggaagaguucuauucgaaugcaaauuacauaaaucuggcuaugucacaguagcacauacaggacaacacgauuuaguaauacccccaaaugguuauuuuagauucgacucaugggucaaccaauuuuacacacuugcaccaaugggaaauggaacaggaagacgaagagcuuuauaa

SEQ ID NO: 31105 - RNA, 1623 nt, Artificial Sequence
  derived and/or modified sequence opt6 from capsid_protein_VP1__Norovirus__AII02635
augaaaauggcaagcaaugaugcuaauccaagcgacggaucagcagcaaacuuaguaccagaaguaucaaacgaaguaauggcacuagaaccaguaguaggagcagccauagcugcaccagucgcaggacagcaaaauguaaucgacccauggauacgaaauaacuuuguacaagcuccaggcggugaauucacaguuucacccagaaacgccccaggcgaaauauuauggucagcaccucuagguccugaucuaaacccauaucuuucccaucucgcaaggauguauaacggauacgccggaggauucgaaguacaaguaauccuagcaggcaaugccuuuacagcaggaaaaauaauauucgcugcaguacccccaaacuuuccuacagaaggacuaucaccaucacaaguaacaauguuuccacauauaaucgucgauguaagacaacuugaaccaguucuuauacccuuaccagauguuagaaacaauuucuaucacuauaaccaaacaaaugacucaacaauaaaauuaauagcaauguuauacacuccccuacgugcaaacaaugcaggcgaagauguauuuacaguaucauguagaguacuaacacgaccaucaccugauuuugacuuuauauuucuuguaccaccaacaguagaaaguagaaccaaaccauuuacaguaccuauauuaacagucgaagaaaugacaaacucaagauucccaauaccauuagaaaaacuuuuuacaggaccaucaggcgcauucguaguucaaccacaaaauggaagauguacaacagacgguguuuuacuaggaacaacacaacuaucaccaguuaauaucuguaccuuccgaggagauguuacacauauagcaggaucaagaaacuacacaaugaaccuagcaucauuaaauuggaacaauuacgacccaacagaagaaauaccggcaccacuagguaccccagauuucgucggaaaaauucaaggaguauuaacacaaacaaccaaaggagacggaucaacaagaggacacaaagcaacagucuacacaggauccgcacccuuuaccccaaaacuaggaucaguacaauucucuacugauacagaaaacgacuucgaaacacaucaaaauaccaaauucaccccaguaggaguaauacaagaugguggaacaacucaucgcaacgaaccucaacaauggguacuaccaucauauagcgguagagacguacauaauguacaccuagcuccagcaguagcaccaacauuuccaggugaacaacuucucuuuuuccgaucaacaaugccaggcuguucuggauauccuaacauggauuuagauugcuuacuaccacaagaauggguacaacauuuuuaucaagaagcagcucccgcacaaucugacguagcauuacuaagauuuguuaacccugacaccgguaggguacuauucgaauguaaacuccauaaaucaggcuacguaacuguugcucacaccggacaacacgacuuaguaaucccaccuaauggauauuucagauuugauucauggguaaaucaauuuuauacucuagcaccuaugggaaacgguacuggccgaagaagagcauuauaa

SEQ ID NO: 31106 - RNA, 1608 nt, Artificial Sequence
  derived and/or modified sequence opt6 from capsid_protein_VP1__Norovirus__AII02638
augaaaauggcaucaaaugaugcagcuccaucaaaugauggagcagccggcuuaguuccagaaguuaauaaugaaacaauggcacuagaaccaguagcaggugcaaguauagcugcaccauuaacaggccaaaauaauguaauagacccauggauaagacuaaauuucguacaagccccaaauggcgaauucaccguaucaccaagaaauucaccaggagaaguacuuuuaaacuuagaauuaggaccagaacugaacccuuacuuagcacauuuaucccgaauguacaauggauaugcaggagguguagaaguacaaguauuauuagcagguaaugcauucacagcagguaaauuaguauuugcagcaguaccaccacauuuuccauuagaaaacauauccccaggacaaauaacaauguuuccucacguaauaauugacguucgaacucuagaaccaguacucuuaccacucccagacguacgaaauaacuucuuccacuauaaucaacaaaacgaaccaagaaugaggcucguugcaaugcuauauacaccacucagauccaauggaucaggagaugacguauucacaguaagcugcagaguacuuacaagaccaucacccgauuuugacuuuaacuaccuaguaccaccaacuguagaaucaaaaacaaaaccauucacauuaccaauauuaaccauaggcgaacuaacaaauagucgauuuccagucccaauagaugagcuauacacuucaccaaaugaaagcuuaguaguacaaccacaaaacggcagaugcgcuuuagacggagaacuucaaggaacaacccaacuacuaccaacagccaucuguucauucaggggaagaauaaaucaaaaagucucaggagaaaaccauguauggaacaugcaaguuacaaauauuaauggaacacccuucgauccaacugaagaugugcccgcaccauuaggaaccccagauuucucaggaaaacuuuuuggcguacucucucaaagagaccaugacaaugcaugcagaucacaugaugcaguaauugcaaccaacuccgcgaaauucacaccuaaacuaggagcaauacaaauaggaacaugggaacaagacgauguacauauuaaucaacccacuaaauucacuccaguaggauuauucgaaucagaaggauucaaucaauggacucuacccaauuauagcggcgccuuaacacugaacaugggacuagcaccaccaguagcuccaacauucccaggcgaacaaauucucuucuuuagaagccacauucccuuaaaaggaggcguagcagaccccguaauagauugcuuguuaccacaagaauggauucaacaccuauaucaagaauccgcaccaucacaaaccgauguagcccucauccgauucacaaacccagacacaggacgaguauuauucgaagcaaaacuacaucgaucaggauauauaacaguugcaaauacuggcucacguccaauaguaguaccagcaaauggauauuuuagauucgauuccugggucaaucaauucuacucacuugcaccaaugggaacaggaaauggaagaagacgaguccaauaa

SEQ ID NO: 31107 - RNA, 1623 nt, Artificial Sequence
  derived and/or modified sequence opt6 from capsid_protein_VP1__Norovirus__AII02641
augaaaauggcuagcaacgacgcuaacccaucagauggaucagcagcaaaccuaguaccagaaguaucaaaugaaguaauggcacuagaaccaguaguaggugcugccauagccgcaccuguagcaggacaacaaaauguaauugacccuuggauacguaauaauuucguccaagcaccaggcggagaauuuacagucucaccacgaaaugcaccaggcgaaauacuuuggucagcaccuuuaggaccagaucucaauccauauuuaucacaucuugcaagaauguacaacggauaugcuggaggauucgaaguacaagucauacucgcagguaacgcauucacugcaggaaaaaucauauuugcagccguaccaccuaauuuuccaacggaaggauuaucacccucacaaguaacaauguuuccucacauaauuguagauguacgucaacuagaaccaguacuaauucccuuaccagacguaagaaacaauuuuuaucauuauaaccaaacaaaugacucaacaauaaaauuaauagcaaugcuauauacaccuuuaagagcaaacaaugccggcgaagauguauucacaguaucaugccgaguucuaacacgaccauccccagauuuugauuuuaucuuuuuaguaccaccaacaguagaaucacgaacuaaacccuucacuguaccaaucuuaacagucgaagaaaugaccaacucaagauuuccaauccccuuagaaaaacuauuuaccgguccuucaggagcauuuguaguacaaccacaaaacggaagaugcacaacagacggaguacuucuaggaacaacucaacuauccccagucaauaucuguacauuuagaggagauguuacccauauagcaggaaguagaaacuacacuaugaaucuagcaucauuaaacuggaacaauuacgauccaacagaagaaauaccagcuccacuuggaacuccagauuuuguaggaaaaauucaaggaguuuuaacccaaacuaccaaaggagacggaucaacacguggccauaaagcaacugucuacacaggaucagcuccauuuacuccaaaacuaggaucuguccaauucucgacagauacugaaaacgauuucgaaacacaccaaaacacaaaauucacaccagucggaguaauccaagacggcggaacaacacauagaaacgaaccacaacaauggguauuaccaucauauucaggaagagauguacauaauguacacuuagcuccagcagucgcacccacauucccuggagaacaacuauuauucuuuagaucaacaaugccaggauguucaggcuacccaaacauggaccuagauugucuuuuaccacaagaauggguucaacacuuuuaucaagaagccgcacccgcucaaucagacguagcauuauuaagauucguaaacccagacacaggcagaguucucuucgaauguaaacuacacaaaucagguuaugucacaguagcacacacaggccaacacgauuuaguaauacccccaaauggauauuuuagauucgauaguuggguaaaccaauucuacacauuagcaccaaugggaaauggaacuggaagacgacgagcacuauaa

SEQ ID NO: 31108 - RNA, 1647 nt, Artificial Sequence
  derived and/or modified sequence opt6 from capsid_protein_VP1__Norovirus__AII02644
augaaaauggccucaaaugacgcagcucccucaaaugacggugcagcaggauuaguuccagaaauaaacucagaagcaauggcauuagaaccugucgcaggcgcagcaauugcagcaccacuuacuggacaacaaaauauaauagauccauggauaaugaauaacuucguacaagcaccaggaggugaauuuacaguuucacccagaaacucaccaggagaaguacuacuuaacuuagaacuaggcccagaaaucaauccauaccuagcacacuuagcaagaauguacaacgguuaugcaggaggauuugaaguacaaguaguccuagcuggcaaugcauuuaccgcuggaaaaauaauuuucgcagcaauaccuccuaauuuuccuauagacaacuuauccgcagcacaaauuacaauguguccacauguaauaguagacguaagacaacucgaaccaguaaaccuaccuaugcccgauguaagaaauaauuuuuuucacuacaaucaaggaucugauucaagacuacgucuaauugcaaugcuauauacaccucuaagagcaaauaauucuggcgaugacguauucaccguuuccuguagaguacuaacaagaccgucaccagacuuuucuuuuaauuuccuuguuccaccuaccguagaauccaaaacaaaacccuucagcuuaccaauauuaacaauuucagaaaugaguaacucccgauucccaguaccuauagauuccuuacacacuucaccaacagaaaacauagucguacaaugucaaaauggaagaguaacucuugauggagaacuaaugggaacaacccaacuauuaccuucucaaaucugcgcauuccgaggaauguuaacaagaucaacuucacgcgcaucagaucaagcagauacagcaacuccccgacuauucaacuauuacuggcauauacaacucgacaaccuaaaugguacaccuuaugaucccgcugaagacauaccagguccacuaggcacacccgauuucagaggaaaaguauuuggaguagccucacaaagaaauccagaugcaacaacaagagcacaugaagcuaaaauagauacaacaucaggaagauucacaccaaaacuaggauccuuagaaauuuccacugaaucaggagauuuugaccaaaaucagccaacuagauucacacccguaggaauaggaguagaucaugaagcagauuuucaacaauggacauuaccagauuacgcuggacaauucacacauaauaugaaucuagcaccagccguugcgcccaacuucccaggagaacaauuauuauuuuuccgaucccaacuaccuuccucaggcgguagaucaaacggaauauuagacuguuuaguaccacaggaauggguucaacacuuuuaccaagaaucagcaccgucacaaacacagguagcacuaguucgauauguuaaucccgacaccgguagaguauuauucgaagccaaauuacauaaauuaggauucaugaccauagccaaaucuggagacucaccaauaaccguaccacccaauggauauuuuagauuugaauccuggguuaauccuuuuuauacccuagcuccaauggguacaggaaaugguaggagaagaauacaauaa

SEQ ID NO: 31109 - RNA, 1623 nt, Artificial Sequence
  derived and/or modified sequence opt6 from capsid_protein_VP1__Norovirus__AII02647
augaaaauggcauccaacgaugcaaacccaucagauggaagcgcagccaaccuaguaccagaagucucuaaugaaguuauggccuuagaacccguaguaggugccgccauagcagcaccaguagcuggacaacaaaacguaauugauccauggauacgaaauaacuuuguacaagcuccaggaggcgaauuuacuguaucaccacgaaacgcaccaggagaaauauuauggucagcaccauuaggaccugauuuaaacccauaucuaucacauuuagcaagaauguauaacggauaugcuggaggauucgaaguucaaguaauuuuagcaggaaaugcguucacagcaggcaaaauaaucuucgcugcaguuccuccuaauuucccaacagaaggacucuccccaagccaaguuaccauguucccacauaucaucguagacguuagacaauuagaaccaguccuuauaccuuuacccgauguaagaaacaauuucuaccacuauaaccaaacaaacgauucaacaauaaaguuaauagccauguuauacacaccuuuaagagcaaauaaugcaggagaagauguauuuacaguaucaugcagagucuuaacacgaccuuccccugauuuugacuucauuuuccuaguaccaccaacaguagaaucccgaacaaaacccuuuaccguaccaauauuaacaguagaagaaaugacaaacucaagauuuccaauaccucuagaaaaacuauuuaccggaccaaguggagccuuugucguacaaccacaaaacggcagauguacaacagacgguguuuuauuaggcacuacacaauuauccccuguaaauauaugcacauuuagaggagacgucacccacauagccggcucaagaaauuauacaaugaaucuugccucacuaaauuggaacaauuacgaccccacagaagaaauaccugcaccauuagguaccccugacuuuguaggaaaaauacaaggaguauuaacccaaaccacaaaaggugacggcucaacacgaggucauaaagcuacugucuauaccgguucugcaccauucacacccaaacuaggaucaguacaauucucuacagauacugaaaacgauuuugaaacacaccaaaacacaaaauucacuccagucggagucauacaagacggaggcacaacacauagaaaugaaccccaacaaugggcacuaccaagcuacuccggaagggauguacauaauguacaucuugcccccgccguagcaccaacauuuccaggagaacaacuauuauucuuucgaucaacaaugccagguuguucaggauauccaaauauggaucuugauugucuauuaccacaagaauggguacaacauuucuaucaagaagcugcuccggcucaaucagacgucgccuuauuaagauucguuaaucccgacacuggaagaguacuauuugaauguaaauuacauaaauccggauauguaacaguugcacacacuggccaacacgaucuaguaauaccuccaaacggauauuuuagguuugauucuuggguuaaccaauuuuacacacuagcucccaugggaaauggaacaggaagacgaagagcacuauaa

SEQ ID NO: 31110 - RNA, 1623 nt, Artificial Sequence
  derived and/or modified sequence opt6 from capsid_protein_VP1__Norovirus__AII02650
augaaaauggcaucaagcgaugccaacccaucagauggaucaacugcaaaccuaguacccgaaguaaacaaugaaguaauggcauuagaacccguaguaggagccgcaauagcagcaccuguugcaggacaacaaaauguuauugacccauggauaagaaauaauuuuguccaagcaccaggaggugaauuuacagucuccccaagaaacgcaccaggagaaauacuuuggucagcaccucuuggaccagaccuuaacccauauuuaucccacuuagcacgaauguauaacggauaugcaggaggcuucgaaguacaaguuauuuuagcaggaaaugcauuuacagcuggaaagauaauauuugcugcaguaccaccuaauuuucccacagaagguuuaucacccucacaaguaacuauguuuccacauauaauaguagacguuagacaauuagagccaguucuaaucccacuacccgacguacgaaacaacuuuuaucacuacaaccaaucaaaugacccuacaaucaaauuaauagcaauguuauacacaccauuaagagcuaauaaugcaggagacgaugucuuuaccgucucaugucguguucuaacaagaccuagcccagauuucgacuuuauuuuccuaguacccccaacaguugaaucuaggacaaaaccauuuucaguaccagucuuaacuguagaagaaaugacaaauucaagauuuccaauuccacucgaaaaacuauucacuggacccucaucagcauucgucguccaaccacaaaauggucgaugcacaacagauggaguacuacuaggcacaacacaacucucacccguaaauauaugcacauuuagaggagacguaacacauauaccaggaucuagaaauuacacaaugaaucucgccagucaaaacuggaacucauacgauccaacugaagaaauaccagcaccucuaggaacaccagacuuuguagguaaaauacaaggaguacucacacaaaccacacgaacaaauggcucaacucguggacacaaagcaacaguauacaccgguucagcagacuuuuccccgaaauuaggacguguacaauuugccacugauacagacaacgauuucgaaacuaaccaaaauacaaaauucaccccaguugguguaauccaagacgguuccacaacuccaagaaaugaaccucaacaauggguuuuacccucauauucagguagaaauauacauaauguacacuuagcacccgcaguugcaccuacauuuccuggagaacaacuauuauuuuuccgaucaacaaugccuggaugcucaggcuauccaaauauggaucuagauugccuauuaccacaagaauggguccaauauuuuuaccaagaagcagcuccugcccagucagauguugcacuuuuaagauucguuaacccagacacaggccgaguauuauuugaaugcaaauuacauaaaucaggauauguaacuguagcacacaccggccaacacgauuuaguaauaccacccaacggauacuucagauuugauucaugggucaaucaauuuuacacucuugcaccaaugggaaauggaacaggccguagaagagcacucuaa

SEQ ID NO: 31111 - RNA, 1623 nt, Artificial Sequence
  derived and/or modified sequence opt6 from capsid_protein_VP1__Norovirus__AII02653
augaaaauggcaucaaaugacgcuaacccaucagauggcucagcagcaaaccuagucccagaaguuuccaacgaaguaauggcccuagaaccaguaguaggugcugcuauagcugcaccaguagcuggacaacaaaauguaaucgauccauggauaaggaauaauuuuguacaagcaccaggaggagaauuuacgguaucacccagaaaugcuccuggagaaauauuauggucagccccacuaggacccgacuuaaaucccuaucuuucucacuuagcaagaauguauaauggauaugcagguggguucgaaguacagguaauauuagcaggcaaugcauucacagccggcaaaauaauauucgcagccguaccaccuaacuuucccacagaaggucuuucaccaucacaagucaccauguuuccacacauuauaguagacguaagacaauuagaacccguacuaauaccauuacccgacgucagaaauaacuuuuaucauuauaaccaaacaaaugauucuaccauuaaacuaaucgcuauguuauauacaccucuaagagcuaauaaugcaggagaagauguauucacaguuucauguagaguacuaacaagaccaucaccagauuucgacuuuauauuucuaguaccaccaacaguugaaucuagaacuaaaccauuuacaguaccaauacuaaccguagaagaaaugacgaacucuagauuuccaauaccauuagaaaaauuauuuacuggaccaagcggagcuuucguaguccaaccacaaaauggaagaugcacaacagacggaguuuuauuaggaacaacacaacuauccccaguaaauauauguacauuuagaggugacguaacacauaucgcaggaucaagaaauuacacaaugaaccuagcauccuuaaacuggaauaauuaugauccaacagaagaaauacccgcaccacuaggaacaccagauuucguagguaaaauccaaggaguauuaacacaaacaacaaaaggagacggcucaacaagaggacauaaagcaacaguuuauacagguuccgccccuuuuacaccaaaacuuggaucaguacaauucuccacagauacagaaaacgauuuugaaacacaucaaaacacaaaauucaccccaguagguguaauucaagacggagguacaacacaucguaaugaaccacaacaauggguacuaccuucauacucaggacgagauguucauaacguucacuuagcaccggcaguugcuccaacauuuccaggagaacaacuauuauucuuuagaaguacaaugccaggcuguucaggauauccaaacauggaucuagacugcuuauuaccucaagaauggguacaacauuucuaucaagaagcagcaccagcacaaucagacgccgcauuacuaagauucguaaauccugauacagguagaguauuauucgagugcaaacuacacaaaucaggauaugucacagucgcacacacaggucaacacgauuuaguaauaccaccaaauggcuacuuuagauuugauuccuggguaaaucaauucuacacauuagcaccaauggguaacggaacugguagaagacgcgcauuauaa

SEQ ID NO: 31112 - RNA, 1647 nt, Artificial Sequence
  derived and/or modified sequence opt6 from capsid_protein_VP1__Norovirus__AII02656
augaaaauggcaaguaacgaugcugccccaucaaaugacggcgcugcaggacuagucccagaaauaaacucagaagcaauggcacuagaaccuguagcaggcgcagcuauagcagcaccacuaacaggacaacaaaauauaauagauccauggauuaugaauaauuucguucaagcaccaggaggcgaauuuacaguauccccaagaaauucuccaggagaaguucuauuaaauuuagaauuaggucccgaaauaaacccuuaccuugcacaccuagcacgaauguacaacgguuacgcugguggauuugaaguacaaguaguauuagcaggaaaugcauuuacagcaggaaaaaucauauuugccgcaaucccaccaaacuuuccaauagauaacuuaucagccgcacaaaucacaaugugcccacacguaauaguagauguaagacaacuugaaccuguaaaucuaccaaugccagacguuagaaacaauuuuuuucauuauaaucaaggauccgauucaagacuuagacuaauagcaaugcuauacacaccacuuagagcaaacaacucaggagaugauguauucacaguaaguugucguguauuaacaagaccaucaccagauuuuucuuucaauuucuuaguuccaccaacaguugaaucaaaaacaaaaccauuuucauuaccaauacuaacaauaucagaaaugucaaauucacgauuucccguaccaauagauucucuucauaccagcccaacagaaaacauaguaguacaaugucaaaacggcagagucacacuagacggcgaauuaaugggaacaacucaauuauuaccaucacaaauaugcgcauucagaggaaugcuaacucgcucaacuaguagagcaucagaccaagcagacaccgcaacaccucgacuauuuaacuauuauuggcacauacaacuggauaacuuaaacgggacuccauaugauccagcagaagauauaccuggcccccucggcacuccagacuuuagagguaaaguuuucggagucgcaucacaaagaaacccugacgcaacaacuagagcccacgaagcaaaaauagauaccacaucagguagauucaccccuaaauuaggaucuuuagaaauaucuaccgaaucaggugacuuugaucaaaaccaaccaacaagauuuaccccaguaggcauugguguagaccacgaagcagauuuccaacaauggacuuuaccagacuacgcaggccaauucacccacaauaugaacuuagccccagcaguugcaccaaacuucccuggagaacaguuauuauuuuuuagaucacaacucccaagcaguggaggaagauccaacgguauauuagauugcuuaguuccucaagaauggguucaacauuuuuaccaagaaucugcaccaagucaaacccaaguagccuuaguuagauacgucaauccagauacaggaagagucuuauuugaagcuaaauuacauaaacuaggauuuaugacaauagcuaaaucaggagacucuccaauaacaguuccacccaaugguuacuuucgauucgaaucuuggguaaauccguuuuauaccuuagcuccaaugggaacaggaaacggaagacgaagaauacaauaa

SEQ ID NO: 31113 - RNA, 1623 nt, Artificial Sequence
  derived and/or modified sequence opt6 from capsid_protein_VP1__Norovirus__AII02659
augaaaauggcaucaaaugacgccaauccaucugacggaucagcagcaaauuuaguuccugaaguaucuaaugagguuauggcacuugaaccaguuguaggagcagcaauugcugcaccagucgcaggacaacaaaauguaauagaucccuggauaagaaauaacuuuguacaagcaccagguggagaauuuacuguauccccaagaaacgcuccaggcgaaauacuauggucagcaccucucggaccagaccuaaauccauauuuaucacauuuagcaagaauguauaacggauacgcagguggauucgaaguucaaguaauacuagcaggcaaugcauuuacagcaggaaaaauaauauuugcugccguaccaccaaacuuuccaacagaaggacuaucaccaagccaaguaaccauguuuccacacauuaucguugauguaagacaauuagaaccaguccuaauacccuuaccugauguaagaaauaauuucuaccauuauaaucaaacaaaugacucaacaaucaaauuaauagcaauguuauacacaccucuaagagcaaauaacgcuggagaagacgucuuuacuguaucauguagaguccuaacacgacccagcccugauuuugauuuuauauuuuuagucccaccaacaguagaaucucgcacaaaaccuuucacaguuccaauacuuacuguagaagaaaugacaaacagucguuuuccaauaccuuuagaaaaacucuuuacuggaccuagcggagcauuugucguacaaccucaaaacggaagauguacaacagauggaguauuauuaggaacaacacaauuauccccuguaaacauauguacuuuucgaggugacguuacacauauagcaggauccagaaauuauacaaugaaucuugcaucacuaaauuggaacaacuaugauccaacagaagaaauaccagcuccacucggcacaccagauuucguuggaaaaauccaaggaguacuaacccaaacaacaaaaggagacgguuccacaagaggacauaaagcaacaguauauaccggaucagcuccauucacgccuaaauuaggcuccguucaauucucaacugacaccgaaaacgauuuugaaacucaucaaaacacaaaauucacaccaguaggcguaauacaagauggcggaacaacacacagaaaugaaccacaacaauggguauuaccaucuuauagcggcagagauguacauaauguacauuuagcaccagcaguagcaccaacauuuccaggagaacaacuacuauucuuccgaucaaccaugccaggauguucaggauauccaaauauggauuuagacugcuuauuaccccaagaauggguccaacacuuuuaucaagaagcagcaccagcacaaucagauguagcauuacuccgauuuguuaaucccgacacugguagaguccuauucgaauguaaacuacauaaaucagguuauguaacaguugcacacacaggacaacacgaccuaguaauaccccccaaugguuauuuucgauucgauucauggguaaaccaauucuacacauuagcuccuaugggaaauggaacugguagaagaagagcacuuuaa

SEQ ID NO: 31114 - RNA, 1647 nt, Artificial Sequence
  derived and/or modified sequence opt6 from capsid_protein_VP1__Norovirus__AII02662
augaaaauggcaucuaaugacgcugcaccaucaaacgacggugcagccgguuuaguaccagaaauaaacagugaagcaauggcccucgaacccguugcaggagccgcaauagcagccccauuaacaggucaacaaaauauaaucgauccauggauaaugaauaacuucguucaagcaccaggaggugaauuuacaguuucaccccguaauucaccuggagaaguauuacuuaacuuagaacuaggcccugagauaaauccauacuuagcacauuuagcacgcauguacaacggguacgcaggaggauuugaaguacaagucguucuagcaggaaaugcauuuaccgcaggaaaaauaauauuugcugcaauaccaccaaacuucccuaucgacaauuuauccgcagcccaaauaacaauguguccacauguaaucguagauguaagacaauuagaaccagucaauuuaccaaugccagauguacgaaauaauuuuuuccauuauaaucaaggaucugauucaagacucagauuaauagccauguuauacacaccacuaagagcuaauaacucgggagacgauguuuucacagucuccuguagaguauuaacaagaccaucaccagacuuuucuuucaauuucuuaguacccccuacaguagaaucaaaaacaaaaccuuuuucacuaccaauccuaaccaucucagaaauguccaauuccagauucccaguacccaucgacucauuacauacaucacccacagaaaacauagucguacaaugccaaaacggacgaguaacacuagacggagaacuaauggguacuacacaauuauuaccuucucaaaucugugcuuuuaggggaauguuaacuagaucaacaucaagagcaucagaccaagccgacacagcaacaccuagauuauuuaauuacuacuggcacauccaacuugauaaccuuaacggaacuccuuaugauccagcagaagauauaccaggaccacucgguacccccgacuuccgagguaaagucuucgguguugcuucacaaaggaauccagaugcaacaacacgagcucacgaagcaaaaauagacaccacaucaggaagauuuacaccaaaacuagguucacuagaaauuucuaccgaaucuggugauuuugaucaaaaucaaccaacaagauuuacuccaguugguaucggaguagaccaugaagcagauuuucaacaauggacccucccagauuaugcaggacaauucacucacaauaugaauuuagcacccgcagucgcuccaaacuuuccaggagaacaacuuuuauucuuuagaucacaauuaccaucuucaggaggacgaucaaauggaauauuagacugccuuguaccacaggaauggguacaacauuuuuaccaagaauccgcaccuucacaaacacaaguagcucuagucagauacguaaaucccgacacaggaagaguuuuauuugaagcaaaauuacacaaauuaggauucaugacaauugcaaaauccggagauucaccuauaacaguaccuccuaacgguuacuucagauucgaauccuggguuaauccuuucuauacuuuagcaccaaugggaacaggaaaugguagaagaagaauacaauaa

SEQ ID NO: 31115 - RNA, 1623 nt, Artificial Sequence
  derived and/or modified sequence opt6 from capsid_protein_VP1__Norovirus__AII02665
augaaaauggcuucuaaugaugcuaauccauccgauggaucagcagcaaauuuaguaccugaaguaucaaacgaaguaauggcauuagaaccagucguuggagcugcaauagcugcaccaguagcuggccaacaaaauguaauagacccuuggauaagaaacaacuuuguacaagcuccaggcggugaauucacaguuuccccacgaaaugcaccaggugaaauacucuggucagccccucuaggaccugaucucaauccauaucuaucucaucuugcccgaauguauaauggauacgccgguggauucgaaguacaaguaauuuuagccgguaaugcuuuuacagcuggaaaaaucauauuugcagcaguuccuccaaauuuuccaacagaaggauuaucaccuucacaagucacaauguuuccccauauaauaguugacgucagacaacuagaaccaguacuuauccccuuaccagaugucagaaacaacuuuuaucacuauaaucaaaccaaugacucuacaauaaaacuaauagcuauguuauacacaccacuaagagcaaauaaugcaggggaagauguauuuacaguuucuugucgaguacucacacguccuucaccagauuuugauuuuaucuuccuaguaccucccacagucgaaucacgaacaaaaccauucacagucccaauuuuaacaguagaagaaaugacaaacagucgauuuccuauaccauuagaaaaacucuuuacuggaccuucaggcgcauuuguaguacaaccucaaaauggaagaugcacaacugauggaguucuacuuggaacaacacaacuauccccaguaaacaucuguacuuucagaggagacguaacacauauagcuggaucaagaaauuauacaaugaacuuagcaucuuuaaacuggaacaauuacgaucccaccgaagaaauaccugcaccccucggaacaccagauuuugucggaaaaauacaaggcguucuaacacaaacaacaaaaggagacggcuccacucguggacacaaagcaacaguauauacagguuccgcaccauuuacaccuaaauuaggaucaguacaauuuucaacagauacagaaaaugauuucgaaacacaccaaaauacuaaguuuacaccaguaggaguaauacaagacggaggaacaacacacagaaacgaaccacaacaauggguauuaccaucauacucaggaagagauguccauaauguacaccuagcaccagcaguagcacccaccuuuccaggagaacaacuauuauuuuucagaucaacaaugccagguuguucaggauacccaaacauggaucuagauuguuuauuaccacaagaauggguacaacauuucuaucaagaagccgcaccagcacaauccgacguagcuuuacucagauucguaaauccugauacaggaagaguucuauucgaaugcaaacuucacaaaucaggauauguaaccguagcacacacaggacaacaugaucucgucauuccaccuaacgguuacuucagauucgauucauggguaaaucaauucuacacucuagcaccaaugggaaauggaacagguagacgaagagcacuauga

SEQ ID NO: 31116 - RNA, 1623 nt, Artificial Sequence
  derived and/or modified sequence opt6 from capsid_protein_VP1__Norovirus__AII02668
augaaaauggcaucaaaugacgccaacccaagcgauggcucagcagcaaauuuaguaccagaaguaaguaaugaaguaauggcauuagaacccguaguaggagcagcuauagcagcaccuguugcaggacaacaaaauguuaucgacccauggauaagaaauaacuuuguucaagcuccaggaggcgaauuuaccguauccccaagaaacgcaccuggcgaaauuuuauggucagcacccuuaggcccagaucuaaacccauaccucucacacuuagcccguauguauaacggauacgccggcggauucgaaguccaaguuauacuagcaggcaacgcauuuacagcaggaaaaauaauauuugccgcaguuccaccuaauuuuccaaccgaaggucuauccccgucacaaguuacaauguucccacauauaauaguagacguaagacaacucgaaccaguuuuaauaccccuucccgauguaagaaacaauuuuuaucacuauaaucaaaccaaugauuccacuauaaaacuaauugcaauguuauauacaccauuaagagcaaauaaugcaggagaagauguuuucacaguuuccuguagaguauuaacaagaccaagccccgauuuugacuuuaucuuccuaguaccaccaaccguagaauccagaacaaaaccauuuaccgucccaauacuuacaguagaagaaaugacuaauucuagauuuccaauaccacuagaaaaacuauucacaggacccucuggagcguuuguaguucaaccucaaaacggaagauguacaacugacggaguauuauuagggacaacucaauuaucccccguaaacauauguacauuuagaggagacguaacccauauugcuggaagucgaaauuauacaaugaaucuagcaucauuaaauuggaacaacuacgauccaacagaagaaauaccagcaccacuaggcacacccgacuucguaggcaaaauacaaggcguauuaacacaaacaaccaaaggugacggaucaacacgaggacauaaagcaacaguuuacacaggaucagcaccauuuacuccuaaauuaggcucaguacaauucucaacagacaccgaaaacgacuucgaaacccaucaaaauacaaaauucacacccguaggaguaauacaagacggagguacaacacaccgaaaugaaccacaacaauggguacuaccuucuuacagcgguagagauguacauaauguacacuuagccccugcaguagcaccuacauuuccaggagaacaguuauuauuuuuucgaucaacaaugcccggauguucaggcuauccaaacauggacuuagauugccucuuaccacaagaauggguacaacacuuuuaccaagaagcagcaccagcacaaucugacgucgcauuacuaagauuuguaaaccccgauaccgguagaguauuauuugaauguaaacuacacaaaucaggauauguaacaguagcacauacaggacaacaugacuuaguuauacccccaaauggcuauuuuagauucgauucauggguaaaccaauuuuauacauuagcuccaaugggaaaugguaccggacgaagaagagcauuauaa

SEQ ID NO: 31117 - RNA, 1623 nt, Artificial Sequence
  derived and/or modified sequence opt6 from capsid_protein_VP1__Norovirus__AII02671
augaaaauggcuucaaaugacgcaaaucccucagacggaagugcagcaaaccuaguaccagaaguaaguaaugaaguaauggcccuagaacccguagucggcgcagcaauugcagcccccguagcaggacaacaaaacguuauagacccauggauaagaaacaacuuuguacaagcaccaggcggugaauuuacagugucaccuagaaaugcaccaggagaaaucuuauggagcgccccgcuagguccagaucucaauccauauuuaucacaucuagcccgaauguauaacggauaugcaggaggauucgaaguccaaguaauauuagcaggaaaugcauuuacagcaggaaaaauaauauucgcagccguaccaccuaauuucccuacggaaggacuaucuccaucacaaguaaccauguucccacauauuauaguagacguaagacaauuagaaccaguucuaauaccacuuccagauguaagaaacaauuuuuaucacuauaaccaaacaaacgacucuacaauaaaacuaauagccauguuauacacuccauuaagagcaaacaaugcaggagaagauguuuuuacaguaucaugucgaguacuaacaagaccuucaccagacuuugacuuuauauuucuugucccaccaacaguagaaucuagaacaaaaccauucacaguccccauccuaacaguugaagaaaugacuaauucaagauuuccaauaccuuuagaaaaacuauuuacaggaccaucuggagcuuucguaguccaaccacagaauggaagauguacaacagacgguguacuacuaggaacaacacaauuaucaccuguaaauauuuguacauuccgaggagacguaacucauauagcuggcucaagaaauuauacaaugaauuuagcaucacuuaauuggaacaauuaugauccaacagaagaaauucccgcaccccuaggaacaccagacuuuguaggaaaaauacaaggaguacuuacacaaacaacuaaaggagacgguuccacacguggucacaaagcuacaguauauacaggaucagcaccauuuacaccaaaauuaggaucaguacaauuuagcacagauacagaaaaugauuucgaaacucaccaaaauacaaaauucacaccagucggaguaauccaagaugguggaacaacccauagaaacgaaccacaacaauggguacuacccuccuacucaggacgugauguacauaauguacaccuagcaccagcaguugcucccacauuucccggugaacaacuauuauucuuucgaaguacaaugcccggauguucaggauaucccaauauggaucuagacuguuuauuaccucaagaauggguucaacauuucuaucaagaagcagcuccagcacaauccgauguagcucuucuaagauucguuaauccagauacaggaagaguacucuucgaaugcaaauuacauaaaucuggauauguaacaguagcacauacaggacaacacgaccuaguaauaccuccgaauggauauuuucgcuuugauagcuggguuaaucaauuuuacacauuagcaccuaugggaaauggaacuggaagaagaagagcacuauaa

SEQ ID NO: 31118 - RNA, 1623 nt, Artificial Sequence
  derived and/or modified sequence opt6 from capsid_protein_VP1__Norovirus__AII02674
augaaaauggccucuaaugacgcuaauccaucugauggcagugcagcuaaucuaguaccagaagucaauaaugaaguuauggcauuagaaccuguaguaggagcagcaauagcugcaccugucgcuggacaacaaaaugucauagacccauggauacguaacaacuuuguacaagcaccaggaggagaauuuacagucucaccaagaaacgcacccggagaaauccuauggagugcccccuuaggaccagaucuaaaucccuaucucucccacuuagcacguauguacaauggauaugcgggaggauucgaaguucaaguaauacuugcugguaaugcauuuacagcagguaaaauaauauucgcagcaguaccaccaaacuuuccaacagaaggacuaaguccaucccaaguaacaauguuuccucacauaaucguugacguuagacaauuagaacccguccucauacccuuaccagacguacguaacaauuuuuaucauuauaaucagucaaaugacucaacaauaaaacuaauagcaauguuauacacaccacuacgagcuaacaaugcuggagaagauguauuuacagucuccugcagaguauuaacaagaccuucaccagacuuugacuuuauauuuuuaguaccaccuacaguugaaaguagaacuaaaccauucacaguacccaucuuaacaguugaagaaaugacaaauucaagauucccaauaccuuuggaaaaauuauuuacaggcccaagcggagcauucauuguacaaccacaaaacggaagauguacaacugacgguguacuacucgguacaacucaauuaucaccaguaaauauauguacauucagaggcgauguaacacauauagcaggcucacgaaauuacaccaugaaucucgcuuccuuaaacuggaacaacuacgaucccaccgaagaaaucccagcaccauuaggaacuccagacuucguagguaaaauacaaggaguauuaacacaaacaacaaaaggugacggaucaacacgaggacacaaagcaacagucuauacaggaucagcaccauuuacacccaaacuuggaucaguacaauuuaguacagauacagaaaacgauuucgaagcacaccaaaauaccaaauucacaccaguaggaguaauacaagacggcggaacaacacacagaaaugaaccucaacaauggguauuaccaucauacuccggaagagauguucauaauguccacuuagccccugcuguugccccuacauucccaggagaacaauuacucuucuuucgauccacaaugccaggaugcuccggauauccaaacauggaccucgauugcuuauuaccacaagaauggguucaacauuucuaccaagaagcagcaccagcacaaucugacguagcacuacuaagauuuguaaacccagacacaggaagaguauuauucgaaugcaaacuacauaaaucaggauauguuacaguagcacacacaggacaacacgacuuaguaauuccaccaaauggauauuuuagauuugauucauggguaaaucaauuuuauacacuagcuccaaugggaaacggaacuggaagaagaagagccuuauaa

SEQ ID NO: 31119 - RNA, 1623 nt, Artificial Sequence
  derived and/or modified sequence opt6 from capsid_protein_VP1__Norovirus__AII02677
augaaaauggccucaucagacgcaaacccaucagauggcucuacugcaaacuuaguaccagaaguuaacaaugaaguaauggcacuagaaccaguuguaggcgcagcaauagcagccccagucgcaggacaacaaaauguaaucgacccauggauaagaaauaauuuuguacaagcaccaggaggugaauucaccguaaguccaagaaacgcaccaggagaaauauuauggucugcaccacuaggaccagaucuaaacccauaucuaucucaccuagccagaauguauaacggcuacgccgguggauuugaaguacaaguaauacuagcaggaaaugccuucaccgccggcaaaaucauauucgcagcagucccaccaaauuucccaacagaaggacuaucaccuucucaaguaacaauguucccacauauaauaguagauguccgacaacuagaacccgucuuaauuccacuaccagaugucagaaauaauuucuaucauuauaaucaaucaaacgauccaacuauuaaauuaauagcaaugcucuacacaccacuaagagccaacaaugcaggagacgauguauuuacuguuucuugucguguacuuacuagaccaucaccagacuucgauuucauauuucuaguacccccaaccguagagucaagaacaaaaccauucucagucccuguacucacaguagaagaaaugaccaacucacgauuuccaauuccccuagaaaaacuauuuacaggaccaucauccgcuuuuguaguccaaccucaaaacggucgaugcacaacagacggaguauuauuaggaaccacacaacuaucaccagucaauauaugcacauuuagaggugauguaacacauauaucagguagcagaaauuauaccaugaaccuagcaucacaaaacuggaacucauaugauccaacagaagagauaccagcaccccuaggcacaccagauuuuguagggaaaauacaaggaguuuuaacacaaacaacucgaacaaacggaucaacaagaggacacaaagccacaguauauacaggaagugcagacuuuagcccaaaacuuggcagaguucaauucgcaacagauacagauaacgauuucgaaaccaaucaaaacaccaaauucacaccagucggaguaauacaagacgguucaacuacaccaagaaaugaaccucaacaauggguacuaccaucauauaguggacguaauauacauaacguacacuuagcaccagcaguagcacccacauuucccggagaacaacuuuuauuuuuccgaucaacaaugccaggauguucaggauauccuaacauggauuuagauugucuccuaccacaagaauggguacaauauuucuaucaagaagcagcaccugcucaaucagacguagcucuuuuaagauuuguuaaccccgacacaggaagaguacucuucgaaugcaaacuucacaaaucagguuacguaaccguagcacauaccggacaacacgauuuaguaauaccaccaaauggauauuuccguuuugauucaugggucaaccaauuuuauacacuggcuccaaugggaaauggcacaggacgacgucgagcacuuuaa

SEQ ID NO: 31120 - RNA, 1623 nt, Artificial Sequence
  derived and/or modified sequence opt6 from capsid_protein_VP1__Norovirus__AII02680
augaaaauggcaucuaacgacgcaaauccaucagauggcucugcagcaaaccuaguaccagaagucucuaacgaaguuauggcauuagaaccaguagucggcgcagcaaucgcugcuccaguagccggacaacaaaauguaauagauccauggauacguaacaacuuuguacaagcaccaggaggagaauuuacagucucuccacgcaacgcaccaggagaaauacuauggucagcaccauuaggacccgacuuaaacccauauuuaucucacuuagcucgaauguacaauggauaugcaggaggauuugaaguccaaguaauacuugcuggaaaugcauucacagcaggcaaaauaauauuugcagcaguaccuccaaacuuuccaacugaaggucucucaccuucacaaguaacaauguuuccacauauuauuguagauguuagacaacuagaaccaguauuaauuccucuaccagauguuagaaauaauuuuuaucauuacaaucaaauuaaugauccaacaauuaaacuaauagccauguuauacacuccauuacgugcuaacaaugcaggagaagacgucuuuacaguauccuguagaguacuaacucgaccaucaccagacuuugauuuuauuuuucuaguaccaccuacuguugaaaguagaaccaaacccuuuacaguaccuauccuaacaguagaagaaaugacuaauagucgauuuccuauuccauuagaaaaacuauuuaccggaccaucuggagcauucguaguacaaccacaaaaugggagaugcacaacagaugguguauuauuagguaccacucaauuaucaccaguaaauaucuguacauuuagaggagacguaacacauauagcagggucaagaaauuacacuaugaaccuagcaucacuaaacuggaauaacuaugauccaacagaagaaauaccagcaccccuagguaccccagacuuuguagguaaaauucaagguguacucacucaaacuacaaaaggugacgguucaacacgaggacauaaagcaacagucuacacaggaucagcaccauuuaccccaaaacuaggauccguacaauucagcacagacacagaaaacgacuucgaaacccaccaaaauacaaaauuuacaccuguagguguuauacaagacgguuccacaacacauagaaaugaaccacaacaauggguuuuaccaucuuacucaggaagagauauacauaauguacacuuagcaccugcaguagcaccaacuuuuccaggagaacaauuauuauucuuuagauccacaaugccaggaugcucaggcuauccuaauauggaccuugauugccuacuaccacaagaauggguacaacauuuuuaucaagaagcagcuccagcucaaucagauguagcuuuacuaagauucguaaauccagacacuggucgaguccuuuucgaaugcaaacuucauaaaucaggauauguaaccguagcacauacaggacaacaugacuuaguaauaccaccaaacggauauuucagauuugacucauggguaaaucaauucuauacauuagcuccaaugggaaauggaacaggacgaagacgagcuuuauaa

SEQ ID NO: 31121 - RNA, 1623 nt, Artificial Sequence
  derived and/or modified sequence opt6 from capsid_protein_VP1__Norovirus__AII02683
augaaaauggcaucaaacgacgcuaauccaucagauggaagugcagcaaacuuaguuccugaaguaaguaaugaaguaauggcauuagaacccguaguaggagccgcaauugcagcaccaguagcaggucaacaaaaugucaucgacccauggauaagaaacaacuuuguacaagcuccaggaggagaauucaccguaucaccaagaaaugcaccaggagaaauuuuauggucagccccccuaggaccagaucuaaauccauaucuaucgcaucuagcacgaauguauaacggauacgcaggagguuucgaaguacaagucauucucgcuggaaaugcauuuacugccggcaaaauaauuuucgccgcaguaccaccaaauuuuccaacagaaggucuuucgccaagucaaguuacaauguucccucauauuauaguugacguacgacaauuagaaccaguacuaaucccauuaccagauguuagaaauaacuucuaucauuauaaccaaacaaacgauucaacuaucaaauuaaucgcaaugcucuauacaccacuacgagcaaacaaugcaggagaagauguauuuaccguaucaugccgaguauuaacuagaccuucacccgauuucgacuuuauauuuuuaguuccuccgacaguagaaagcagaacuaaaccauuuacagucccaauauuaacuguugaagaaaugacuaacucucgauucccaauaccacucgaaaaauuauucacaggucccucuggagcauuugucguacaaccacaaaacggaagaugcacaacagacggcguccuauuaggaaccacacaacuaucaccaguaaauaucuguacuuuucgaggagacguaacccauauagccgguucccgcaacuauacuaugaaccucgcauccuuaaauuggaauaacuaugauccaacugaagaaauaccagcaccacuagguacaccagacuuuguaggaaaaauucaaggaguuuuaacacaaacaacaaaaggugacggaagcacucgaggacacaaagcaaccguauauaccggaucagccccauuuacaccaaaauuaggaucuguccaauucucaacagacacagaaaacgacuucgaaacacaccaaaauacaaaauucacacccguaggaguaauccaagacggaggcacaacccaucgaaaugaaccacaacaauggguauuaccaucauauucaggaagagauguucauaacguacacuuagcaccagcaguagcaccaacauuucccggagaacaacuacuauuuuuccgaucuacaaugccaggauguucaggauauccaaauauggaucuagacuguuuacuuccacaagaauggguucaacauuucuaucaagaagcagcuccagcacaaucagacguagcacuacuuagauuuguaaauccagacacaggaagagucuuauucgaauguaaacuacauaaaucaggauacguuacaguagcacauacuggacaacacgacuuaguuauuccaccaaauggauauuuucgcuuugacaguuggguaaaucaauucuacacccuagcuccaaugggaaauggaacaggaagaagacgagcuuuauaa

SEQ ID NO: 31122 - RNA, 1623 nt, Artificial Sequence
  derived and/or modified sequence opt6 from capsid_protein_VP1__Norovirus__AII02689
augaaaauggcaucaaaugacgcaaaucccucagacggaucagcagcaaauuuaguuccugaaguaucuaaugaaguaauggcauuagaaccaguagucggugcagcaauagcugcaccaguagcuggacaacaaaauguaauagacccauggaucagaaacaacuuuguccaagcacccggcggugaauuuacuguaucaccuagaaaugcaccaggcgaaauacuuuggucggcaccacuaggaccagaucucaauccauaucuaagucaccuugcaagaauguauaacggauacgcuggaggauucgaaguucaagucauucuugcuggaaaugcauucacagcaggaaaaauaauauuugcugcagucccaccaaauuucccuacagaaggacuaucaccaucccaaguaacaauguucccccacauuauaguagacgucagacaacuugaacccguauuaauaccacuacccgacguuagaaacaacuucuaccauuacaaucaaacaaaugacucaacaauaaaauuaauagccauguuauauacuccauuacgagcaaacaaugcaggagaagauguauucaccgucucuugucgaguacucacaagaccuucaccugauuuugacuucauauuucuaguaccaccuacaguugaaucacgcaccaaaccauuuaccguaccaauccuaacaguugaggaaaugacaaacucaagauuuccaauaccauuagaaaaauuauuuacaggaccaucaggagcauucguaguccaaccacaaaacggacgauguaccacugauggaguauuauuaggaacuacacaacuaucaccaguaaacauaugcacauuccgcggcgacguuacacauauagcuggaucaagaaauuacacaaugaaucuagccucauuaaauuggaauaauuacgaucccacagaagaaauaccugcaccauuaggcacuccagacuuugucggaaaaauacaaggaguccuaacacaaacaacuaaaggugacggaucaacaagaggacacaaagcaaccguguauacuggaucugcacccuuuacaccuaaauuaggcucaguacaauuuucuacugauacugaaaacgacuuugaaacacaucaaaacacaaaguuuacaccuguaggcguaauucaagacggaggaaccacacaccgaaaugaaccccaacaauggguucucccauccuauucaggaagagauguacauaauguacauuuagccccagcaguagcaccuacauuucccggagaacaauuauuauucuuuagaucuacaaugccagguuguucaggauacccaaauauggauuuagauugccuuuuaccacaagaauggguucaacauuucuaucaagaagcagcacccgcucaauccgaugucgccuuacuacgcuucguuaauccugacacuggacgagucuuauucgaaugcaaacuacacaaaucaggauaugucacaguagcacacacaggacaacaugauuuaguuauaccccccaauggauacuucagguucgauaguuggguuaaucaauuuuauacucuugcuccuaugggaaauggcacaggaagaagaagagcauuauaa

SEQ ID NO: 31123 - RNA, 1623 nt, Artificial Sequence
  derived and/or modified sequence opt6 from capsid_protein_VP1__Norovirus__AII02692
augaaaauggcaucaaacgacgcaaaccccucagacgguucagcagcaaaucuuguaccagaaguauccaacgaaguaauggcacuagaaccaguuguuggugcagcuauugcagcaccaguagcaggacaacaaaauguaauagacccauggauaagaaacaacuuuguccaagcaccaggaggagaauuuacaguuucaccgcguaacgcaccaggcgaaauccucuggucugcaccuuuaggucccgaucuuaaccccuaccuaucacauuuagcacguauguacaauggauacgcaggaggcuuugaaguucaaguaauacuagcaggaaaugcauuuacagcuggaaaaauaauuuucgcugcaguaccuccaaauuucccaacagaaggacuaucaccaucacaaguaacaauguucccucacauaauaguagacgugcgacaauuagaaccaguccuaauaccauuaccagauguaagaaauaauuuuuaccauuacaaucaaacaaaugacucuacaauaaaauuaauagcaauguuauacacuccacuuagggcuaacaaugccggagaagacguuuuuacuguaucaugcagaguacuaacaagaccauccccagacuuugacuucauauucuuaguucccccaacaguagaaucgagaacuaaaccauucacaguuccuauauuaacggucgaagaaaugacaaacucuagguuccccauuccucuugaaaaauuauuuacaggaccaucaggagcauuuguuguacaaccccaaaaugggcgauguacuacagauggaguucuacuaggaacuacacaauuaucuccaguaaacauaugugcauuuagaggagacguaacacauauagcaggaucaagaaauuacacaaugaauuuagcuucacuuaacuggaacaauuacgaucccacugaagaaauaccagccccauuaggaaccccagauuucguaggaaaaauacaaggagucuuaacacagacaacaaaaggugacggaucaacaagaggucauaaagccacuguauauacaggaucagcaccauuuacacccaaacuuggauccguacaauuuucaacagacacagaaaaugauuucgaaacacaucaaaauacaaaauuuacaccuguuggagucauccaagacggaggaaccacccauagaaaugaaccacaacaauggguauuaccaagcuauuccgguagagauguccacaacguacaccuagcucccgcaguagcaccuacauucccaggugaacaacuacuauuuuuuagaucuaccaugccaggaugcucuggcuacccaaacauggaucuagacugcuuacuaccucaagaauggguucaacauuucuaccaagaagccgcaccagcucaaucagacguagcuuuacuaagauucguaaacccagacaccggaagaguauuauucgaaugcaaacuacauaaaucuggauauguaacaguagcacacacuggacaacaugaucuagugaucccaccaaacggauauuucagauucgauucauggguuaaucaauuuuacacguuagccccaaugggaaauggaacuggaagacgaagagcacuauaa

SEQ ID NO: 31124 - RNA, 1623 nt, Artificial Sequence
  derived and/or modified sequence opt6 from capsid_protein_VP1__Norovirus__AII02695
augaaaauggcaucaaaugacgcuaauccaucagauggcucagcagccaaucuaguaccagaagugucaaacgaaguaauggcacuagaacccguagucggagcagcaaucgcugcuccuguggcuggacaacaaaauguaauugacccauggauaagaaacaauuuuguacaagcacccggcggagaauucaccguaucacccagaaacgcuccuggagaaauauuauggucagcaccccuaggucccgaucuaaauccauaucuaucacaccuagcacgaauguauaacgguuacgcuggaggcuucgaaguacgaguuaucuuagcaggaaaugcauuuacagcaggaaaaauaauauucgcagccguaccaccaaacuuuccaacagaaggacuaucacccucacaaguaacaauguucccgcacauaauaguagacguaagacaacucgaaccaguccuaauaccacuaccagacguacgaaauaacuucuaucacuacaaucaaacuaacgacuccacaaucaaacuaaucgcaaugcuauauaccccacucagagcaaauaaugcaggagaagauguuuuuacuguuucauguagaguauuaacaagaccuuccccagauuuugacuuuauauuccuaguaccccccacaguugaaucaagaacaaaaccauucacaguacccaucuuaacagucgaagaaaugacuaauucuagauuuccaauaccauuagaaaaacuauucacaggaccaucuggagcauucguaguacaaccacaaaauggaagaugcacaaccgaugguguacuuuuaggaacaacacaauuauccccaguaaacauauguacauuucgaggugacguaacccauaucgcuggaucccgaaauuauacuaugaacuuagcaucauuaaauuggaauaauuacgauccaacagaagaaauaccugcaccacuagguacaccagauuuuguaggaaaaauucaaggagucuuaacacaaacaaccaaaggagauggaagcacccgaggucacaaagcuacaguauauacaggaagcgccccauucacaccuaaauuaggaucaguccaauucaguaccgauacagaaaaugacuucgaaacccaccaaaauacaaaauucacaccaguuggaguaauacaagauggaggaacuacacaccgaaacgaaccacaacaauggguacuucccucauauucuggucgagauguacacaacguacauuuagcaccagcaguagcaccaacauuuccuggagaacaacuacuauucuuuagaucaacaaugccagguugcucuggauauccaaacauggaccuugauugcuuauuaccacaagaauggguacaacacuucuaucaagaagcagcaccagcucaaucugauguagcauuauuaagauuuguaaaucccgacacaggucguguauuauucgaaugcaaacuacauaaauccggauacguuacuguagcacacacaggacaacaugaucuaguaauaccaccaaauggauauuucagauucgauucauggguuaaucaauuuuacacacuagccccaauggguaauggaacaggccgacgacgagcauuguaa

SEQ ID NO: 31125 - RNA, 1623 nt, Artificial Sequence
  derived and/or modified sequence opt6 from capsid_protein_VP1__Norovirus__AII02698
augaaaauggcaucaaacgaugcaaauccaucagacggaagugcagcaaaucuagucccagaaguaucaaaugaagucauggcucuagaacccgucguaggagcagcuauagcagcaccugucgcaggucaacaaaaugugaucgauccauggauuagaaacaacuuuguacaagcaccaggaggugaauuuacagucagcccccgaaacgcaccaggagaaauauuauggucagcaccacuggguccagauuuaaauccauauuuaucacaccuagcuagaauguauaaugguuacgcaggaggauucgaaguccaaguaauucuagcuggaaacgcauuuacagcaggaaaaauaaucuuugcagcaguaccaccaaacuuucccacugaaggccuaucacccucacaaguuacaauguuuccccacauaauuguagauguacgucaacuagaaccaguacuaauaccccuaccugauguaagaaacaauuucuaucacuauaaucaaacaaacgacucuacaauaaaacuaauagcaauguuauacacaccacuuagggcaaacaaugcaggugaagauguauucaccguaucauguagaguauuaacaaggccaucaccagauuuugauuuuauauuucuagucccaccaacaguagaaucaagaaccaaaccuuucacaguaccaauuuuaacagucgaagaaaugacaaacucuagauuuccaauacccuuagaaaaacuauuuaccggaccaucaggagcauucguaguucaaccacagaauggaagauguaccaccgacggcguauuacucggaacaacucaauuaucaccaguaaacaucuguacauuuagaggagacguaacacauauagccggaucaagaaauuauacaaugaaucuagcaagccuaaacuggaacaauuacgauccaacagaagaaauaccagccccacuaggaacaccagacuuuguugguaaaauacaaggaguacuaacacaaacaacaaaaggagaugguucaacaagaggccauaaagcaacuguuuauacaggaucugcaccauuuacaccaaaauuaggaucaguacaauuuaguacagauacagaaaacgauuucgaaacacaccaaaauacaaaauuuacaccugucggcguaauacaagacggagguaccacgcaucgaaacgaaccccaacaaugggucuuaccaucauauaguggaagagacguccauaauguucauuuagcacccgcagucgcuccuacauuuccaggagaacaacuauuauucuuucgaucaacaaugccaggaugcagcggauauccaaauauggauuuagauugcuuauugccacaagaauggguacaacauuuuuaucaagaagccgcucccgcacaaucugauguagccuuauuacguuucgucaauccagauaccggacguguuuuauucgaaugcaaacuacauaaaucagguuaugucacaguagcacacacaggacaacaugauuuagucauuccuccaaacggcuauuucagauucgacucauggguaaaucaauucuacacauuagcaccuaugggaaacggcacaggacgaagacgagcacuauaa

SEQ ID NO: 31126 - RNA, 1623 nt, Artificial Sequence
  derived and/or modified sequence opt6 from capsid_protein_VP1__Norovirus__AII02701
augaaaauggcuucaaaugaugcaaacccauccgauggaucagcagcuaauuuagucccugaagucucaaaugaaguaauggccuuagaaccaguuguaggagccgcaauugcagcaccugucgccggacaacaaaauguaauugacccauggauaagaaauaauuuuguucaagcaccaggaggagaauucacuguuucaccaagaaaugcuccaggagaaauauuaugguccgcaccauuaggaccagaucucaauccauaucuaucacaccuagcaagaauguauaaugguuaugcuggaggcuuugaaguacaaguuauacuagccggaaaugccuuuacagccggaaagauaauauuugcugcaguucccccaaauuuuccaacagaaggacuaucaccaucacaaguaacaauguucccacauaucauaguagacguccgccaacuagaaccaguacuaauaccacuaccugacguacgcaauaauuuuuaucacuacaaccaaaccaaugacucaacaauaaaacuaauagccaugcuauauacaccauuacgcgcaaacaacgcaggagaagaugucuucacaguuucauguagaguacuaacuagaccaucaccagacuucgauuuuauauuccucguaccaccaacaguagaaucaagaacuaaaccauucacaguaccaauacuaacaguagaagaaaugaccaauucacgauuuccaauuccauuagaaaaauuauucaccgguccaucaggagcauucguuguacaaccacaaaacggucguuguacuaccgaugguguuuuacuagguacuacccaauuaucaccagucaacauuuguaccuuuagaggagacguaacacacaucgccggaucaagaaauuauacaaugaacuuagcaucauuaaauuggaauaacuacgacccaacagaagaaauuccagcaccauuaggaacaccagauuuuguaggcaaaauacaagguguauuaacccaaacaacaaaaggugacggaucaacaagaggacauaaagcaacuguuuauacaggaucugccccauuuacaccaaaauuagguuccguccaauucuccaccgauacagaaaacgacuuugaaacacaccaaaacacuaaauucacaccaguaggaguaauacaagacggaggcacuacccauagaaaugaaccacaacaauggguucuaccuuccuauucaggucgcgacguucauaacguacaucucgccccagcaguugcaccgacauuuccaggugaacaacuccuuuuuuuccgauccacaaugccaggaugcucaggauauccaaauauggaucucgacugcuuacuuccucaagaauggguacaacauuuuuaucaagaagcagcacccgcacaaucagacgucgcauuauuacgcuuuguaaacccugacaccggacgaguauuauucgaaugcaaacuacacaaaucaggauauguuacuguagcacauacuggacaacacgauuuaguaauaccaccaaauggcuauuuuagauucgacucauggguaaaucaauuuuauacucuagcaccaaugggaaauggcacaggaagaagaagagcucuauaa

SEQ ID NO: 31127 - RNA, 1623 nt, Artificial Sequence
  derived and/or modified sequence opt6 from capsid_protein_VP1__Norovirus__AII02707
augaaaauggcuucaaacgacgcuaauccaucagacggaucagcagcaaacuuaguaccagaaguuuccaacgaaguuauggcauuagaacccguaguaggcgcagcaauagcagccccaguagcaggucaacaaaaugucaucgacccauggauaagaaacaacuucguccaagcaccaggaggcgaauucacaguaucaccaagaaacgcaccaggagaaauauuauggucggcgccacuuggaccagacuuaaauccauaucuaucucaccuagcaagaauguauaacggauaugccgguggauuugaaguacaaguaauacuagcaggaaaugcguuuacagcuggaaaaauaauuuuugcagccgucccaccuaacuuucccacugaaggauuaucaccaucacaaguaaccauguuuccacacauuaucguagacguaagacaacuagaaccuguacuaaucccacucccugacguaagaaacaacuuuuaucacuauaaccaaacaaaugacuccacaauaaaacucauagcaauguuauacacuccacuaagagcaaauaaugccggagaagauguauucacaguaucaugucgaguauuaacaagaccaucacccgacuuugacuuuauauuucuaguaccaccuaccguagaaagcagaacuaaaccauucaccguaccaauccuaacaguagaagaaaugaccaauagccgcuuuccaauaccacuugaaaaacucuuuaccggaccguccggagcauuuguuguacaaccucaaaacggaagauguaccacugacggaguauuacuaggaaccacacaauuaucaccaguaaauauaugcaccuuuagaggagacguaacacauauagcaggaucacgaaacuacacaaugaaucuagcuucccuuaauuggaacaacuaugacccaacagaagaaauuccugcuccacuaggaacucccgauuucguaggaaaaauacaaggaguacuaacccaaacaacaaaaggagacggaucaacacgaggacacaaagccacagucuauacaggaucagcacccuucacuccaaaacuaggaagcguacaauucucaaccgauacagaaaacgauuucgaaacacaccaaaauacaaaauucacaccaguuggaguaauacaagacgguggaacaacacauagaaaugaaccucaacaauggguauuaccaucuuacucuggaagagauguacauaauguacauuuagcaccagcaguagcaccaacauucccaggagaacaacuacuauuuuucagauccacaaugccagguugcuccggauauccuaacauggacuuagacugccuuuuaccucaagaauggguacaacauuucuaucaagaagccgcaccagcacaaucagauguugcccuauuacgauuuguaaacccagacacaggaagaguauuauucgaauguaaauuacauaaauccggcuauguaacagucgcccauaccggacaacacgauuuaguuauaccuccuaauggauauuucagauucgauucauggguaaaccaauucuauacacuagcaccuaugggcaauggcacaggaagaagaagagcacuauaa

SEQ ID NO: 31128 - RNA, 1623 nt, Artificial Sequence
  derived and/or modified sequence opt6 from capsid_protein_VP1__Norovirus__AII02710
augaaaauggccucaaaugaugcaaauccaucagauggauccgcagcaaaccuugucccagaaguuucaaaugaaguaauggcauuagaaccuguaguaggagcagcuauagcagcaccuguagccggucaacaaaaugucauagacccauggauaagaaauaacuuuguccaagcacccggaggagaauuuaccguaucaccaagaaaugcuccaggagaaauacuauggucugcaccacuaggacccgacuuaaaucccuacuuaucacaccuagcccguauguauaacggcuaugcaggaggauuugaaguacaagucauauuagcaggaaaugcauuuacugcagguaaaauaauauucgcagcaguuccuccaaacuuuccaacagaaggacuaucaccaagccaaguaacuauguucccacauauaauuguagacguaagacaacuagaaccaguacuaauaccuuuaccugauguaagaaauaauuucuaucauuacaaccaaacaaacgacucaaccauaaaacucauagcaaugcuauacaccccacuaagagcaaacaaugccggugaagacgucuuuacaguauccugcagaguacuaacuagaccaucaccagacuuugacuuuaucuuuuuaguuccaccaacaguagaaucuagaacaaaaccuuucacaguaccaauacuaacaguugaagaaaugacaaacagccgauuuccaauaccacuagaaaaacuauuuacaggaccaucaggagcuuucguaguccaaccacaaaauggaagauguacaacagacgguguucucuuaggaacaacccaacuuucaccuguaaauaucuguacauuuagaggugauguaacacauaucgcuggcucacguaauuauacaaugaauuuagcaucacuaaacuggaauaauuaugauccaacagaagaaauuccagcuccacucggaacaccagacuucguagguaaaauacaaggaguccuuacacaaacaacaaaaggagacgguucuaccagaggacacaaagcaacaguauauacaggcucagccccauuuacaccuaaacuuggaucaguacaauucucaacugacacagaaaacgauuuugaaacacaucaaaauacaaaauucacacccguuggcguaauacaagauggaagcacaacucaucguaacgaaccucaacaauggguccuacccucauauucagguagagacguacauaacguccauuuagcuccugccguagcaccaacauuuccaggugaacaacuauuauuuuuuagaucaacaaugccagguuguucaggauauccaaacauggauuuagacuguuuauuaccacaagaauggguucaacauuucuaucaagaagcagcuccugcacaauccgacguagcucuauuaagauucguuaauccagacacaggaagaguacuuuucgaauguaaacuucauaaaucagguuauguaacagucgcccauaccggccaacacgaccuaguuauaccaccgaacggcuauuuuagauuugauaguugggucaaucaauuuuauacccuugccccaaugggaaauggaacaggacgacgaagagcauuauaa

SEQ ID NO: 31129 - RNA, 1647 nt, Artificial Sequence
  derived and/or modified sequence opt6 from capsid_protein_VP1__Norovirus__AII02713
augaaaauggcaucaaaugacgcugcaccaucuaacgauggagcagcaggauuagucccagaaauaaauucagaagccauggcacuugaaccaguagcuggcgcagcaauagcagcaccauuaaccggacaacaaaacauuauagauccauggauaaugaacaauuucguucaagcaccagguggcgaauuuacaguaucuccacgaaacucuccaggagaaguauuacuaaauuuagaacuaggacccgaaauaaacccuuacuuagcacaccuagcaagaauguauaacggauaugcaggagguuucgaaguacaaguuguacuagcaggaaacgcauuuacagcgggaaaaauaauauucgcagcaauaccucccaacuuuccaauagacaaucuaucagcagcucaaauuacaauguguccacacguuauaguagacguacgacaauuagaacccguaaaucuacccaugccugauguucguaacaauuucuuccacuacaaucaaggauccgacuccagacuaagauuaauugcaaugcuuuauaccccacuaagagcaaauaacucaggagacgauguauuuacaguauccugccgaguucugacacggccaucccccgacuucucauuuaacuuucuaguaccaccaacuguugaaucaaaaaccaagccauuuucccuaccaauacuaaccauaucagaaaugucuaauucaagauucccaguuccaaucgacucauuacauacaucaccaacagaaaauauaguuguacaaugccaaaacggcagaguaacacuagauggagaacuaauggguacaacacaacuacuuccaucucaaauaugugcauuucgaggaauguuaacuagaucaacaagccgagcaucugaccaagcagacacugcaacaccaagauuauuuaauuauuacuggcacauacaacuugacaaccuaaacggaacacccuacgauccagcugaagauauaccaggaccacuaggcaccccagacuuuagaggaaaagucuucggaguagcaagucaaagaaauccugacgcgacaacuagagcacacgaagcaaaaauugacacuacauccggccgauuuacaccuaaauuaggaucacuagaaaucucaacagaaagcggagauuuugaucaaaaccaaccaacaauauucacuccaguaggcauaggaguagaccacgaagcagacuuucaacaauggacccuuccagauuaugcaggacaauucacccauaacaugaaucuagcaccagcaguagcaccaaauuuuccaggugaacaacuauuauuuuucagaucacaauuaccaucaucaggaggacgaucaaauggaauauuagacuguuuaguuccacaagaauggguucaacacuucuaccaagaaagugcaccuucacaaacgcaaguagcacuuguacguuaugucaauccagauacaggcagaguauuauuugaagcuaaacuacauaaacuaggauucaugacuauugcuaaaucuggugacuccccuauaacaguaccaccuaaugguuacuuuagauucgaaucauggguaaacccauucuauacucuagcaccaaugggaacaggaaauggcagacgacgaauacaauaa

SEQ ID NO: 31130 - RNA, 1647 nt, Artificial Sequence
  derived and/or modified sequence opt6 from capsid_protein_VP1__Norovirus__AII02716
augaaaauggcuaguaacgaugcagcaccaucuaaugacggagcugcaggauuaguaccagaaauaaacuccgaagccauggcauuagaaccuguagcuggcgcugcaaucgcagcuccacuaacaggucaacaaaauauaauagacccauggaucaugaacaacuucguacaagcacccggaggagaauucacugucuccccacgaaauuccccuggcgaagucuuacuuaauuuagaauuaggcccugaaauaaauccguaccuagcacaucuagcacgcauguacaacggauaugcaggcggcuucgaaguccaaguaguacuagcagggaacgcuuuuacagccggaaaaauuauauuugcagcaauaccuccaaacuuuccaaucgauaacuuaucagcugcucaaauaacuauguguccacacguaauuguugauguacgacaauuagaacccguaaacuuacccaugccugacguucgaaauaacuuuuuccacuacaaccaaggcucagauaguagauuaagauuaauagccauguuauacacaccccuaagagcaaauaauucaggagaugacgucuuuacaguaucaugucgaguacuaacaagaccuaguccagauuuuuccuuuaauuucuuaguaccucccacaguagaaucaaaaacaaaacccuuuucacuacccauccuaacaauaucagaaaugucaaacucacguuuuccaguaccaauagauucccuacacacaucaccuacagaaaauauaguuguacaaugucaaaauggaagaguaacacucgauggcgaacuaaugggaacaacacaauuacucccaagccaaauaugugcauuuagaggaaugcuaacacgaucaacauccagagccucagaccaagcagacacagcaacaccaagacuuuuuaacuauuacuggcauauacaacuagacaaccuaaauggaaccccauaugaucccgccgaagauauaccuggaccauuaggaaccccagacuuuagagguaaaguauucggaguagccucacaacgaaacccagacgcaaccacaagagcacaugaagcaaaaauagacacaacaucaggcagauucacgccaaaacuaggaucauuagaaauaucaacagaaucuggagacuuugaucaaaaccagcccacacgcuucacacccgucgguauaggaguugaucacgaagcagacuuucaacaauggacacucccagauuaugcaggacaauucacacacaauaugaaucuagcacccgcuguagcuccaaauuuuccaggugaacaacuauuauucuuuagaucacaauuaccaucuaguggagguagaucaaacggcauacuagacugccuagucccacaagaauggguacaacauuuuuaccaagaaucugcaccaucacaaacacaagucgcuuuaguccgcuauguuaauccagauacaggcagaguacuauuugaagcaaaauuacauaaacuaggcuuuaugacaauagcaaaaucaggagacucaccaauaaccguaccaccuaauggauauuuuagauuugaaucauggguaaacccauucuacacauuagccccaaugggaacaggaaacgguagaagaagaauacaauaa

SEQ ID NO: 31131 - RNA, 1650 nt, Artificial Sequence
  derived and/or modified sequence opt6 from capsid_protein_VP1__Norovirus__AII02719
augaaaauggcuaguaacgacgcagcuccaaguaaugauggugcagcaaauuuaguaccagaagcuaauaaugaaguuauggcacucgaaccaguaguaggagcaucaauagcagcaccaguaguuggacaacaaaacauaauagauccauggauaagagaaaauuuuguacaagcaccacaaggagaauuuacugucucccccagaaauagcccaggagaaaugcuucucaaucuagaauuaggaccagaacuaaacccauaucuaucacaccuaagcagaauguauaauggauacgcaggaggaaugcaaguacagguuguucuagcuggaaaugcuuucacagcaggaaaaauaauauucgcugcaguucccccacacuucccaguagaaaauauaaaugcugcacaaauaacuauguguccucauguaauaguugauguaagacaauuagagcccguauuauuaccauuaccugauaucagaaauagauucuuucacuacaaccaagaagacacaccaagaaugcgacuaguagcaauguuauauacaccccuacgagcuaauucaggcgaagauguauucacuguaucauguagaguacuaacaagaccugcaccagacuuugaauucacauuccuaguaccaccaacuguagaaucaaaaacuaaaccauucacauuaccaauauuaaccuuaggagaacuaaguaauucaagauucccagcaccuaucgauaugcuauauacagaucccaacgaaggaauaguaguacaaccacaaaacggaagauguacucuagauggaacauuacaaggcacaacacaauuaguaccaacacaaauaugugcauucagaggaauacuaauaggacaaacauccagaucacccgauucagauagcacagacucugcaccaagaagacgagaucacccacuacacaugcaacuugaaaaccuggaugguacacaauaugauccuacagacgaaguacccgcagcacuaggggcaguagacuuuaaaggaacaauauuuggaguugcaagucaacgagauacaucagguacacaagucggcgcaacgcgcgcacaugaaguaauaauaaauacaacagauccacgauauacucccaaauuagguucaguacucauguacucagaaucacaagauuucgaaaccggacaaccaauccgauuuacuccaauaggaaugggcgaaaaugauuggcaucaaugggaacuaccaaacuauucaggaagauuaacuuuaaacaugaacuuagcaccagcaguagcacccgcauucccuggugaaagaauacuauuuuucagaucaauugucccuucagcaggaggauacggaucuggacaaauagauugucuucuaccacaagaauggguacaacacuuuuaccaggaagcagcaccaucccaaagugcaguagcacuaauacgauauguaaacccugauacaggaagaaauauuuuugaagcaaagcuacauagagaaggauuuauaacaguagcuaauucuggaaacaauccaauagucguaccccccaauggcuacuuucgauuugaagcauggguuaaccaauucuacacacuaacaccuaugggaacuggacaaggacgaagaagaaaucaauaa

SEQ ID NO: 31132 - RNA, 1650 nt, Artificial Sequence
  derived and/or modified sequence opt6 from capsid_protein_VP1__Norovirus__AII02722
augaaaauggccaguaacgacgcagcuccauccaaugauggagcagcaaauuuaguaccagaagcaaacaaugaaguaauggcacuggaaccuguagcaggagcuuccauagcagcaccaguagugggacaacaaaacaucauagauccauggauaagagaaaacuuuguacaagcaccacaaggcgaauuuacaguuucucccagaaauucuccaggugaaaugcuacucaaccucgaauuaggaccugaauuaaacccuuaccuaucucaccuuucaagaauguauaauggauaugcaggugguaugcaaguacaaguaguauuagcaggaaacgcauuuacugccggaaaaauuauuuuugcugcuguaccaccacauuuuccaguagagaacauaaacgccgcucaaauaacaauguguccacauguaauaguagauguaagacaauuagaaccaguauugcuuccauuaccagauauaagaaauagauuuuuccauuauaaucaagaagauacaccacgaaugagguuaguagcaaugcuauauacuccacucagagcuaauucaggugaagauguuuuuaccguuucaugucgcguauuaacaaggccagcuccagauuuugaauuuacuuuuuuaguaccaccuacaguagaaucuaaaacaaaaccauucacauuaccaauauuaacauuaggagaacuuuccaauucaagauucccugcaccaaucgauaugcucuacacagauccaaaugaagguauaguaguucaaccucaaaauggacguugcacuuuagauggcacacuucaagguacaacacaacuagugccaacucaaauaugugcauuucgaggaagacuaauaggacaaacauccagaucaccagaucuagacucuacagacucugcaccaagaagacgagaccauccacuacacaugcaauuagaaaaccuagacggaacacaauaugauccaacagaugaaguaccagcugcacuaggcgcaguagacuucaaaggaacaauuuuuggaguagcuagucaaagagauacaucagguucccaaguaggcgcaacaagagcucacgaaguaacaauaaauacaacagacccaagauauacaccuaaacucggaucaguuuuaauguauuccgaaucacaagauuuugaaacaggacaaccuauaagauuuacaccaauaggaaugggugaagaugauuggcaucaaugggaacuaccaaacuauaguggacgucuuacauuaaauaugaacuuagcaccagcaguugcuccagcauucccuggcgaacgaauacuauuuuuuagaucaauaguaccaucagcaggaggcuauggaucaggacaaauugauugucuucuaccacaagaauggguucaacacuucuaucaagaagccgccccaucacaaagcgcagucgcacucauuagauauguaaaucccgacacaggaagaaauauuuuugaagcuaaauuacauagagaagguuucaucacaguagcuaacucugguaauaauccuauaguaguaccuccaaauggauacuuccgauuugaagcauggguaaaucaauucuauacucuaacuccaauggguacuggacaaggccgacgaagaaaccaauag

SEQ ID NO: 31133 - RNA, 1623 nt, Artificial Sequence
  derived and/or modified sequence opt6 from capsid_protein_VP1__Norovirus__AII02725
augaaaauggcaucaaaugacgcaaacccaucagauggaucugcugcaaaucuaguaccugaaguauccaaugaagucauggcauuagaaccagucguaggagccgccauagcagcaccaguagcuggucaacaaaaugucaucgacccuuggaucagaaauaacuuuguacaagcaccaggaggugaauuuacaguaucaccuagaaaugcaccaggagaaauccuauggucugcaccacuaggaccagaucuuaacccauaccuaucacaccuagcaagaauguauaauggauacgcaggcggauuugagguacaaguaauuuuagcagguaaugcauuuacagcaggcaaaauaauauucgcugcaguacccccaaacuuucccacugaaggacuuuccccaucccaaguaaccauguuuccucacaucauaguugacguacgccaacuagaaccaguuuuaauuccucuuccagauguaagaaauaauuucuaucauuauaaucaaaccaacgacucaaccauuaaauuaauagcaauguuguacacuccauuaagagcaaacaaugcaggagaagauguauuuacagucucauguagaguacuaacaagacccuccccagacuuugacuucaucuuucucguuccacccacgguugaauccagaacuaaaccguucacaguaccuauauuaacagucgaagaaaugacaaacagucgauuuccuguaccccuagaaaaacuauuuacagguccaucaggagcauucgucguccaaccacaaaauggaagauguaccaccgaugguguucuauuaggaacaacacaauuaucaccaguuaauauauguacauuuagaggagacguuacccauauagcagguuccagaaauuacacaaugaaucuagcuucauuaaauuggaauaauuaugauccaacagaagaaauaccugcaccacuaggcaccccugacuucguaggaaaaauacaaggagucuuaacacaaaccacaaaaggagacggaucaaccagaggacacaaagcaacaguauauacaggauccgcaccuuuuaccccaaaacuaggaucaguacaauucuccaccgauacagaaaacgauuucgaaacacaucaaaacacaaaauuuacaccaguuggaguuauacaagacggcgguaccacacaccgaaaugaaccacaacaauggguacuaccaucauacucaggaagagauguacauaauguccacuuagcuccugcaguugcaccaaccuuuccuggcgaacaauuacuuuucuucagauccacaaugccagguugcucaggauaucccaacauggauuuagauugucuacuaccgcaagaauggguucaacauuucuaucaagaagcagcucccgcucaaucugacguugcauuacuaagauucguuaacccugacaccggacgaguauuauucgaauguaaacuccauaaaucaggauauguaacaguagcacacaccggacaacaugaucuaguaauaccaccaaauggauauuucagauucgauucauggguuaaccaauuuuacacacucgcuccaaugggaaauggcacuggaagaagaagagcauuauaa

SEQ ID NO: 31134 - RNA, 1623 nt, Artificial Sequence
  derived and/or modified sequence opt6 from capsid_protein_VP1__Norovirus__AII02728
augaaaauggcaucaaaugacgcuaacccuucagacgguucagcagcaaauuuagucccugaagucucaaaugaaguaauggcauuagaaccaguuguaggagcagcuauagcagcaccaguugcaggacaacaaaacguaauugacccauggauaagaaauaacuucguccaagcaccaggaggcgaauucaccguaucaccaagaaaugcaccaggagaaaucuuauggagugcaccuuuaggaccagaucuaaaucccuaucucucucacuuagcaagaauguauaacggauacgcuggaggauucgaaguacaagucauacuagccggaaaugcauuuaccgcaggaaaaauuauuuucgcagccguaccaccaaauuuuccaaccgaaggacuaucaccaucacaaguaacaauguuuccacacauuauaguagauguccgccaacucgaaccaguauuaauaccacuaccagacgucagaaauaacuucuaccauuacaaccaaacaaaugacccaacaauaaaauuaaucgccaugcuauacacaccuuuaagagccaacaaugcaggagaagacguauucacaguaucuuguagaguacuaacuagaccaaguccagacuuugacuucaucuuccuaguaccuccuacagucgaauccagaacuaaaccauuuaccguaccaauacuaacaguagaagaaaugacaaauuccagauuuccaauuccccuugaaaaacuuuuuacaggcccaucaggcgccuucguaguacaaccacaaaacgguagauguaccacagauggaguacuucucggcacaacacaauuaucuccuguaaauaucuguacauucagaggagacguaacacauauagcaggauccagagauuauacaaugaauuuagcauccuuaaauuggaauaauuacgacccaacagaagaaaucccagcaccacuaggaacaccagacuuuguuggaaaaauacaaggaguauuaacucaaacaacaagaggcgacggaucaacaagaggucacaaagcuaccguauauacaggauccgcacccuuugcaccaaaauuaggaucuguacaauucucaacagauacugaaaacgacuucgaaacacaucaaaauacaaaauucacacccgucggagucauacaagacgguggaacaacacauagaaaugaaccacaacaauggguccuaccaaguuauucaggaagagacguacauaauguccaucuagcaccagccguagcaccuacuuuuccaggagaacaacuucuauucuucagaucuacaaugccaggaugcucaggauauccaaauauggaccuagauugcuuacuaccacaagaauggguccaacacuucuaucaagaagccgccccugcccaaucagacguugcacucuuacgauucguaaacccagacacaggaagaguauuauucgaaugcaaacuacauaaaucuggauacgucaccgucgcucacacaggacaacaugaucuaguaauacccccuaaugguuauuucagauuugauucuuggguaaaccaauucuauacucuagcaccaauggguaauggaaccgguagaagaagagcacucuaa

SEQ ID NO: 31135 - RNA, 1653 nt, Artificial Sequence
  derived and/or modified sequence opt6 from capsid_protein_VP1__Norovirus__AII02731
augaaaauggcuagcaacgaugcagccccaagcaaugauggagcagccaaucuaguaccagaagcaaauaaugaagucauggcacuagaaccuguaguaggagcauccauagcugcaccuguuguagggcaacaaaauaucauagacccauggauuagagaaaauuuuguacaagcaccacaaggugaauuuacaguaucaccaagaaauagucccggcgaaauguuauuaaacuuagaauuaggaccagaacuaaauccauauuuaucacacuuaucaagaauguauaauggauaugcaggcggaaugcaaguucaaguagucuuagcaggaaacgcauucacagccgguaaaaucauuuuugcagcaguuccaccacacuuuccaguugacaacauaucagcugcucaaauaacaauguguccucauguaauuguagacguaagacaauuagaaccaguacuacucccccuaccagauauaagaaauagauuuuuccauuacaaucaagaaaacaccccucguaugagacuaguagcuauguuguauacaccacuaagagcaaacucgggcgaagacguauucacaguaagcuguagaguacuaacacgaccagcaccagauuucgaauucacauuccucguccccccaacaguugaaucuaaaacaaaaccuuuuacauuaccaauauuaacuuuaggagaacuauccaacucaagauuuccagcagcaauugacauguuauauacagaccccaacgaaucaauaguaguacaaccacaaaacggaagauguacauuagauggaacauuacaagguacaacccaauuaguacccacacaaaucugcgcauucagagguacgcuaauaucccaaacagcuagagcagccgauuccacagauucaccucaacgcgcuagaaaccauccauuacauguacaaguuaaaaaccuagauggaacacaauaugauccaacagacgauauaccagccguacuaggcgccauugacuuuaaagguacaguauuuggcguagcaucacagagagauguuucaggaacacaagaacaaggacauuaugcaacaagagcacaugaagcacacaucgauacuacagacccaaaauaugcuccaaaacucggaacaauacucauaaaauccgaauccaccgacuucaauacaaaucaacccauacgcuuuacaccagucggaaugggagacaauaacuggcgccaaugggaacuuccagacuauucuggaagucuaacccuaaacaugaaccuagccccugccguuucaccaucauuuccuggagaaagaauccucuuuuuuagaucaauuguccccucagcuggagguuauggaucagguuauauagacugucuaauaccacaagaauggguacaacauuuuuaucaagaagccgcaccuucccaaucugcuguagcucuaguaagauauguaaaucccgauacaggaagaaauauuuucgaagcaaaacuacauagagaaggauuucuaaccgucgcaaacucaggaaacaacccuauaguaguaccaccaaacggcuacuuucgauuugaagccuggguuaaucaauuuuacacacucgcaccaauggguuccggucaaggaagaagacgagcacaauaa

SEQ ID NO: 31136 - RNA, 1623 nt, Artificial Sequence
  derived and/or modified sequence opt6 from capsid_protein_VP1__Norovirus__AII02734
augaaaauggcaucaaacgaugcaaauccaucagacggaucugcagcaaauuuaguaccugaaguuagcaaugaaguaauggcuuuagaaccuguaguaggugcagcaauagcagcaccuguagcaggacaacaaaauguaauagacccauggauuagaaauaauuuuguccaagcaccuggaggagaauuuaccguuagcccacgaaacgcaccaggcgaaauacuguggucagcaccucuagguccugaucucaacccauacuuaucccacuuagcccgaauguacaauggcuaugcuggaggauuugaaguucaaguaauacuagcaggaaaugcauuuacagcuggaaaaaucauauucgccgcaguacccccaaacuucccaaccgaagguuuaucacccucacaaguaacuauguucccucacauaauagucgacguaagacaacuagaacccguucucauaccauuaccagacguacgaaacaauuucuaucacuauaaucaaacaaaugacucaacaauaaaacugauagccauguuauacaccccacuaagagcaaacaacgccggagaagacguauuuaccguaagcugccgaguccuaacaagaccaagucccgacuuugacuuuauuuuuuuaguaccuccaacuguagaaucucgaacaaaaccauucacaguaccaauauuaacaguugaagaaaugacaaacaguagauuuccaauaccauuagaaaaacuauuuacuggacccucaggagccuucguaguucaaccacaaaauggaagaugcacaacagacgggguacuuuuaggaacaacacaacuaucaccuguaaauaucugcacauucagaggugaugucacacauauagcaggaucacguaauuacacaaugaaccuagcaucacucaacuggaacaauuacgaucccacagaagaaauaccagcuccacuaggaacaccagacuucgucgguaaaauacaagguguauuaacucaaacaacaaaaggugacggaucaacgagaggacacaaagcaacaguauacacagguuccgcuccuuuuacuccaaaacuuggaucuguacaauucucaacagauacagaaaacgauuucgaaacccaccaaaauacaaaauucacaccaguaggaguaauacaagacggaggaacaacacaucgcaaugaaccucaacaauggguuuuaccaucauacucaggacgagauguacauaacguccaucuagccccugcaguagcaccuaccuuccccggagaacaauuauuguucuuuagaucaaccaugccaggaugcucaggauaucccaacauggauuuagauugccuauuaccacaagaauggguacaacauuuuuaucaagaagcagcaccugcacaauccgacguagcauuacuaagauuuguaaacccagacacaggaagaguauuauuugaaugcaaacuucauaaaucaggauauguaacuguagcacauacaggucaacaugaucuaguaaucccaccaaauggauacuucagauucgauuccuggguaaaucaauuuuauacauuagcaccuaugggaaacggaacugggagaagaagagcucucuaa

SEQ ID NO: 31137 - RNA, 1623 nt, Artificial Sequence
  derived and/or modified sequence opt6 from capsid_protein_VP1__Norovirus__AII02737
augaaaauggcaaguaaugacgcaaauccauccgacggauccgcggcaaaccuaguaccugaaguaucaaaugaaguaauggcuuuagaaccaguuguaggggcagcaauagcagcaccaguagccggacaacaaaacguaauagauccauggauuagaaauaacuucguacaagcaccugguggugaauuuacaguaucacccagaaacgcaccaggagaaauacuauggucugcaccacuagguccagaccuaaauccauacuuaucacaucucgcucguauguacaacggauacgcaggcggcuucgaaguacaaguaauucuagcaggaaaugcauuuacagcaggaaaaauaauauuugcugcaguacccccuaacuuuccaaccgaaggccucucaccaucacaagucaccauguucccacauauaauaguagauguacgccaacuagaaccaguuuuaauaccauuaccugauguacgaaacaauuucuaccauuauaaccaaacuaaugauuccacaauuaaauuaauagcaaugcuauacacaccccuuagagcaaacaacgcuggagaagacgucuuuacaguaucaugcagaguauuaacaagacccucuccagauuuugauuuuauauucuuaguaccuccaacaguagaaucaagaacaaaaccauuuacaguacccauacuaacaguugaagaaaugacaaacucaagauucccaauaccacuagaaaaauuauuuacaggcccaucaggagcauucguaguacaaccucaaaaugguagauguacaaccgacggaguacuacucggcacaacacaacuuuccccaguaaauauauguacauuucgcggagauguaacucacauagcaggaucacgaaauuacaccaugaauuuagcaucccuaaauuggaauaauuacgauccaacagaagaaauaccagcaccacuugguacacccgauuuuguuggcaaaauacaaggagucuuaacccaaacaacaaaaggagauggaucaacaagaggucacaaagcaaccguauacacagguucagcaccauucacaccaaaacuaggcucaguacaauucucuaccgauacagaaaaugauuuugaaacacaucaaaacacaaaauucacaccaguaggaguaauacaagauggaggaaccacccacagaaacgaaccacaacaauggguauuaccuagcuauucaggcagagauguccauaauguacauuuagcucccgcaguagccccaacauucccaggcgaacaacuacuuuucuucagaaguacaaugccaggcuguucuggauauccaaauauggaucuagauugucuauuaccacaagaauggguacaacauuuuuaccaagaagcagcaccagcacaaucagacguagcucucuuaagauuuguuaaccccgacacaggaagaguacuauuugaaugcaaacuccauaaaucaggauauguuacuguagcacauacaggccaacacgaccuaguuaucccaccaaauggcuauuuuagauuugauucauggguaaaucaauucuauacauuagcuccaaugggaaacggaacaggaagacgaagagcacuauaa

SEQ ID NO: 31138 - RNA, 1623 nt, Artificial Sequence
  derived and/or modified sequence opt6 from capsid_protein_VP1__Norovirus__AII02740
augaaaauggcaccaaaugacgcaaauccaucagauggguccgcagcuaauuuaguaccagaaguaucaaacgaaguuauggcauuagaaccaguuguaggugcugcaauagccgccccuguagcuggacaacaaaaugucauagacccauggauaagaaacaauuuugugcaagcaccagguggagaauuuacaguaagucccagaaaugcacccggagaaauacuauggggcgcaccauuaggaccugauuuaaauccauaucuaucucacuuagcacgaauguauaacggauaugcugguggauucgaaguacaagucauacucgcagguaaugcauuuacagcuggaaagauaauuuucgcugcaguccccccuaacuuucccacagaaggcuuaucaccuagccaaguaacuauguuuccacacauaauaguagacguaagacaacuagaaccaguuuuaaucccauuaccagacgucagaaauaacuucuaccacuacaaccaaacaaaugacucaacaauuaaauuaauagcaauguuauacacaccacuaagagcaaacaaugccggugaagacguauuuacaguaagcuguagaguauuaacaagaccaucaccagacuuugauuuuaucuuuuuaguaccaccaacaguugaauccagaacaaaaccauuuacaguaccuauuuuaacaguagaagaaaugacuaacucucgauucccaauaccauuagaaaaacuuuuuacagguccauccggagcauucguaguacaaccacaaaacggacgauguacaacugaugguguacuauuaggaaccacacagcuaucaccaguaaacauauguacauuuagaggcgacgucacccacauugccggaucacgaaauuauacuaugaaucuugcaucacuaaauuggaacaauuaugauccaacugaagaaauuccagcaccucuaggaaccccagauuucgucggaaaaauacaaggaguacuaacacaaaccaccaagggagacggaucaacaagaggccacaaagcuacaguauauacaggcucugcuccauuuaccccuaaacuaggauccguacaauuuucaaccgauacagaaaacgauuuugaaacacaucaaaauacaaaauucacccccguuggaguaauacaagauggcggaacaacacacagaaacgaaccacaacaauggguucuaccaucauauuccggaagagacguacacaacguucauuuagcaccagcaguugccccuacauucccaggagaacaauuacuauucuuuagaucaacaaugccugguugcuccgguuacccaaauauggaccuagacugcuuauuaccacaagaauggguacaacauuucuaccaagaagcagccccagcucaaucagauguagcauuauuaagauuugucaauccagacacaggaagaguauuauuugaaugcaaacuccacaaaucaggauauguaacagucgcacacaauggacaacacgaccuagucauaccaccaaacggauauuuuagauuugauuccuggguaaaucaauuuuacacauuagcuccaaugggaaauggaacaggacgaagaagagcacuauaa

SEQ ID NO: 31139 - RNA, 1623 nt, Artificial Sequence
  derived and/or modified sequence opt6 from capsid_protein_VP1__Norovirus__AII02743
augaaaauggcaucaaaugaugcuaauccaucagauggaucagcagcuaaccuaguaccagaaguuucgaacgaagucauggcucuagaaccaguaguaggagcagcaauagcugcuccaguagcaggccaacagaauguaauugauccauggauacgcaacaacuuuguacaagcaccaggaggagaauuuacaguaucaccaagaaaugcaccaggagaaauacuauggucagccccacucgguccugaucuaaauccuuauuuaucacauuuagcaagaauguauaacggauacgcagggggauucgaaguacaagucauacuagcaggaaaugccuuuacagcaggcaaaaucauuuucgcagcuguaccacccaacuuuccaacugaagguuuaaguccaucccaaguaacuauguuuccacacauaauagucgacguacgacaauuagaaccagucuuaauaccacuuccagaugucagaaacaacuucuaucauuacaaucaaaccaaugacagcacaauaaaauuaauagcaaugcuuuacacaccacuacgcgccaauaacgcuggagaagacguauucacagucucauguagaguacuaacaagaccaucaccagauuuugauuuuaucuuuuuaguuccaccaaccguagaaucaagaacaaaaccauuuacaguaccaaucuuaacaguagaagaaaugacuaauucgagauuuccaauuccauuagaaaaacuauuuaccggacccucuggagcuuucguaguacaaccucaaaacgguagauguacaacugauggaguauuacuuggcaccacacaauuaagcccaguaaauauauguacauuuagaggagacguuacacacauagcaggcucaagagauuacacaaugaaucuagcuagcuuaaacuggaacaauuaugauccaacagaagaaauuccagcacccuuaggaacaccagacuuuguaggaaaaauacaagguguauuaacacaaacaaccaaaggcgacggcuccacuagaggacacaaagcuacaguauauacugguucugcaccauucacaccaaaacuuggaagcguucaauucucaacagauacagaaaaugauuuugaaacacaccaaaacacaaaauucacuccaguaggaguaauacaagaugguggaacaacacaucgcaaugaaccacaacaauggguacuaccaucauauuccggaagagauguacauaacguucaccuagcaccugccguagcaccuacuuuccccggagaacaacuauuauucuuuagaucaacuaugcccgguugcucugguuauccaaauauggaucuagacugcuuacuaccacaagaauggguccaacacuucuaucaagaagcugcaccugcucaauccgaugucgcacuacuacgauuuguaaauccugacacaggaagaguucuauuugaaugcaaacuucauaaaucaggauauguaacagucgcacacaccggucaacacgaccuaguaaucccucccaauggauauuucagguuugauucauggguaaaucaauuuuacacacuugcaccaaugggcaacggaacaggaagaagaagagcauuauaa

SEQ ID NO: 31140 - RNA, 1623 nt, Artificial Sequence
  derived and/or modified sequence opt6 from capsid_protein_VP1__Norovirus__AII02746
augaaaauggcaucaaaugacgcaaauccuucagauggcucagcagcaaauuuaguaccagaaguaaauaacgaaguaauggccuuagaaccaguaguaggugcagcaauugcagccccuguagcaggacaacaaaacguaauagacccuuggauacgcaauaauuuuguacaagcaccuggaggcgaauuuacaguaucaccaagaaacgcccccggagaaauacuuuggucagccccauuaggacccgaccuaaauccauacuuaucacauuuagcaagaauguauaacggcuaugcaggagguuucgaaguccaaguaauacuagcaggaaaugcuuuuacagcaggaaaaauaauauuugcugcaguuccaccaaacuuuccaacagaagguuuaucaccaucccaaguuacaauguucccacauauaaucguagacguacgccaacuugaaccaguccuuauuccucuuccagauguuagaaauaauuuuuaccauuacaaucaauccaaugacuccaccauaaaacuaauagcaauguuauacacaccccuaagagccaacaacgcaggagaagauguuuucacaguaucaugucgaguacuaacacgaccaucaccagauuuugauuuuauauuuuuaguuccuccaacuguagaaucuagaacaaaaccuuuuacaguaccaauauuaacagucgaagaaaugacaaauucacgcuuuccaauaccacuugaaaaacuauuuacaggacccucaggagcauucauaguccaaccccaaaauggaagauguacaaccgacggaguauuacuagguacaacacaacuuucaccagucaauauuuguacauuuagaggagacguaacacauauugcaggaucacguaauuacaccaugaaccuugcuucacuaaauuggaauaauuaugauccaacagaagaaaucccagcaccacuuggaacaccugauuucguaggaaaaauucaaggaguacuaacccaaacaacaaaaggagacggaucaaccagaggucacaaagcaacugucuauacaggauccgcuccauuuacaccaaaacuaggcucaguacaauucucaacagauacagaaaacgacuuugaagcccaucaaaacacuaaauuuacuccaguaggcguaauccaagacggaggaacaacacaccguaaugaaccacaacaauggguacuaccuuccuauucaggaagagauguacauaacguucaucuagcccccgcaguagcaccaacauuucccggcgaacaguuacuuuucuuucgaucaacaaugccaggcugcuccggauaucccaacauggaucuagauugccucuuaccccaagaauggguacaacacuuuuaccaagaagcagcaccagcucaaucugauguagcauuauuaagauuuguaaauccugacacaggaagaguacucuucgaaugcaagcuacacaaaagcggauacgucacuguagcccauacaggccaacaugacuuaguaaucccaccuaaugguuauuuccguuucgauucauggguaaaucaauuuuacacucucgcaccaauggguaacgguacuggaagaagacgcgcauuauaa

SEQ ID NO: 31141 - RNA, 1623 nt, Artificial Sequence
  derived and/or modified sequence opt6 from capsid_protein_VP1__Norovirus__AII02749
augaaaauggcaucaaaugacgcaaauccauccgaugguucagccgcuaacuuaguaccagaaguuucuaaugaaguaauggcacuugaaccaguaguaggcgcugcaaucgcagcaccugucgcuggccaacaaaauguaauagauccauggauuagaaacaauuucguacaagcaccuggaggagaauucacaguaucaccacgcaaugcucccggagaaauccuauggagugcaccucucggacccgacuuaaauccauauuuaucacaccuugcacgaauguauaacggauacgccggaggauuugaaguucaaguaauauuagcaggaaacgcauucacagcaggaaaaauaaucuuugcagcaguaccaccaaauuuuccaacagaaggucuauccccaagccaaguaacaauguuuccucacauuauuguagauguaagacaauuagaaccaguacuaauaccccuaccagacguacguaacaacuucuaucacuacaaccaaacaaacgacucuacaaucaaauuaauagcaauguuauacacaccauuaagagcuaacaaugcuggagaagacguauuuacaguuuccugcagaguacuaacuagaccuucaccagauuucgauuucauauuccucguuccuccaacaguagaaaguagaacuaaacccuucacaguaccuauauuaaccguagaagaaaugacuaauucacgauuuccaauuccacuagaaaaacucuuuacagguccuaguggcgcauuuguaguucaaccacaaaaugguagaugcaccacagauggaguacucuuaggaacaacacaacuaucaccaguaaauauaugcaccuuuagaggagacguaacacauauagcaggaucucgaaauuacacaaugaaucuagcaucacuaaacuggaauaacuacgauccuacagaagaaauaccagcaccucuugguacaccagacuuuguaggaaaaauacaagguguauuaacacaaacuacaaaaggagaugguuccacgagaggacacaaagcuacagucuauacaggcucagcaccauucacaccaaaacuuggguccguacaauuuucuacagacacagaaaacgauuucgaaacucaucaaaauacaaaauucacaccaguuggcguuauucaagacgguggcacaacacaucgcaaugaaccacaacaauggguacuaccaucauauucaggaagagauguacauaauguucacuuagcuccagcaguugcuccaacauucccaggugaacaacuccuauucuuuagaucuacaaugccaggaugcucaggauauccaaauauggauuuagauuguuuauuaccccaagaauggguucaacauuuuuaucaagaagcagccccagcacaaucagaugucgcauuauuaagauuuguaaacccagacacaggaagaguuuuauucgaauguaaauuacauaaaucaggauacguaacagucgcacacacaggucaacaugaucuaguaauaccacccaauggauacuucagauucgauuccuggguaaaucaauuuuacacacuagcuccaaugggaaacggcacaggcagacgaagagcauuauaa

SEQ ID NO: 31142 - RNA, 1623 nt, Artificial Sequence
  derived and/or modified sequence opt6 from capsid_protein_VP1__Norovirus__AII02752
augaaaauggcaucaaaugaugccaacccaucugauggcuccgcagcuaauuuaguaccagaaguaucaaaugaaguaauggcuuuagaaccaguaguuggagcagcaauagcagccccaguagccggacaacaaaaugucauagacccauggaucagaaauaauuucguccaagcucccggaggugaauuuacaguuuccccccgaaaugcaccaggagaaauuuuauggucagcuccucuaggcccagaucuaaaucccuaucuaagucacuuagcuagaauguacaacgguuaugcgggaggauucgaaguacaaguaauuuuagcaggaaaugcauuuacagcaggaaaaauaauauucgcagcaguaccacccaauuuccccaccgaaggacuaucaccaucccaaguaacaauguuuccacacauuauaguagacguccgacagcucgaaccaguauuaaucccacuaccagauguaagaaacaacuuuuaucacuauaaccaaacaaaugacucaacaauaaaacuuauagcaaugcuauauacuccacuaagagcaaacaaugccggagaagaugucuuuacuguauccugucgaguuuuaacaagaccaucaccagacuucgauuuuauauuccucgucccaccaacaguugaaucaagaacuaagccauuuacaguaccuauacuaacaguagaagaaaugacgaauagccgauuuccaauaccucuugaaaaacucuuuacaggcccgucaggagcuuuuguaguccaaccucaaaauggaagauguacaacagacgguguauuacuaggaacaacacaauuaagcccagucaauauuuguacauucagaggugacgucacucauauugcaggaucuagaaauuauacaaugaaucuugcaucacuaaacuggaacaauuaugaucccacagaagaaauaccagccccucuaggaacuccagacuuuguaggaaaaauacaaggaguuuuaacucaaacaacaaaagaagauggaucaacaagaggacacaaagcaacagucuauacaggcucagcaccauuuacaccuaaauuaggaucuguacaauuuucuacagauacagaaaacgacuucgaaacacaccaaaauacaaaguuuacacccguaggaguaauacaagacggaggaaccacgcacagaaacgaaccacaacaauggguccuacccuccuauucaggacgagauguacacaacguacacuuagcaccagcaguagcaccaacauuuccuggugaacaacuauuauucuuucgcucaacaaugccaggcuguucagguuauccaaauauggacuuagacugccuauuaccacaagaauggguacaacauuucuaccaagaagcagcaccugcacaaucagacgucgcccuucuuagauucguaaacccagacacaggacguguauuauucgaaugcaaacuucauaaaucagguuauguaaccgucgcucacacaggacaacacgauuuaguaauuccuccuaauggauacuuucgauuugauucauggguaaaucaauuuuauacauuagccccaaugggaaauggcacaggaagacguagagcacuauaa

SEQ ID NO: 31143 - RNA, 1623 nt, Artificial Sequence
  derived and/or modified sequence opt6 from capsid_protein_VP1__Norovirus__AII02758
augaaaauggcuagcucagacgcuaacccaucagauggaucaacagcaaaccuuguaccagaaguuaacaaugaaguaauggcucucgaaccaguagucggagcagcaaucgcagccccaguagcuggacaacaaaauguaauagauccauggauaagaaacaauuuuguccaagcaccaggcggagaauucacaguuuccccacgcaacgcccccggagaaauacucugguccgcaccacuuggacccgaucuaaauccauauuuaucucaccuagcaagaauguauaacggauaugcuggaggauuugaaguacaaguaauccuagcuggaaaugccuuuacagcuggcaaaauaaucuucgcagcaguaccaccaaacuuucccacagaaggacucuccccaucacaaguuacaauguuuccacacauaauagucgacguuagacaacuugaaccaguauuaauuccacuaccagauguaagaaacaauuucuaccacuauaaccaaucaaaugacccaacaaucaaauuaauagcaaugcuauacacuccuuuaagagccaacaaugcuggagacgacguauuuacuguuagcugucgaguacuuacaagaccaucaccagauuuugacuuuauauuccucgucccuccaacaguagaaucaagaacaaaaccauuuucugucccaguuuugaccguagaagaaaugaccaacucaagauucccaauuccuuuagaaaaacuauuuaccggaccaucuucagcauuuguaguucaaccacaaaacggucgcugcacaacagacgguguucuuuuaggaacaacacaacuuucgccagucaauauaugcacauuuagaggagacguuacacauauaccaggaucucgaaacuacacaaugaacuuagcuagccaaaacuggaauucuuaugauccaacugaagaaauuccagcuccccucggcacaccagacuucgucggaaaaauacaaggaguacuaacacaaacaacaagaacaaauggaagcacgagaggacacaaagcaacaguauauacaggauccgcugacuuuucaccaaaauuaggaagaguacaauucgcaacagauacagacaaugauuuugaaaccaaucagaauacaaaauuuacaccuguaggaguaauacaagacgguagcaccaccccuagaaaugaaccucaacaauggguucuaccaucauauucuggcagaaauauacauaauguccauuuagccccagcagucgccccaacauucccaggagaacaacuacuauucuuucgcagcacuaugccugguugcucaggauauccaaauauggauuuagauugcuuacuaccacaagaauggguacaauauuucuaucaagaagcagcuccagcacaaucagauguugcccuauuaagauuuguuaauccagacacaggaagaguacuauucgaauguaaacuucacaaaucuggauauguaacaguagcacauacuggacaacacgaccucguaauaccaccaaauggguauuucagauuugacucauggguuaaucaauuuuauacauuagcaccaaugggaaacggcacaggacgccgacgcgcauuauaa

SEQ ID NO: 31144 - RNA, 1623 nt, Artificial Sequence
  derived and/or modified sequence opt6 from capsid_protein_VP1__Norovirus__AII02761
augaaaauggcauccucagaugcaaauccaucugacggaucuacagcaaaucuagucccagaaguaaacaaugaaguaauggcacuugaaccaguugucggagcagcaaucgcagcaccaguagccggacaacaaaacguaaucgauccuuggauuagaaauaauuuuguacaagcaccugguggagaauuuacaguaucaccacguaaugcaccaggagaaauacuaugguccgccccacuaggaccagauuuaaaucccuaucuaucacauuuagcuagaauguauaacggauacgcaggaggauucgaaguccaaguaauccucgcuggaaaugccuucacagcagguaaaauaauauucgcagcuguaccaccuaauuuuccaacagaaggacuuucacccucucaaguuaccauguuuccacaccuaauaguagacguaaggcaauuagaaccaguccuaauuccacuuccagauguuagaaacaacuucuaucauuacaaucaaucuaaugauccuaccauaaaacuaauagcaaugcuauacacuccacuaagagccaauaaugcaggagacgauguauuuacaguauccugcagaguacuaacuagaccuucaccagauuucgacuuuaucuuccuaguaccaccaacgguugaaaguagaacuaaaccauucucaguacccguacuuacaguagaagaaaugaccaauuccagauuccccauuccucuagaaaaacuauuuacaggacccuccucagcauuuguaguucaaccacaaaacggaagauguacaacagauggcguauuacuugguacuacacaacucucaccagucaauauauguacuuuuagaggugacguuacacauauaucaggaucaagaaauuauacaaugaaccucgcuucacaaaauuggaacucauaugacccaacugaagaaauaccagcaccccuuggcacaccagacuucguagguaaaauacaagguguauugacacaaaccaccagaaccaauggauccacuagaggucauaaagcaacugucuacacuggaucugcagauuuuaguccaaaauuaggccgaguccaauuugcaacagauacagauaacgauuuugaaacaaaccaaaacacaaaauuuacacccguaggaguaauacaagacgguagcacuacaccucguaaugaaccacaacaauggguccucccauccuacucaggaagaaauauacauaacguacaccuagcuccugcaguagccccaaccuuuccaggagaacaauuauuauucuuccgaucaaccaugccagguugcucuggcuauccaaauauggaccuagauugcuuacuaccccaagaauggguucaauauuucuaucaagaagcagcacccgcacaauccgacguugcauuauuacguuucguaaauccagauacaggaagaguccuauucgaaugcaaacuacauaaaucaggauauguaacaguagcacauacaggucaacaugacuuaguuauacccccaaaugguuacuucagauucgauucauggguaaaccaauuuuauacacucgcacccaugggaaauggaacaggacguagaagagcauuauga

SEQ ID NO: 31145 - RNA, 1623 nt, Artificial Sequence
  derived and/or modified sequence opt6 from capsid_protein_VP1__Norovirus__AII02764
augaaaauggcuucuaaugacgcaaacccaucagauggauccgcagcaaaucuaguaccagaaguuucaaaugaaguuauggcacuugaaccaguaguaggagcugcaaucgcagcaccuguagccggacaacaaaaugucauagauccauggauaagaaauaacuuuguacaagcuccaggaggagaauuuacaguuucaccuagaaacgcaccaggagaaauacuaugguccgcaccacuaggcccagaucuuaacccauaucuuucucauuuagcacgaauguauaacggauacgccggaggcuuugaaguucaaguaauacuagcuggcaacgccuucaccgccggcaaaauaauauucgccgccguaccuccaaacuuuccaacagaaggucuuucaccaucucaaguuacuauguuuccacacauuauaguagacguaagacaacuagaaccaguucuaauaccuuuaccagauguaagaaauaauuucuaccacuauaaucaaacaaacgacucaacuauaaaauuaauagcuaugcucuacaccccacuaagagcaaacaaugcaggagaagauguauuuacaguaucaugucgcguuuuaacuagaccaucuccagacuuugacuuuauauuccuugucccaccaacagucgaaucuagaacaaaaccauucacagucccaauucuaacaguagaagaaaugacuaacucaagauuucccauucccuuagaaaaacucuucaccggaccgucuggcgcuuuuguaguacaaccacaaaacggaagaugcacuacagaugguguauuacuaggaacaacucaacuaagcccaguaaauauauguacauuucgaggugacguaacacacauagcuggaucaagaaauuauacaaugaaccuagcaucauuaaacuggaacaauuacgaccccaccgaagaaaucccagcaccacuagguacaccagacuuuguaggcaaaauacaaggcguacucacucaaacuacaaaaggagacggaaguaccagaggccauaaagcaacuguauacacaggaucagcaccuuuuacaccaaaacuaggaucaguacaauucaguaccgauacugaaaaugacuuugaaacucaucaaaauacaaaauucacuccaguaggagucauacaagacggcggaacaacccauagaaaugaaccucaacaauggguauuaccaucauauagcgguagagacguacauaauguucaccuagcaccagccguugcacccacauucccaggagaacaacuacuauucuucagaucaacaaugccugguugcucaggauaucccaauauggaucuagauuguuuauuaccccaagaauggguacaacauuuuuaucaagaagcagcccccgcacaaucagauguagcacuauuaagauuuguuaauccugacacaggucgaguacuauucgaaugcaaacuacacaaaucaggcuauguuacaguagcacacacaggacaacaugauuuaguuauuccacccaaugguuauuuucgcuucgauucauggguaaaucaauuuuacacucucgcacccaugggcaauggcaccggcagaagaagagcacuauaa

SEQ ID NO: 31146 - RNA, 1623 nt, Artificial Sequence
  derived and/or modified sequence opt6 from capsid_protein_VP1__Norovirus__AII02767
augaaaauggcaucuaaugacgcaaauccauccgauggauccgccgcaaacuuaguaccugaaguaucaaacgaaguaauggcacuagaaccaguaguaggagccgcaauagcugcaccaguugcaggacaacaaaaugucauugacccauggauacgaaauaacuucguacaagcaccagguggcgaauucacaguaucgccacguaaugcaccaggagaaaucuuaugguccgcuccacuuggaccagaucucaauccuuaucuaucacaucuagcuagaauguauaacggauaugcaggcggauucgaaguacaaguaaucuuagcagguaaugcauucacagccggaaaaauaauauuugcagcugucccaccaaauuuuccaacagaaggauuaucacccagucaaguaacaauguucccgcacauaauaguagacgucagacaauuagaaccaguauuaauaccuuuaccagacguaagaaauaauuuuuaucacuacaaucaaacaaaugacuccacaauaaaauuaauugcuauguuauacacuccucuaagagcuaauaaugccggcgaagauguauuuacaguaucaugccguguauuaacacgcccaucaccagacuuugauuuuaucuuuuuaguaccaccuacaguugaauccagaacaaaaccauucacaguaccaauacuaaccguagaagaaaugacaaacucuagauucccaauacccuuagaaaaacuauuuacagguccaucuggcgcuuucguaguucaaccacaaaaugguagauguacuacagaugguguacuacuaggaaccacucaacuuuccccggucaacauuuguacauuuagaggagacguaacacauauagcaggaucucgcaauuacacuaugaaccuugccucauuaaacuggaacaauuacgauccuacugaagaaauaccagcaccacuaggaacacccgacuucguuggaaaaauacaaggaguauuaacacaaaccacaaaaggcgacggaucaacaagaggucauaaagcaacuguauauacaggcagugccccauuuacaccaaagcuuggaucuguccaguuuagcacagauacagaaaaugauuuugaaacacaucaaaauacaaaauuuacaccagucgguguaauccaagaugguggaacaacacaccgcaacgaaccacaacaauggguccuaccuucuuacagcggacgagauguacauaauguacauuuagcaccagcuguugcaccuaccuucccaggagaacaacuauuauucuuuagaucuacuaugccaggauguucuggauacccaaauauggaucuugacugcuuauuaccccaagaauggguacaacauuucuaucaagaagcagcuccagcccaaucagacguagcccugcuaagauuuguaaacccagacacaggaagaguauuauucgaauguaaacuacacaaaucaggauaugucacaguagcucauaccggucaacacgaucuaguuauaccacccaaugguuauuucagauuugauucaugggucaaucaauucuauacgcuagcgcccaugggcaauggaacaggaagaagaagagcacuuuaa

SEQ ID NO: 31147 - RNA, 1647 nt, Artificial Sequence
  derived and/or modified sequence opt6 from capsid_protein_VP1__Norovirus__AII02770
augaaaauggcauccaacgaugcagcaccaucaaacgacggagcagcaggacuagucccagaaauaaacucugaagccauggccuuagaaccagucgcaggcgccgcaauagcagccccucuaacaggccaacaaaauauaauagacccauggauaaugaacaauuuuguacaagcaccuggaggagaauucaccguaucuccucgcaauucaccuggagaagucuuacuaaaucuagaacuuggaccagaaaucaacccauaucucgcucauuuagcucgcauguauaauggcuacgcuggaggauucgaaguacaaguaguacuagcaggcaaugcauuuacugccggaaaaaucauauuugcagcaauccccccaaacuuuccaauagacaaucuaucagcagcucaaaucacaauguguccucauguaauagucgacguaagacaauuagaaccaguaaacuuaccaaugcccgauguacgaaauaauuucuuccauuauaaccaaggaucagacucaagauuaagacucauagcuauguuauacacuccccuaagagcaaacaauucaggagaugauguauuuacaguaucaugucgagucuuaacucgaccaucacccgacuucucauuuaacuuuuuaguaccaccaacuguugaaucaaaaacaaaaccauuuucacuaccuauacucacaauaucagaaaugucuaacagucguuuuccaguucccauugauucauuacacacaucaccaacagaaaacauaguaguccaaugucaaaacggucgaguuacauuagacggagaacuaaugggaacaacucaacuauuaccaucacaaaucugugcauuucgcggaauguuaacaagaucaacauccagagcaucugaucaagcagacaccgccacaccaagacuauucaauuacuacuggcacauacaacuagacaauuuaaacgguacuccauacgacccagccgaagauaucccaggaccucuagguacaccagacuuuagaggaaaagucuuuggaguugcaagucaacgaaacccugacgcaaccacacgagcacacgaagccaaaauagauacuacuucuggaagauuuacacccaaacuaggaucacucgaaauaucaacagaaucuggcgacuuugaucaaaaucaaccaacaagauuuacuccaguaggaaucgguguugaucaugaagcugauuuucaacaauggacacuaccagacuacgcaggacaauuuacccauaauaugaaucuagcaccugcagucgcaccaaacuuuccaggagaacaauuauuauucuuuagaucacaauuacccucaucaggaggucgaucaaacgguauucuugacugucuaguaccacaagaauggguacaacacuucuaccaagaaucagcccccucccaaacacaaguagcauuaguucgcuauguaaacccagauacuggacguguauuauucgaagccaaacuucauaaacuaggauuuaugacaauagcaaaaaguggagauuccccaauaacaguaccucccaauggauacuuccgauucgaaucauggguaaauccauuuuauacacuugcuccaauggguacaggaaacggaagaagacguauccaauaa

SEQ ID NO: 31148 - RNA, 1623 nt, Artificial Sequence
  derived and/or modified sequence opt6 from capsid_protein_VP1__Norovirus__AII02773
augaaaauggcuuccaaugacgcaaauccaagugacggaucagcagcaaaccuagucccugaaguuucuaacgaaguaauggcacuugaaccuguuguaggagcagcaauagcagcccccguagcuggacaacaaaaugucaucgauccauggauaagaaauaacuuuguacaagcaccuggcggagaauuuacaguauccccacgaaacgcacccggagaaauuuuauggucugcaccacuaggaccagaucuaaauccauaccuaucucaccuagcacgaauguauaauggauaugcuggcggauuugaaguacaagucauacuagccggcaaugccuucaccgccggaaaaauaauauucgcagcaguacccccuaauuuuccaacagaaggacuaucaccaucucaaguaacuauguuuccucauauaauaguagaugugagacaauuagaaccuguauuaauaccauuaccagauguuagaaauaauuucuaucacuauaaccaaacaaacgacucaacaauaaaacuuaucgcaaugcuuuacacaccauuaagagcaaacaaugcaggagaagaugucuuuacaguaucuuguagaguauuaaccagaccuaguccagauuuugauuuuauauuuuuaguaccaccaaccguugaaucccgaacaaaaccauucacagucccaauacucacaguugaagaaaugacaaauucuagauucccaauaccauuagaaaaauuauucacaggacccaguggagcauuuguuguucaaccucaaaacggaagaugcaccacagacggaguacuauuagguaccacacaacuaucacccguaaacauauguacauucagaggagacguaacacacauagcaggaucaagaaauuauacuaugaaucuagcauccuuaaacuggaacaauuacgaccccacagaagaaauaccugcaccuuuaggaacaccagacuucgucgguaaaauacaaggaguacuuacccaaacaacaaaaggcgauggaucaacaagaggacacaaagcaacuguuuacacuggcucagcucccuuuacaccaaaauuagguucaguacaauucucaaccgacacugaaaacgauuuugaaacucaucagaacacaaaauucacuccuguaggcguaauacaagacggaggaacaacacauagaaaugaaccacaacaaugggugcuaccaucauacucaggaagagauguacauaauguacacuuagcaccugcaguagcaccaaccuuuccaggugaacaauuacuauuuuucagaucuacuaugccagguuguuccggcuacccaaauauggacuuagacuguuuacuaccacaagaauggguccaacauuuuuaccaagaagcagcaccagcacaaucagauguugcauuauuaagauucguaaauccugacacugguagaguacuuuuugaauguaaauuacauaaaucaggauacguuacuguagcacacacaggacaacaugauuuaguaauaccaccgaauggauauuuuagauucgauucauggguaaaucaauuuuacacacuagcucccaugggaaaugguacaggaagaagaagagcuuuauaa

SEQ ID NO: 31149 - RNA, 1650 nt, Artificial Sequence
  derived and/or modified sequence opt6 from capsid_protein_VP1__Norovirus__AII02776
augaaaauggcauccaaugaugcagcaccaaguaaugacggagcagcaaauuuaguaccagaagcaaacaaugaagugauggcccuagaaccuguaguaggagcaucuauagcagccccuguaguaggccaacaaaauaucauugaccccuggauacgagaaaauuuuguacaagccccacaaggagaauuuacagugaguccacgaaacucuccaggugaaaugcuacuaaacuuagaacuaggaccagaacuaaaccccuacuuaucacacuuaaguagaauguauaacggcuaugcaggaggaaugcaaguccaaguaguacuagcaggaaacgcauuuacagcaggcaaaaucauauucgcagccguaccaccucauuuucccguagaaaauauaaaugccgcacaaauaacuaugugcccacacguaauaguagacguaagacaacuagaacccguucuacuaccauuaccagauaucagaaauagauucuuucacuauaaccaagaagacacaccaagaaugagauuaguugcaaugcuauacacacccuuacgagcaaacaguggagaagauguauucacaguuucaugucgcguauuaacaagaccugcaccagauuuugaauucacauuuuuagucccaccaaccguagaaucaaaaacaaaaccauuuacacuacccauacuuacccuaggggaacuaagcaauucacgauuuccugcaccaauugauaugcuauacacagauccaaacgaaggaauaguuguacaaccacaaaacgguagaugcacuuuagauggaacauuacaaggcacaacacaauuaguaccaacacaaaucugugcauuucgaggaauacuuauaggacaaacaucacgaucuccagacucagacucaaccgauagugcaccaagaagacgugaucauccacuucacaugcaacuugaaaaucuagacggaacccaauacgauccaacagacgaaguaccagcagcacuaggagcaguagacuuuaaaggaacuauauucggaguagcaucacaacgagauacaucaggcucacagguaggagcaaccagagcucacgaaguaauuaucaacacaacagauccuagguauacaccuaaauuaggaaguguacuuauguauucagaaucucaagauuucgagacaggucaaccaauaagauucacacccauaggaaugggagaaaaugauuggcaucaaugggaacuaccuaauuacucaggcagauuaacauuaaauaugaauuuagcaccugcaguugccccagcauucccaggagaaagaauauuauuuuucagaaguauuguaccaagugcaggaggauauggaucgggacaaauggauugccuauuaccacaagaauggauacaacacuuuuaccaagaagccgcacccagucaaagcgcaguagcccuaauaagauaugucaacccagauacaggcagaaacauauuugaagcaaaacuucacagagaaggauuuauaacaguagcaaauaguggaaauaauccaaucguaguaccaccuaacgguuacuuuagauucgaagccuggguaaaucaauucuacacucuaacaccaaugggaacuggccaaggacgucgaagaaaucaauaa

SEQ ID NO: 31150 - RNA, 1623 nt, Artificial Sequence
  derived and/or modified sequence opt6 from capsid_protein_VP1__Norovirus__AII02779
augaaaauggccucuaacgacgcuaauccaagugauggcucugcagcuaacuuaguuccagaaguaagcaaugaaguaauggcacuagaaccaguuguaggugccgcaauugcagcaccugucgcaggacaacaaaauguaauagacccauggauaagaaauaauuucguacaagccccagguggagaguuuacaguaucaccacgaaaugcaccuggagaaauacuauggucagcaccauuaggaccagaucuaaauccuuaucuaucucaccuagcaagaauguauaacgguuaugcugguggauucgaaguacaaguaauuuuagccggaaacgcauucaccgcuggaaaaauaauauuugcagccguacccccuaacuuucccacagaaggacuaucaccaucccaaguaaccauguucccucacauaauugucgacguaagacaacuagaaccaguucuaauaccauuacccgauguaagaaacaauuuuuaucauuauaaccaaacaaaugacucaacaauaaaacucauagccaugcuuuacaccccacuuagagcaaauaaugcaggagaagacguauucacaguaucaugcagaguacuaacucgaccuuccccagacuuugacuucauauuucuuguuccaccuacugucgaaucacgaacaaaaccauuuacaguaccaauccuaacagucgaagaaaugacaaacuccagauuuccaauuccacuugaaaaacuauucacagguccaucaggagccuucguuguucaaccacaaaacggacguuguacaacagacggaguauuacuaggaacaacacaauuaucaccaguaaauauauguacauuuagaggagaugucacacacauagccggaucaagaaauuacacuaugaacuuagcaucauuaaauuggaacaacuacgacccaacugaagaaauaccugcaccacuaggaacaccagauuucguuggcaaaauacaaggaguacuaacccaaacaacuaaaggagacggauccacaagaggacauaaagcaacaguuuacaccgguucggcaccauucacaccaaaauuaggaucaguacaauuuucaaccgauacagaaaacgauuuugaaacacaccaaaauacaaaauuuacaccaguuggaguaauacaagacggaggaacaacccauagaaaugaaccacaacaauggguacuaccaucuuauucaggacgugauguucauaauguccacuuagccccagccguagcaccaacauuuccgggugaacaacuauuauucuuccgcucuacaaugccaggaugcucuggauaucccaauauggaccuagauugcuuauuaccucaagaauggguacaacauuucuaucaagaagcugcuccugcccaaucagaugucgcccuacucagguucguaaacccagacacaggaagaguacuauucgaaugcaaauuacauaaaucaggauaugucacaguagcucacacaggacaacaugaucuaguaaucccaccaaauggauacuuuagauucgauucauggguaaaccaauuuuacacauuagcuccaaugggaaauggaacuggccgcagaagagcacuauaa

SEQ ID NO: 31151 - RNA, 1623 nt, Artificial Sequence
  derived and/or modified sequence opt6 from capsid_protein_VP1__Norovirus__AII02782
augaaaauggcuucaaacgaugcuaaucccuccgauggaucagcagccaaccucguucccgaaguaucaaacgaaguaauggcauuagaaccaguuguaggcgcugcaauagcugcaccuguagcaggucaacaaaauguaauugacccuuggauacgaaauaacuucguacaagcaccagguggagaauucaccguaucaccaagaaaugcuccaggcgaaauauuauggagcgcaccacuaggaccagauuuaaauccauaucuaucgcaccucgcacgaauguauaauggauaugcaggaggauucgaaguacaaguaauucuugcuggaaaugccuuuacagcaggaaaaauaauauucgcagcagucccacccaauuucccgacagaaggccuaucaccaucacaaguaacaauguucccacacauuauagucgauguaagacaauuagaaccuguacuaauaccauuaccagauguuagaaauaauuuuuaccacuauaaucaaacaaaugacucaacuauaaaauuaaucgccaugcuauauaccccauuacgcgcaaacaacgcaggagaagacguauuuacaguauccuguagaguacucacaagacccucaccagauuuugacuucauauuucuuguaccacccaccguagaaucuagaacaaaaccauuuacagucccaauacuaacuguagaagaaaugacaaauucccgauucccuauaccuuuagaaaaacucuuuacaggacccucaggagcauucguaguacaaccacaaaauggaagauguacuacugauggcguauuacuaggaacaacacaauuaucacccgucaauauauguacuuuucgaggugauguaacacauauagcaggaagucgaaauuacacaaugaauuuagcuagucuaaacuggaacaauuaugacccaacagaggaaauuccagcacccuuagguacuccugacuuuguuggaaaaauacaaggaguauuaacccaaaccacaaaaggugauggaucuaccagaggacacaaagcaacaguuuauacaggcuccgcaccuuuuacacccaaacuaggcucuguacaauucucaaccgauacugaaaacgacuuugaaacacaucaaaacacaaaauucacaccuguaggaguaauacaagauggaggaacaacacaucgaaacgaaccacaacagugggucuuaccaagcuauucagguagagacguacacaauguacauuuagcaccagcaguggcaccaacauuucccggagaacaacuauuauuuuucaggucaacaaugccagguuguucuggauaucccaauauggaucuagauuguuuacuaccacaagaauggguucaacauuucuaccaagaagccgcacccgcucaaucagacguagcauuacuaagauucguaaacccagacacaggaaggguuuuauuugaauguaaacuccauaaaucaggauauguaacuguagcacauacaggacaacaugauuuaguaauaccaccuaacggauauuuuagauuugauucauggguaaaucaauuuuauacucucgcaccaaugggaaacgguacuggcagaagaagagcauuauaa

SEQ ID NO: 31152 - RNA, 1623 nt, Artificial Sequence
  derived and/or modified sequence opt6 from capsid_protein_VP1__Norovirus__AII02785
augaaaauggcaucaaacgacgcuaacccaucagauggaagcgcagcuaaucuaguacccgaaguuucaaaugaaguaauggcacuugaaccuguuguaggagcagcaaucgcagcaccaguagccggacaacaaaauguaaucgacccauggauacguaauaauuuuguacaagcaccuggaggagaauuuacaguaucaccacgaaacgcaccaggugaaauacuauggucagcaccacuaggcccagaccuaaacccauaccuaucacaccuagccagaauguauaacggauaugcaggcgguuucgaaguacaaguaaucuuagcaggaaaugcauuuacagcaggaaaaauuauuuucgccgcagucccacccaauuucccaacagaaggacuaucccccucacaaguaacaauguucccacacauuauagucgauguucgccaacuagaaccaguacuuauuccccuaccagauguuagaaacaauuucuaucacuauaaccaaaccaaugacucaacaauuaaauuaaucgcaaugcuauauacuccauuaagagcuaacaaugcuggggaagauguuuuuacuguaucauguagaguacuaacacgaccaucaccagacuuugauuuuauauuucuaguaccacccacagucgaaucaagaacaaaacccuucacuguaccaauauuaacaguugaagaaaugacaaacucaagauuuccaauuccuuuagaaaaacucuuuacaggccccucaggagcauuuguaguucaaccacaaaacggaagauguacaacagauggugucuuacuagguaccacacaacuuucucccguaaacauauguacauuuagaggagacguuacccauauugcaggaucaagaaacuauacuaugaauuuagcaucaaucaauuggaacaauuacgacccaacagaagaaauaccagcgccuuuaggaacaccugauuucguugguaaaauacaaggaguacuaacucaaaccacaaaaggagacgguucaacaagaggacacaaagcaaccgucuauacagguucugcuccauuuaccccaaaacugggaucaguacaauuuucaacagacacagaaaacgacuuugaaacacaucaaaauacuaaauucacuccaguuggcgucauacaagacggaggaacaacacacagaaaugaaccacaacaauggguacuaccuucauauucaggccgugauguacauaacguacaccuagcaccagcaguagcaccaacauuuccaggagaacaauuauuauucuuuagaucaaccaugcccggaugcuccggauacccaaacauggacuuagauugccuuuuaccucaagaauggguucaacacuucuaucaagaagcugcaccugcacaauccgacgcagcacuacuaagauucguaaauccagacacaggaagaguacucuuugaauguaaacuacacaaaucuggauauguaacaguagcucauacaggucaacaugauuuaguuauaccaccaaacggauauuuccgauuugacucauggguaaaucaauuuuauacauuagcucccaugggaaacggaacaggacguagacgugcccuauaa

SEQ ID NO: 31153 - RNA, 1647 nt, Artificial Sequence
  derived and/or modified sequence opt6 from capsid_protein_VP1__Norovirus__AII02788
augaaaauggcaucaaaugacgccgcaccaucgaacgauggagcagcaggacuaguaccugaaauuaauucugaagccauggcauuagaaccaguagcaggagcagcaauagccgcaccucuaacaggccaacaaaauauuauugauccauggaucaugaacaauuuuguccaagcaccaggaggagaauuuaccgugucuccaagaaauucaccaggcgaaguacuucuaaauuuagaauuaggacccgaaauaaacccauacuuagcucauuuagccagaauguauaacggauaugcaggaggauucgaaguacaaguaguccuagcuggaaaugcauuuacagcuggaaaaauaaucuuugccgcaaucccaccaaacuucccaaucgauaauuuaucagcagcacaaauaaccaugugcccacacguaauaguugaugucagacaauuagaacccguaaauuuaccaaugccagauguaagaaacaauuuuuuucacuacaaucaagguuccgauucucgauuacgacuaauagcaauguuauauacaccacucagagcaaauaacucuggagacgacguauuuacaguaucuugucgaguacucacaagaccuucuccagauuuuagcuuuaauuuucuuguaccaccaacuguagaauccaaaacaaaaccauucucuuuaccaauacucaccauaucagaaauguccaauucaagauuuccaguaccaauagacucauuacauaccagcccaacugaaaacauaguaguacaaugucaaaauggacguguaacccucgacggagaacuaaugggaacaacacaacuccucccaucacaaauaugugcauuucgaggcaugcuuacuagaucaacuucacgugccucugaccaagcagacacagcaacaccuagacucuucaauuauuacuggcauauacaauuagauaacuuaaacggaacaccauacgauccugcagaagauauaccugggccauuagguaccccagauuuucgaggaaaaguauucggaguugcaucacaaagaaauccagacgccacaacaagagcacaugaagcuaaaauagacacaacaucuggacgauucacaccuaaacuaggaucauuagaaauuucuaccgaauccggagacuucgaucaaaaucaaccaacacgauuuacacccguugggauaggcguagaucaugaagcagauuuucaacaauggacacuaccugauuacgcaggccaauucacacacaacaugaauuuagcuccagcaguagcaccaaauuuccccggagaacaauuacuauuuuuucgcucacaauuaccauccucaggcggaagaucaaauggaauacucgauuguuuaguuccacaagaauggguacaacauuucuaucaagaaucagcaccaucccaaacucaagucgcucuaguaagauauguaaaccccgauacaggaagaguucuuuuugaagcaaaauuacacaaauuaggauuuaugacaauagcaaaaucuggagauucaccuauaacaguaccaccuaacggauauuuccgcuucgaaucauggguuaacccauuuuauacccuagcacccaugggaacaggaaauggcagaagacgaauacaauaa

SEQ ID NO: 31154 - RNA, 1647 nt, Artificial Sequence
  derived and/or modified sequence opt6 from capsid_protein_VP1__Norovirus__AII02791
augaaaauggcuucuaaugaugcagccccauccaaugacggagcagcaggccuaguaccagaaauaaacucugaagcaauggcauuagaaccuguagcuggagccgcaauagcagcaccacuaaccggacaacaaaauauaauagacccuuggauaaugaauaacuuuguccaagcaccaggcggcgaauucacaguuuccccucgaaauucaccaggagaaguauuacuuaaucuugaauuaggaccagaaauaaacccauaucuagcacaccucgcccgaauguauaauggauaugcaggagguuuugagguucaaguaguuuuagcagguaaugcauuuacagccggaaaaauuauuuuugcggcaauaccaccaaauuuuccaauagacaaucucucagccgcacaaauaacaaugugcccacauguuauaguugauguaagacaacuugaacccguaaauuuaccaaugccagauguaagaaauaacuucuuucauuauaaucaaggaagcgacucaagacuaagacuaauagccaugcuauacacaccacuaagagcaaauaacucaggagaugauguuuuuacaguuucauguagaguucuaacacgaccuucaccugacuucucauucaacuuucucguaccaccaaccguagaaucuaaaacaaaaccauuuagcuuaccuauuuuaacaauuucagaaaugucaaacucucgauucccaguuccuauagacucucuacacacauccccaaccgaaaauauaguaguacaaugucaaaauggccgaguaacauuagauggagaacucauggguaccacgcaacuauuacccucacaaauaugugcauucagaggcauguuaacaagauccacaucaagagcaucggaccaagcagauacagcaacuccacgcuuauucaauuacuacuggcacauacaacuggauaauuuaaauggaacaccauaugauccagcagaagauauacccggaccauuagguacaccugauuucagagguaagguauucggaguagcaucacaacgaaauccugacgccacuacacgugcacacgaagcaaaaauagacacaacaucaggaagauucacaccaaaacucggcucacucgaaauaucaacugaauccggcgauuuugaccaaaaucaaccaacacgauucacaccaguagguauuggcguagaucaugaagcagacuuccaacaauggacacuuccagacuaugcaggacaauucacacacaauaugaaucuugcaccugcuguagcaccaaauuucccuggcgaacaauuauuauucuuuagaucucaauuaccaaguuccggaggccgaucaaauggaauauuagauugcuuaguuccucaagaauggguacaacauuuuuaucaagaaucugcccccagccaaacacaaguagcauuaguccgauauguaaacccagacacaggacgcguacuuuuugaagcaaaacuacauaaacuaggauucaugacaauagcaaaaucuggcgacagcccaauaacaguaccuccaaacggauauuuccgcuucgaaucauggguaaauccuuucuacacacuugcaccaaugggcacaggaaauggaagaagacgaauacaauaa

SEQ ID NO: 31155 - RNA, 1623 nt, Artificial Sequence
  derived and/or modified sequence opt6 from capsid_protein_VP1__Norovirus__AII02794
augaagauggcauccucagacgcuaacccuucagacggaucuacagccuccuuaguaccagaaguaaacaacgaaguaauggcacuugaacccguaguuggugcagcaauagcugcaccaguagccggacaacaaaaugucauagaccccuggauaagaaacaauuuuguacaagcaccaggaggagaauuuacuguauccccacgaaaugcacccggagaaauacuauggucugcaccauuagguccugaucuaaacccauaucuaucccaccuagcaagaauguauaacggauacgcaggaggcuuugaaguacaagucguacuagcaggaaaugccuuuacagcuggcaaaauaauuuucgcugcuguacccccgaauuucccaacagaaggacuuucuccuucacaaguaacaauguuuccacauaucauaguagauguaagacaacuugaaccaguucucauacccuuaccugauguuagaaauaauuucuaucacuauaaccaauccaaugacccuacaauuaaacuaauagcaauguuauacacuccucuaagagcaaauaaugcaggugacgauguuuuuacagucucuugucgaguacuaacaagaccuucaccagacuucgacuuuauauuccucguaccaccaaccguagaaucacgcacaaaaccauucucaguaccaguacucacaguagaagaaaugacaaauucaagauucccaauaccauuagaaaaacuauuuacuggaccaucaucugcuuucguaguacaaccucaaaauggaagaugcacaacagacggaguacuauuaggaacaacacaauuaucaccaguaaauauauguacauucagaggcgauguaacacauauaucaggcucaagaaauuacacaaugaauuuagcuucacaaucauggaacucauacgauccaacugaagaaauaccugcuccacuuggaucuccugauuuuguaggcaaaauucaaggaguccuaacucaaacuacaagaacaaauggauccacacgaggacacaaagcuacuguauauacaggguccgcagauuuuucaccuaaacuugguagaguucaauucgcaacagacacagauaacgauuuugaaacaaaccaaaacaccaaauucacacccguuggcguaauacaagauggauccacuacuccaagaaaugaaccacaacaauggguacuaccaucauauucaggaagaaauauacauaacguacauuuagcaccugcaguagcaccuacuuuuccaggcgaacaauuauuauuuuuccgauccacaaugccaggcugcucaggauauccuaacauggauuuagacugcuuacuaccacaagaguggguacaauauuuuuaucaagaagccgcaccagcacaaucugaugucgcucuuuuacgauuuguaaauccagacacaggucgaguacuauuugaaugcaaauuacauaaaucagguuacguaacaguugcucacacuggacaacaugaccuaguaauccccccaaauggcuauuuuagauucgauucuuggguaaaccaauuuuacacauuagcaccaauggguaacggaacaggccgcagaagggcuuuauaa

SEQ ID NO: 31156 - RNA, 1623 nt, Artificial Sequence
  derived and/or modified sequence opt6 from capsid_protein_VP1__Norovirus__AII02797
augaaaauggcaagcaaugacgcaaauccaucagaugguuccgcagcaaaccuaguaccugaaguaucaaaugaaguaauggcuuuagaaccaguaguaggagcugcaauagccgcaccaguagcaggccaacaaaauguaauagacccauggauacgaaauaauuuuguacaagcuccaggcggugaauuuacaguaucaccaagaaaugcaccaggagaaauuuuauggucggccccuuuaggaccagauuuaaauccauauuuaucacacuuagccagaauguacaacgguuaugcaggaggcuuugaaguacaaguaauacuagcaggaaacgcauucaccgcuggaaaaaucauauuugcagccguaccuccuaacuuuccuacagaaggacucucuccaucacaaguaaccauguuuccucacauaauaguagacguaagacaacuagaacccguauuaauaccauuaccagacguacgcaacaauuuuuaucauuauaaucaaacaaaugacucaacaauaaaauuaauagcaaugcuauauacuccauuacgagcaaauaaugcaggagaagauguauuuacaguuuccuguagaguacuaacacgaccauccccagacuuugauuuuauauuucucguaccacccacaguagaaucacgcacuaaaccauuuaccgucccaauccucacaguagaagaaaugacaaacucuagauuuccaauuccguuagaaaaauuauucacaggaccauccggagcauucguaguacaaccccaaaauggcagauguacaacagacgguguccugcuaggcacaacacaacuaucaccaguaaauauauguacauuucgaggggacguaacccauaucgcaggaucuagaaauuacaccaugaaucuagcuucauuaaacuggaacaauuacgacccaacagaagaaauaccugcaccauuagguacaccagacuuuguaggaaaaauacaaggaguuuuaacacaaacaaccaaaggagacggcucuacaagaggacauaaagcuacaguauauacaggauccgcaccuuucacaccgaaacuaggauccguacaauuuagcacagacacagagaacgauuuugaaacacaccaaaacacaaaauuuacacccguaggaguaauacaagauggcggaacaacacauagaaaugaaccccaacaauggguacuaccauccuauucaggcagagacguccacaauguacacuuagcaccagcaguagcaccaacauucccaggagaacaauuauuauuuuucagaucaacaaugccuggauguucaggauaucccaauauggaucuugauugcuuacuaccacaagaauggguacaacauuucuaucaagaagcagcaccagcacaaucugauguugcauuacuaagauucgucaacccagacacuggaagaguauuauucgaaugcaaacuacauaaaucugguuauguaaccguagcccacacaggacaacaugauuuaguaauuccacccaacggcuacuuccgauuugauucaugggucaaucaauucuacacacucgcuccaaugggaaauggaacaggaagaagaagagcauuauaa

SEQ ID NO: 31157 - RNA, 1623 nt, Artificial Sequence
  derived and/or modified sequence opt6 from capsid_protein_VP1__Norovirus__AII02800
augaaaauggcaucaaaugacgcaaacccaucagauggaucagccgcaaaucucguaccagaaguaucaaaugaaguaauggcacucgaaccaguugucggagccgcaauagcagcuccaguagcaggacaacaaaauguaauagauccuuggaucagaaauaacuuuguccaagccccaggaggagaauuuacaguauccccuagaaaugccccuggagaaauacuauggucugccccacuaggaccagaucuaaaucccuaccuuucccaccuagcacgaauguacaauggcuacgcugguggauuugaaguacaaguaauuuuagcaggaaacgcauucacagcaggaaaaaucauauucgcagcaguaccaccaaauuuuccaacagaaggacuaucacccucacaaguaacaauguucccacauauaauaguagacguaagacaacuagaacccguauuaauuccauuaccagauguaagaaacaauuucuaccacuauaaucaaaccaacgauucuaccauaaaauuaaucgcaaugcuauauacaccacucagagcuaacaaugcaggagaagauguauuuacaguuucaugccgaguacuuacucgaccaucccccgacuuugauuucaucuuuuuagugccaccaacaguagaaucaagaacaaaaccuuuuacaguaccaaucuuaacaguagaagaaaugaccaauucaagauuuccaauaccacucgaaaaauuauuuacuggaccaucaggugcauucguaguucaaccccaaaacggaagauguacaaccgacggcguucuuuuaggaacaacccaacucucuccagucaacauauguacuuuuagaggagauguaacccauauagcagguucaagaaauuacacuaugaaucucgcaucauuaaauuggaacaauuaugauccaacagaagaaauaccugcaccccucgguaccccagacuuugucgguaaaauacaaggaguauuaacacaaacuacaaaaggagauggauccacaagaggucauaaagccaccguuuauacaggaucagcuccauucacaccaaaauuaggaucuguacaauuuaguaccgauacagaaaaugacuucgaaacacaucaaaauacaaaauuuacaccaguaggaguaauacaagacggcggaacaacacaucgaaacgaaccucaacaauggguacuaccuucauacucaggaagagacguacacaauguacaccucgcaccugccguagccccaacuuuuccaggagaacaacuauuauuuuuccgaagcacaaugccaggaugcucaggcuauccaaauauggaucuagauugcuuacucccacaagaauggguacaacacuucuaucaagaagcagcaccugcucaaucagacguagcuuuacuacgauucgucaaucccgauacaggaagaguacuauuugaaugcaaauuacauaaaagcgguuaugucacagucgcacacacaggucaacacgaccuaguaauuccuccaaacgguuauuucagauuugauucaugggucaaucaauuuuauacauuagcaccaaugggaaacggaaccggaagacgacgugcucuauaa

SEQ ID NO: 31158 - RNA, 1623 nt, Artificial Sequence
  derived and/or modified sequence opt6 from capsid_protein_VP1__Norovirus__AII02803
augaaaauggcaucaaaugaugccaacccaucugacgguucagcagcaaaucuuguuccugaaguauccaaugaaguaauggcacuagaaccaguuguaggagcagcaauagccgcaccagucgcaggccaacaaaauguaauagacccauggauaagaaacaacuuuguacaagcaccaggaggagaauucacagugucaccaagaaaugccccaggugaaauauuauggucugcuccacuaggcccagaccuaaauccuuaucuaucucauuuagcaagaauguauaaugguuaugcaggagguuucgaaguacaaguaaucuuagcuggaaaugcauuuacagcaggaaaaauaauauuugcagcaguaccaccaaacuuuccgacugaaggccuaucuccaucucaaguaacuauguuuccucacauaauagucgacguuagacaacucgaacccguucuaauaccuuuaccagacguaagaaauaauuuuuaccauuauaaccaaacaaaugaccccacuauuaaauuaauagcaaugcuauacacaccuuuaagggcaaauaacgcaggagaagacguauucacaguaucaugcagaguacuuacucgaccaucuccugacuucgacuuuauauuuuuaguaccaccaacuguagaaucacguacuaaaccauuuacaguuccaauauuaacuguugaagaaaugacuaacucacgauuuccaaucccauuagaaaaauuauuuacaggaccaucaggugccuucguuguacaaccacaaaacggccguuguacaacagacggaguacuauuaggaacaacacaauuaucuccaguuaauauauguaccuucagaggagauguaacacauauagcuggaucaagagauuacacaaugaaucuugcaagccuuaacuggaacaauuacgauccaacugaagaaauuccugcaccacuagguacaccagacuuuguaggaaaaauacaaggcguauuaacccaaacaacacgaggagacggaucaacuagaggccacaaagcaacaguuuacacuggaucagcaccauuugcuccuaaauuaggaucaguccaguucucaacagauacagaaaaugacuucgaaacucaucaaaauacuaaauucacaccuguaggaguuauacaagacggaggaacuacacauagaaaugaaccacaacaauggguauuaccaucauauucuggacgagauguacauaauguacauuuagcaccagcuguugcuccaacuuuucccggcgaacaauuacuauucuuuagaagcaccaugccagguugcuccggauauccaaacauggauuuagauugcuuacuaccacaagaauggguacaacacuucuaccaagaagccgcucccgcacaauccgacguagcauuacuaagauucguaaacccugacacaggacgaguccucuuugaaugcaaacuacauaaaucaggauacguaaccguagcacauacaggacaacaugauuuaguuauaccaccaaauggauauuuucgauuugauucuugggucaaucaauucuacacacuagcaccaaugggcaauggaacgggacgaagaagagcacuauaa

SEQ ID NO: 31159 - RNA, 1623 nt, Artificial Sequence
  derived and/or modified sequence opt6 from capsid_protein_VP1__Norovirus__AII02806
augaaaauggcuucaaaugaugcuaauccuucagacggaucagccgccaaucuuguuccagaaguuucaaacgaaguuauggcacuagaaccuguagucggugcagcaauagcagcuccagucgccggacaacaaaauguaauugauccauggauccgaaauaacuuuguccaagcaccaggcggagaauuuacuguuucaccaagaaacgccccaggagaaauccuauggucagcaccacuaggaccagaccuaaauccauaccucucacaccuagcuagaauguauaauggauaugcagguggauucgaaguacaaguuauauuagcuggcaacgcuuucacagcaggcaaaauuauauuugcagcaguaccuccgaauuuuccaacagaaggucucucaccaucacaaguuacaauguucccacacauuauaguagauguucgccaguuagaaccuguacugauaccauuaccagacguacgaaauaauuucuaccacuauaaccaaaccaaugauucaacaaucaaacuuauagccaugcuauacacaccacuaagagcaaauaacgcuggugaggauguauuuacaguuucauguagaguacuaacaagaccaucaccagauuuugacuucaucuuucuaguuccacccacagucgaaucucgaacaaaaccuuucacaguaccaauacucacagucgaagaaaugacuaauucuagauuccccauaccacuagaaaaacuauucacuggaccaucaggagccuucguaguucaaccacaaaacggacgauguacaacugacggaguauuacuaggcacaacacaacuaucaccaguaaauaucugcaccuuuagaggagacguaacacauaucgcaggaucaagaaacuacacuaugaaucucgccucguuaaauuggaauaacuacgaccccacagaagaaauaccagcuccuuuaggaacuccugauuuuguuggaaaaauacaaggaguacuaacacaaacaacaaaaggcgacggaucaacaagaggccacaaagccacaguauauacaggaucagcacccuuuaccccaaaauuaggaucaguucaauucagcacugacacugagaacgauuuugaaacacaucaaaauacaaaauucacaccaguaggaguuauucaagauggcggaacaacacauagaaacgaaccccagcaaugggucuuaccaucauauucaggcagggacguacauaacguccaucuugcacccgcaguagccccuacauuucccggugaacaacuauuauucuuuagauccacuaugccaggaugcucugguuauccaaauauggaccuugauugccuuuuaccucaagaauggguucaacacuuuuaccaagaagcagcccccgcacaauccgauguugcucuccuuagauucguaaauccugauaccggaagaguauuauuugaaugcaaacuacacaaaucaggauacguaacuguagcccacacaggacaacacgauuuaguaauaccaccaaacgguuacuuccgauucgacucauggguaaaucaauuuuacaccuuagcaccaaugggaaauggcacaggaagacgaagagcacuauaa

SEQ ID NO: 31160 - RNA, 1623 nt, Artificial Sequence
  derived and/or modified sequence opt6 from capsid_protein_VP1__Norovirus__AII02809
augaaaauggcuucaaacgacgcuaauccaucagacggaucugccgcaaauuuaguaccagaaguuaauaacgaaguaauggcacuagaaccugucguaggagcagcuauagccgcaccaguugcaggacaacaaaacguaauugaccccuggauaagaaacaacuucguacaagcaccuggaggggaauuuacuguuucaccaagaaaugcaccaggugaaauauuauggucagccccccuaggaccagaccuuaacccauaucuaucacaucuugcacgaauguacaacggcuaugcggguggauucgaaguacaaguaauccuugcaggaaacgcauuuacagcaggaaaaauaauauucgcagccguaccacccaauuucccaacagaaggauuaucaccaucacaagucacaauguucccacauauaauagucgaugucagacaacuagaaccaguacuuauacccuuaccagauguaagaaacaauuucuaucacuauaaucaauccaaugacagcacaaucaaauuaauagcaaugcuauacacgccacuacgugcuaacaaugcaggagaagacguauuuaccguaucauguagaguauuaacaagaccuaguccugacuucgauuucauauuuuuaguaccuccuacaguugaaucuaggacaaaacccuucacaguuccaauauuaacaguagaagaaaugacaaacagcagguuuccuaucccauuagaaaagcuauucacaggaccaucuggagcauucauaguucaaccucaaaauggacgcugcacaaccgacggaguucuauuagguacuacccaacuaagcccuguaaauauauguacauucagaggagauguaacucauauagcuggaagcagaaauuacacuaugaaccuagcaagucuuaacuggaacaacuaugauccaacugaagaaauuccugccccacuaggaacaccagacuuuguaggaaaaauacaaggaguauuaacacagacaacaaaaggagacggaagcacaagaggacacaaagcaacaguauacacaggcucagcaccuuucaccccaaaauuaggaucaguucaauucucaacagacacagaaaacgauuucgaagcacaccaaaauacaaaauuuacuccgguuggaguaauacaagacgguggcacaacccauagaaaugaaccacaacaauggguacuaccaucauauagcggucgagauguacacaauguucaccuagcuccugcaguagcacccacauuuccaggagaacaacuauuauuuuuuagaucaacaaugccagguugcucuggauaccccaauauggaucuagauuguuuacuaccccaagaauggguucaacauuucuaucaagaagcagcaccagcacaaucagacguugcuuuacuacgcuucguuaaucccgacacuggaaggguucuauuugaaugcaaacuacauaaaucugguuauguaacaguugcucacacuggacaacaugauuuaguuauaccaccuaauggauauuuuagauuugauucauggguaaaccaauuuuacacacuagccccaaugggcaauggcacuggacgcagaagagcuuuauaa

SEQ ID NO: 31161 - RNA, 1647 nt, Artificial Sequence
  derived and/or modified sequence opt6 from capsid_protein_VP1__Norovirus__AII02812
augaaaauggcuucuaacgacgcagcuccaucaaaugacggagcugcaggucuaguacccgaaauaaauucagaagcaauggcacuagaaccuguugcaggugcagccauugcugcaccgcuaacaggacaacaaaacauaaucgauccauggauaaugaauaacuucguacaagccccaggaggagaauucacaguaaguccuagaaacucgccaggugaaguacuauuaaaucuagaacuaggaccugaaauaaauccauaccuugcacaccuagcacgaauguauaacgguuaugcuggaggauucgaaguacaaguaguacuagcaggaaaugcauuuacagccggcaaaauaauauuugcagcuauacccccaaauuucccaauagacaaucuaagugcagcucaaauaacaaugugcccacauguaauaguugauguacgacaacuugaaccaguuaauuuaccaaugccagauguacgaaacaacuuuuuccauuacaaucaggggagugacucccgucuccgacuaauugcaaugcuauauaccccucuacgugcaaauaauucaggagacgacgucuuuacaguaucaugccgcguacuaacuagaccaucuccagacuucucauucaauuuuuuaguacccccaaccguagaaucuaaaacuaagccuuucuccuuaccaauauuaacaauaucagaaaugucaaauucaagguuuccaguaccaauagacucucuacauacuucaccaacagaaaacauuguuguccaaugccaaaacggccgaguaacacuagacggagaauuaauggguacuacacagcuauuaccaucacaaauaugugcauucagagguaugcuaacaagaucaacuucaagagcaagugaccaagcagacacagcaaccccucgacuauucaacuacuauuggcacauacaauuagacaaucuaaauggaacaccauaugauccugcagaagauauaccuggaccacuuggaacaccugauuuuagagguaaaguauucggcgucgcuucucaaagaaauccagacgcaacuacaagagcacaugaagcuaaaauagauacaacaaguggaagauuuacacccaaauuagguucacuagaaauaucaacagaauccggagauuuugaccaaaaucaaccuacaagauuuacccccguugguauaggaguagaucacgaagcagacuuucaacaauggacacuaccagauuaugcaggacaauucacucacaauaugaaucuagcaccagcaguagcgcccaacuucccuggugaacaacuauuauuuuucagaucccaauuaccaucaucagguggccgaucaaauggaauucuugauuguuuaguaccacaagaauggguacaacacuuuuaucaagaaagugccccaagccaaacucaaguugcauuaguaagauauguaaacccugacacaggaagaguauuauuugaagcuaaacuucauaaauuaggauuuaugacaauagcaaaauccggagacucaccaauaacaguaccaccaaauggauacuuuagauuugaaucauggguaaacccauuuuauacacucgcaccuaugggaacugguaauggaagaagacgcauucaauaa

SEQ ID NO: 31162 - RNA, 1623 nt, Artificial Sequence
  derived and/or modified sequence opt6 from capsid_protein_VP1__Norovirus__AII02815
augaaaauggcaucaaaugaugcaaaccccagcgauggcucagcagcaaacuuaguaccagaaguaaacaaugaaguaauggcauuagaacccguaguaggggcagcuauagcagcacccguagcaggacaacaaaaugucauugacccauggauacguaauaacuuugugcaagcaccaggaggugaauuuacaguaucuccucgaaaugcaccaggugaaaucuuauggucagcaccacuaggccccgauuuaaauccauauuuaucacauuuagccagaauguacaauggauacgccggcgguuuugaaguacaaguaauacuagcagguaaugccuuuacagcuggaaaaauaaucuucgcagccguaccaccuaacuuuccaacagaaggacuaucaccaagucaaguaacaauguucccacauauaaucguagacguaagacaauuagaaccaguacuaauaccacucccagacgucagaaauaauuucuaccacuauaaucaaucaaacgauucaaccauaaaacuaauagcaauguuauacacaccauuacgagcaaacaaugccggagaagaugucuuuaccguaucaugcagaguacuaacuagaccaucaccugauuuugacuucauauuccuaguaccacccacaguagaaucaaggacaaaaccauucacaguaccgauauuaacaguagaagaaaugacaaauucaagauucccuauuccccuagaaaaacuuuuuacaggaccaucuggggcuuucauuguucaaccucaaaacggacgauguacaacugaugguguauuauuaggcacuacacaacuaagcccuguaaauauaugcacauuuagaggagacguaacacauauagcaggaucaagagauuacacaaugaaccuagcaucauuaaacuggaacaacuaugauccaacugaagaaauaccugcaccauuaggaacaccugauuuugucggaaaaauacaaggaguacucacacaaacuacaaaaggagacggcucaaccagaggucacaaagccacaguauauacaggaucagcacccuuuacaccaaaacuuggcagcguacaauuuucuacagacacagaaaacgauuucgaagcacaccaaaauacaaaauucacaccagucggcguaauucaagacgguggaacaacacauagaaacgaaccacaacaauggguacuaccaucauauucaggaagagauguacauaacguucaccuugcaccagccguugccccaacauucccaggagaacaauuauuauuuuuuagauccacaaugccagguugcucaggauacccaaauauggaucuagacuguuuauuaccccaagaauggguucaacacuuuuaucaagaagccgcaccugcacaaucagacguugcacuauuaagauucguuaacccagauacaggcagaguacuuuucgaaugcaaacuacauaaauccggauauguaacuguugcucauacaggacaacaugaccuaguaauacccccaaauggcuacuucagauucgauucauggguaaaucaauuuuacacacuagccccaauggguaaugguacuggaagacgaagagcccuuuaa

SEQ ID NO: 31163 - RNA, 1647 nt, Artificial Sequence
  derived and/or modified sequence opt6 from capsid_protein_VP1__Norovirus__AII02818
augaaaauggccucuaaugacgcugcaccaucaaaugacggagcagccggucucguaccugaaauaaacucugaagcaauggcccuagaacccgucgcaggugcagcuauagcugcaccacuaacuggacaacaaaauauaauagacccauggauaaugaacaacuuuguccaagcaccagguggcgaauuuacaguaucaccacgaaauucaccaggugaaguacucuuaaaccucgaauugggaccagaaauaaauccauaucuugcucacuuagcacgcauguauaaugguuacgccggaggauucgaaguacaaguuguuuuagcaggaaaugcauuuacagcaggaaaaauuauuuuugccgccaucccaccaaacuuuccuauagauaauuuaucggcagcccaaauuacaaugugcccucauguaaucguugauguaagacaacuagaaccuguaaacuuaccaaugcccgauguacguaacaacuucuuucacuauaaccaaggaucagauucaagacucagauuaauagcuauguuauacacaccacuucgagcaaacaauucaggagaugauguauuuaccguaagcuguagaguauuaacaagaccaucuccugacuuuucuuuuaacuuucuaguuccaccaacaguagaaucuaaaacaaaaccauuuucacuaccaauacuuacaauuagcgaaauguccaacucacgauuuccaguaccaauugauucacuacauacaucaccaacagaaaauauaguuguccaaugccaaaauggaagaguaacucuugauggagaacuaauggguacaacacaauuauuaccaagccaaauaugcgcauucagagguaugcucacaagaucaacauccagagcaucagaccaagccgacacaguuacucccagauuauucaauuacuauuggcacauacaauuagauaaccucaacggaacaccuuacgacccagcagaagauauaccaggaccacuaggaaccccagacuuucgaggaaaagucuucggaguagcaucacaaagaaauccagaugcaacaaccagagcacaugaagcaaaaauagauacuacaucaggacguuuuacaccaaaauuaggcucccucgaaauaucaacagaaucugacgauuucuaucaaaaucagccuacaagauuuacccccguaggaauaggagucgaccaugaagcagauuuucaacaauggacacuacccgacuaugcaggccaauuuacccauaacaugaaccuugcaccagcaguagcaccuaauuuuccaggagagcaacucuuauuuuucagaucacaauuaccaucaucaggaggaagauccaacggaauauuagauugccuaguuccccaagaauggguccaacauuucuaccaagaaucagcuccuucucaaacacaaguagcuuuaguacgcuauguuaauccagauacaggaagaguacuuuuugaagccaaauuacauaaacuuggauucaugaccauagcuaaaaauggagauucuccaauaacaguaccaccaaacggauauuucagauucgaaucauggguaaauccauucuauacauuagccccaaugggaaccggaaauggaagacgucgaauacaauaa

SEQ ID NO: 31164 - RNA, 1623 nt, Artificial Sequence
  derived and/or modified sequence opt6 from capsid_protein_VP1__Norovirus__AII02821
augaaaauggcuaguaacgaugcaaacccaucugauggaucagcagccaaucuaguaccagaaguaaacaacgaaguaauggcauuagaaccaguaguuggagcagcuauagcagcaccaguagcuggucaacaaaacguaauagacccauggauaagaaauaacuuuguccaagcaccaggcggagaauuuacuguauccccacgaaaugccccaggagaaauucuauggucagcaccucuaggacccgaucuaaacccauauuuaucacacuuagcaagaauguauaacgguuacgcagguggauuugaaguccaagucauauuagcaggaaaugcuuucacagcuggaaaaaucauauuugcagcaguaccaccgaauuuccccacagaaggucuauccccuagucaaguaacaauguuuccacacauaauaguagaugucagacaguuagaaccuguauuaauaccacuaccagacguaagaaacaacuucuaucauuauaaucaaagcaaugauuccacaauaaaauuaauagcuaugcuauacaccccauuaagagcaaacaaugcaggagaagauguauuuacaguaagcugccgaguauuaaccagaccaucaccagacuuugacuucauauuucuaguaccaccaacaguagaaaguagaacaaaaccauucacuguaccaauauuaacaguagaagaaaugacaaauucaagauuuccaauaccucuugaaaaacuauucacuggacccucuggugcuuucauaguccaaccccaaaauggacgauguacuacagacggaguauuacuaggcacaacacaacuuucuccaguaaauauauguaccuuucguggugauguaacacacauagcagguaguagaaauuacacaaugaauuuagcaucacuaaauuggaacaauuacgaccccacagaagaaauaccugcaccccuaggaaccccagacuucguaggaaaaauucaaggcguacuaacccaaacaacaaaaggugauggcucaacacgaggucacaaagcuacaguauacacagguggagcaccuuuuacaccaaaauugggauccguacaauucuccacugauacagaaaaugacuuugaagcacaucagaauacaaaauuuaccccaguaggaguaauccaagauggaggcacaacacaucgaaacgaaccacaacaaugggucuuaccaucauauuccggacgagacguacauaacguacaccuagcaccagcaguugcaccuacuuuuccaggugaacaacuacuuuucuuuagaaguacuaugccaggcugcucuggcuauccaaauauggacuuagauugccuacucccacaagaauggguacaacauuucuaucaagaagcugcacccgcucaaucagacguagcccuccuuagauuuguaaacccugacacagguagaguauuauucgaaugcaaauuacacaaaucugguuaugucaccguagcccauacaggacaacaugaccuaguaauaccucccaacggcuacuuuagauuugacucauggguaaaucaauuuuauacauuagcaccaaugggaaauggcacuggacgaagaagagcuuuauaa

SEQ ID NO: 31165 - RNA, 1623 nt, Artificial Sequence
  derived and/or modified sequence opt6 from capsid_protein_VP1__Norovirus__AII02824
augaaaauggccucaaaugacgcaaacccuucagauggaucagcugcaaacuuaguaccagaaguaucaaaugaagucauggcucuagaaccaguaguaggagccgcaauugcugcaccaguagcaggacaacaaaacguaaucgauccauggauacgaaauaacuucguccaagccccagguggagaauuuacagucucaccaagaaaugcacccggcgaaauacuaugguccgcaccccuaggaccagacuuaaauccauauuuaucacacuuagcuagaauguauaacggauaugcuggagguuucgaaguucaaguaauauuagcagguaaugccuucaccgcuggcaaaauaauauucgcagcuguaccacccaacuuucccaccgaaggauuaucaccaucccaaguaaccauguuuccacauauuauaguagauguaagacaacuagaaccaguauuaauucccuuaccagauguuagaaacaauuucuaucauuauaaucaaacaaacgacaguacuauaaaacuaaucgccaugcuauauacaccacuaagagcaaacaaugcaggagaagauguuuuuacaguuucaugucgaguacuaaccagacccucuccagacuuugacuucaucuuucuaguaccaccaacaguugaaucaagaacaaaacccuuuacaguaccaauauuaacaguagaagagaugaccaauagccgauuuccaauuccauuagaaaaauuauuuacaggcccaucaggagcauuuguaguucaaccacaaaacggacgauguaccacagauggaguucuacuaggaacaacccaauuaaguccagucaauauaugcacauuuagaggugauguaacacauaucgcaggcucaagaaauuacacaaugaaccuugcaucucuaaauuggaacaauuaugaucccacagaagaaaucccagcuccccuaggaacaccugacuuuguaggaaaaauacaagguguacuaacacaaaccaccaaaggugacggaucgacacgaggacauaaagccacaguuuauacuggaucagcaccuuuuacaccaaaauuagguucaguccaauucucuacagacacagaaaacgacuuugaaacucaucaaaacaccaaauuuacacccguaggagucauccaagacggaggaacuacucacagaaaugaaccacaacaauggguccuaccaucauacucaggccgugauguacauaacguccacuuagcaccagcaguugccccuacuuuccccggagaacaacuacuuuuuuuuagaucaacuaugccaggauguuccggauauccaaauauggaucuagauuguuuauuaccacaagaauggguacaacauuucuaccaagaagcugcaccagcacaaucagacgucgcauuacuaagauucguaaacccagacaccggcagaguucuauuugaauguaaauuacauaaaucaggauauguaacaguagcacauacaggacaacacgacuuaguaauaccacccaaugguuacuucagguucgacucauggguaaaucaauuuuacacacuugcaccaauggguaauggaacaggacgacgaagagcuuuauaa

SEQ ID NO: 31166 - RNA, 1623 nt, Artificial Sequence
  derived and/or modified sequence opt6 from capsid_protein_VP1__Norovirus__AII02827
augaaaauggcuucaaaugaugcaaaccccucugacggcuccgcugcuaaccuaguaccugagguaucaaaugaaguaauggcacuagaaccaguaguaggagcagcaauagcugcucccguagcaggacaacaaaauguaauugacccauggauaagaaauaacuucguccaagcuccuggaggugaauuuacagucucaccucguaacgcacccggugaaaucuuauggucagcuccucuagguccugaucuaaauccauaucucagccacuuagcacgaauguauaacggauacgccggaggauucgaaguucaagucauacuagcaggcaaugccuucacagcaggaaaaauuauuuuugccgcaguaccuccaaauuucccaacagagggauuauccccaucucaaguuaccauguucccacauauaauuguagacguuagacaauuagaaccaguacuaauacccuuacccgauguacgaaacaauuuuuaucacuauaaccaaacaaaugacucaacuauaaaauuaauugcaauguuauauacuccacuuagagcaaauaacgcaggugaagacguauuuacaguaucaugcagaguacuaacaaggccaucaccagacuuugacuucauauuucuaguuccacccacaguagaaucaagaacaaaaccauuuacaguaccaauucuuacuguagaagaaaugacuaacucacgauuuccaauuccauuagaaaaauuauuuacagguccaucaggcgcauucguaguacaaccacaaaacggaagauguacaacagauggaguacuacuaggaacaacucaauuaucaccuguaaacauauguacauuucgaggugacguuacccauauagcagguucaagaaacuacacaaugaauuuagcuucccuaaauuggaauaauuaugauccaacagaagaaauaccagcaccccuaggaacaccugacuuuguagguaaaauacaaggaguacucacacaaacaacgaaaggagacgguucuacacgaggacauaaagcaaccguauauacagguucagcaccuuuuacaccaaaacucgguucaguacaauuuucaaccgacacugaaaaugacuucgaaacacaucaaaauacuaaauucacaccaguugguguuauacaagacggaggaacaacccaccgaaacgaaccccaacaauggguacuaccuucauacuccggacgagauguacacaacguucaccuugcuccugccguagcaccaacauucccaggagaacaacuauuauucuuuagaagcacaaugccuggaugcucaggauacccaaauauggauuuagauugccuacuaccucaagaauggguacaacauuuuuaccaagaagcagcccccgcucaauccgauguugcauuauuacgauucguaaacccagacacuggaagaguacuauuugaauguaaacuucauaaaucuggauaugucacaguagcucacaccggccaacacgaucuaguuauaccuccaaacgguuauuucagauuugauucauggguuaaucaauucuauacacuagcuccaaugggaaauggcacuggccgcagaagagcacuauaa

SEQ ID NO: 31167 - RNA, 1623 nt, Artificial Sequence
  derived and/or modified sequence opt6 from capsid_protein_VP1__Norovirus__AII02830
augaaaauggcaucuaaugacgcaaaccccuccgaugguucagccgccaacuuaguacccgaaguaaguaaugaagucauggcuuuagaaccuguaguuggagcagcaauagcugcaccuguugcuggucaacaaaauguaauugacccguggaucagaaauaauuuuguacaagcaccugguggcgaauuuacaguaucaccaagaaaugcaccuggagaaauauuauggucagcaccuuuaggaccagaucuaaauccauauuuaucccacuuagcaagaauguauaauggauaugcuggcggcuucgaaguacaagucauucuugcagguaaugcauuuacagcaggaaaaaucauauucgcagcaguaccccccaauuuuccaacagaaggauuaucaccuucucaaguaacaauguuuccacacaucauuguugacguuagacaacuagaaccaguauuaauaccauuaccagacguaagaaacaauuuuuaucacuacaaccaaacaaaugacucaacaauaaaauuaauagcaaugcuauauacuccauuacgugcuaauaaugccggagaagauguauucacgguuucuuguagaguacucacacgcccuaguccagacuuugauuuuauauuucuagucccaccaaccguagaaaguagaacuaaaccuuuuacuguaccaauacuaacaguagaagaaaugacaaacucccgauuuccaauaccauuagaaaaacuauucacaggaccaucuggagcauucgucguacaaccacaaaacggaagauguacuacagacggaguacuccuaggcacaacacaauuaucaccugucaauauauguacauuuagaggagauguaacacauauugcaggaucacgaaauuacacaaugaauuuagcauccuuaaacuggaacaauuacgacccaacugaagaaauaccugccccacuaggaacuccagauuuuguaggaaaaauucaaggaguacuaacccaaacaacaaaaggagacggaucuaccagaggucauaaagccacaguauacacugguucagcuccuuuuacaccaaaacuaggaucaguccaauucucuacagacacagaaaaugauuuugaaacacaucaaaauaccaaauucacaccaguaggaguaauacaagacggagguacaacacauagaaaugaaccacaacaauggguauuaccaagcuacagcggccgagauguacauaauguucacuuagcacccgcaguugcaccaacuuuuccaggagaacaacuuuuauuuuuuagaucaacuaugccaggcuguucgggcuauccaaauauggacuuagauugcuuacuaccacaagaauggguucaacauuucuaucaagaagcagccccagcacaaucagacguagcacuccugagauuuguaaacccagauacaggaagaguucuauucgaaugcaaacuacauaaaucaggauauguuacaguagcacacacuggucaacaugaucuuguuaucccaccaaauggauacuucagauucgacagcuggguaaaucaauuuuacacacuagcaccaaugggaaauggaacaggcagaagaagagcacuuuaa

SEQ ID NO: 31168 - RNA, 1623 nt, Artificial Sequence
  derived and/or modified sequence opt6 from capsid_protein_VP1__Norovirus__AII02833
augaaaauggcuuccaaugacgcaaaccccucugaugguucagccgcuaacuuaguaccugaaguaaacaacgaaguaauggcucuugaaccaguaguuggcgccgcaauagcagccccagucgcaggccaacaaaacguaauagacccuuggauucgaaauaacuucguacaagcacccggcggagaauuuacuguaucaccccguaaugcaccaggagaaauauuauggucugcaccacuaggaccagacuuaaauccauaucuaucacaucuagcaagaauguacaauggauacgcaggcggauucgaaguacaagucauuuuagccggaaaugcauuuacagcaggaaaaauaauauuugcagccguaccaccaaauuuuccaacagaaggucuaucaccaucacaaguaacaauguuuccacauauaauaguagauguaagacaauuagaaccaguauuaauuccacuuccagacguuagaaacaauuuuuaucacuauaaucaaagcaacgacucaacaauaaaacuaauagcuaugcuauacacaccuuuacgcgcaaacaacgcaggcgaagauguauuuacuguaucaugcagaguacuaacucgcccauccccagacuucgacuuuauauuucuaguacccccuacaguagaaucaagaacaaaaccauucacaguaccaauauuaacagucgaagaaaugacaaacucuagauuuccaauaccuuuagaaaagcuauuuacaggaccaucaggcgcauucauaguccaaccacaaaacggaagaugcaccacagauggagucuuacucggcacaacucaacucuccccagucaacaucugcacauuucgagguggaguaacacauauugccggaucaagaaauuacacuaugaauuuagcaucacuuaauuggaacaauuaugaucccaccgaagaaauuccugcacccuuagguacaccugacuuuguaggaaaaauacaagguguacuaacucaaaccacuaaaggagacggaucaacaagaggucacaaagcaaccguauauaccgguuccgcacccuucacaccuaaacuaggauccguacaauucuccacagauaccgaaaaugacuucgaagcacaucaaaauacaaaauuuacacccguuggagugauacaagacggaggcacuacacauagaaaugaaccucaacaauggguauuaccaucauacucaggaagagacguccauaacguucacuuagcaccugcaguggcaccaaccuuuccaggcgaacaauuauuauucuuucgcucuacaaugccaggauguucaggauauccaaacauggaucuagacugucuauuaccacaagaauggguucaacauuucuaucaagaagcagcucccgcacaaucagauguagcacuauuaagauuuguaaacccugacacaggacgaguuuuauucgaauguaaauuacauaaaucuggauaugucacaguagcccauaccggacaacaugauuuaguuauaccaccuaacggauacuucagauucgacagcugggugaaucaauuuuacacacuugcaccaaugggaaaugguacuggcagaagaagagccuuauaa

SEQ ID NO: 31169 - RNA, 1623 nt, Artificial Sequence
  derived and/or modified sequence opt6 from capsid_protein_VP1__Norovirus__AII02836
augaaaauggcaaguaacgacgcuaacccaucugacgguucagcagcaaauuuaguuccugaaguuucaaaugaaguaauggcacuugaaccagucgcaggagcagccauagcagcaccggucgcuggacaacaaaauguaauugacccuuggaucagaaacaacuuuguucaagcaccaggaggugaauuuacaguuucaccacgaaaugcaccaggugaaauacuauggucagcaccauuaggacccgauuuaaaccccuauuuaucacaccuagccagaauguauaauggcuaugcggguggauucgaaguacaaguaauacuagcaggaaacgcauuuacugcuggaaaaauaaucuuugcugcaguuccuccaaauuuuccaacugaaggacuauccccaucacaaguaacaauguucccacacauaauaguagauguuagacaauuagaaccaguucuaauaccauuacccgauguccguaacaacuucuaucacuacaaucaaaccaacgauaguacaauaaaauuaauagcaaugcuauauacacccuuaagagcuaacaacgcaggagaagaugucuuuacuguaucaugccgaguacuaacccgaccaucuccugauuucgauuuuauauucuuaguaccaccaacuguagaaucaagaacaaaacccuucacuguaccaauacuaacaguugaagaaaugacaaauucaagauuuccaauaccauuagaaaaacuauucacuggaccaucuggagcuuuuguaguucaaccacaaaacggacgcuguaccacagauggaguacuauuaggaacaacacaauuauccccugucaauauauguacuuuuagaggcgauguuacacauauagcaggcucaagaaauuauacaaugaacuuagcaucuuuaaacuggaacaacuacgauccaaccgaagaaauaccugcaccacucgguacacccgacuuuguaggaaaaauacaaggcguacuaacucaaacaacaaaaggagauggaucaacaagagggcauaaagcuacaguauauaccggaucagcaccauuuacaccuaaauuaggaagcguccaauuuucaacagauacagaaaacgacuuugaaacacaucaaaauacaaaauuuacaccaguuggcguaauacaagacggagguacaacucauagaaaugaaccacaacaauggguacuaccuucauacuccggaagagauguacauaauguacaucuagcaccugcaguagcaccaacguuuccaggagaacaauuauuauucuucagauccacaaugccagguugcucaggauauccaaauauggaucucgauugcuuacucccucaagaauggguccaacauuucuaucaagaagccgcaccagcucaaucagacguagcuuuacuaagauucguaaacccagauacaggacgcguuuuauucgaaugcaaacuacauaaaucuggauauguaacuguagcacauacaggacaacaugaccuaguaauacccccuaacggauauuucagauucgauucauggguaaaucaauuuuacacucucgcuccaaugggcaauggaaccggacgacgucgugcuuuauaa

SEQ ID NO: 31170 - RNA, 1623 nt, Artificial Sequence
  derived and/or modified sequence opt6 from capsid_protein_VP1__Norovirus__AII02839
augaaaauggcuucaaaugacgcuaacccaucagauggcucagcagcaaaucucguaccagaaguauccaacgaaguaauggcucuagaaccagucguaggagccgccauugcagcaccaguagcaggacaacaaaacguaaucgacccuuggauaagaaauaacuucguucaagcaccuggaggcgaauuuacaguaucaccuagaaaugcacccggcgaaauauuauggggcgcaccauuaggaccagaucucaauccauaccuaucacaccuagccagaauguacaacgguuacgccggaggauuugaaguccaaguaauacuagccggaaaugcauucacagccgguaaaauaauuuucgcagccgugccaccaaacuuuccaacagaaggauuauccccaucucaaguaacaauguucccacacauuauaguugauguaagacaacuugaaccaguauuaauuccucuccccgacgucagaaacaacuucuaccauuauaaccaaacaaaugacaguacaauuaaacuaaucgcaauguuauacacuccuuuaagagcuaacaaugcaggagaagauguauucacaguaucaugucgaguacuaacaagaccaucaccagacuuugauuuuauuuuucuugucccaccaacaguugaaucaagaacaaaaccauucacaguaccaauuuuaacaguugaagaaaugacaaauuccagauucccaauaccauuagaaaaauuauucacaggaccauccggugcauuuguaguacaaccacaaaauggcagauguacuacagacggcguauuacuaggcacaacucaauuaucaccaguaaauauauguacauucagaggagaugucacacauauagccggaaguagaaauuauacuaugaauuuagcuucacuuaacuggaauaauuaugacccaacagaagaaauaccggcacccuuaggaaccccagacuuuguuggaaaaauucaaggagugcuuacacaaaccacaaaaggugacggaucgacacgaggacacaaagcaacagucuauacaggaucagcaccauuuacaccaaaacuaggaucaguacaauucucaacagauacagaaaacgauuuugaaacacaucaaaauacaaaauucacaccaguaggcguaauacaagacggcggaacuacacauagaaaugaaccucagcaauggguucucccaucauauucaggaagagauguacacaacguacaucuugcaccagcaguagcaccaacauucccuggcgaacaauuacuauucuuuagaaguacaaugccaggauguucaggauauccaaauauggaucuagacugccuacuaccacaagaauggguccaacauuucuaccaagaagcagcaccagcacaaucagacguugcauuacucagauuuguaaauccagacacuggaagaguacuauucgaauguaaacuucauaaaucaggauacguaacaguagcacauaacggacaacaugacuuagucauaccaccaaauggauauuuccgcuuugauucauggguuaaucaauucuacacacuagcuccaaugggaaauggaacaggaagaagacgagcacuauaa

SEQ ID NO: 31171 - RNA, 1623 nt, Artificial Sequence
  derived and/or modified sequence opt6 from capsid_protein_VP1__Norovirus__AII02842
augaagauggcaucaaaugaugcaaacccaucugauggaucagcagcuaauuuaguuccugaagucucaaaugaaguaauggcucuagaaccaguaguaggagcagcaauagcagcaccuguagcuggacaacaaaauguuauagaccccuggauucguaauaacuucguccaagcaccaggaggagaauuuacagucaguccaagaaacgccccaggugaaauacuauggucugcaccacuaggacccgaccuaaauccauacuuaucacacuuagcaagaauguauaacggauaugcaggaggauucgaaguacaaguuauauuagcaggaaaugcauuuacagcuggaaaaauaauauuugcugcuguuccaccuaacuuuccuacugaaggacuaucaccaagccaaguaacaauguucccucauauaauaguagacguaagacaauuagaaccuguucuaaucccacuaccagacguaagaaacaacuucuaccacuauaaccaaacuaaugacucuacaauaaaauuaauagcaaugcuuuacacaccucuaagagcuaacaaugcaggagaagauguauuuacaguaucuuguagaguccuuacaagaccaucaccagauuucgacuuuauauuucucguaccuccuacaguugaaucaagaacgaaaccauucacagucccaauauuaacgguagaagaaaugacaaauucuagauuuccaauaccccuagaaaaacuauuuacaggaccaucaggagcauuuguuguacaaccacaaaacggaagaugcacuacugauggaguauuacucggaacaacacaauuaaguccaguaaauauauguacauucagaggugacguuacccacauagccggcucuagaaauuauacaaugaaucuagccucucucaauuggaacaacuacgacccaacagaagaaauaccagcaccucuuggaacaccagacuuuguugguaaaauacaaggugucuuaacacaaacaacaaaagaagacgguuccacacgaggucacaaagcuaccguauacacuggaucagcaccauuuacaccaaaacuugguucaguacaauucucaaccgauacagaaaaugauuucgaaacccaucaaaauaccaaauuuacucccgucggaguuauacaagacggaggaacaacacauagaaacgaaccacaacaauggguccuaccaaguuacucuggaagagauguacauaacguucaccuugcaccagcaguugcaccaacauuccccggagaacaauuacuauucuuuaggucaaccaugccaggcugcucaggauauccaaacauggaucuagauugcuuacuuccacaagaauggguacaacacuucuaucaagaagcagcaccagcacaaucagacguugcuuuacuaagauucguaaacccagacacaggacgaguauuauucgaaugcaaauuacauaaaucaggauauguaacaguagcacauacuggacaacaugauuuaguaauaccacccaauggcuauuucagauuugacuccuggguaaaucaauucuacacgcuagcaccaauggguaauggaacaggucgaagaagagcacuauaa

SEQ ID NO: 31172 - RNA, 1647 nt, Artificial Sequence
  derived and/or modified sequence opt6 from capsid_protein_VP1__Norovirus__AII02845
augaaaauggcaucuaaugaugcagcacccucaaaugacggugcagcuggacuaguuccugaaaucaauuccgaagcuauggcauuagaaccagucgcaggagcagcaauugcagcuccauuaacaggccaacaaaauauaauugaucccuggauuaugaauaauuuuguacaagcaccagguggagaauuuacaguaucuccaagaaauuccccuggagaaguacuacuaaaucucgaauuaggaccagaaauaaauccauauuuagcacaucuugcuagaauguauaaugguuacgcagguggauuugaagugcaaguaguucuagcuggcaaugcauucacagccggaaaaauaauauuugcagccaucccuccaaauuuuccaauagauaaccuaucagcagcucaaaucacaaugugcccccacguuauuguugacguaagacaacuagaaccaguaaaucuuccaaugccugacgucagaaacaauuucuuucauuacaaucaaggaucugacucuagauuaagacuuauagcuaugcuauacacaccucuuagagcuaacaauucaggagaugauguauucacaguaucuugucgaguccuaacaagaccaucaccugacuuuucauuuaacuuccuaguaccaccaacaguugaguccaaaacuaaaccauuuucauuaccuauauuaaccauuucugaaaugucaaacucaagauuuccaguaccaauagacagucuacauacaucaccaacugaaaauauaguaguacaaugucaaaauggaagaguaacuuuagacggugaauuaauggguacaacacaauuacuaccaucccaaauaugcgcauuuagaggaaugcuaacaagaucaacuucucgagccucugaccaagccgacaccgccacucccagacuuuuuaacuauuauuggcacauccaacuagacaauuuaaauggcacuccauacgauccagcagaagauauaccagguccccuaggaacucccgauuuccguggaaaaguuuucgguguagcaucacaaagaaauccagaugcaacuacucgcgcacacgaagcaaaaauagauacaacaagcggacgcuuuacaccuaaacucggaucauuagaaauaucaaccgaaaguggagauuuugaucaaaaccaacccaccagauuuacaccaguaggaauaggaguugaucaugaagcagacuuccaacaauggacacuaccagacuaugcaggacaauuuacucauaacaugaaucuagcuccagcaguagcaccaaauuuuccuggagaacaacuccuuuuuuuuagaucucaauuacccucaucugguggucgaucaaauggaaucuuagacugccuuguaccucaagaauggguacaacauuuuuaucaagaaucagcaccaucccaaacacaaguagcacuuguaagauauguaaauccagacaccggucgaguacuauucgaagccaaacuacauaaacuagguuucaugacaauagcuaaauccggcgauucucccauaaccguuccuccaaauggcuauuuccgauucgaaucauggguaaauccauucuauacccuugccccaaugggaacaggaaacggaagaagacguauacaauaa

SEQ ID NO: 31173 - RNA, 1647 nt, Artificial Sequence
  derived and/or modified sequence opt6 from capsid_protein_VP1__Norovirus__AII02848
augaaaauggcgucaaaugaugcugccccuucuaacgacggagcagcagguuuaguacccgaaauaaacucagaagcaauggcacucgaaccuguagcaggagcagcaauugcugcaccucuaacaggucaacaaaacauaauugauccauggauuaugaauaacuuuguacaagcucccggaggcgaauuuaccgugucaccccgcaacucuccaggugaaguacuucuaaauuuagaauuaggaccagaaaucaauccauauuuagcccacuuagcaagaauguacaacggcuaugcuggaggauucgaaguacaaguaguauuagccggaaaugcauuuaccgccggaaaaaucauauuugccgcaauccccccaaacuuuccaauagacaaucuaucugcagcacaaaucacaauguguccccaugucauaguagacguaagacaacuagaaccaguuaaccuaccaaugccagauguuagaaacaacuucuuucauuacaaccaaggaucagauuccagacuacgucuuauagcuaugcuauacacaccccuaagagccaauaauucaggugaugacguauucacgguaucaugcagaguauuaacacgaccaucacccgauuucucauucaauuucuuaguaccaccaacaguagaaucuaaaacaaaaccuuucucacuacccauauuaaccauaucagaaaugucaaacaguagauuucccguuccaauagauucacuacauacauccccaaccgaaaauauaguaguccaaugucaaaauggucgagucacucuagauggagaauuaaugggaaccacucaauuacuaccaucucaaauaugugcauuuagaggaauguuaacaagaucaaccuccagagcaucagaucaagccgauaccgcaacuccaagauuauuuaauuacuauuggcacauacaauuagauaacuuaaauggaacaccauacgauccugcugaagauauaccaggcccacuuggaacucccgacuuuagagguaaaguauuuggagucgcaucacaaagaaaucccgacgcaacuacaagagcacaugaagcaaaaauagacacaacaucuggaagauucacuccaaaacuaggaucauuagaaaucagcacagaauccggagauuuugaccaaaaucagccaacacgauucacaccaguugguauaggaguagaucaugaagcagauuuccaacaauggacuuuaccagauuaugcaggccaauuuacacauaacaugaaucuagcacccgcaguagccccaaacuuuccaggagaacaauuauuauucuuuagaucccaacuaccuuccucaggagguagaucaaacggaauucuagauugucuaguaccccaagaauggguucaacauuucuaucaagaaucugccccaucacaaacccaagucgcucuaguaagauacgugaauccagacacaggaagaguauuauucgaagccaaacuacauaaauuaggauuuaugacaauagcaaaaucaggagacucaccaauaacagucccaccuaacggauauuucagauuugaaucauggguaaauccuuuuuacacacuagcuccaaugggaacagguaauggacgcagacguauacaauaa

SEQ ID NO: 31174 - RNA, 1623 nt, Artificial Sequence
  derived and/or modified sequence opt6 from capsid_protein_VP1__Norovirus__AII02851
augaaaauggcaucaaacgaugcaaacccaagugacggaucagcagcaaauuuaguaccugaagucucaaacgaagucauggcuuuagaaccaguugucggagcagcaauagcagcaccaguagcaggacaacaaaauguaauagaucccuggauacgcaauaauuucguccaagcaccaggaggagaauuuacaguaucaccaagaaacgcaccaggugaaauacuauggucagcuccuuuaggacccgaucuaaacccauaccuaucacaucuagcuagaauguauaauggcuaugcgggaggcuuugaaguacaaguaauccuagcuggcaaugcauuuacagcaggaaaaauaaucuucgccgcaguacccccuaacuuuccaacagaaggacuaucuccaucacaaguaacaauguuuccucacauuaucguagauguaagacaauuagaaccaguauuaauaccauuaccagauguacgaaauaauuucuaucacuauaaccaaaccaaugauucuacaauaaaacuaauagcuauguuauauacuccacucagagcaaacaacgcaggcgaagauguuuuuaccguaagcugccgaguuuuaacccgaccaucaccagacuucgacuucauauuuuuagucccaccaacaguugaaucacgcacaaagccauucacaguaccuauacuaacaguagaagaaaugacaaacucaagauuuccaauuccccuagaaaaacuauuuaccggaccuaguggcgcauucguaguacaaccucaaaauggucgcuguacuacugacggaguucuacuagggaccacucaacuuucaccagucaacauauguacauuucgaggugauguuacacauaucgcaggcucacgugauuacaccaugaaccuagcaagcuuaaauuggaacaauuacgauccuacagaagaaauaccagcaccacuaggaaccccagacuuuguagguaaaauacaagguguauuaacacaaacaacaaaaggagaugguucaacacgaggucauaaggcaacaguuuauacaggaucagcacccuucacaccaaaacuaggaucagugcaauuuucaacagauacagaaaacgacuucgaaacacaucaaaauaccaaauuuacacccguaggagucauacaagacggaggcacuacacacagaaaugaaccacaacaauggguacuaccauccuauucagguagagauguacauaacguacauuuagcuccagcaguagcaccaacauuuccaggugaacaauuacuauucuuuagaucaacaaugccuggauguucaggguauccaaauauggacuuagacugccuauuaccacaagaauggguacagcacuucuaucaagaagcagcaccugcacaaucagacguagcauuauuaagauuuguuaacccagauaccggacgaguauuauuugaauguaaauuacauaaaucaggauaugucacaguagcacacacaggccaacaugaucuuguaauaccuccaaauggauacuuccgauucgauucauggguaaaucaauucuauacauuagcacccaugggcaauggaacaggacguagaagagcacuauaa

SEQ ID NO: 31175 - RNA, 1623 nt, Artificial Sequence
  derived and/or modified sequence opt6 from capsid_protein_VP1__Norovirus__AII02854
augaaaauggccucaaacgacgcaaauccaucugacggauccgcagcuaaucuuguaccagaaguaucaaacgaaguaauggcuuuagaaccaguugucggagcagcuaucgcagcaccugucgccggacaacaaaauguuauagauccauggauaagaaauaacuuuguacaagcuccuggaggagaauuuacagucuccccuagaaaugcaccaggagaaauauuauggucagcaccacuaggacccgauuuaaaucccuaucuaucucaccuagcccguauguauaacggauaugcaggaggauuugaaguacaagucauuuuagcagguaaugcauuuacagcaggaaaaaucauauucgcagcuguccccccaaacuucccaacagaaggacuaucaccaucacaaguaacaauguucccacauaucauuguagauguacgacaacuagaaccuguccuaaucccacuuccagauguacgcaacaauuucuaucauuauaaucaaacuaaugauucuacuaucaaacuaauagcuaugcuauacaccccauuaagagccaacaacgcaggagaagaugucuucacaguuucaugucgaguacuuacaagaccaucuccugacuuugacuucauauucuuaguaccaccaacaguagaaucaagaacuaaaccuuucacuguaccaauuuuaacaguugaagaaaugacuaacucaagauuuccaauacccuuagaaaaauuauucaccggaccaucuggagcuuuugucguucaaccacaaaauggcagauguacaacagauggcguauuauuaggaaccacacaauuaucaccagucaauaucuguacauucagaggagacguuacacauauagcaggcucaagaaacuauacaaugaauuuagccaguuuaaacuggaacaauuacgacccaacugaagaaauaccagcaccacuaggaaccccagacuuuguaggaaaaauacaaggaguauuaacacaaacaacaaaaggagauggcucaaccagaggucacaaagcuaccguauacacaggcagcgcaccauuuaccccaaaacuaggaucaguacaauucucaacagauacagaaaaugauuuugaaacccaucaaaauacaaaguuuacaccaguaggaguaauacaagacggcggaacaacucauagaaacgaaccucaacaauggguauuacccuccuacucaggucgagacguucauaauguacacuuagcacccgcaguagcuccuacuuucccaggagaacaauuacuauucuucagaucuaccaugccaggauguuccggauaccccaacauggaucuugauugucucuuaccacaagaauggguacaacauuuuuaucaagaagcugcacccgcacaaagugacguagcauuacuaagauuugugaaucccgauacaggaagaguauuauuugaauguaaacuucacaaaagugguuauguuacaguagcacacacaggacaacaugauuuaguaaucccaccaaauggauacuucagauucgacucauggguaaaucaauuuuacacacuagcuccuaugggcaauggaacuggaagaagaagagcacuauaa

SEQ ID NO: 31176 - RNA, 1623 nt, Artificial Sequence
  derived and/or modified sequence opt6 from capsid_protein_VP1__Norovirus__AII02857
augaaaauggcaucaaaugacgccaacccaucagacggcucugccgcuaaucuaguaccagaaguaaauaaugaaguuauggcauuagaaccagucgucggugcagcaauagcagccccuguugcaggucaacaaaauguuauagauccuuggauaagaaauaacuuuguacaagcacccggaggagaauucacaguauccccccgaaaugcacccggagaaauacuauggucagcaccuuuaggaccugaucuaaaucccuauuuaucacauuuagccagaauguacaacgguuacgccggaggauucgaaguacaaguaauuuuagcagguaaugcauucaccgcagguaaaauaauauuugcagcugucccaccaaacuuccccacagaaggacuaucaccaucccaaguaacaauguucccccauauaauuguagacgucagacaacuagaaccaguuuuaauaccauuacccgacguaagaaauaacuuuuaucauuauaaccaaucuaaugacagcacaauaaaacuaauagcaaugcuuuacacuccacuucgagcuaauaacgcaggagaagauguauuuacaguauccugucguguccuaacaagaccaucuccagacuuugacuucaucuuuuuaguaccaccaaccguagaaucucgcacaaaaccauucacaguuccuauauuaacaguugaagaaaugacuaauucaagauucccaauaccauuagaaaaauuauuuacuggcccaucaggagcauuuauaguccaaccucaaaacggacguuguacaacugauggaguacucuugggcaccacacaacuaucaccaguuaauauauguaccuuuagaggagacguaacacauauagcaggcucuagaaauuacacaaugaacuuggcaucuuuaaauuggaauaauuacgauccuacugaagaaauaccagcaccccuuggaacuccagacuuuguagguaaaauacaaggaguauuaacacaaacaacaaaaggcgacggaucaacuagaggucacaaagccaccgucuauacaggaucggcaccauuuacuccaaaacuuggaucaguacaauucucaacagacaccgaaaacgacuucgaagcacaccaaaauacaaaauucacccccguaggaguaauacaagauggaggaacaacacauagaaaugaaccacaacaauggguacuuccaucuuacucaggucgagauguucauaacguacacuuagcaccagcaguugcaccuaccuuuccaggugaacaacuacucuucuuccgcucaacaaugccaggaugcucaggauauccaaauauggaccuagauugccuuuuaccacaagaauggguacaacauuuuuaucaagaagcugcuccagcacaaagugauguggcauuacuacgauuuguaaauccagacacuggaagaguuuuauuugaaugcaaauuacauaaaccaggauauguaacaguagcacauaccggacaacacgaucuuguaauaccuccaaauggauauuucagauuugauucauggguaaaucaauuuuacacauuagccccaaugggaaacgguacaggaagaaggagagcauuauga

SEQ ID NO: 31177 - RNA, 1623 nt, Artificial Sequence
  derived and/or modified sequence opt6 from capsid_protein_VP1__Norovirus__AII02860
augaaaauggcaucuaaugacgcaaauccaucagauggcuccgcagcaaaccuuguccccgaaguaagcaacgaaguuauggcuuuagaaccaguaguuggagcagcaauagcagcaccagucgcaggccaacaaaauguaauagaucccuggauacgaaacaacuucguacaagcaccuggaggagaauuuacaguuagcccucgcaacgcaccuggagaaauacucuggucugcaccucuugguccagaucuuaacccauaucuaucucaucuugcuagaauguauaacggcuacgcaggaggauuugaaguacaaguaauacucgccggaaaugcauuuacugccggaaaaauaauauuugcagcaguaccaccuaacuucccaacagaagguuuaucacccagucaaguuaccauguucccacacauuauagucgacguaagacaacuagaaccagucuuaauaccacuacccgauguccgaaacaauuucuaucacuauaaccaaacuaaugacuccacaauaaaauuaauagccauguuauacacaccauuaagagcaaacaacgcuggagaagauguauucacaguuucauguagaguacuaacaagaccgucacccgacuucgacuuuauauuucucgucccaccaacuguagaaagccgaacaaaaccuuucacaguaccaauacucacaguagaagaaaugaccaacucccguuuuccaauaccacuagaaaaacuguuuacaggaccuaguggagcauuuguaguacaaccccaaaauggucgauguaccacugacggaguacuacucggaacaacacaacuauccccaguaaacauaugcacauuuagaggugauguaacacauauagcaggaucaagaaauuacacaaugaauuuagcauccuuaaacuggaacaauuacgauccaacugaagagauaccugccccacuaggaacaccagacuucgucgguaaaauacaaggaguauuaacacaaacaacaaaaggagacggcucaacaagaggacauaaagcaacuguauacacagguucugcaccauuuacaccaaaacuaggcucaguacaauucuccacagauaccgaaaaugauuucgaaacacaucaaaauacaaaauucacaccaguaggcguaauucaagacggaggaacuacacauagaaaugaaccacaacaaugggucuuaccaucauauucugguagagauguacauaauguucaccuugcaccugcaguugcacccacauuuccaggagaacaacucuuauuuuuuagaaguacaaugccagguugcucaggauacccuaauauggauuuagauugucuacuuccacaagaauggguucaacacuucuaucaagaagcugcaccagcacaaagcgacguagcuuuacuaagauuuguuaacccagauacaggaagaguacuauucgagugcaaauuacauaaaucaggcuauguaacaguagcccacaccggacaacaugaccuaguuauaccaccaaauggauauuucagauucgauucauggguaaaucaauucuacacacucgcucccauggggaacggaacaggaagaagacgagcauuauaa

SEQ ID NO: 31178 - RNA, 1623 nt, Artificial Sequence
  derived and/or modified sequence opt6 from capsid_protein_VP1__Norovirus__AII02866
augaaaauggcuuccaaugaugcaaacccaucagauggcucagccgcuaaccuaguaccugaaguaucuaaugaagucauggcacucgaaccaguaguaggcgcugccauagccgcaccuguagcaggacaacaaaaugucauugacccauggauucgaaauaauuuuguacaagccccaggcggagaauuuacagucucccccagaaacgcuccaggagaaaucuuauggucagcaccuuuaggacccgaccuaaacccuuauuuaucacauuuagcacgaauguacaaugguuacgccggcggauucgaaguacaaguuauauuagcuggaaaugcauuuacagcaggaaaaauaauuuucgcagcaguacccccaaauuucccaacugaagguuuaucaccuucucaaguaacuauguuuccucacauaauuguagauguuagacaauuagaaccaguacuaauacccuuaccagauguaagaaacaauuucuaucauuauaaucaaaccaaugacucaacaauaaaacuaauagccaugcuuuacacaccacuuagagcuaauaacgcaggugaagacguauuuacaguuucuugcagaguucuaacuagaccaucaccagacuucgauuuuauauucuuaguacccccaacaguugaaucgcgaacaaaaccauucacuguuccaauccuaacaguagaagaaaugacuaauucaagauuuccaauaccuuuagaaaaacucuuuacaggaccuucaggagcauucguaguacaaccccaaaacgguagauguacuaccgacggcguauuacuaggcacaacacaauuauccccuguaaauauauguacauuucgaggcgacguuacacacauagcagguucaagaaacuauacaaugaaccuagcaucacuuaacuggaacaacuacgacccaacagaagaaaucccagccccucucggaaccccugauuuuguuggaaaaauacaaggaguauuaacacaaacaacaaaaggugauggaucaacaagaggacauaaagcaacagucuauacuggaucugcuccauuuacaccaaaacuuggcucaguacaauuuucaaccgacacagaaaacgauuuugaaacacaccaaaauacaaaauucacuccuguuggaguuauacaagauggaggaacuacucauagaaaugaaccacaacaauggguacuaccuucauauucaggacgagacguacauaacguacauuuagcaccugcaguagcaccaacauuuccaggugaacaacuauuauucuuuagaucuacaaugccaggaugcucaggcuauccaaauauggaucuugacugccuucuaccacaagaauggguacaacacuuuuaucaagaagcagcaccagcccaaagugacgucgcccuauuaagauucguaaauccugacacaggccgaguucuauuugaaugcaaauuacauaaaaguggauauguaacaguagcucacacuggacaacaugauuuaguaauacccccaaauggauauuucagauucgacucauggguaaaucaauuuuacacauuagcaccuauggguaauggaacaggaagaagaagagcacuauaa

SEQ ID NO: 31179 - RNA, 1623 nt, Artificial Sequence
  derived and/or modified sequence opt6 from capsid_protein_VP1__Norovirus__AII02869
augaaaauggcaucaaacgacgcuaacccuacagacggaucagcugcgaaucuuguucccgaaguaucaaacgaaguaauggcauuagaaccaguaguaggagcagcuauagcagcaccagucgcaggacaacaaaauguaauugacccauggauaagaaauaacuucguucaagcaccaggaggagaauucacugucucaccacgaaacgcaccaggcgaaauccuauggucagcaccacuaggaccagauuuaaauccuuaucuaagccacuuagcaagaauguacaacggauacgcaggcggauuugaaguacaagucauacuagcaggcaaugcauuuacagccggaaaaauaauauucgccgcaguaccaccaaauuucccaacagaaggcuuaucacccucucaaguuacaauguuuccacacauaauaguugacguaagacaacuagaacccguauuaauacccuuaccagaugucagaaauaauuuuuaucauuauaaccaaacaaaugacucaacuauaaaguuaauagcgauguuauacacuccuuuacgagcaaacaaugccggugaagauguuuuuacaguuucauguagaguacuaacacgcccauccccagauuuugacuucaucuucuuaguaccaccaacaguagaaagcaggacuaaaccuuucacuguaccaauauuaacaguagaagaaaugacaaauucaagauuuccaauacccuuagaaaaacucuuuacagguccaucaggugcauuugucguacaaccccaaaauggacgaugcaccacagacggaguauuacucggaacaacucaauuaucuccaguaaauauauguacauuucgaggagacguaacucauauagcuggaucuagaaauuauacuaugaauuuagcuucacuaaauuggaauaauuaugauccuacagaagaaauaccugcaccacuaggaacaccagauuucguaggaaaaauacaaggaguacuaacacaaacaacaaaaggagacggaucaacucgaggucauaaagcaacaguauauacaggauccgcaccauuuaccccaaaauuaggcucaguacaauuuucuacugauacagaaaacgacuuugaaacacaucaaaacaccaaauuuacaccaguaggaguaauacaagauggaggcacaacacaccgaaaugaaccacaacaauggguauuaccaucauauagcggaagagauguacauaauguccauuuagcuccugcaguagcuccaacuuucccaggagaacaacuccuuuucuucagaucaaccaugccaggaugcucaggauauccaaauauggaucuagauugccuacuaccacaagaauggguacaacauuucuaucaagaagcagcaccagcacaaucugacguagccuuauuaagauucguaaacccagauacagguagaguccuauucgaaugcaaacuacacaaaucugguuauguaacaguagcccacacaggacaacaugacuuaguaaucccaccaaauggcuacuuccgauucgacuccuggguaaaccaauuuuacacucuagcaccaauggguaauggaacaggaagacguagagcacuauaa

SEQ ID NO: 31180 - RNA, 1623 nt, Artificial Sequence
  derived and/or modified sequence opt6 from capsid_protein_VP1__Norovirus__AII02872
augaaaauggcaucaaacgacgcaaauccuucagauggaagugcagcuaacuuaguaccagaaguauccaacgaaguaauggcacuugaaccaguuguuggugccgcaauagcagcuccuguagcaggucaacaaaacguuauagacccauggauaagaaacaacuuuguccaagcuccaggaggggaauuuacagucucaccaagaaaugcaccuggagaaauacuuuggucagccccauuaggaccugaucuaaauccauauuuaucucacuuagcaagaauguacaauggauacgccggaggcuucgaaguacaaguaauuuuagcagguaaugcauuuacagcuggaaaaauaauuuucgcugcaguaccacccaacuuuccaacagaaggauuauccccaucacaaguaacaauguucccacacauaauagucgauguacgacaauuagaacccguuuuaauaccauuaccugauguacgaaacaacuucuaucacuacaaccaaacuaaugauucaacaauuaaauuaauagccaugcuauauacuccacuaagagcaaacaaugcuggagaagauguauuuacaguaaguugucgaguacuuacaagaccaucaccagacuucgacuuuauauuuuuaguacccccaacaguagaaucuagaacaaaaccauuuacaguaccuauacucaccguagaagaaaugacaaauuccagauuuccaauacccuuagaaaaauuauuuacaggacccucgggagcauuuguaguucaaccucaaaacggaagauguacaacagacggaguacuacuaggaacaacacaacuaucaccuguaaacauaugcacauuuagaggagacgucacacauaucgcaggaucuagaaacuauacaaugaaucuugcuucacuuaacuggaacaauuacgauccaacagaagaaauaccagcaccucuaggaaccccagacuuuguaggaaaaauacaaggaguauuaacacaaacaacaaaaggugacggauccacaagaggacacaaagccacaguauauacaggaucagcuccauucacaccuaaauuaggaucuguccaauucucaacugacacagaaaacgauuucgaaacacaucaaaauacaaaauucacaccaguaggcguuauacaagacggaggaacaacacauagaaaugaaccucaacaauggguacuaccaucauauaguggacgagauguacacaacguacaucuugcaccagccguagcaccaaccuuuccaggagaacaacuuuuauucuuucgaucaacaaugccaggauguucaggauaccccaauauggaccuagauugcuuacuaccacaagaaugggugcaacauuucuaucaagaagcagccccagcacaaucagacgucgcuuuauugagauuuguuaacccagacacugguagaguuuuauucgaaugcaaacuucauaaaucaggauauguaacaguagcacacacuggacaacacgaucuagucauuccucccaauggauauuuuagauucgauucaugggucaaucaauuuuacacauuagcaccaaugggaaaugguacaggaagacgcagagcucuauaa

SEQ ID NO: 31181 - RNA, 1623 nt, Artificial Sequence
  derived and/or modified sequence opt6 from capsid_protein_VP1__Norovirus__AII02875
augaaaauggcaucaaaugacgcaaacccaucagauggaucugcagccaacuuaguaccagaaguaucaaaugaaguuauggcacuagaaccuguaguaggagccgcaauagcugcaccaguagcaggacagcaaaauguaauagacccauggauaagaaauaacuuuguucaagcaccaggaggagaauucacaguaucaccaagaaacgcccccggcgaaauauuauggucagcaccacuaggaccugaucucaauccauaccuuucccauuuagcaagaauguacaacggauaugcaggcggauuugaaguccaaguaauauuagcaggaaacgcuuuuacagcaggcaaaauuauuuucgcagcaguuccaccuaacuucccuacugaaggucuuucuccuucucaaguaaccauguuuccacacauaauaguagaugugagacaauuagaaccagucuuaauuccauuaccagauguccgaaacaauuucuaucauuauaaccaaacaaacgacucuacuauaaagcuuaucgcuauguuauauacaccauuaagagcuaacaacgcaggagaagacguuuuuacaguaucaugucgaguacuaacaagaccauccccagauuucgauuuuauauuuuuaguaccuccaacuguugaaucacgaacaaaacccuucacaguuccaauauuaacaguagaagaaaugacuaauucaagauucccaauacccuuagaaaaacuauucacuggaccaaguggagcauucguuguccaaccccaaaacggucgauguaccacagacggaguauuauuaggaaccacacaauuaucaccugucaacauauguacauuuagaggugacguaacacacauagcuggauccagaaauuacacaaugaaucuugcaucauuaaauuggaauaauuacgauccaacagaagaaauacccgccccauugggaaccccagacuuugucggaaaaauacaaggaguauuaacucaaacuacaaaaggagacgguucaacacgaggccacaaagcaacaguauauaccggaagugcuccauucaccccaaaauuagguucaguacaauucucuacagacacagaaaacgauuucgaaacccaucaaaacacaaaauucacaccagucggaguaauacaagacggaggaacaacucauagaaacgaaccccaacaauggguacuaccaucauacuccggacgugauguucauaacguacaucuugcucccgccguagcaccaacauucccaggagaacaauuauuauucuuuagaucaacaaugccuggaugcucaggauaucccaacauggauuuagauuguuuacuaccacaagaauggguacaacacuuuuaccaagaggcagcaccagcacaaucagauguagcacuucuaagauuuguaaauccagacacaggacguguacuauucgaguguaaauuacauaaaucuggcuauguaacuguagcacauacaggacaacacgauuuaguaauaccuccaaauggauauuuuagauucgacaguuggguuaaccaauuuuauacauuagcuccuaugggaaauggaacaggaagaagaagagcauuauaa

SEQ ID NO: 31182 - RNA, 1647 nt, Artificial Sequence
  derived and/or modified sequence opt6 from capsid_protein_VP1__Norovirus__AII02878
augaaaauggcaucaaacgaugcagcaccaucaaaugacggcgcagcaggucuaguaccagaaaucaauucagaagcaauggcauuagaaccuguagcaggagcagcuauugcagcaccauuaacaggacaacaaaauauaauagacccauggauaaugaauaauuucguacaagcaccagguggcgaauuuacaguguccccccgaaauucuccaggagaaguucuauuaaauuuagaauuagguccagaaauaaauccuuaucuugcacauuuagcaagaauguacaauggauaugcagguggcuucgaaguccaaguaguacuagcuggcaaugcauuuaccgccggaaaaauaauuuucgcagccauaccaccaaauuuuccuauagacaauuuaucagcagcacaaauaacaaugugcccacacguaauuguagauguccgucaacuagagccuguaaaccuaccaaugccagauguuagaaauaauuucuuccauuauaaucaaggaucagauucacgauuacgacuuauagcuauguuauacacaccucuacgcgcaaacaauucaggcgaugacgucuucaccguuucaugucguguacuaaccagaccgucuccagacuuuucauuuaacuuucuaguuccaccaacuguagaaaguaaaacaaaaccauucucuuuacccauacucacaauaucagaaaugucaaauucucgauucccaguacccauagauucacuucacacaucacccacagaaaacauaguaguacaaugccaaaacggacgaguuaccuuagauggagaauuaauggguacuacacaacuacuuccaucucaaaucugcgcauucagaggaaugcuuacacgaucaacuagcagagccucagaccaagcagauacagcaacaccacgacucuucaacuacuacuggcauauacaacuagauaaccuaaacgguacaccauacgauccagcagaagauauaccaggcccuuuagguacacccgacuuccgcggaaaagucuuugguguagcaagccaaagaaaucccgaugcaacuaccagagcacacgaagcaaaaauagacacuaccucagguagauuuaccccaaaacuaggaucauuagaaauaucuacugaaucaggagacuucgaucaaaaucaaccuacacgauucacucccguagguaucggaguagaccaugaagcugauuuucaacaauggacacuaccagauuaugcaggacaauuuacccauaauaugaacuuagcaccagcaguagccccaaauuuuccaggcgaacaacuacucuuuuucagaucacaauuaccaucaucuggagguagaucaaauggaauauuagauuguuuagucccacaagaauggguucaacauuucuaucaagaauccgcaccaucucaaacccaaguagcacuaguaagauauguaaauccagauacaggaagaguauuauuugaagccaaacuccacaaacuuggauuuaugacaauugcgaaaucuggagauucaccuauaacuguuccucccaacggauacuucagauucgaaagcuggguaaaucccuuuuacacucucgcaccaaugggcacaggaaauggaagacguagaauacaauaa

SEQ ID NO: 31183 - RNA, 1623 nt, Artificial Sequence
  derived and/or modified sequence opt6 from capsid_protein_VP1__Norovirus__AII02881
augaaaauggcaucaaaugacgcaaauccgucagauggcucagcugcaaaccuaguuccagaaguaagcaaugaaguaauggcacuugaacccguagucggagccgcaauagccgcaccuguugcugggcaacaaaauguuauagacccuuggauaagaaauaacuuuguacaagcaccaggaggagaauucacagucucuccaagaaaugccccuggagaaauacucuggucagcuccucuuggaccagauuuaaauccuuauuuaucacauuuagcaagaauguauaauggauaugcaggugguuuugaaguacaaguaauucucgcaggaaaugcauuuacagcgggaaaaauaauauucgcagcaguccccccaaauuuuccaacagaaggcuuaucacccucacaaguaacaauguuuccucacauaauaguagacguaagacaauuagaaccaguucuaauuccacuuccagacguacgaaacaacuucuaccacuacaaucaaacaaaugacucaacaauaaaauuaauugcaaugcuauacacaccauuacgagcaaacaaugcaggagaagauguauuuacagucaguugucgaguacuaacacgcccaucaccagacuucgauuuuauauuucuaguuccuccuacuguagaaucaagaacaaaaccuuuuacaguaccaauacucacagucgaagaaaugacaaauuccagauucccaauaccucuagaaaaacucuuuacaggaccuucuggagcauucguaguccaaccacaaaacggaagauguacuacagacggaguacuacuaggaaccacacaauuaucaccaguaaauauauguacauuucgaggcgauguaacacauauagccggaucccgaaauuauaccaugaaucucgcaucccuaaauuggaacaauuaugauccaacagaagaaauaccagcaccacucggaaccccugauuuuguaggaaaaauacaaggaguacuaacacaaacaacaaaaggagauggaucaacucgaggucacaaagccacaguauauacagguucugcccccuucacaccuaaacuaggaagcguacaauucucaaccgacacagaaaacgauuuugaaacacaucaaaauaccaaauuuacaccaguuggaguaauacaagauggagguacaacacauagaaaugaaccacaacaauggguacucccaucuuacaguggacgagauguacauaacguacaucuugcaccagcuguagcacccacauuuccaggugaacaacuauuauucuuuagaucaacaaugccaggaugcuccgguuauccaaauauggaccuagacuguuuauuaccacaagaauggguacaacacuucuaucaagaagcagccccagcucaaucugacguagccuuauuacguuuuguuaacccugacacaggaagaguauuauucgaauguaaacuacauaaaucuggcuacguaaccgucgcacauacaggucaacaugaucuaguaaucccaccaaacggauauuuuagauuugacucauggguaaaccaauucuauacacuagcaccuaugggaaauggaacuggcagacgaagagcacuauaa

SEQ ID NO: 31184 - RNA, 1623 nt, Artificial Sequence
  derived and/or modified sequence opt6 from capsid_protein_VP1__Norovirus__AII02884
augaaaauggcuucuaaugacgcaaauccuucagacggaucagcagccaauuuaguaccagaaguaucaaaugaaguaauggccuuagaaccaguagucggagcugcaauagcugcuccagucgcaggacaacaaaauguuauagauccauggauucgaaauaauuuuguacaagcuccaggaggagaauuuacaguaucacccagaaaugcaccuggagaaauauuauggucagccccucuaggacccgaucuuaacccauaucuaucacaccuagcuagaauguacaauggauacgcuggaggcuucgaaguacaaguaauucuugcaggaaacgcauucacugcagguaaaaucauuuuugcagcuguaccaccaaacuuuccaacagaaggacucucacccucacaagucacaauguuuccucacauaauaguagacguaagacaacuagaacccguauuaauaccacuaccagacguacguaauaauuuuuaucacuauaaucaaacaaaugauucaacaauaaaacuaauagcuauguuauauacaccauuaagagcaaacaaugcaggagaagauguauuuacagucucauguagaguccuuacacgaccuucacccgauuuugauuuuauauuucuaguaccaccaacuguagaaucaaggacaaaaccauucaccgucccuauucuaacaguagaagaaaugacaaacuccagauuccccauaccccuugaaaaauuauucacaggaccaucaggcgccuucguaguacaaccucaaaacggacgauguacaacggacggaguccuguuagguacaacucaacuaucaccuguaaacauuuguacuuuucguggagacguaacacauaucgccgguagccguaauuauacaaugaaucucgcaucauuaaauuggaauaauuaugaucccacagaagaaauuccagcucccuuagguacucccgacuucguuggaaaaauacaagggguucucacacaaacaacaaaaggagacggcucaacuagaggccacaaagcaacuguuuacacagguucagcaccauuuacaccaaaauuaggcaguguacaauucucaacagauacagaaaaugacuucgaaacccaucaaaacacaaaauuuacaccaguuggagucauacaagacgguggaacuacucauagaaaugaaccucaacaauggguacuaccaucauauucaggacgagacguacauaacguucacuuagcaccagcaguagcaccuacauucccaggugaacaacuauuauuuuucagaucaacaaugccagguuguucaggauacccaaauauggauuuagacugccuacuaccucaagaauggguacaacacuucuaucaagaagcugcacccgcacaaucagacguagcccuucuaagauucguaaauccagauacaggacgaguauuauuugaaugcaaacuacauaaaucugguuacguaacaguagcucauacaggacaacacgauuuaguaauaccaccgaacggauauuuucgauucgauaguuggguaaaucaauuuuacacauuagcacccaugggcaacggaacaggcagaagacgagcauuauaa

SEQ ID NO: 31185 - RNA, 1647 nt, Artificial Sequence
  derived and/or modified sequence opt6 from capsid_protein_VP1__Norovirus__AII02887
augaaaauggcuucaaacgaugcagcaccaagcaaugacggugccgcaggauuaguaccagaaauaaacucagaagcaauggcuuuagaaccaguagcuggcgccgcaauagcagcaccccucacuggccaacaaaauaucauagacccauggauaaugaauaacuuuguacaagcaccaggaggagaauuuacuguaucaccaagaaauaguccaggcgaaguauuacuuaaccuugaacuaggacccgaaauaaaucccuaccucgcacaccuagcaagaauguacaacggauaugcagguggauucgaaguacaaguaguauuagcagguaacgcauucacugcagguaaaauaauuuucgcugcaauaccaccuaauuuccccauagauaaucuaucagcagcccaaauaacaauguguccucacguaauuguagauguccgccaauuagaaccaguaaacuuacccaugccugacguacgaaauaacuucuuccacuacaaucaaggaucagauaguagauuaagauuaauagcaaugcuauauacuccauuacgcgcaaacaauucaggagaugaugucuuuacagucuccuguagaguauuaacacgcccaaguccagacuucaguuuuaacuuucuaguaccuccaacaguugaaucaaaaacaaaaccauuuucuuuacccauauuaaccauaucugaaaugucaaacucaagauuuccaguaccaauagacucauuacauacaucaccaacugaaaauaucguuguccaaugccaaaacggacguguaacauuagauggagaacuaaugggaacaacccaacuauuacccucacaaauaugcgccuuuagaggaauguuaacacgaucaacuucaagagccuccgaucaagcagacacugcaacaccaagauuauucaauuauuauuggcacauucaacuugauaaucuaaacgguacacccuacgaucccgcagaagacaucccaggaccauuaggcacaccugacuuuagaggaaaaguauuuggaguagccucucaaagaaaucccgaugcuacaacaagagcacaugaagccaaaauagauacaacuucaggccguuucacgccaaaacuuggaucacuagaaauaagcacagaaucuggugauuuugaccaaaaccaaccaacaagauuuacucccguagguauagguguagaucaugaagcagauuuucaacaauggacauuaccagauuacgcaggccaauuuacacacaacaugaauuuagccccugcaguagcuccaaacuucccaggagaacagcuauuauucuucagaucucaacuucccucaucuggaggccguucaaauggaauacuugauugcuuaguaccacaagaauggguucaacacuuuuaccaagaaucagcaccaucacaaacccaaguugcacuaguucguuacguaaacccagauacagguagaguuuuauuugaagccaaacuacauaaacuuggauuuaugacaauagcaaaaucuggagauucaccuauaacaguaccaccaaacggauauuuuagauuugaauccugggucaauccauuuuauaccuuagcaccuaugggaacaggaaacggaagacgaagaauccaauaa

SEQ ID NO: 31186 - RNA, 1623 nt, Artificial Sequence
  derived and/or modified sequence opt6 from capsid_protein_VP1__Norovirus__AII02890
augaaaauggcaucaaacgacgcaaacccaucagacggaucagcagcaaaucuaguaccagaagucuccaaugaaguaauggcucuagaacccguaguaggugcugccauagccgccccaguagcuggacaacaaaauguaauagacccauggauaagaaauaacuuuguucaagcaccaggaggagaauuuacagucucccccagaaacgccccaggcgaaauauuauggucagccccauuaggaccagauuuaaacccauaccucucucauuuagcacgaauguauaacggcuacgcuggaggauuugaaguacaaguuauauuagcuggaaaugccuucacagcuggcaaaauaauauucgcugcaguaccaccaaauuuuccaacagaaggauuaucaccaucacaagucacaauguuuccccacauaauugucgauguucgccaacuagagccaguacuaauaccauuaccagaugucagaaauaacuucuaucauuacaaccaaaccaacgacucaacaauuaaauuaaucgcaaugcuauauacacccuuaagagcaaauaaugcaggugaggauguuuucacaguaucauguagaguauuaacaagaccuucaccagauuuugauuuuauauuucuuguaccccccacaguagaaucuagaacaaaaccauuuaccguaccaauacuuacaguugaagaaaugacaaauuccagauucccaauuccauuagaaaaauuauucaccgguccaucaggcgcauuuguaguacaaccucaaaauggaagauguacaacagacggcguacuacuaggaacaacacaauuaucaccaguuaauauauguacauucagaggugauguaacacauauagcuggaucccgaaauuacacaaugaauuuagcaucauuaaacuggaauaauuaugaucccaccgaagaaauacccgccccacuaggaacaccagacuuuguaggaaaaauucaagguguauuaacacaaacuacuaaagaagacggaucuacacgaggacauaaagcaacaguauauaccggaagugcuccauucaccccaaaauuaggcuccguucaauucuccacugauacagaaaacgauuucgaaacacaucaaaacacaaaauucacacccguuggagucauccaagaugguggcaccacgcaucgcaacgaaccucaacaauggguacuaccaucauauucuggaagagauguacauaacguccacuuagccccagcaguugccccaacauuucccggagaacaauuacuauucuuuagaaguaccaugccaggaugcucaggcuauccaaauauggaucuagauugcuuacucccacaagaauggguacaacauuucuaucaagaagcagccccagcacaaucagauguagcacuauuacgcuucguaaacccagauacagguagaguauuauucgaauguaaacuucauaaaucaggauauguaaccguugcacauaccggacaacacgaccuaguaauuccaccaaaugguuacuucagauucgauucauggguaaaucaauucuacacacuagcuccaaugggaaacggaacaggaagaagaagagcccuauaa

SEQ ID NO: 31187 - RNA, 1623 nt, Artificial Sequence
  derived and/or modified sequence opt6 from capsid_protein_VP1__Norovirus__AII02893
augaaaauggccaguaaugaugccaacccaucugacggauccgcagcuaaccucgucccugaaguuagcaaugagguuauggcacuagaaccugucguaggcgcagcaauagcagcacccgucgcaggacaacaaaacguuauagaucccuggaucagaaacaauuuuguucaagcaccugguggcgaauuuaccguaucaccaagaaacgcaccuggcgaaauauuauggucagcaccauuaggaccagaucuaaauccauaucuaucacacuuagcacgaauguauaacggauaugccgguggauucgaaguacaaguuauacuugcuggaaaugccuuuacugccggaaaaauaauuuuugcugcaguaccacccaacuuccccacagaaggauuaucaccuucucaaguaacaauguucccucauauaauaguugauguucgacaacuagaaccuguauuaauaccauuacccgauguaagaaauaauuucuaccacuauaaccaaacaaacgauucuacaauaaaacuaauagcaauguuauacacuccauuacgagccaacaaugcaggagaagaugucuucacaguaucaugcagaguucuuacacguccaucaccugauuucgacuucauauuuuuaguaccaccaacaguagaaucaagaacaaaaccuuucacaguaccuauauuaaccguagaagaaaugacaaacucuagauucccaauaccuuuagaaaaacucuuuaccggaccuucaggagccuucguaguacaaccacaaaauggacgauguacuacagacggaguauuauuaggaacaacacaacuaucuccaguuaauauauguacauuuagaggagacguaacacauauagcaggaucuagaaacuauaccaugaacuuagcuucauuaaauuggaacaauuacgaccccacugaagaaauaccagcaccacuuggaacaccagacuuuguaggaaaaauacaaggaguacucacacaaacaacaaaaggagacggaucaacaagaggucacaaagccacuguauacacaggaucugcuccauucacccccaaauuaggauccguacaauuuucaacagauacagaaaaugacuuugaaacucaccaaaauacaaaauucacuccuguuggcguaauccaagacggagguacuacccauagaaaugaaccucaacaaugggcacuuccuucauacucaggaagagauguucauaacguacacuuagcacccgcaguugcaccaacauucccuggugaacaacuacuuuucuuucgauccacaaugccaggaugcucaggauauccaaauauggaccuagacugcuuauuaccacaagaauggguacaacauuuuuaucaagaagcagcuccugcucaaucugacguagcucuacuuagauuuguaaacccagacacuggcagaguauuauuugaaugcaaauuacauaaaucaggcuauguaacugucgcucacaccggacaacacgacuuaguaauaccuccaaacgguuauuucagauucgacagcuggguaaaccaauucuacacacuagcaccaaugggaaauggaacuggccgaagaagagcauuauaa

SEQ ID NO: 31188 - RNA, 1623 nt, Artificial Sequence
  derived and/or modified sequence opt6 from capsid_protein_VP1__Norovirus__AII02896
augaaaauggcaucaaacgaugcuaacccaucagacggaucagcagccaacuuaguucccgaaguaagcaacgaaguaauggcucuagaaccaguaguaggagcagcgauagcagccccuguagcaggucaacaaaauguaauagacccuuggauucgaaauaacuuuguacaagcuccaggcggugaauuuacaguaucaccaagaaacgcuccaggagaaauauuauggucagcaccauuaggaccagauuuaaauccauauuuaucacaccuagcaagaauguauaacggauaugcugguggcuucgaagucagaguaauauuagcuggaaaugcguuuacugcaggcaaaaucauuuucgcagcuguaccaccuaacuucccaacagaaggacucucacccucucaaguaacaauguuuccccacauaauaguugacguuagacaauuagaaccaguauuaauaccacuuccugauguacgaaauaauuucuaucacuacaaucaaacaaaugauucuacaauaaaacuaauagcaauguuauacacaccacuaagagcaaauaaugccggcgaagauguauucacaguaaguuguagaguacuuacacgacccucaccagacuucgacuuuaucuuucuaguacccccuacuguagaaucaagaacaaaaccuuucacaguacccauauuaacaguagaagaaaugacuaauucaagauuuccaauaccacucgaaaaauuauuuaccgguccaucaggagcauuuguaguucaaccacaaaacgguagauguacaacagacggaguacuccuaggaacaacucaacuauccccaguaaauauauguacauucagaggagacgugacucauauagcaggaucacgaaauuacacuaugaaucuagcuucacuaaauuggaacaauuacgacccaacugaagaaauaccggcuccacuaggcacaccagacuuuguagguaaaauccaagguguccuaacacaaacaacaaaaggugauggaucaacaagaggucauaaagcaacaguauauacaggaucagcaccauuuacccccaaauuaggcucaguacaauuuucaacugauacagaaaacgauuucgaaauacaucaaaacacaaaauucacuccaguuggcguaauccaagauggcggaacaacacaccgcaaugaaccucaacaauggguucuaccaagcuacucaggaagagauguacauaacguccacuuagcaccagccguagcuccaacauuuccaggagaacaauuacuuuucuuccgaucuacaaugccaggaugcaguggauauccuaauauggaucuagauugccuacuaccacaagaauggguacaacauuucuaucaagaagcagcaccagcacaaagugaugucgcacuauuacgcuucgugaacccagauacaggaagaguacuauuugaauguaaauuacacagaucaggauauguaacaguagcacauacaggccaacaugacuuaguaauaccuccaaaugguuauuucagauucgauucauggguaaaucaauucuauacauuagcaccaauggguaauggaacuggccgaagaagagcacuauaa

SEQ ID NO: 31189 - RNA, 1647 nt, Artificial Sequence
  derived and/or modified sequence opt6 from capsid_protein_VP1__Norovirus__AII02899
augaaaauggcaucaaaugaugccgcuccuuccaacgauggugcagcaggauuaguaccagaaauuaauuccgaagcaauggcccuagaaccuguagcuggugcagcaauagcugccccccuuacaggacaacaaaauauaauagauccauggauaaugaacaacuuuguccaagcuccuggcggugaauucacagucuccccaagaaacucuccuggagaaguauuauuaaaccuagaauuaggaccugaaauaaauccauauuuagcccaucuagcaagaauguacaauggauacgcuggaggauucgaaguacaaguaguuuuagcagguaacgcuuuuacagcaggaaaaauuauauucgcagcuauuccuccaaauuucccaauagacaacuuauccgccgcucaaauaacaaugugcccucauguaauaguagacguacgacaacuagaaccaguaaaucuaccaaugccagauguuagaaacaacuuuuuccacuauaaucaaggaagugacucaagacuaagauuaauagccaugcuauauacacccuuacgagcaaacaacucuggcgaugauguauuuaccguaucauguagaguauuaacaagaccaucacccgauuucucauucaauuucuuaguaccaccuacaguagaaucuaaaacaaaaccauucucauuaccaauacuuacaauaucagaaaugucaaauucuagguuuccagucccaauugauucacuacacacaucaccuacugaaaauauaguaguccaaugccaaaauggaagaguaacucuagauggugaauuaaugggcacaacccaauuauuaccuucccaaauaugugcauucaggggaauguuaacacgaucgacuucucgagccucagaccaagcggacacagcuacuccaagacuauucaauuauuauuggcauauucaacuagacaaucuaaacggcacaccauacgacccagcugaagacauuccuggaccucuaggaacacccgauuuucguggaaaaguuuucgguguagcaucccaaagaaauccagacgcuacaacaagagcucacgaagcaaaaauugauacaacaagcggaagauuuacaccaaaacuaggaucacuagaaauaucaacagagucaggugauuuugaucaaucacaaccuacuagauucacaccagucggaauaggaguagaccacgaggcagauuuccaacaauggacacuacccgacuaugcaggccaauuuacacauaacaugaauuuagcaccugcaguugcaccaaacuucccuggcgaacaacucuuauucuuccgaucacaacuuccaucaucaggcggaagaucaaacggcauacuagacugucuaguaccacaagaauggguacaacacuuuuaucaagaaucagcucccucucaaacacaaguagcauuagucagauauguaaauccagauacaggacgcguacuuuuugaagcaaaauuacauaaacuaggcuucaugacaauagcaaaaucaggagacucacccauaacaguacccccaaacggauacuuucgauuugaaucauggguaaauccauucuacacacuagccccaauggguacaggaaauggacgcagaagaauucaauaa

SEQ ID NO: 31190 - RNA, 1623 nt, Artificial Sequence
  derived and/or modified sequence opt6 from capsid_protein_VP1__Norovirus__AII02902
augaaaauggcaucaaacgaugcuaauccauccgauggcucagcagcuaacuugguuccagaaguaucaaaugaaguaauggcacuagaacccguaguuggugcugcaauugcagcaccaguagcaggucaacaaaauguaauagacccauggauaagaaacaacuucguacaagcaccugguggagaauuuaccguaaguccuagaaacgcuccaggagaaauucuuuggucagcaccauuaggaccagaccuaaauccauaucuaucacauuuagccagaauguauaacgguuacgcuggcggauuugaaguacaaguaauacuugcaggaaacgcauucacagcaggaaaaauaauauucgcugcaguaccaccaaacuucccaacagaaggucuaucucccucucaaguaacaauguucccacacauaauaguagauguaagacaacuagaaccaguucuuauaccuuuaccagauguacgaaauaauuuuuaccauuacaaccaaacaaacgauucaacaauaaaacuaaucgccaugcuauacacccccuuacgagcaaauaaugcaggagaagauguauucacaguaucauguagaguauuaacaagaccaucaccagacuuugacuuuauauuccuuguuccaccuacaguagaaagccgaacaaaaccuuuuacaguaccuauauuaacaguagaagaaaugacaaacucaagauucccuauaccauuagaaaaacuauuuacuggaccauccggugcauuuguaguacaaccacaaaacggucgauguacaacugauggcguccuacuugggacaacgcaacuaucuccuguaaacaucugcacauuuagaggagacgugacacauaucgcaggcucuagaaauuacaccaugaaucucgcaucauuaaacuggaacaacuaugacccuacagaagaaauaccagccccauuaggaaccccagacuucguaggaaaaauacaaggcguacuaacacaaacuacaaaaggagauggaagcaccagaggacacaaagcaacaguauauacaggaucagcacccuuuacaccuaaauuaggcagcguucaauucucaacagauaccgaaaacgacuucgaaacacaccaaaauacaaaauucacuccaguuggaguaauacaagacggaggcacaacucaucgaaacgaaccacaacaauggguccuacccucauauucaggaagagacguccauaauguacaucuagcaccagcaguagcaccuacauuuccaggagaacaauuacuauucuuuagauccacuaugccaggaugcucaggcuaucccaauauggaucuagacugucuucuaccacaagaauggguacaacauuucuaccaagaagcagcgccagcacaguccgauguagcacuccuaagauucguaaauccagacacaggcagaguauuauuugaaugcaaacuccauaaaucagguuauguuacuguggcucacacaggccaacaugaucucguaauuccaccuaauggauauuucagauuugacuccuggguuaaccaauuuuacacucuagcucccaugggaaacggaacaggcagaagaagagcacuauaa

SEQ ID NO: 31191 - RNA, 1647 nt, Artificial Sequence
  derived and/or modified sequence opt6 from capsid_protein_VP1__Norovirus__AIS24557
augaaaauggcuuccaacgacgcagcucccucuaaugauggugcagccggacuagucccagaaauaaauaaugaagcaauggcuuuagaccccgucgcuggagcagcaauagcagcucccuuaacaggacaacaaaacauuauagauccauggauaaugaauaauuuuguacaagcaccaggcggagaauuuacaguaucacccagaaauuccccaggagaaguauuacuaaauuuagaacuaggcccagaaaucaacccauaucucgcucacuuagcuagaauguauaacggauaugcagguggauuugaaguccaagucguauuagcaggaaaugcauuuaccgcaggaaaaguaauauucgcagccauaccaccuaacuuuccaacugauaauuuaucagcugcucaaauaacaauguguccucacgucauuguugauguaagacaacucgaaccaauaaaccuacccaugccagauguacgaaacaauuuuuuccauuauaaccaaggauccgacucuagacuaagauuaaucgcaaugcuauacacuccauuaagagccaauaacaguggugacgacguauuuaccgucucaugucgaguacuaacuagaccaucaccugauuucucauuuaacuuucuaguaccaccaacaguagaauccaaaacaaaaccauuuacuuuaccuaucuuaacaauaucagaaauguccaacucaagauuucccguaccaauagacucacuacauacaucaccaacagacaauauuguaguacaaugucaaaacggaagaguaacauuagacggagaauuaaugggaacuacucaacuacuuccaagccaaauaugugcauuuagagguguacucacaagaucaacuucgcgagcuucagaccaagcagaugccgccaccccacgauuauucaauuauuacuggcauauacaacuagacaaccuaaacggaaccccuuacgacccagccgaagauauaccagcaccacucggaacaccagauuuucgagguaaaguauucggaguagcuucacaacgcaauccagauucuacaacaagagcacaugaagccaaaguugauacuaccucuggacgauuuacaccuaaacuuggcagucuugaaauaucuacagaaaguggagauuucgaucaaaaucaaccaacaagauucacaccaguaggaauuggaguagauaaugaagccgacuuccaacaauggacauuaccagauuacucuggucaauuuacacacaacaugaacuuagcaccugcaguugcuccaaacuuuccaggcgaacaauuauuauuuuucagaucacaacuaccaucauccgguggaagaucuaacggaauucuagauugcuuaguaccacaagaauggguacaacacuucuaucaagaaagugcaccugcucaaacccaaguugcuuuaguacgauauguaaacccggacacaggacgcguauuauucgaagcaaaacuacauaaauuaggauauaugacaauagcaaaaucaggagauagcccaauaacaguucccccaaaugguuauuuuagauuugaaucaugggucaacccauuuuauacauuagcuccaaugggcacaggaaaugguagaagacgcauacaauaa

SEQ ID NO: 31192 - RNA, 1620 nt, Artificial Sequence
  derived and/or modified sequence opt6 from capsid_protein_VP1__Norovirus__AIY30135
augagaaugucugauggagcagcaccaaaagcagauggaucugaagcuuccggacaagauuuagucccaacagcaguugaacaagcaguaccuauacaaccaguagcaggcgcagcacuagcugccccugcagcaggucaaauuaaucaaauugaucccuggauauuccaaaauuuuguacaauguccacuuggugaauuuaguauuagcccaagaaauaccccaggugagauacuuuucgaucuagcacuagguccugguuuaaauccuuaucuugcacaucuuucagcaauguauacaggcuggguuggaaauauggagguacaacuuguauuagcagguaaugcuuuuacagcuggcaaaguagucgucgccuugguuccaccuuacuuuccaaaaggaucuuuaacuacagcucaaauaacaugcuuuccacauguuaugugugauguuagaacauuagaaccaauacaacuaccauuacuagaugucagaagaguacuauggcaugcaacacaagaccaagaagaaucaaugcgucuaguuuguaugcuuuauaccccacuaagaaccaauucucccggugaugaaagcuuuguaguaucugguagauuauuaucaaaaccagcagcagacuucaacuuugucuauuuaacuccaccuauugaaagaacaauauauagaaugguugaucuuccaguaauacaaccaagacuuuguacacaugccagauggccagcacccguauacgguuuauuaguagacccaucauuaccaucuaauccacaauggcaaaauggacgaguucacguagaugguacacucuuaggcaccacuccaguaucagguucuuggguauccuguuuugcagccgaagcagcauacgaguuucaaucaggcacaggucaaguagcaacauuuacauuaauagaacaagauggcucagcauauguuccaggugacagagcagccccauuaggcuauccagacuucucuggucaauuagaaauagaaguacaaacugaaacaacaaaaacuggagauaaacuuaaaguaacaacauuugaaaugauucucgguccuaccacaaauguugaucaagccccauaucaaggaaaagucuucgcaucaaucacagcugcugcaucauuagauuuaguagauggacgaguucgagcaguaccuagaucaauauauggcuuccaagacguuauacccgaauauaaugauggacuuuuagugccauuagcaccuccaauaggaccauuuuuacccggcgaaguccuauuaagauucagaacuuauaugagacaauuagacacagcagacgcagcagcugaagcaauagauugcgcauuaccacaagaauucauaagcugguucgccucuaauguauucacgguacaaucagaagcauuauuacuaagauauagaaauacacuaaccggacaauuauuauuugaauguaaacuauacucagaaggcuauauagcauuaucauauucuggaucugggccauuaacauuuccaacugauggauucuuugaaguaguaagcuggguaccaagacuuuaucaauuagcgagcguugguuccuuagcaacuggacgaacucuauaa

SEQ ID NO: 31193 - RNA, 1623 nt, Artificial Sequence
  derived and/or modified sequence opt6 from capsid_protein_VP1__Norovirus__AKE07100
augaaaauggcaucaucugacgcaaauccaucagacggaucaacagcaaaccuaguaccagaaguaaacaaugaaguaauggcauuagaaccaguuguuggugcugcaauagcagcacccguagcuggacaacaaaauguaauagauccauggauaagaaauaauuuuguacaagcaccaggcggagaauucacaauaucaccaagaaaugcaccaggagaaauauuauggucugcaccacuagguccggacuuaaaccccuaucuaucccacuuagcaagaauguacaacgguuacgcaggaggauucgaaguacaaguaauauuagcaggaaaugcauucacagcaggaaaaguaauuuuugccgcaguaccaccaaacuucccaacugaaggauuaucaccaucacaaguaacuauguuuccucauauaguaguagacguccgccaacuagaaccaguacuaauaccccuucccgacguuagaaacaacuuuuaucacuauaaccaaagcaacgacccaacaauaaaauuaauagcaauguuauacacacccuuaagagcuaauaaugcaggagaugacgucuucacaguuucaugcagaguacuaacucgucccucaccagauuucgauuucauauuccuaguaccaccuacagucgaaucaagaacaaaaccuuuuucaauuccaguauuaaccauagaagaaaugacuaauucaagauuuccaauaccccucgaaaaguuauuuacaggaccaucaucugcauucgucguacaaccacaaaacggacgaugcucaacagauggaguacuacuaggaacaacacaauuaucaccaguuaauauuugcacauuucgaggagacguuacacacaucgcugguagucacaauuacacuaugaaucuagcaucacaaaauuggaacucauacgaucccacagaagaaauaccagcaccguuagguacaccagauuuuguaggaaaaauacaaggcguauuaacacaaacuacucgugcugacggcuccacacgcggacauaaagcaacuguauuaacaggaucagcaaauuucaccccuaaauuaggaagaauacaauucgcuaccgauacagauaacgauuucgaaacaaaccaaaauaccaaauuuaccccagucggcguaauccaagacggagacacagcacauagaaacgaaccacaacaaugggucuuaccuucuuauucaggucgaaauacacauaauguacauuuagcaccagcuguagcacccacauuuccaggagaacaacuacuuuucuuucgaaguaccauaccagguugcucugguuacccaaacauggaucucgauugcuuacuaccccaagaauggguacaauucuucuaucaagaagcagcuccagcacaaucagaugucgcauuauuaagauucguuaacccagauaccggaagaguacuuuucgaaugcaaacuacauaaaucaggauauauaacuguugcccauacaggccaacacgaucuaguaauaccaccaaauggcuauuuucgcuucgacucuugggucaaccaauucuauacauuagccccaaugggcaacggaacagguagaagaagagcuuuauaa

SEQ ID NO: 31194 - RNA, 1623 nt, Artificial Sequence
  derived and/or modified sequence opt6 from capsid_protein_VP1__Norovirus__AKE07103
augaaaauggccuccucagacgcaaauccuuccgauggaucagcugcaaauuuaguaccugaaguaaacaaugaagucauggcauuagaaccaguaguuggagccgcaauagcagcaccagucgcaggacaacaaaacguaauugacccauggauaagaaacaauuucguacaagcaccuggaggagaauucacuguaucaccaagaaaugcaccaggcgaaauuuuauggucugcuccucuaggaccagauuuaaacccauacuuaucccaccuagcaagaauguacaacgguuaugcagguggauucgaaguucaaguaauuuuagcaggaaacgcauuuacagcagguaaaauuaucuuugccgccguuccaccaaacuucccuacugaaucuuuaucaccaucccaaguaacaauguucccacauauuauaguagacguaagacaauuagaacccguucuaauaccauuaccagauguacgaaauaacuucuaucacuacaaucaaucaaaugacccaacuauaaaauuaaucgcuauguuauacacaccacuuagagcuaauaaugcaggagacgacguauuuacaguaucaugcagaguacuaaccagacccucaccagacuuugauuuuauauuuuuaguaccaccaacaguagaaucucgaacaaaaccauuuucuguaccuauacuaacaguagaagaaaugacaaacaguagauuuccaauaccauuagaaaaauuauucacaggacccucaucagcauuuguaguccaaccacaaaauggcagaugcacaauagauggaguccuacugggaacaacacaacuaucaccugucaacaucuguacauuuagaggagauguaacacacauagccggaacacacaacuacacuaugaacuuagcaacccaaaacuggaauucauaugacccaacugaagaaauuccagcaccacuaggaacaccagacuuuguaggaaaaauccaaggaguauuaacacaaaccacaaaaacagaugguucaacuagaggucacaaagcaaccguuugcauaggaucagcugacuuugcuccaaaacuaggaagaguucaauuugaaaccgauacaaacaacgaucuugaaacaaaucaaaacacaaaauuuacaccaguaggcguaauccaaaacggugaaacagcacaucgaaaugaaccacaacaauggguacuaccaucuuacagcggacggaacacuccaaacguacaccuagccccagcaguagccccaacauucccaggcgaacaauuauuauuuuuccgauccaccaugccugguuguucagguuauccaaauauggaucucgauugucuacuuccucaagaauggguucaauauuucuaccaagaagcagccccagcacaauccgacguagcuuuauuaagauucguuaacccagacacaggaagaguacucuucgaaugcaaacuacauaaaucuggcuaugucacaguugcacauaccggaucacacgaucuaguaauaccucccaauggcuacuucagauuugauucauggguaaaucaauuuuacacccuagcaccaauggguaacggaacaggacgaagaagagcaacauaa

SEQ ID NO: 31195 - RNA, 1623 nt, Artificial Sequence
  derived and/or modified sequence opt6 from capsid_protein_VP1__Norovirus__AKE07106
augaaaauggcaucaucagaugcuaacccaucugauggaagcacagcaaaucuuguaccugaaguaaaugaugaaguaauggcauuagaacccguuguaggagcagcauuagcagcaccaguagcaggacaacaaaaugucauagacccuuggauaagaaacaacuucguacaagcacccggaggcgaauuuacaguaaguccaagaaaugcaccuggagaaauuuuauggucagcaccauuaggacccgauuuaaaucccuaucuaucucaucuagcaagaauguauaacggauaugcaggagguuucgaaguacaaguuauacucgcaggaaacgcauuuacggcaggcaaaguaauuuucgcagccguaccaccaaacuuuccaacagaaggacuaucaccaucacaagucacuauguucccacauauaaucguagacguaagacaacuagagccaguauuaaucccacuccccgacgcacguaauaacuucuaccacuauaaucaaucaaaugaaucaacaauaaaauuaauagcaaugcuuuacacaccacuaagagcaaauaaugcaggcgacgauguuuuuacaguuuccugcaggguauuaacucgcccuucauuagauuuugacuuuauauuuuuaguuccaccaacuguagaaagucgaacaaaaccauucucaguaccuauauuaacaguagaagaaaugacaaacucuagauucccuaucccacuagaaagacuauucacagguccaucaucagccuuugcaguacaaccacaaaauggaagauguacuacugacggcguacuauuaggaacaacucaacuaucaccaguuaauaucuguaccuuccgcggugacguaacacauacaacaggaucccauaacuauacaaugaauuuagcaucucaaaauagaucaaauuacgauccaacagaagaaauaccagccccccuuggaacaccagauuuuguuggaaaaauacaaggagcauuaacacaaacaacaagagcagacgguucaacuagaggacacaaagcaacugucuauacgggaucugcugauuuuacaccuaaauuaggaagaguacaauuugcaaccgauacagaucacgacuuugauacuaaucaaaauacaaaauucacucccguaggcguaauacaagauggcucaacaacacaucguaaugaaccacaacaauggguacuaccuucguauucagguagaaauacccauaacguacacuuagcaccagcuguagcaccaacuuucccaggcgaacaacuacucuucuucaggucuacuaugccugguugcucagguuaucccaacauggaucuagauugcuuacuaccacaagaaugggucgcacacuucuaucaagaagcagcaccagcacaauccgacguugcacuacuccgauuuguaaacccugacacaggaagagucuuauuugaauguaaauuacacaaaucaggauauguaacaguagcucacacaggucaacacgaccuaguaauaccaccaaacggauacuucagauucgauucaugggucaaucaauuuuauacauuagcaccaauggguaacggcacugggagaagaagagcauuauaa

SEQ ID NO: 31196 - RNA, 1719 nt, Artificial Sequence
  derived and/or modified sequence opt6 from capsid_protein_VP1__Norovirus__ALQ12260
augaaaauggcaucaaauggagccgcggcaccaucacaagauggugcagcuaaccuagucccugaaucacaacaagaaguacuugcauuagaaccuguagcaggagcagcucuagcagcuccaguagcgggccaauucaaugcaauagauccauggauaaaacaaaauuucgugcaagccccugcaggcgaauuuacuguuaguccaagaaacgcaccuggagaaguacuaauggauuuagaauuagggccugaaaugaauccauuuuuagcucaucuagcacaaauguauaaugcauaugcaggcggaauggaagugcaaauaauauuagcaggaaacgcuuuuaccgcaggaaaaauaauaguuugugcaguaccaccaaacuuuccaccagauagacuaucugcaagccaagcaacaaacuuuccucauguaauaauggauguaagaacauuagaaccaguuguauuaccuuuaccugauguaagagcaggauucuuucauuauaaucaauuacgagaaccacgaaugcgacuaaugacauuauuauauaccccacuaagagcuaacggcacuggagaugacgcuuuuaccguuucuuguagaguucuaacucgaccaauguuagauuuugaauuuauguuuuuaguaccaccaacaguagaaagcagagugacaccauuuucaguccccacuuauccaguuguagaaaugacaaauucccgauggcccgccagaauaucagguaugcauguaaacgcuaaucaaacacuagcaguccaauuucaaaauggaagauguacuuuagauggacaauuaaugggaacaacucaauuaugugcugcagacguaugcagaaugagaggucgauauacaaguacaagagcagacccagcaggauuaggaugggacuuagacgcaaccacacucguugacggaccagaagcacgaguacaagcacgaauaucaguaucugcacacuuacaacuagaagaauuaucuggacaaccuuacgaaguauauggagaacaaccagccccauuaggcacacccgauuuucaauguagacuuaugggagaacuaguucgucuaccuucagcaaacccuguagcacaaucaagauuccgagacgcauuuuuugauacauacggagcucuuuuugcaccagcuguagggaguguuacaguaacaguuaauaauucuucaucuagugauuuugcaaaugaccaaccauucgaauuuuuaccaauaggcguagaaaucgguaacucagcuagguacgaugaauuugcuuuaccuucuuauaauggagcaauaggagaaaacagacacuuagcacccauugcagcuccagguuucccaggagaaaacuuaauauuuuucucaucuaaccucccaguaugggauucaacaucugcacaaucaaaccgaagaauaucaugccugcuaccaaaugaauuuauccaacauuucuacgaucuacaagcaccuagucaaagcgauguagcacucuuacgauauguacauccagaaacagaccgauuucuauuugaaugcaaauuauauagagacgcauucuuaacaguaaauggagcaaguuaugcagaauuuccaguaaaugguuauucaagauuugauagcuggguaaaacaauucuucacauuaagcccgguaggaacagguucgggcagaagaggacgaagcagaaaagcucaauaa

SEQ ID NO: 31197 - RNA, 1620 nt, Artificial Sequence
  derived and/or modified sequence opt6 from capsid_protein_VP1__Norovirus__BAI49904
augaaaauggcuucaaaugacgcaaacccaucugacgggucaaccgccaaccuuguaccagaaguuaacaacgaaguaauggcacuagaaccagucgucggugcagcaauagcugcaccaguagcaggacaacaaaauguaaucgaccccuggauacgaaauaacuuuguacaagcaccuggaggagaauucacuguaucaccuagaaaugccccaggagaaauauuauggucugcaccuuuagguccugauuuaaacccauacuuaucacauuuagccagaauguacaauggcuacgcuggagguuuugaaguccaagucauacucgcaggaaaugcauucacugccgguaaaauuauauuugcagccguaccacccaauuucccuacagaaggacuaucaccaucccaaguaaccauguucccucauauaauaguagauguaagacaacuagaaccaguucuuaucccacuaccugauguaagaaauaauuucuaccacuacaaucaaucuaacgacucuacaaucaaauuaauagcuaugcuuuauacaccuuuaagagccaacaaugcaggagaugauguauucacagucucuuguagaguauuaacaagacccucuccagacuucgauuuuauauuccuaguacccccaacuguagaaucuagaacuaaaccauuuacuguaccaauacuuaccguagaagaaaugucuaaaagcagauuuccaauuccgcuugaaaaacuuuacacaggaccauccucagcuuuuguaguccaaccacaaaacgguagauguacaacugacggcguacuucuagguaccacccaauuauccguaguaaacauaugcacauuucguggugacguaacacacauagcagguucucacgauuauacaaugaaccucgcaucacaaaacuggaacaauuaugacccaaccgaagaaauacccgccccacuaggaacaccugacuucguagguaaaauucaaggaauguuaacacaaacuacacgagaagacggaucaacaagagcacauaaagcuaccgugucaacaggaucuguacacuuuacaccaaaacuuggaucuguacaauacacuacagacacaaauaaugauuuccaaacaggacaaaacacaaaauuuacaccuguaggaguuauacaagacgguaauaaccaccaaaacgaaccacaacaauggguauuacccaauuacucaggacgaacaggacacaacguucauuuagcaccagcaguagcacccacuuuuccaggagaacaacuuuuauuuuuccgaucaacuaugcccggauguuccggauacccuaacaugaaucuagacugccuauuaccacaagaauggguacaacauuucuaucaagaagcagcaccagcacaaucagauguagcacuacuuagauuuguaaauccagauacagguagauucuuauuugaauguaaauuacauaaaucaggauauguaacaguagcccauacaggaccacaugacuuagucaucccaccuaacggauauuucagauuugacucauggguuaaccaauucuauacacucgccccaauggguaauggagcaggacgaagacgaguucuauaa

SEQ ID NO: 31198 - RNA, 1623 nt, Artificial Sequence
  derived and/or modified sequence opt6 from capsid_protein_VP1__Norovirus__BAI49905
augaaaauggccucaaacgacgcaucucccuccgacggaaguaccgcaaaucuaguuccugaaguaaacaaugaaguaauggcauuagaaccgguagucggugcagcaauagcagcaccaguagcaggacaacaaaaugucauagauccuuggauaagaaacaacuuuguacaagcuccaggaggagaauuuaccgucagcccacgaaacgcuccaggagaaauuuuauggucugcaccauuaggaccagauuuaaacccauaucugucacacuuagcaagaauguacaauggauaugcagguggauuugaaguacaaguuauuuuagcaggaaacgcauuuacagcaggaaaaauaauuuuugcugcagucccuccaaauuuuccuacugaaggauuaucacccucacaaguaacaauguuuccacauauaauaguagauguaagacaacuugaaccaguuuuaauacccuuaccagauguaagaaauaacuucuaucauuauaaccaaagcaacgauucaacaauaaaacuaauagcaaugcuuuauacaccauuaagagcaaacaacgcuggagaugacguauuuacuguuucaugccgcguacuuacaagaccaucaccagacuuugauuucauauuuuuaguaccuccuacuguugaaaguagaacaaaaccuuucacuguaccaauacuaacaguagaagaaaugacaaacucuagauuuccuauacccuuagaaaaauuauuuacuggaccaagcucggcauucgucguacaaccacaaaacggaagauguacaacugaugguguacuacuaggaacaacacaacuaucuccaguaaauauaugcacauuucgaggagauguaacccauauaccuucaacuagaaccuaucgaaugaaucuagcaucacaaaauuggaacaauuaugauccaacagaagaaauaccugcuccacuuggcacuccugauuuuguaggaaaaauucaaggcaugcucacacaaacaacaaaaggcgacgguucaacaagaggacauaaagcaacaguaagcacuggaucaguagacuuuacacccaaauuaggauccguacaauucgcaaccgacacagauaaugacuuugaaacaggucaaaacacaagauucacaccaguaggcguaauacaagaugguucuucagcacauagaaacgaaccacaacaauggguucucccagauuacagcggaaggacaguacauaacguacacuuagccccagcaguugcaccgacauucccaggagaacaacucuuauuuuucagaucaacuaugccaggauguucuggauacccaaauauggaucuugauuguuuacuaccccaagaauggguucaacauuucuaucaagaagccgcaccagcacaaagugauguagcguuacucagauuuguuaacccagauacuggccgaguacucuuugaaugcaaacuacacaaaacaggauacguaacaguagcacauacaggccaacacgaucuaguaauaccaccaaacggauacuuucguuuugacuccuggguaaaucaauuuuauacacuagcucccaugggcaauggagcaggaagaagaagagcauuauaa

SEQ ID NO: 31199 - RNA, 1623 nt, Artificial Sequence
  derived and/or modified sequence opt6 from capsid_protein_VP1__Norovirus__BAI49906
augaaaauggcaucaaaugacgcuucaccaucagauggaucaacagcaaacuuaguaccagaaguuaacaaugaaguaauggcacuagaaccagucgucggagcagcaauagcagcaccagucgcaggacaacaaaaugucauagacccuuggauaagaaacaauuucguacaagcuccaggaggcgaauuuacaguauccccuagaaaugccccaggagaaauauuauggucugcaccauuaggaccagacuuaaaucccuaccuaucucacuuagcaagaauguacaaugguuaugccggagguuuugaaguacaaguaauuuuagcaggaaaugcauuuacagcaggaaaaauaauauuugcagcuguaccaccaaacuuuccaaccgaaggacuaucaccaagucaaguaacaauguuuccacauauaauagucgacguaagacaacucgaacccguauuaaucccauuacccgauguacgaaauaauuucuaucacuauaaccaaagcaaugacucaacaauaaaacuaaucgcuaugcuauacacacccuuaagagccaauaaugccggagaugacguauuuaccguuucuugucgaguacucacacgaccaucacccgauuuugauuuuauauucuuagucccaccaacaguagaaaguagaacaaaaccauucacuguaccuauauuaacaguagaagaaaugacaaacucacgcuuuccaauaccuuuagaaaaauuauuuacaggcccaucaucagcauucguaguacaaccacaaaacggaagaugcacaaccgacgguguauugcucggaacaacucaauuaucaccaguaaauauauguacauucagaggagacguaacacauauaccaggaacccgaacuuacagaaugaauuuagcaucucaaaacuggaauaacuacgacccuacagaagaaauuccagcaccacuugguacacccgacuuuguuggaaaaauacaagguauguuaacucaaacaacaaaaggagauggguccacacauggucacaaagcaaccguaucaacaggauccguagauuuuaccccaaaauuaggcuccguucaauuugcaacagacacagacaacgacuucgaaacaggacaaaacacgagauuuacuccaguaggagucauacaagaugguucaucagcacauagaaaugaaccacaacaauggguuuuacccgauuauucaggacgaacaguacauaauguucacuuagccccagcaguugcaccaacauuuccgggugaacaauuauuauucuuuagaucaacuaugccaggauguaguggauacccaaauauggaucuugacuguuuauuaccucaagaauggguacaacacuucuaucaagaagcagcacccgcucaauccgauguagcccuauuacgcuucguaaacccagacacaggaagaguauuauuugaaugcaaauuacauaaaacaggauaugucacuguugcacauacaggacaacaugaucuaguaauacccccaaauggauauuuccgauuugauucauggguaaaucaauuuuacacauuagcaccuaugggaaacggugccggacgacgaagagcacuauaa

SEQ ID NO: 31200 - RNA, 1623 nt, Artificial Sequence
  derived and/or modified sequence opt6 from capsid_protein_VP1__Norovirus__BAI49907
augaaaauggcaucaaacgaugcaucaccuucagacggauccacagcaaauuuaguacccgaaguaaacaaugaagucauggcuuuagaaccugucguaggugcagcuaucgcagcaccaguagccggacaacaaaacguuaucgaccccuggauaagaaacaacuucguacaggcaccaggcggcgaauuuacuguaucaccuagaaacgcaccaggagaaauacuauggucagcaccacuaggaccagaccuaaauccauaccuaucacacuuagcaagaauguauaauggauacgccggaggcuuugaaguucaaguaauccuugcaggcaacgccuucacagcaggaaaaauuauuuuugcagcaguaccacccaauuuuccaacagaaggacuaucuccaucacaaguaaccauguucccucacauaauaguagauguaagacaacuagaaccuguucuuauaccacuaccagacguucguaacaauuucuaucauuauaaucaaucuaaugacucuacaauaaaauuaauagcuauguuauacacuccacugcgugccaauaacgcgggugacgauguuuuuacaguaucguguagaguauuaacaagaccuuccccugauuuugacuuuaucuuuuuaguuccaccaacaguagaaucuagaacaaaaccauucacaguaccuauacuaacagucgaagaaaugacaaacuccagauucccuauaccauuagagaaauuauuuacaggaccaucaucagcuuuugucguacaaccacaaaacggaagauguacaacagacggaguauuacuagggacaacacaacuaaguccaguaaacauauguacuuuucgaggugauguaacacacauaccaggaacuagaaccuaccgaaugaaucucgcaucacaaaacuggaauaacuaugauccaacagaagaaauaccagccccacuaggaacuccagacuuuguaggaaaaauucaaggaguauuaacacaaacaacaagaggugacgguagcacuagaggacauaaagcaacaguaaguacugguucagucgacuuuacaccaaaacuagguaguguacaauucgcuacagauaccgacaacgauuucgagaccggucaaaacacacguuuuacuccuguaggcguaauacaagacggaucaucugcucaucguaaugaaccccaacaauggguauuaccagacuacucuggaagaacaguacacaacguucacuuagcuccagccguagcaccaacauucccaggugaacaacuauuauucuuuagauuuacuaugcccggauguuccggauaccccaauauggaucuagauugcuuauuaccucaagaauggguacaacacuucuaucaagaagcagcaccugcacaauccgacguagcauuauuaagauuuguuaauccugauaccggacgaguacuuuuugaauguaaacuccauaaaacaggauacguaaccguugcacauacaggacaacaugaccuaguaaucccaccaaauggauacuuuagauucgauucauggguuaaucaauuuuacacauuagcaccaaugggaaacggagcaggaagacgaagagcuuuauaa

SEQ ID NO: 31201 - RNA, 1623 nt, Artificial Sequence
  derived and/or modified sequence opt6 from capsid_protein_VP1__Norovirus__BAI49909
augaaaauggcaucaaaugaugcuacucccucagacggaucaacagcaaaccuaguaccagaaguuaauaaugaagucauggcacuagaaccaguaguuggagcugcaauugcagcuccugucgcuggucaacaaaauguaauagacccauggauucgcaauaacuuuguccaagcacccggaggugaauuuaccguaucaccaagaaacgcaccaggagaaauauuauggucagcaccuuuaggaccugacuuaaauccauauuuaucacacuuagcacgaacuuauaauggauaugcaggagguuucgaaguccaaguaauacuagcuggaaacgccuuuacagcuggaaaaaucauuuucgcagccguaccaccuaacuuuccaacagaaggccuaucacccucacaaguuacaauguuuccacauauuauaguagacguuagacaacuagagccaguacuaauacccuuaccugauguaagaaacaauuucuaucacuauaaucaaagcaacgauucuacaauuaaacugaucgccaugcuauacacaccauuaagagcuaacaaugccggcgacgauguauuuacaguaucuuguagaguauuaacacguccaucaccugacuucgauuuuauauuucuugucccaccuacaguagaaucaagaacaaaaccauucucaguaccaaucuuaacuguugaagaaaugaccaauucucgauuuccaaucccauuagaaaaacuauucaccggaccuucuucugcuuucgucguacaaccacaaaacggaagaugcaccacagacgguguauuauuaggaaccacucaauuaucuccaguaaauaucugcacauuuagaggagacguaacacacauagcugguacccaaaauuacacuaugaaucucgcuucacaaaacuggaacaauuaugauccaacagaagaaauaccagcaccacuagguaccccagacuuuguaggaaaaauacaaggugucuuaacacaaaccacaagaagagauggaucuacaagaggucacaaagccacagucucuacaggaucaguccauuucaccccuaaauuaggcucaguucaauuuuccacagauacuuccaacgacuucgaaaccggacaaaacacaagauuuacaccaguaggaguuguacaagacgguucaacaacacaucaaaaugaaccacaacaauggguacuaccaaacuauucagguagagacucucacaauguucauuuagcaccagcaguagcaccaacauuuccaggagaacaacuacucuucuuucguagcacaaugccaggcugcucaggauaccccaauaugaauuuagauuguuuacuaccacaagaauggguacaacauuuuuaccaagaaucagcacccgcacaaucagauguagccuuacuaagauucguaaauccagauacaggacgaguuuuauucgaaugcaaacuacauaaaucaggauauguuacagucgcacauacuggacaacaugacuugguuauuccuccaaacggcuacuuuagauucgauucauggguuaaucaauucuacacuuuagcaccaaugggaaauggagcuggacgaagaagagcucuauaa

SEQ ID NO: 31202 - RNA, 1623 nt, Artificial Sequence
  derived and/or modified sequence opt6 from capsid_protein_VP1__Norovirus__BAI49910
augaagauggccagcaaugacgcaaccccgucagacgguucaacugcuaaccuaguaccagaaguaaacaaugaaguaauggcacuagaaccaguaguaggugcagcaaucgcagcaccagucgccggacaacaaaauguaauugauccauggauaagaaacaacuuuguacaggccccaggaggugaauucacaguaucaccacgaaacgcaccaggagaaauccuauggucagcaccucuaggcccagaccucaauccauacuuaucacaucuugcaaggauguauaacggauacgcaggaggauuugaaguacaagucauacucgccgguaaugccuucacugcaggaaaaaucauauucgcagcaguaccaccaaauuuuccaacagaaggacuuagcccaucccaaguaacaauguuuccccauauaauaguugacguucgacaacuagaaccaguacuaauuccccucccagacguaagaaacaacuuuuaucauuauaaccaaaguaaugacuccacaaucaaauuaauagcaaugcucuacacuccauuacgugcaaacaaugcaggugaugauguuuuuacaguaucaugcagaguauuaacaagaccaucuccagacuuugacuuuauuuuccuaguaccaccuaccguagaaucaagaacaaaaccguucucuguucccauauuaacuguagaagaaaugaccaacucuagauuuccaauaccacuagaaaaacuauuuacagguccaagcagugcauuuguaguacaaccacaaaacggccgauguacaacagacgguguacuacuaggaacuacacaauuaucuccaguaaauaucuguacauuuagaggugacguaacacauauagccggaacucaaaauuacacuaugaaccuagccucacaaaacuggaacaauuaugaucccaccgaagaaauaccagcuccucuagguacaccugauuuuguaggcaaaauacaaggaguauuaacccaaacaaccagaagagacggaucaacaagaggacauaaagcaacaguaucaacuggaucaguucacuucacaccaaaauuaggcucaguacaauuuucaacagauacaucaaacgacuuugaaacaggucaaaauacacguuuuacuccaguuggaguaguucaagacggaucaacaacacaucaaaaugaaccacaacaguggguacuaccuaacuacucagguagagauucacacaacguccacuuagcaccagcagucgcaccaacauucccaggagaacaacuccuuuuuuucagaucaacaaugccaggaugcucaggauacccaaauaugaaucuagacugcuuacuuccucaagaauggguucaacacuucuaccaagaaagcgcaccagcucaaucugauguagcacuauuacguuucguaaacccugacacaggacgaguauuauucgaaugugaacuacauaaaucaggauauguaacaguagcacauacuggacaacacgaucuaguaauacccccaaacggauauuuuagauuugacagcuggguaaaucaauuuuauaccuuagcccccaugggcaauggagccgguagacgacgcgcauuauaa

SEQ ID NO: 31203 - RNA, 1623 nt, Artificial Sequence
  derived and/or modified sequence opt6 from capsid_protein_VP1__Norovirus__BAI49911
augaaaauggcuucuaacgacgcuucaccaucagaugguucgacagcaaauuuaguaccagaagugaacaacgaaguaauggcauuagaaccaguaguuggagcagcuauagcagcuccaguagcuggacaacaaaacguuauagauccauggauaaggaacaauuuuguacaagcaccuggaggugaauucacaguaaguccaagaaacgcaccaggagaaauauuauggucagcacccuuaggaccagacuuaaauccauaucucucacaccuugcacgaauguauaacgguuaugcaggagguuucgaaguucaaguuauccuagcaggaaaugcauuuacagcuggaaaaauaauauuugcagcaguuccccccaauuucccuacagaaggauuaaguccaucucaaguaacuauguucccacacauuaucguagacguucgacaauuagaaccaguccuaauaccauuacccgauguaagaaauaauuucuaucauuauaaccaaucaaaugauucaaccauaaaacuaauagcuauguuauacacuccucuacgagccaauaaugcaggugacgauguauuuacgguuuccuguagaguucuaacaagaccaucaccagauuuugacuuuaucuuuuuaguuccaccaacaguagaaaguagaacaaaaccauucacaguaccaauauuaacuguugaagaaaugacaaacucucgauucccaauaccucuugaaaaauuauucacaggaccaucaucagcuuucguaguucaaccacaaaacgguagaugcacaacagauggaguucuacuaggcaccacucaacuaucaccaguaaauauaugcacauuuagaggagauguaacacacaucccuggaacuagaacuuaucguaugaauuuagcaucacaaaauuggaacaacuacgacccaacagaagaaauuccggcaccacuaggcacuccagauuuugucggaaaaauccaaggaauguuaacacaaacaacacgaggugacggauuaaccagaggucacaaagcuacuguuuccacaggaucaguagacuuuacacccaaauuaggcuccguccaauucgcaacugauacugauaacgauuuugaaacuggucaaaauaccagauucacaccuguaggaguaauacaagauggaaguucugcacauagaaaugaaccacaacaauggguucuacccgacuauagcgguagaacuguacacaauguccaucuagcaccugccguagcaccaacauuuccaggagaacaauuacuauucuucagaucuacaaugcccggaugcucaggauaccccaacauggaucuagauuguuuauuaccacaagaauggguacaacauuucuaucaagaagcagcaccagcacaauccgacguagcauuacuaagauuuguugauccagacacuggccgugucuuauucgaauguaaauuacauaaaacaggauauguuacaguagcacauacuggacaacaugaucucguaauuccuccaaauggcuacuuuagauuugauucauggguaaaucaauuuuauacacuugcaccaaugggaaauggagcaggccgaagaagagcucuauaa

SEQ ID NO: 31204 - RNA, 1623 nt, Artificial Sequence
  derived and/or modified sequence opt6 from capsid_protein_VP1__Norovirus__BAI49912
augaaaauggcaucaaaugaugcaucaccuucagauggaucaacagcaaaccuuguaccagaaguaaacaacgaaguuauggcacuagaaccaguaguaggagcagcuauagcagcaccagucgcaggacaacaaaacguaaucgauccauggauacgcaauaauuucgugcaagcaccagguggagaauucacagucucaccaagaaacgcaccuggagaaauacuauggucugcaccuuuaggaccagauuuaaauccuuauuuaucacauuuagcacguauguauaacggauacgcaggagguuuugaaguacaaguaauacuugcggguaaugcauucacugcuggcaaaauaauauuugcagcagucccaccaaauuucccaacagaaggauuauccccaucacaaguaacaauguuuccacacauaauaguagauguaagacaauuagaaccaguauuaauaccacuaccagauguacgaaauaauuucuaucauuauaaccaaagcaaugacucaacuauuaaacuuaucgcaauguuauacacaccacuaagagccaacaaugcaggagacgacguauucacaguaucaugucgaguauuaacuagacccucaccagacuuugauuuuauauuucuaguccccccaacaguugaaucacgcacaaaaccauuuacaguuccaauuuuaacaguagaagaaaugacuaacagucgauucccaauaccauuagaaaaacuauuuacaggcccuucaucagcauuuguaguacaaccacaaaauggaagauguacaacagauggagucuuacuaggaacuacacaauuaaguccagugaacaucuguacauuccguggagacguuacucauauuccaggaacaagaacauauagaaugaauuuagcaucacaaaacuggaauaauuaugauccuacagaagaaaucccugcaccauuaggaacaccagauuuuguagguagaauucaaggaauguuaacacaaacaacuaaaggugacggaucaacaagaggacacaaagcuacuguaucaaccggauccguugauuuuacaccaaaacugggaucaguucaauucgcuacagacacagauaacgacuuugaaacaggacaaaauacucgauuuaccccaguuggcguaauccaagauggaucaagugcauuaagaaacgaaccacaacaauggguacuaccagacuacucaggacgaacaguacauaacguacacuuagcaccagcaguagcucucacauuucccggagaacaacuauuauuuuuuagaucaacuaugccagguuguucugguuacccaaauauggauuuagauugccuccuaccccaagaauggguacaacauuucuaccaagaagcagcaccaucccaaucugacguugcccuacuacgauucguaaaccccgauacagggagaguacuauucgaaugcaaauuacauagagcaggauacguaacuguagcacacacaggacaacaugaucucguuauaccaccuaauggauacuucagauucgauucauggguaaaucaauuuuauacacuagcaccuauggguaacggcgcuggaagacgacgagcuuuauaa

SEQ ID NO: 31205 - RNA, 1623 nt, Artificial Sequence
  derived and/or modified sequence opt6 from capsid_protein_VP1__Norovirus__BAI49914
augaaaauggcuucaaacgacgcaucaccuucugauggcucaacagccaacuuaguuccagaaguaaacaaugaaguuauggcacuagaaccuguagucggagcagccauagcugcuccagucgcaggacaacaaaauguaauugacccuuggauacgcaauaauuuuguacaagcacccggaggagaauuuacuguaucuccacgaaaugcaccaggagaaauacucuggucagcaccacuaggacccgauuuaaauccauacuuaagucacuuagcaagaauguauaacgguuacgcuggagguuuugaaguccaaguaauacuagccggaaaugcauucacugcaggcaaaauaauauucgcagccguaccaccaaauuucccuacagaaggacuauccccaucucaaguaacaauguucccacauauuauaguugauguaagacaauuagaaccaguccuaauaccacuuccagauguaagaaacaacuuuuaucauuauaaccaauccaaugauagcacaauaaaauuaauagccaugcuauacacaccauuaagagcaaacaaugcaggagaugauguauucacaguaagcuguagagucuuaacgagaccaucacccgauuuugacuucauauuucuaguuccacccaccguugaaucuagaaccaaaccauucacaguccccauacuaacaguagaagaaaugacaaacucaagauuuccaauaccauuagaaaaacuauuuacuggcccaucuucagcuuuuguaguacaaccacaaaacggucgauguacaacagacggaguacuacuaggaacuacacaacuuucaccagucaauauauguacauuucgcggagacguuacucacauaccaggaaccagaacauauagaaugaauuuagcuucacaaaacuggaauaacuaugacccaacugaagaaauccccgcaccacuuggaacacccgauuucguagguaaaauacaagguauguuaacacagaccacaaaaggagacggcucaacaagaggacacaaagccacgguuucuacugguucaguugacuuuacaccuaaacuaggcucaguacaauucgcuacagauacagacaaugacuuugaaaccggucaaaauacuagauucaccccagucggaguaauccaagacggaucaucaacucauagaaacgaaccccaacaaugggucuuaccagauuauucaggccguaccguccauaauguacaucucgcaccugcugucgcaccaacauucccuggagaacaacuucuuuuuuucagaucuacaaugccaggaugcucaggauacccaaauauggaucuugauugucuacuaccucaagaauggguccagcauuuuuaccaagaagcagcaccaucacaaucugacguugcacuauuaagauucguaaacccagacacaggaagaguauuauucgaauguaaauuacacaaagcagguuauguaacaguugcacacacaggccaacaugaucuaguaauuccacccaauggcuauuuccguuuugauuccuggguaaaucaauuuuacacucuagcaccaaugggaaacggugcaggaagaagaagagcucuauaa

SEQ ID NO: 31206 - RNA, 1623 nt, Artificial Sequence
  derived and/or modified sequence opt6 from capsid_protein_VP1__Norovirus__BAI49916
augaaaauggcuuccaaugaugcaaacccuucugauggcucagcagcaaacuuaguuccagaaguaaacaaugaaguaauggcucuagaaccuguaguaggagcagcaaucgcugcaccaguagcuggacaacaaaaugucaucgacccuuggauaagaaauaacuuuguacaagcuccuggaggugaauuuacuguaucuccacgcaacgcaccaggcgaaauacucugguccgcuccacuuggaccagaucucaacccuuacuuaagucacuuagcaagaauguauaauggcuacgcaggaggauuugaaguacaaguaauacucgcuggaaacgcauuuacagcagguaaaauaauauuugcugcaguaccuccaaacuuuccaacagaaggauuaucaccaucucaaguuacaauguucccucauaucauaguagacguuagacaauuagaaccaguccuaauacccuuaccagauguaagaaauaacuuuuaucacuauaaucaaucaaaugauucuaccauuaaacuaauagcaauguuauauacuccacuucgcgccaacaacgccggagaagacguauuuacaguaucauguagagucuuaaccagaccaucaccagacuuugauuuuauauuuuuaguacccccaacaguagaaucuagaaccaaaccauucacaguuccuaucuuaaccguugaagaaaugacaaacucuagauucccuauaccauuagaaaaacuauuuacaggaccaucuggagcauuuguuguucaaccacaaaaugguagauguacaacagauggaguauuacuaggaacaacacaacucucacccguaaacauauguacauuuagaggugaugugacacauauagccggaucaagaaacuacacaaugaaccuagcuucauuaaacuggaacaacuaugauccuaccgaagaaauaccagcaccccuaggcaccccagauuuuguaggaaaaauacaagguuuauuaacucaaacaacaaaaggagacggaucaacacguggacauaaagcuaccguauauacugguucagcacccuuuacaccaaaacuaggaggaguacaauuuucaacagauaccgaaaacgauuucgaaacgcaccaaaauacaaaauuuacaccuguaggagucauacaagacggaucaacaacacauagaaaugaaccacaacaauggguauuaccaucuuauuccggacgaaacguacauaacguucaccucgcaccagcaguagcaccaacauuccccggugaacaauuacucuucuuuagauccacaaugccaggcuguucuggauauccaaauauggaccuagauugcuuacuaccacaagaauggguacaacauuuuuaccaagaagccgcaccagcacaaucagauguagccuuacuacgauucgucaaccccgauacuggcagaguccuauucgaauguaaacuacauaaaucaggauauguaacuguagcacacaccggucaacacgaccuaguaauaccaccaaauggauacuuccguuuugacuccuggguaaaucaauuuuacacacuugcacccaugggaaauggaacagguagaagaagagccuuauaa

SEQ ID NO: 31207 - RNA, 1623 nt, Artificial Sequence
  derived and/or modified sequence opt6 from capsid_protein_VP1__Norovirus__BAI49917
augaaaauggcaucaaaugacgcaaaucccucagauggaucugcagcaaaccuuguuccugaagugaacaaugaaguuauggcuuuagaacccguaguaggagcagcaauagcagccccuguugcuggacaacaaaauguaauagauccauggauacgaaacaauuuuguccaagcaccaggcggagaauuuacuguuuccccaagaaaugcaccaggcgaaauauuauggucugcaccucuaggaccagaucuaaauccauauuuaagccaucuagcaagaauguacaacggauacgcaggcgguuucgaaguacaagucauacucgcugguaaugcauucacagccggaaaaauaauauuugcugcuguuccuccaaacuuuccaacagaaggacucucaccaucacaaguuacaauguucccacauauaauaguugauguuagacaauuagaaccaguauuaauaccacuacccgauguaagaaauaacuucuaucauuauaaucaaucuaacgacucaaccauaaaauuaauagcaauguuauauacccccuuacgagccaacaaugcaggugaagauguauuuacaguaucaugcagaguacuaaccagaccaucacccgauuuugauuuuauauucuuaguaccaccaaccguagaaucaagaacuaaacccuuuacaguaccuauauuaacaguagaagaaguaacuaauucuagauucccaauccccuuagaaaaacucuuuaccggcccuucaggagcauucguaguacaaccccaaaacggccgcuguaccacagacggaguauuauuaggaacaacacaauuaucaccaguaaauauauguacauuuagaggagacguaacccacauagcuggaacuagaaauuacacaaugaaccucgcaucauuaaacuggaauaauuacgauccaacagaagaaauaccagcuccacuagguacccccgacuuuguuggaaaaauacaaggcgucuuaacacaaacaaccaaaggugauggaucaacacgaggacauaaagcaacuguauacaccggcucugcuccauuuacccccaaacuaggaucgguacaauuuucuacagacacugaaaaugauuuugaaacacaucaaaauacaaaauuuacaccugucggaguaauacaggaugguggaacuacacauagaaaugaaccacaacaauggguacuaccauccuauucgggacgaaauguacauaauguccaccuugcaccagccguugcaccuacauuuccaggcgaacaauuacuauuuuuccgaucaacaaugccaggauguucaggcuaucccaauauggaucuugauugcuuauuaccucaagaauggguccaacauuucuaucaagaagcagcaccagcacaaucugauguagcacuaaugagauuuguuaauccugacacaggcagaguucucuucgaauguaaacuucauaaaucaggcuaugucacaguagcacacaccggacaacacgaccuuguaauaccuccaaauggauauuuucgauuugacucauggguuaaccaauucuacacacuugcaccuaugggaaaugguacuggucguagaagagcucuauaa

SEQ ID NO: 31208 - RNA, 1623 nt, Artificial Sequence
  derived and/or modified sequence opt6 from capsid_protein_VP1__Norovirus__BAI49918
augaaaauggcuucuaacgacgcaaacccaagugacggauccgccgcuaaccuaguacccgaaguaaacaaugaaguaauggcccuagaacccguagcaggagcagcuauagcagcaccuguagcaggccaacaaaauguuauagacccauggauuagaaauaacuucguacaagcaccuggcggagaauucacagucuccccaagaaaugcuccaggcgaaauauuaugguccgcaccacuaggaccagauuuaaaucccuaucuaucacauuuagccagaauguauaaugguuacgccggaggauucgagguacaaguaauauuagcaggcaaugcauuuacagcugguaaaaucauauucgcagcuguacccccaaacuuuccaacagaaggacuaucuccuucacaaguuacaauguucccacacauuauuguugacgucagacaauuagaaccaguucuaauaccauuacccgaugucagaaacaacuucuaucacuauaaccaaaguaaugacaguacaaucaaauuaauagcuaugcuauauacaccucuacgagcuaauaacgccggagaagauguauuuacaguaucauguagaguacuuacaagaccaagucccgacuucgauuuuauauuucuaguaccuccaacagucgaaucaagaacaaaaccauucacaguaccaauacucaccguagaggaaaugacaaacucaagauucccaauaccacuugaaaaacucuuuacaggaccaucaggagcuuuuguaguacaaccacaaaacgguagauguacaacagaugguguacuauuaggaacaacacaauuaucaccagucaacauauguacuuucagaggugauguaacacauauagcuggaacaagaaauuauacaaugaauuuagcuucauugaacuggaacaauuacgauccaacagaagaaauaccagccccuuuaggaacaccagacuucguaggaaaaauucaaggaguacuuacucaaacaacaaaaggugauggaucaacucgaggacacaaagcaacaguauacaccggaagcgcaccauuuacaccuaaacuagguucaguacaauuuucaacagauacagaaaacgacuuugaaacacaccaaaacacuaaauuuacacccguaggagucauacaagauggaggaacuacacauagaaaugaaccacaacaauggguucuaccaucauauaguggaagaaacguacauaacguacauuuagccccugcuguagcccccaccuuuccaggagaacaauuacuauucuuuagaucaacaaugccaggaugcucugguuauccaaacauggauuuagacuguuuacuaccacaagaauggguccaacauuucuaccaagaagcagcucccgcucaaucugacguagcacuaaugagauuuguaaauccagacacaggacgaguacucuuugaaugcaaacuacauaaaucaggcuauguaacaguagcacacacaggacaacacgaucucguuauaccaccaaaugguuauuuccgcuuugacucauggguaaaucaauuuuacacacucgcacccaugggaaacggcacaggaagaagacgagccuuauaa

SEQ ID NO: 31209 - RNA, 1623 nt, Artificial Sequence
  derived and/or modified sequence opt6 from capsid_protein_VP1__Norovirus__BAI49919
augaaaauggcaucuaacgacgcaaauccauccgauggaucagcagcaaauuuaguuccagaaguaaauaaugaaguaauggcacuagaaccuguagucggcgccgcuauagcagcacccguagcaggacaacaaaacaucauugauccauggauaagaaauaauuucguacaagcaccaggaggagaauuuaccguaucaccucgaaaugcaccaggagaaauauuaugguccgcaccauuaggaccagacuuaaauccauaccuaucacauuuggcaagaauguauaacggauaugcaggcggauuugaaguucaaguaauauuagcuggaaaugcauuuacagcaggaaaaauaauauucgcagcagucccaccuaacuucccaacagaaggauuaagccccucacaagucacaauguucccacauauaaucguugacgucagacaacuagaaccaguauuaauuccccuaccagacguaagaaacaauuuuuaccacuauaaucaauccaaugauucaacuauaaaauuaauagcaauguuauauacaccacuacgagccaauaacgcaggagaagaugucuuuacagucucauguagaguacucacaagacccagcccagacuuugauuuuauauuuuuaguucccccaaccguagaaucacgaacaaaaccuuucacaguaccaaucuuaacaguagaagaaaugacaaauucaagauuuccaauaccauuagaaaaauuauuuaccggaccaucaggagcauucguaguacaaccacaaaacggcagaugcacaacagauggaguacuacuuggaacaacacaacuaagcccaguuaauauaugcacauuccguggagacguaacacacauagcaggcacccgaaauuauacaaugaaccucgccagccuuaacuggaauaauuacgacccaacagaagaaauaccagcuccucucgggacuccagauuucguagguaaaauacaaggcguauuaacgcaaacaacuaaaggagaugguaguacaagaggacacaaagcaacaguuuauaccggcucagcucccuuuacuccaaaacuaggaucaguacaauucucaacagauacagaaaacgauuuugaaacacaccaaaauacaaaauuuacaccaguaggaguuauacaagacggcggaacuacacauagaaaugaaccacaacaauggguacucccuuccuacucaggaagaaacguccauaacguacaccuagcaccagcaguagccccuacuuucccaggagaacaauuacuauucuucagaucuacaaugccaggaugcucaggcuauccaaauauggacuuagauuguuuauuaccucaagaauggguacaacacuucuaccaagaagcagcaccagcacaaucagacguagcauuaaugagauucguaaacccagauacuggaagaguauuauuugaauguaaacuacacaaaucaggauauguuacaguugcacacacaggccaacacgaccuaguuauaccaccaaacggauauuuuagauucgauucauggguaaaucaauucuacacuuuagccccuaugggaaaugguacugguagaagacgagcauuauaa

SEQ ID NO: 31210 - RNA, 1623 nt, Artificial Sequence
  derived and/or modified sequence opt6 from capsid_protein_VP1__Norovirus__BAI49920
augaaaauggcaucaaaugaugcaaacccaagugacggaucagcagcuaaucuuguaccagaaguaaacaacgaaguaauggcauuagaaccaguuguuggugcugcaauugcagcaccaguagcaggacaacaaaaugucauugacccauggauuagaaacaauuucguacaagcuccgggcggugaauuuacagucucuccaagaaaugcaccaggagaaauuuuauggucagcacccuuaggcccagaucuaaaucccuaucuaucacacuuagcuagaauguauaaugguuaugcaggaggauucgaaguacaaguuauacucgcaggaaaugccuuuacagcuggaaaaaucauauuugcagcaguaccaccaaacuuucccacagaagguuuaucuccaucacaaguuacaauguucccacacauaauaguagauguaagacaacuagaaccaguauuaauaccauuacccgauguaagaaauaauuuuuaucauuacaaccaauuaaaugacucaacaauuaaacuuauugcaaugcuauacaccccacuaagggcaaauaaugcuggagaagacgucuuuacaguuucaugcagaguacuaacacgcccaucaccagacuuugacuuuauauuuuuaguaccaccaacaguagaaucacgcacaaagccuuuuacaguaccaauauuaacaguugaagaaaugacaaauucaagauuuccaauuccccuagaaaaauuauuuaccggaccuucaggagcauucgugguacaaccacaaaacggacgauguacuacugacggaguuuuacuaggaacaacacaacucucaccuguaaacaucuguaccuucagaggagacguaacacauauagcaggaucacguaacuauacaaugaauuuagcauccuuaaauuggaauaauuacgacccaaccgaagaaauaccagcaccuuuggguacaccuggcuuuguaggaaaaauucaaggaguacucacacaaacaacaaaaggagacggaaguacaagaggacacaaagccaccguauauacaggaagugcaccauuuacaccaaaacuugguucuguacaauuuucaacagauacagaaaacgauuuugaaacccaucaaaauacaaaauucacuccagucggaguaauacaagacggaucaacaacccaucgcaaugaaccucaacaauggguuuuaccauccuauuccggacgaaacguacacaacguacaccuagcaccugcaguagcaccaacuuuucccggagaacaacuauuauucuuucgaucaacaaugccaggauguucagguuauccuaauauggaccuagauugcuuauuaccccaagaauggguacaacauuucuaucaagaagcagcaccagcacaaucugacguugcauuacuaagauucguaaaucccgauaccggcagagucuuauucgaaugcaaacuacacaaauccggauauguaacaguagcacacacaggacaacacgaucucguuauaccuccaaauggauacuucagauucgauaguuggguuaaccaauuuuauaccuuagcuccuaugggaaacggaaccggacgaagaagagcccuauaa

SEQ ID NO: 31211 - RNA, 1623 nt, Artificial Sequence
  derived and/or modified sequence opt6 from capsid_protein_VP1__Norovirus__BAI49921
augaaaauggccuccucagacgccaacccuuccgauggauccgcagcuaauuugguaccagaagugaacaaugaagucauggcccucgagccuguaguaggugcugcaauagccgcaccaguugcuggacaacaaaauguaauugauccuuggauuagaaauaacuuuguacaagcaccaggaggugaauucacaguaucaccaaggaacgcacccggagaaauucuauggucagccccacuaggucccgaccuaaaccccuauuuaucucaucuagcaagaauguauaacgguuacgcaggcggauuugaaguacaaguaauacuugcaggaaaugcauuuacagcaggaaaaauaauauucgcagcaguaccacccaacuuuccaacagaagguuuaucaccuucccaaguuaccauguuuccacacauaauaauagauguaagacaauuagaaccaguucuaauaccccucccagacguacgaaacaauuucuaccacuauaaucaaucaaaugauuccacaauaaaacuaauagcuaugcuauacacuccauuaagagccaacaacgcaggagaagacguuuucacaguuuccugcagaguauuaacaaggccaucauuagacuuugauuucauauucuuaguaccuccaacaguagaauccagaacaaaacccuucacaguuccaauuuuaacuguagaagaaaugacaaacucucgauuuccuauaccacuugaaaaauuauuuaccggucccuccggagccuucguaguacaaccucaaaacgguagauguacuacagauggcgucuuacuuggaacaacacaacucucacccguaaauauaugcacacucagaggugacguaacccauauagcaggaagcagaaauuauacaaugaaccuagcauccuuaaacuggaacaauuacgauccaacagaagaaauaccugcaccucuaggcacaccugacuuuguaggaaaaauacaagguguuuuaacccaaacaacaaaaggugaugguucaaccagaggacacaaagcaacuguauacacaggaucagcaccauucaccccaaaauuaggaucuguacaauuuucuacagauacagaaaacgauuuugaaacacaccaaaauacaaaauucacacccguaggaguaauacaagacgguucaaccacacaucgaaaugaaccucaacaauggguacuaccaucguauagcggccgaaauguacauaauguacaccuagcaccugcaguggcuccuaccuuuccaggagaacaacucuuauuuuuucgaucaacaaugcccggaugcucuggauauccaaauauggauuuagauugccuauuaccucaagaauggguccaacauuucuaucaagaagcagcuccagcacaaucagauguagcauuacuacgauucguaaaccccgauacaggaagaguccuuuuugaaugcaaacuacauaaauccggauauguuacaguagcacauacaggccaacacgaucucguaauaccaccaaacggcuauuuuagauucgacucauggguaaaccaauuuuauacauuagcaccaaugggaaauggaacaggacguagaagagcacuauaa

SEQ ID NO: 31212 - RNA, 1623 nt, Artificial Sequence
  derived and/or modified sequence opt6 from capsid_protein_VP1__Norovirus__BAI49923
augaaaauggcaucaaacgacgccaauccuucagauggcucugcagcaaacuuaguaccagaaguuaacaacgaggucauggcucuagaaccaguuguaggagccgcaauagcagcaccaguagcuggacaaacaaauguaauagauccauggauaagaaacaacuucguacaagcuccaggaggagaauuuacuguaucaccacgaaacgccccaggagaaauacuauggucagccccuuuaggaccagaucuaaacccuuaucuaucccauuuagcacgaauguacaacggauacgcaggaggauucgaaguacaaguaauccuagcaggcaaugcuuuuacagcaggaaaaauaauuuuugcugcagucccaccuaauuuuccaacugaaggucuaucuccaagccaaguaacaauguuuccacacauaauaguugacguaaggcaauuagaaccuguauuaauuccucuccccgauguaagaaauaauuuuuaccauuauaaccaaucaaacgauucuacuauaaaauuaaucgcaauguuauacacaccccuuagagccaauaaugcuggagaagauguauuuacaguuucuugccgaguccuaaccagaccaucuccugacuuugauuucaucuuucuagucccaccuacaguagaaaguagaacaaaaccuuucacuguaccaauccucacaguagaagaaaugacaaauucaagauuuccaauuccacuagaaaaauuauuuacuggaccaucaggagcuuucguaguacaaccucaaaacggaagauguaccacagauggaguauuauuagguacuacacaauugucuccaguuaauauauguacauuuagaggcgauguaacacauauagcaggaucaagaaauuacacaaugaauuuagcuucucuaaauuggaacaauuaugauccaacugaagaaauaccagcaccacuagguacucccgacuuugugggaaaaauccaagguguacuaacucaaaccacaaaaggagacggaucaacacgaggacacaaagcaacagucuauaccgguuccgcaccauuuacuccaaaacuaggcucaguacaauuuucaacagauacagaaaaugauuucgaaacccaccaaaauacaaaauucacaccaguaggaguaauccaagacggaucaaccacacacagaaacgaaccccaacaauggguuuuaccuucauacucaggacgcaauguucauaauguacacuuagccccagcaguagcucccaccuuuccaggugaacaacuacuauucuuuagaaguacaaugccaggaugcucuggauauccgaacauggacuuagauugcuuacuaccucaagaauggguacaacauuucuaccaagaagcagcaccagcacaaucagauguagcauuauuacgauucguaaacccugacacaggcagaguccuauucgaaugcaaacuacacaaauccggauauguaacaguagcacauacaggucaacacgaccuuguaaucccaccaaacgguuauuucagguuugauucauggguuaaucaauuuuacacauuagcaccaaugggaaacggaacaggaagaaggcgagcauuauaa

SEQ ID NO: 31213 - RNA, 1623 nt, Artificial Sequence
  derived and/or modified sequence opt6 from capsid_protein_VP1__Norovirus__BAI49924
augaaaauggcaucaaaugaugcaaaucccucagacggaucagcagcaaacuuaguuccagaaguaaauaaugaaguaauggcacuagaaccaguaguaggagcagcaauagcagccccaguagccggucaacaaaauguuauagaucccuggauuaggaauaacuuuguucaagcaccaggcggugaauuuacuguaucuccaagaaaugcaccaggugaaauacuauggucagcaccacuaggccccgaucuaaauccuuacuuaucucacuuagcuagaauguauaacggauaugcaggcggauucgaaguacaaguaauauuagcaggaaaugcauuuacagcaggaaaaauaauauuugcugcaguuccuccaaauuuuccuacugaaggacuuucuccaucacaaguaacaauguucccacacauuaucguagauguaagacaacuagaacccguacuaaucccacucccagacguuagaaacaacuuuuaccauuauaaccaauccaaugacagcacuauaaaauuaauagcuaugcucuacacaccacuacgagcaaacaaugcuggagaagauguauucacaguuucauguagaguucuuacuagaccauccccugauuuugauuucauauuucucguaccuccuacaguagaaucaagaacaaaaccauucacaguaccaauuuuaacaguagaagaaaugacaaauucaagauuuccaauaccauuagaaaaacuuuuuacaggaccaucaucagcauucguuguccaaccccaaaauggacguuguaccacagacgguguauuauuaggaaccacacaacucucuccaguuaacaucuguacauucagaggcgacguaacacauaucgccggaaguagaaacuauauaaugaaucucgcaucacuaaauuggaacaacuaugauccaacagaagaaauaccagcaccauuaggaacaccagauuucguagguaaaauacaaggagucuuaacacaaacaacuaaaggagacggcucaacaagaggucauaaagcaacaguauauaccggcucagcaccauuuacaccaaaauuagguucuguacaauucucaacagacacagaaaacgauuucgaaacacaucaaaacaccagauuuacacccguuggaguaauacaagauggaggaacaacacaucgaaacgaaccccaacaauggguucuaccaucauauucaggaagaaacguaccuaauguccaccuagcaccagcaguugcacccacauucccaggagaacaauuacuauuuuuuagaucuacaaugccaggcugcucaggauacccuaauauggaucuagacuguuuauuaccacaagaauggguucaacauuuuuaucaagaagcagcaccagcacaaucagaugucgcacuucuuagauucguaaacccagacacagguagaguucuuuuugaauguaaacuccauaaaucaggauauguuacuguugcacacacaggucaacacgaucucguaauuccaccaaacggauauuuucgauucgacucauggguaaaucaauuuuauacucuagcacccaugggaaauggaacaggaagaagaagaguauuauaa

SEQ ID NO: 31214 - RNA, 1623 nt, Artificial Sequence
  derived and/or modified sequence opt6 from capsid_protein_VP1__Norovirus__BAI49925
augaaaauggcaucaaacgacgcaaacccuucugacggaucagcagccaaucuaguaccagaaguuaacaaugaaguaauggcguuagaaccaguugucggagcagcaauagcugccccugucgcaggacaacaaaacguaauugacccauggauuagaaauaauuuuguccaagcaccaggaggugaauuuacuguuucaccacgaucagcaccaggagaaauuuuauggucagcucccuuagggccagaucuaaacccauauuuaucucauuuagccagaauguauaauggauaugcaggaggauucgaaguucaaguaauauuagcugguaaugccuuuaccgcaggaaaaauaauauucgcugcaguaccccccaauuuuccaacagaaggauuaucaccaucucaagucacaauguucccacauauaaucguagauguaagacaacuugaaccaguauuaauaccuuuaccagauguacgaaacaauuuuuaucauuauaaucaaucaaacgacucaacaaucaaacuuauagcaaugcucuacacaccucuaagagcaaacaaugcaggagaagaugucuuuacuguaucauguagaguauuaacuagaccuuccccagacuuugacuuuauuuuccuuguaccacccacuguugaaucaagaacuaagcccuucacaguaccaauacuaacaguugaagaaaugacaaauucuagauuucccauaccucucgaaaaacuauucacaggaccaaguagcgcuuucguuguccaaccacaaaacggaagaugcacaaccgacggaguacuacuagguacaacacaacuaucaccuguaaacauauguacauucaggggagacguaacccauauagccggaaguagaaauuacacuaugaaucuagcaagcuuaaauuggaacaauuaugaccccaccgaagaaaucccagcaccuuuaggaacaccagauuuuguagguaaaauacaagguguauuaacacaaaccacaaaaggagacggauccacacgaggccauaaggcaacuguauauacaggaucagcaccauucacaccaaaauuaggaucaguacaauucucaacagauacagaaaacgauuuugaaacacaccaaaauacaagauucacuccagucggaguaauacaagauggaggcacaacacacagaaaugaaccacaacaauggguacuuccaucauauucaggaagaaacguaccaaacguacauuuagcuccugcgguagcuccaacauuucccggagaacaauuacuuuucuuuagauccacuaugccagguuguucuggauauccuaauauggaucuagauugcuuacucccacaagaauggguacaacauuucuaccaagaagcagcaccagcacaaucagacgucgcacuccuacguuuuguuaacccagacacaggcagaguuuuauucgaaugcaaauuacacaaaucaggauauguaacagucgcacacacaggucaacacgaucuagucauuccuccaaauggauauuuccgauucgacucauggguaaaucaauucuauacacuagcacccaugggaaauggaaccggaagaagaagaguacuuuaa

SEQ ID NO: 31215 - RNA, 1623 nt, Artificial Sequence
  derived and/or modified sequence opt6 from capsid_protein_VP1__Norovirus__BAI49926
augaaaauggcuucaaacgacgcaaacccuucagaugguagcgccgcaaauuuaguaccugaagucaacaacgaaguaauggcucuugaaccagucguaggugcagcaauagccgccccagucgcaggacaacaaaacguuauagauccauggauaagaaacaacuuuguucaagcaccuggaggagaauuuaccgucucgcccagaaaugcaccuggagaaauauuaugguccgcaccucuagguccagacuuaaaucccuaccuaucacaccuagcuagaauguacaacggauacgcuggaggauuugaaguucaagucauccuugcuggaaaugcauucacagcuggcaaaaucauauucgcagcaguaccaccaaacuucccaacagaaggauuaucucccucacaagucacaauguucccccacauaauugucgauguuagacaauuagaacccguucuaauaccacuuccagauguaagaaacaacuucuaccauuauaaucaaucaaaugauucaacaauaaaauuaauagcaauguuauacacaccucuaagagcaaacaaugcaggcgaagauguauuuacaguaucauguagaguauuaaccagaccuucuccugauuuugacuuuauauuucuaguccccccaacuguagaaagccgaacuaaaccauucacaguaccaauacucacaguagaagaaaugacaaacuccagauuuccaauaccacuagaaaaacuauucacuggaccaucaggcgcuuuuguaguacaaccacaaaauggacgaugcacaacagauggaguucuacucggaacaacacaauuaagcccaguaaauauaugcacauuuagaggugacguaacucacauagcuggaucaagaaacuacacaaugaauuuaacuucacuaaacuggaacaacuaugauccaacugaagaaauaccagcuccacuaggaacaccagacuuuguuggaaaaauucaaggauuacuaacacaaacuacuaaaggagacggaucaacaagaggucacaaagcuaccgucuacacagguucagcaccuuucaccccaaaauuagguucaguccaauucucaacagauacagaaaacgauuucgaaacacaccaaaauacaaaauucacaccuguaggcguaauacaagacggaucaaccacacaucgaaacgaaccacaacaauggguacuaccaucguauaguggaauaaacguucacaacguccaccuagcaccagcaguugcuccaacauuuccuggagaacaauuacuauuuuuuagaucaacaaugccaggaugcuccggauauccaaauauggauuuagauugucuauuaccccaagaauggguacaacauuucuaucaagaagccgcaccagcacaaucugacguugcucuuuuaagauucguaaacccugacacaggccgaguacuauucgaaugcaaacuacauaaauccggauauguaaccguagcacauaccggacaacacgacuuaguuauacccccaaauggcuacuucagauucgauucauggguaaaucaauuuuauacacucgcaccaaugggaaauggaaccggacgcagaagagcucuauaa

SEQ ID NO: 31216 - RNA, 1623 nt, Artificial Sequence
  derived and/or modified sequence opt6 from capsid_protein_VP1__Norovirus__BAI49927
augaaaauggcuucuaacgacgcaaauccauccgauggaucagcagcuaaccucguaccugaaguuaacaaugaaguuauggcauuggaaccaguagucggagcugcaauugcagcuccgguugccggccaaacaaacguaauugauccuuggauaagaaauaacuuuguacaagcaccaggaggagaauuuacaguaucaccacguaaugcaccaggugaaauacuuuggagugcccccuuaggacccgauuuaaauccuuauuuaucacaucuagcccgaauguauaacggauaugcugguggauucgaaguacaaguaauacuagcaggaaaugcauuuaccgcaggaaaaauaauauucgcagcaguaccacccaauuuuccaacagaaggauuaucaccaucacaaguuacaauguucccucauauuauuguagacguaagacaacuugaaccaguucuaauaccacuaccagauguacgaaacaauuuuuaccacuacaaucaaucaaacgacuccacaauaaaauuaaucgcaauguuauauacaccauuaagagcaaauaacgcaggagaagacguauucaccguaucuugccguguauuaacacguccaucucccgacuuugacuuuauauuuuuaguaccaccaaccguugaaucaagaacuaaaccauuuacagucccuauauuaacaguugaagaaaugacaaacucaagauucccaauaccacuagaaaaacuuuucaccggcccaucaggagcauuuguaguacaaccacaaaaugguagauguacaacagacggcguccuacucggaacuacccaauuaaguccaguaaauauauguaccuucagaggagacguaacucacaucgcagguucccgcaacuacaccaugaauuuagcaucauuaaacuggaacaauuaugauccaacagaagagaucccagccccacuagguacccccgacuuuguagguaaaauacaaggaguauuaacccaaaccacaaaaggugaugguuccacaagaggacacaaagcaacaguauauaccggaucagcaccauuuacuccuaaacuaggaucaguucaauucucuacagauaccgaaaacgacuuugaaacacaucaaaauacaaaauucacacccgucggaguaauacaagacggaggaacaacacacagaaaugaaccacaacaauggguacuuccaagcuacucagggagaaacguacauaauguacacuuagcacccgcagucgcaccaacauucccaggagaacaacuacuauucuuccgaucuacaaugccuggaugcucuggcuauccuaauauggaccucgauugccuacuuccacaagaauggguucaacauuucuaccaagaagcagcaccagcacaaucagacguagcacucuuaagauucguaaauccagauacuggacgugucuuauucgaaugcaaacuucauaaaucagguuacguuaccguagcacacacaggacaacacgaucuaguaauuccaccaaaugguuauuuucgauuugauucuuggguaaaucaauuuuauacucuagccccaaugggaaaugguacaggccgaagacgagcccuauaa

SEQ ID NO: 31217 - RNA, 1623 nt, Artificial Sequence
  derived and/or modified sequence opt6 from capsid_protein_VP1__Norovirus__BAI49928
augaaaauggcuucaaacgacgcaaauccaagcgacggaucagccgcaaauuuaguaccugaaguuaauaacgaaguaauggcacuagaaccaguuguaggagcagcaauagccgcaccaguagcuggacaaacaaacguaauagauccauggaucagaaauaauuucguacaagcuccaggaggugaauucacaguaagcccaagaaacgccccaggagaaauauuauggucagcaccauuagguccagaucucaauccauaucuaucacauuuagcaagaauguauaauggauacgcaggagguuucgaaguacaagucauacuagcaggaaaugcauucacagccggaaaaauaauauucgccgccguaccaccuaacuuuccaacagaaggucuuucaccaagucaaguaacaauguucccccacauaauaguagauguaagacaacuagaaccaguauuaaucccuuuaccagauguaagaaacaauuucuaucacuacaaccaaucaaacgacuccacaauaaaauuaauugcaaugcuuuauacaccuuuaagagcaaacaacgcaggagaagauguuuuuacaguaucuuguagaguauuaacaagaccaucaccagacuuugacuucaucuuucucguaccaccaacaguagaaucuagaaccaaaccuuucacaguuccaauacuaacaguagaagaaaugacuaauucccgauuucuuaucccacuagaaaaacuauuuacaggaccaucaggagccuucguaguacaaccccaaaauggaagauguacaacagacggaguauuacuuggaacaacucaacuaucaccagucaacaucuguaccuuucgcggagauguaacccauauagcaggaucaagaaauuauacaaugaauuuagccucauuaaacuggaauaauuacgauccaacagaagaaauaccagcaccacucggaacaccugacuuuguaggaaaaauacaaggaguauuaacacaaacaacuaaaggagauggaucaacaagaggacacaaagccacaguauauacagguucugcaccuuucacaccaaaacucggaucuguccaauucuccacagauacagaaaacgauuuugaaacacaccaaaacaccaaauuuacaccaguaggagucauucaagacggcuccacaacacauagaaaugaaccacaacaauggguucuuccaucauauucaggcagaaauguacauaauguacaccuagcacccgccguagccccaacauucccuggagaacaauuacuuuucuucagaucaacuaugccaggaugcucuggauauccaaauauggaucuagauuguuuacuaccucaagaauggguacaacauuuuuaucaagaagcagcaccugcucaaucagauguugccuuacuaagauuugucaaccccgacacagguagaguauuauucgaauguaaacugcauaaaucuggcuauguaacaguugcacauacaggacaacaugaucuaguaaucccaccaaauggauauuuucgauucgacucauggguuaaucaguuuuauaccuuagcaccaaugggcaauggaacaggaagaagaagagcauuauaa

SEQ ID NO: 31218 - RNA, 1620 nt, Artificial Sequence
  derived and/or modified sequence opt6 from capsid_protein_VP1__Norovirus__BAJ25070
augaaaauggcaagcuccgacgcagcaccaucaaacgacggcgcaacaggcuuaguaccagaaauaaacacagaaacacucccauuagaaccaguagcaggcgcagcaauugcagcuccaguuaccggucaaaauaauauaaucgauccauggauaagaaacaauuucguacaagcaccaaacggagaauuuacaguaucaccaagaaauucccccggagaaauacuaaugaaucuagaacucggaccagaccuaaacccauaucucgcacauuuaucaagaauguacaacggauaugcuggaggagucgaaguucaaguacucuuagcaggaaaugccuucaccgcaggaaaaauccuuuucgccgcagucccaccaaacuuuccuguagacaugcuuucaccagcucaaaucacuauguuaccacacuuaauuguagacguacgaacauuagaaccaauaaugauaccacuaccagacguaagaaacgucuuuuaucauuauaauaaccaacccgcaccacgcaugcgacuaguagcaauguuauacacaccuuuaagaucaaauggauccggagaagacguauuuacaguauccugucgcguacucaccagaccaacacccgacuucgaauuuacauaccuuguaccacccucuguagaaucuaaaacaaaaccauucucacuaccuauacuuacaaucggcgaauuaacaaauucucgauucccagcaccaauugaucaacuguucacaucaacaaacaacgacgucgucguacaaccacaaaacgguagaugcacacuagacggugaacuacaagguacaacacaauuacuaucaacagccauaugcucauaccgcggcacaacaucaaacccaauagaugauugggaugaccaccucuuacauuuaacacaccccaauggggcaacuuacgacccuacagaagacgucccugcaccauucggaacacaagacuuucaaggaauauuauacggaaugcucacacaaaacccacaaaccggaggcggcgaagccgcaaacucaagaggaguauauauauccaguacaucagacaaauucacaccaaaacuaggaacuauugguuuacaucacguacaagguggagauguugcuaacaaccaaaaaucuaaauuuacccccauagguauugcagaaaauggaaacaccccauuuagacaauggguccuaccaaauuauucuggaagauuaacacuaaacaccaaucuagcuccagcagucgggccaaacuucccaggagaacaaauauuauucuuccguucaaacguuccaucuguccaaggaggacauucaauugaaaucgauuguuuaauaccacaagaauggauaucucacuuuuaccaagaaagcgcaccgucucaaucagacguagccuuaauaagauauguaaauccagacacaggacgaacacucuucgaagcuaaauuacacagacaaggauuuaucacaauagcaaccacuggcaacaaccccguaguaguaccacccaacggauacuucagauucgacagcugggucaaucaauuuuaugcauuagccccaaugggaacaggaaacgguagaagaagaguucaauaa

SEQ ID NO: 31219 - RNA, 1620 nt, Artificial Sequence
  derived and/or modified sequence opt6 from capsid_protein_VP1__Norovirus__BAJ25072
augaaaauggcaucuaacgacgcugcccccucaaaugacggcgcaacaggacuuguaccagaaauaaauacagaaacauuaccacuagaaccaguugccggagcagcaauagccgcuccaguaacaggacaaaauaauauaaucgaccccuggauaagaacaaauuuuguacaagcaccaaauggugaauucacaguaucuccacgaaacucuccaggagaaauacuaaugaauuuagaauuaggaccagaucuaaauccauaccuagcucaccuagcaagaauguacaacggauacgcaggaggcguagaaguucaaguauuauuagcaggaaacgcauucacagcuggaaaaauauuauuugccgcaguuccacccaauuucccuguagauauguuaucaccagcacaaauaacaauguuaccccaucuaaucgucgauguacguacacuagaaccuaucaugauaccccuuccagacguaagaaauguauuuuaccacuacaacaaccaaccugcaccuagaaugagacuaguagcaauguuauauacaccauuaagaagcaacgguucaggcgaagacguauuuacaguaucgugccguguacuaacaagacccacaccagauuucgaauucacauauuuaguaccacccucuguagaauccaaaaccaaaccuuucucauuaccaauuuuaacaauaggagaacucacaaauucacgauuucccgcaccaauagaccaacuauucacaucaacuaauaaugaugucguaguacaaccacaaaauggacgauguacucuagacggagaacuacaaggcacaacacaacuauuaucaaccgcaguauguuccuaccgaggaacaacuucuaacccuauagacgacugggaugaucaccuauuacacuuaacacauccuaacggagcaacauaugacccaaccgaagacgucccagcaccuuucggaacucaagauuuucaaggaauacuauacggcauguuaacucaaaauccccaagcagguggcggugaagcugcauccucacgcggaguuuacaucucaucaacauccgacaaauuuacuccaaaauuaggaacuauagguuugcaccgaguacaagggggugcaguagcagauaaucaaaaaucaaaauuuacaccaauaggaauugcagaaaaugacaacaccccauuuagacaauggguacuaccaaauuauucaggccgccuaacacuuaauacaaacuuagcacccgcaguaggcccaaacuuuccuggagaacaaauauuauuuuuuagaucaaacgucccaucaguacaaggaggucacucuaucgaaauagacugcuuaauaccacaagaauggguaucacauuuuuaccaagaaucugcaccaucccaaucagauguagcccuuauaagauacgucaauccugauaccggaagaacccuauucgaagcuaaauuacauagacagggcuuuauaaccauagcaacaaccggcaacaacccaguugucguaccucccaacggcuacuuuagauucgacuccuggguaaaucaauuuuaugcacuagcaccaaugggcacaggaaacggcagacgaagaguccaauaa

SEQ ID NO: 31220 - RNA, 1608 nt, Artificial Sequence
  derived and/or modified sequence opt6 from capsid_protein_VP1__Norovirus__BAJ25076
augaaaauggcaucaaacgaugcaaauccaucuucagauggaagugcaaaucuaguuccugaaaucucaaacgaagucauggcacuugaaccuguagcaggagcagcuauagcagcaccaguagcaggccaacaaaacauaauagaccccuggauaagaaauaauuucguacaagcaccaggaggagaauucaccguuucccccagaaacgcccccggugaaguauuauuaaaccuaccuuuaucuccagacauaaacccauauuuagcucauuuaagcagaauguacaacggauacgcaggagguguagaaguagaagucguauuagccgguaaugcauucacagcuggaaaaauaauauuugcagcaguaccaccaaauuuuccuccagaaaaccuaucaccaucacaaaucaccaugcuaccacauauaaucguagauguaagacaacucgaaccaguucguauaccucuacccgaugucagaaacaauuuuuaucauuacuccagagaaaacgauucaacacuucgacucauagcaaugcuauauaccccacuucgagcaaauaaugcaggugaugaugucuuuacaguaucauguaggguauuaacaagaccauccccugacuucgacuucauauuucuuguaccaccaaccguagaaucuaaaucaaaaccauuuacuauucccauguuaacaauagaagaaaugacaaauucuagauucccagccccuuuagaacuaaugacaacaggaccuucucaugauauuguuguacaaccacaaaauggacgauguacaauagaugguguauuauuaggaacaacucaacucucuccaguaaauauaugcucucuuagaggaguaccaacaaaacgaaccaacggaaacgauaauuguuucguacaacuagaaaacccaaaugguucugccuaugauccaacugaagauauaccugcaguacucggaucuccagacuuugucggugaauuauacggcacuauaacacaacguucaucagauaauucaacaagagcacacccauuuacucuaaauacaggcucaccaagauauacuccaaaaaucggaucuguagauauaagaguaaccgauguuucagauuuacaagaucaugauccuguaaaauuaacaccagucggucuuucuggagauagaggcucaauccaucaauggcaacuacccaacuauucaggaguugcaacccauaauaugcaccuagcccccucuguagcccccuuauuucccggagaacaaaucuuauucuuuagaucaaccguaccaggauguggaggcuacccuaauucuaacaucgauugcuuaauuccacaagaauggguacaacauuuuuaucaagaaggagcaccagcacgaacagaugucgcauuacuacgauuuauaaacccagauacaggaagaguacuuuucgaaugcaaacuacacaaacaugguuuuauaacaguugccuauucugguaaucaugauuuaguuaugccaccaaauggcuauuuccgauuugaaucauggguaaaucaauuucauacauuagcccccaugggcacuggaucuggucgucgcagaauacaauaa

SEQ ID NO: 31221 - RNA, 1644 nt, Artificial Sequence
  derived and/or modified sequence opt6 from capsid_protein_VP1__Norovirus__BAN16283
augaaaauggcaucaucagaugcagcaccgaguaacgacggugcagcaaacuuagucccugaagcaaacaaugaaguaauggcuuuagaaccaguaguaggagcaagcauugcugcuccaguaguaggucaacaaaauauaauugauccauggauacgcgaaaauuuuguacaagcaccacaaggagaauucacaguaucaccaagaaacucuccuggcgaaaugcuauuaaaucuagaauuaggucccgaauuaaauccauauuuaucacaccuaucaagaauguacaacggcuacgcaggcgguaugcaaguacaaguaguacuagccggcaacgcauucacugcaggaaaaaucauauuugcagccgucccuccucauuuuccaguagaaaauauaucugcagcacaaauaacaaugugcccacacguuauagucgacguaagacaacucgaaccaguacuuuuaccuuuaccugacauuaggaacagauuuuuucacuauaaccaagaaaauaccccaagaaugcgauuaguagcaaugcuauacacgcccuuaagagcaaauucaggcgaagauguauucacagucucaugcagaguacuaacaagaccagcacccgacuuugaauucacuuuucuuguacccccaacuguagaaucaaaaacaaaaccauuuacauuaccaauauuaacacuaggggaauuaucaaacucacgauucccagcaccaauugauauguuauauacagauccaaacgaaggaauaguaguacaaccacaaaaugguagaugcacacuagauggaacacuacaaggaacaacacaauuaguaccaacacaaauaugugcauucagaggaacucuaauaggacaaacaucaagaucaagugauaguacagauucagcaccacgacgaagagaucacccauuacacguacaacucaaaaaucucgacggcacacaauacgauccaacugacgaaguuccagcaguauuaggagcaauagacuuuaaaggaacaguauucggaguagccucucaaagagacguuucuggagaccaaguaggagcaacaagagcacaugaaguccauauuaacacaacugauccaagauauacacccaaacucggaucaauacuaaugcauucugaaucaggagauuuugucacaggacaaccaguaagauuuacaccaauaggaaugggugauaaugauuggcaccaaugggaacuaccagacuacucaggacaucuuacucuaaacaugaaucuagcuccagcaguugcaccagcuuucccaggugaaagaauucuauuuuucagaucaauaguaccaucugcuggaggcuaugguacaggacaaauagauugucuuaucccccaagaauggguucaacacuuuuaucaagaagcggcaccaucccaaucagcuguagcucuaauaagauauguaaacccagauacaggaaggaacauuuucgaagcuaaauuacauagagaaggauuuauuacaguugcaaacucaggaaacaauccaauaguaguaccaccuaacggauacuuuagauuugaagcauggguaaaucaauucuauacuuuaacuccaauggguacaggacaaggaagacgcagaaaucaauaa

SEQ ID NO: 31222 - RNA, 1644 nt, Artificial Sequence
  derived and/or modified sequence opt6 from capsid_protein_VP1__Norovirus__BAN16285
augaaaauggcauccaaugacgcagccccauccaaugauggagcagcaaauuuaguaccugaagccaauaaugaaguuauggcacucgaacccguaguaggagcaucaauugcagcaccaguaguaggacaacaaaauauaauugauccauggauacgcgaaaacuucguacaggcuccacaaggagaauucacaguaagcccaagaaauagcccaggagaaauguuacuaaaucuagaauuaggaccagaacuuaauccauaccuaucacacuuaaguagaauguauaacgguuaugcagguggaaugcaaguacaagucguacuagcaggaaaugccuucacugcaggaaaaauaauauucgcagcuguaccaccacacuucccaguagaaaauauaagugcugcacaaauaacuaugugcccacauguaauagucgauguaaggcaacucgaaccaguguuauuaccauuaccagauauaagaaaccgauucuuucacuauaaucaagaaaauacaccuagaaugagauuaguagcuaugcuauauacuccauuacgagcaaacaguggagaagauguauuuacaguuucaugcagaguauuaacaagaccagcacccgauuucgaauuuacauuuuuagucccaccuacaguugaaaguaaaacaaaacccuuuacacugccaauauuaacacuaggagaauuaucaaauagucgauuuccugcaccaauagacaugcuuuauaccgauccaaaugaagguauaguaguacaaccacaaaauggacgauguacacuagauggaacacuacaagguacuacacaauuaguaccaacccaaauuugcgcauuuagaggaacauuaaucggacaaacuucgagaagcagugacucaacagauucugcaccacgaagaagagaucauccgcuccauguucaauuaaaaaauuuagauggaacucaauaugaucccacugacgaaguucccgcaguacuaggugccauagauuucaaaggaacaguauucggcguugccagccaaagagacguaucaggacaacaagucggagccacuagagcacaugaaguacauauuaacacaacagauccuagauauacaccaaaauuaggaucaauacuaaugcacucugaaagugaugacuucguaacaggacaaccaguaagauuuacaccaaucggaaugggcgacaaugauuggcaucaaugggaacuaccagauuauucaggucaucuuacauuaaacaugaaccucgcacccgcaguagcaccggcauuuccaggugaacgaauuuuauuuuucagaucaaugguacccucagcaggaggauauggaaguggacaaauagauuguuuaauaccacaagaauggguccaacacuucuaucaagaagcagccccaucacaaucagcagucgcauuaauuagauauguaaauccagauacaggacgaaacauauuugaagcaaaauuacaucgagaaggauuuauaacaguugcaaacuccggaaauaacccuaucguuguaccaccaaauggauauuucagauuugaggcauggguuaaucaauucuacacacuuacaccaaugggcacuggacaaggcagaagacguaaccaauaa

SEQ ID NO: 31223 - RNA, 1644 nt, Artificial Sequence
  derived and/or modified sequence opt6 from capsid_protein_VP1__Norovirus__BAN16287
augaaaauggccaguaaugacgcagcaccaucaaaugacggagcagcaaauuuaguaccagaagcuaauaaugaaguuauggcuuuagaaccuguagcaggagcuucaauagcagccccaguagucggccaacaaaacauaauagacccauggauacgagaaaauuuuguccaagcaccacaaggagaauuuacaguaucuccucgaaauuccccuggugaaauguuauuaaaucucgaacuuggcccagaauuaaacccuuauuuaucacauuuaucacgcauguauaauggauaugcaggaggaaugcagguccaagucguuuuagcaggaaaugcauuuacagcuggaaaaauaauauuugcagcaguaccaccacauuucccaguaaaaaauauuucagcagcacaaauaacuauguguccccauguuauaguagacguaagacaauuagaaccaguauuauuaccacuuccagauauaagaaauagauuuuuccauuauaaucaagaaaauacgccaagaaugagauuaguagcaaugcuauacacaccauuaagagcuaauaguggugaagauguauucacgguaucuuguagagucuuaacucgaccagcaccggauuuugaauuuacauucuuaguacccccaacuguagaaucaaaaacuaaaccauuuacucucccuauucucacauuaggcgaauuaucaaauucacgauuuccagcaccaauagauaugcuauacacagacccaaaugagggaauaguaguacaaccacaaaacggaagauguacauuagauggcacauuacaaggaacuacacaauuaguaccaacucaaauaugugcauuccgaggcacacucauaggccaaacuucaagaucuucagauucuacagauuccgcaccuagaagaagagaucacccauuacauguacaauuaaaaaaccuugacggaacacaauacgacccaaccgacgaaguaccagcuguauuaggagcaauagauuuuaaagguacaguauuuggaguagcaucacaacgagacguuucuggacaacaaguaggagcaacucgagcucacgaaguucauauuaacacaacagacccaagauauacaccgaaauuaggaucaauacuaauacauucugaaucagacgauuucguaacaggccaaccaguuagauucacuccaauagguaugggugauaaugauuggcaucaaugggaauuaccagauuacucaggucacuuaaccuuaaacaugaaucuugcaccagcaguagcacccgcuuuuccaggugaaagaauacucuucuucagaucuaugguuccaucagcaggcggauauggcucuggacaaaucgauuguuuaaucccacaagaauggguacaacacuuuuaucaggaagccgcaccaucacagucagcagucgcauuaauaagauauguaaauccagacacaggaagaaacauauuugaagcuaaauuacacagagaaggauuuauaacuguugcaaauagcggaaauaauccaauaguaguuccccauaacggcuacuuuagauucgaagcauggguaaaucaauucuauacuuuaacuccaaugggaacaggucaaggaagaagacgaaaccaauaa

SEQ ID NO: 31224 - RNA, 1644 nt, Artificial Sequence
  derived and/or modified sequence opt6 from capsid_protein_VP1__Norovirus__BAN16289
augaaaauggcaucaaaugacgcagcacccucuaaugauggagcugcuaaucuagucccagaagcaaacaaugaaguuauggcuuuagaaccaguaguaggcgcaucuaucgcagcacccguaguaggccaacaaaauauaauagauccauggaucagagaaaauuucguucaagcaccucaaggagaauucacuguaucuccacgaaacucaccaggcgaaaugcuacuaaaccucgaauuaggaccagaauuaaaucccuaccuaucacauuuaucccgaauguauaacggauaugcaggagguaugcaaguccaaguaguauuagcaggaaaugccuuuacugcaggaaaaauaauauuugcagcagucccuccacauuucccagucgaaaauauuucagcagcccaaaucacaauguguccucaugucauaguagacguccgccaacucgaaccaguauuauuaccccuaccugauauaagaaauagauucuuccauuauaaucaagaaaauacaccaagaaugagauuaguagcaaugcuauauacaccacucagagcaaauucaggagaagauguauuuaccguaucauguagaguacuaacaagaccagccccugauuuugaauuuacauuccuagucccaccaacaguugaaucaaaaacuaaaccuuucacacuuccaauuuuaacucuaggagaacuuucaaauucuagauuuccagccccaauugauaugcuauauacagauccaaaugaaggaauaguaguacaaccacaaaauggccgauguacauuagaugguacacuacaaggaaccacucaacuaguccccacacaaauaugugcauuuagaggaacguuaauuggucaaaccucacgaucaagcgauuccacagacucugcuccaaggcgucgugaccauccacuacauguacaacuaaaaaacuuagauggcacacaauacgauccuacagacgaagucccagcaguacuuggagcuauagauuucaaaggaacaguacuaggagucgcaucccaaagagacguaagcggacaacaaguaggagcaacccgagcucaugaaguacauauuaauacaacagacccuagguacacaccuaaacuaggaucaauauuaaugcauagugaaucagaugacuuuguaacaggccaaccaguaagauuuacacccauaggaaugggagauaaugauuggcaccaaugggaauuaccagauuauucuggacauuuaacacuaaacaugaaucuugcaccagcaguagcaccugcauucccaggagaacgaauauuauucuuuagauccauaguaccaagugcaggaggauacggcuccggacaaauagauugccuaaucccacaagaauggguacaacauuuuuaucaagaagccgcaccgucucaaagugcaguagcacuaauucgauacguaaacccugauacuggaagaaauauauucgaagcaaaacuacaccgagaaggauucauaacaguagcaaacucagguaauaacccaauaguaguaccaccaaauggauauuuuagauucgaagcauggguaaaucaauucuacacacuaacaccuaugggaaccggucaaggacguagacguaaccaauaa

SEQ ID NO: 31225 - RNA, 1644 nt, Artificial Sequence
  derived and/or modified sequence opt6 from capsid_protein_VP1__Norovirus__BAN16291
augaaaauggcaucaaaugaugccgcaccuucuaaugauggagcagcaaauuuaguaccagaagcaaauaaugaaguaauggcauuagaaccaguaguuggagcaucaauagcagcucccguaguaggccaacaaaauauaauagaccccuggauccgagaaaacuucguacaagcuccacaaggagaauuuacaguuaguccucguaacuccccaggagaaauguuacuuaauuuagaacuuggaccagagcuaaauccauaucuaucacauuuaucaagaauguauaacggauaugccggcggaaugcaaguccaaguaguauuggcaggaaaugcauuuacagcagguaaaauaauauuugcagcaguaccuccacacuuuccaguagaaaauauaucagcagcacaaauaacaauguguccucauguaauuguagauguaagacaauuagaaccuguacuuuuaccauuaccagauauaagaaauagauuuuuucauuacaaucaagaagacaccccaagaaugagacuuguagcuauguuauauacaccucuaagagcaaauagcggagaagauguauuuacaguaucaugccgaguauuaacacguccagcuccagauuuugaauucacauuuuuaguaccaccuacaguagaaucaaaaacuaaaccuuuuacuuugcccauacuaacauuaggugaacuuuccaauucaagauuuccagcaccaaucgauauguuauacacugacccaaaugaaacuauaguuguccaaccacaaaacggaagaugcacacucgacggaacauuacaaggaacaacucaacuaguuccaacacaaauauguuccuucagaggcacauuaauaucacaaacauccagaucagcugauaguacagauucugccccuagaguaagaaaccauccauuacacguacaaaugaagaauuuagacggaacaccauaugauccuacugaugaaguaccagcuguauuaggagccauagacuuuaagggaacaguauuuggaguagcaucacaaagaaauacaacaggaaacucaguaggagcaacacgagcacaugaaguacauauagauacaacuaacccaagauauaccccuaaacuagguucuguacuaaugaauucagaaucaucugauuuugacgauggacagccuauaagauuuacaccaauaggaaugggagcugaugauuggcaucaaugggaauuaccagaauacucaggucauuuaacucuuaauaugaaucuagcuccagcaguagcuccagcuuuccccggcgaacgaauucucuuuuuuagaucaguuguuccuucagcaggagguuaugguucaggacaaauagauugucuaauaccucaagaauggguacaacauuucuaucaagaagcugcaccaucccaaagugcuguagccuuaauacguuacguaaauccagacaccggcagaaauauauuugaagcuaaauuacauagagaaggauuuaucacaguagcaaacucuggaaacaauccaauuguugucccaccuaacggcuauuuccgauuugaagccuggguuaaucaauucuacacacuuacuccuauggguacaggacaaggaagaagaagaguacaauaa

SEQ ID NO: 31226 - RNA, 1644 nt, Artificial Sequence
  derived and/or modified sequence opt6 from capsid_protein_VP1__Norovirus__BAN16293
augaaaauggcaagcaaugaugcagccccaucaaaugauggagcagcaaaucuuguacccgaagcaaauaaugaaguaauggcuuuagaaccuguaguaggagcaucaauugcugcaccaguaguaggacaacaaaauauuauagauccauggauaagagaaaauuuuguucaagcaccacaaggagaauucaccguaucuccccgaaauucaccaggagaaauguuauuaaaucuagaauuaggaccugaacucaauccauaucuuucacauuuauccagaauguacaaugguuaugcugguggaaugcaaguucaaguaguuuuagcuggcaacgcauucacagcaggaaaaaucauauuugcagccguaccuccacacuuuccaguagaaaauauaucugccgcacaaauaacaauguguccacauguaauuguagacgucagacaauuagaaccagucuuacuaccauuacccgauauuagaaacagauuuuuucauuauaaccaagaagauacaccaagaaugagacuaguagcaauguuauauacuccacuaagagcaaauucaggcgaagacgucuuuacaguaucauguaggguucuuacuagacccgcaccagauuucgaauucacauuccuuguaccuccuacaguagaaucaaaaacaaaaccauucacauuaccaaucuuaacacuuggagaacuuucaaauucuagauuuccugcacccauagauauguuauauacagauccuaacgaaacaauaguaguacaaccucaaaauggacgauguacacuagacgguacccuccaaggaacuacccaauuaguacccacucaaauuuguucauuuagaggaacauuaauuucccaaaccucaagaucagcagacucuaccgauucagcaccaagaguacgcaaucacccauuacauguccaacuaaaaaaucuugauggcacuccauacgauccaaccgacgaaguuccagcaguacucggagcaauagauuucaaaggcacuguauucggaguagcgucucaaagaaauacgacaggaaauucuguaggagcaacccgagcacaugaaguccacauagauacaacaaauccacguuacacaccaaaauuaggaaguguccuaaugaauucagagucaucagauuucgaugacggccaaccaauaagauucacaccaauaggcaugggagcugacgacuggcaucaaugggaauuaccagaauauucuggucaccucacacuuaauaugaaucuugcaccagcagucgcaccugccuuuccuggugaaagaauucuauuuuuuagaucaguaguuccuucagcugguggauauggaucaggucaaaucgacugcuuaauaccacaagaauggguccaacacuuuuaccaagaagcagcaccaagccaaucagcaguugccuuaauacgauaugucaaucccgacaccggaagaaacauuuuugaagccaaacuacacagagaagguuucauaacugucgcuaauucaggaaauaacccaauaguuguaccuccuaaugguuacuucagauuugaagcauggguaaaucaauuuuauacauuaacuccaauggguacaggacaaggcagaagaagaguacaauaa

SEQ ID NO: 31227 - RNA, 1644 nt, Artificial Sequence
  derived and/or modified sequence opt6 from capsid_protein_VP1__Norovirus__BAN16295
augaaaauggcaucaaaugaugcugcaccaagcaacgacggagcagccaaucucguacccgaagcaaacaacgaaguuauggcacuagaaccuguuguuggagcuucuauagcagcaccaguaguaggacaacaaaauauaauagauccauggauuagagaaaacuuugugcaagcaccacaaggugaauucacaguaaguccuagaaauucaccuggugaaaugcuauuaaauuuagaauuaggcccugaacucaauccuuaucuaucccauuuaucucgaauguauaacggauaugcagguggaaugcaaguucaagaaguucuagcagguaaugcauucacagcaggaaaaauaauauucgcagcaguacccccacacuuuccaguagaaaacauuucagcagcacaaaucacaauguguccacauguaauugucgaugucagacaauuagaaccuguucuucuuccuuuaccagacauaagaaauagauuuuuccauuauaaccaagaagauacuccacguaugagacuagucgcaauguuauauacaccauuaagagcaaauucaggagaagacguuuucacuguuucuuguagaguauuaacccgaccagccccugauuucgaauuuacauuuuuaguaccacccacagucgaaaguaaaacaaaaccuuuuacacuaccaauccucacauuaggagaacuuagcaauucaagauucccagcuccuauagauaugcuauacaccgauccgaaugaaacaauaguaguacaaccacaaaauggucgauguacucuagacggaacacuacaaggaacaacacaauuaguuccgacacaaauauguucauuuagagguacauuaauaucucaaaccucacgcucagccgauucuacagauucagcaccuagagucagaaaccacccacuacauguacaacuaaaaaacuuagauggcacacccuacgacccaacagacgaaguaccagcaguacuuggagcaauagauuuuaaaggaacaguuuucggagucgcuucacaaagaaauacuacuggaucaucggucggagcaaccagagcacaugaaguacauauugauaccacaaauccaagauauacaccaaaauuaggauccguacuaaugcauucagaaucuucugacuuugaugauggacaaccaacaagauuuacaccuauagguaugggagcagacgacuggagacaaugggaauuacccgaauauucaggacauuuaacauuaaacaugaaucuugcuccagccguagcaccugcauuuccuggugaaagaauacuauuuuuuagaucaguaguuccaucagcuggaggauauggcucaggucaaauagauugucuuauaccacaagaauggguacaacauuuuuaccaggaagcagcaccaagccaauccgcaguugcacuaauuagauaugucaacccagauaccggaagaaacauauuugaagcuaaauuacaccgagaaggauuuauaaccguagcaaauucaggaaauaauccaaucguuguaccaccaaacggauacuucagauucgaagcauggguuaaucaauuuuauacccuaaccccaaugggaacaggacaaggaagaagaagaguacaauaa

SEQ ID NO: 31228 - RNA, 1653 nt, Artificial Sequence
  derived and/or modified sequence opt6 from capsid_protein_VP1__Norovirus__BAN16297
augaaaauggcuaguaaugaugccgcaccaucuaacgacggagcugcaaaucuaguaccagaagcuaauaaugaaguaauggcauuagagccagucgucggagcaucaauagcugcaccaguuguaggacaacaaaauauaauagauccuuggauaagagaaaauuucguacaagcaccucaaggagaauuuacaguaucaccaagaaacucaccuggcgaaauguuauuaaaccuagaacuagggcccgaacucaacccauacuuaucacaucuauccagaauguacaauggcuaugcaggcggaaugcaaguccaaguaguccuugcaggcaaugcauucaccgcaggaaaaauaauauuugccgccguaccuccacacuuuccuguagauaauauaagcgcugcacaaauaaccauguguccucauguuauaguagacguaagacaacuagaaccaguacuacuuccauuaccagauauuagaaauagauuuuuucacuauaaccaggaaaauacaccacgaaugcgauuaguagcaauguuauauacaccauuaagagcuaauucaggcgaagauguauucacaguaucauguaggguccuaacaagacccgcccccgauuuugaauuuacauuucuaguaccaccaacaguagaaucaaaaaccaaaccauuuacauuaccuguacuaacucuuggagaauuaucaaauucaagauuuccagcagcuauagauauguuauauacagauccaaacgaaaguauuguuguacaaccacaaaacggcagaugcacccuagauggaacuuuacaagguacaacacaacuaguaccuacacaaauaugugcauuuagagguacauuaauaagucaaaccgcacgagcagcagacucuguagauucaccacaaagagcaagagaucauccacuucacguacaaguuaaaaacuuagauggaacacaauaugaucccaccgacgacauaccagccguauuaggagcaauugauuuuaaagguacuguuuucggagucgccucccaaagagauguaucaggaacacaagaacaaggccacuaugcuacaagagcacaugaagcacauauugauacaacagaucccaaauacgcccccaaauuaggcacuaucuuaauaaaaucagauucaaaugauuucaacacaaaucaaccuauacgauuuacaccagucggaaugggagauaacaauuggagacaaugggaacuuccagauuauucaggaagauuaacacuaaacaugaaucuagccccagcaguuuccccaucauuucccggagaaagaauauuauuuuuuagaucuaucguaccaucagccggaggauauggaucuggauauauugauugucuaauuccacaagaauggguacaacacuucuaucaagaagcagcuccaagucaaagcgcaguugcauuaguccgauacguaaauccagacacaggaagaaauauauuugaagcaaaauuacaucgcgaagguuuucugacaguagcaaauuccgguaacaacccaauaguaguuccaccuaauggauacuuucguuuugaagcauggguuaaucaauuuuacacucuugcaccuauggggucaggacaaggcagacgcagagcucaauaa

SEQ ID NO: 31229 - RNA, 1623 nt, Artificial Sequence
  derived and/or modified sequence opt6 from capsid_protein_VP1__Norovirus__BAR42289
augaaaauggcaucaaaugacgcagcaccaagcaaugauggagcagcaggauuaguaccugaaggaaauaacgaaacauuaccgcuagaacccguagcaggagcagcaauagcagcaccuguaaccggacaaaacaauauaaucgacccauggaucagaacuaacuuuguucaagccccaaauggcgaauuuacaguaucaccaagaaauucaccaggagaaauacuacuaaauuuagaauuaggaccugauuuaaauccuuauuuggcacauuuaucuagaauguauaauggauaugcaggaggcguagaaguacaaguauuacuugcaggaaaugcauucacugcagguaaaauacuauucgcugccgucccacccaacuuuccaguagaauuccuaucaccagcacaaauaacaauguuaccucauuuaauuguugauguaagaacccuagaaccaauaaugauaccauuacccgauguacgaaauacuuuuuuucacuacucaaaucaaccuaauucuaggaugagacucguagcaauguuauacacaccuuuaagaagcaacggauccggugaugacguauucacuguaucaugccgaguauuaacgagacccaccccagacuuugaauuuacauaucuaguaccaccuagugucgaaucuaaaacaaaaccauucucucuaccaauacucacauuauccgaacuaacaaacucaagauucccuguaccuauagauucucuauuuacagcacaaaauaauguacuacaaguccaaugucaaaauggaagauguacacuagacggagaacuacaaggaacaacacaacucuuaccaacaggaauaugcgccuuucgaggaagaguaacagcccaaauaaaucaacgagauagauggcacaugcaacuacaaaaccuaaacggaacaacuuaugauccaacagaugacguuccagcaccccucggcacaccagauuucaagggcguuguuuucggcaugguaucacaacgaaacguuggaaaugaugcacccggaucaacaagagcucaacaagcauggguuagcacauacagcccacaauucgucccaaaacucggaucaguaaaucuaagaauaucagauaaugaugauuuccaauuucaacccacaaaauucacacccguaggaguaaacgacgaugaugauggacauccauucagacaaugggaauuaccaaacuauucaggagaacuuacacucaauaugaauuuagcucccccaguagccccaaauuuccccggagaacaauuacuuuuuuuuagaucuuuuguaccauguucaggaggauauaaucaagguauaauagauugcuuaauaccacaagaauggauacaacacuuuuaucaagaaucagcuccaagccaaucagaugucgcucugauacguuacguaaaucccgacacaggaagaacuuuauuugaagcaaaacuucaucguucaggauacauaacagucgcccauucaggcgacuacccucuuguaguaccugccaauggacauuuccgauucgauucauggguuaaucaauuuuacuccuuagcucccaugggaaccggaaauggucgacgaagagcacaauaa

SEQ ID NO: 31230 - RNA, 1617 nt, Artificial Sequence
  derived and/or modified sequence opt6 from capsid_protein_VP1__Norovirus__BAR47616
augaaaauggcaucaaacgacgcagccccaagcaaugauggcgccgcaggauuaguaccagaaggcaacaaugaaacacuaccacucgaaccaguagccggagcugcuauagcugcuccaguaacaggacaaaacaacaucauagacccauggauaagaacuaacuucguucaagcaccaaacggagaauuuacuguaucaccccgaaauucaccaggagaaauacuacuaaaccuagaacuaggaccagauuuaaauccauaucuagcacauuuaucccguauguauaacggauaugcagguggagucgaaguacaagucuuacuagcuggaaacgcauuuacagcuggaaaaauacuauucgcugcaguucccccaaacuuucccguagaauuucuaucaccagcacaaauaacaaugcucccucacuuaauugucgacguacgaacauuagaaccuauuaugauaccauuaccagauguaagaaacaccuuuuuucauuauaauaaccaaccaaauaguagaaugagacucguagcaaugcuauauacaccauuaagaucaaacggcucaggagaugauguauuuacaguaaguugcaggguucucacuagaccaaccccagacuuugaauucacauaccucguaccaccaucaguagaaucaaaaacaaaaccauucucuuuaccuauacuuacauuaucagaacuaacaaauucuagauuuccaguaccaauagauucacuauuuacagcacaaaauaacguacuacaaguccaaugccaaaauggacgaugcaccuuagacggagaauuacaaggaacaacacaauuacuacccucaggaaucugcgcguuucgugggagaguaacugcugaaacugaucauagagauaaauggcauaugcaauuacaaaauuuaaauggcacaacauacgauccaaccgaugacguaccagcacccuuagguacacccgacuuuaaaggcguuguauuuggaguugcaucacaacguaacguaggaaaugacgcuccaggaaguacaagagcucacgaagcagugauaucaaccuauucaccacaauuuguaccuaaacucggaucuguaaacuuucggucuaacgacaacgacuuucaacuacaacccaccaaauuuacuccaguugguauaaaugaugacggcgaccauccauuuagacaaugggaacuaccagacuauagcgguuuacuaacacuaaauaugaaccuagcaccacccguagcuccaaauuuuccaggcgaacaacuauuauuuuuuagauccuucguaccaugcagcggagguuauaaccagggaauaguugacugucuuauaccacaagaauggauacaacauuuuuaucaagaauccgcaccuucacaaucagauguagcauuaauuagauauguaaauccagacacuggcagaacacuauucgaagcaaaacuacauagaucuggauauauuacuguagcucacucaggagauuacccacuaguuguaccugccaauggauacuuuagauucgacagcuggguaaaucaauucuacuccuuagcaccaaugggaacuggaaacggaagacgaagagcacaauaa

SEQ ID NO: 31231 - RNA, 1617 nt, Artificial Sequence
  derived and/or modified sequence opt6 from capsid_protein_VP1__Norovirus__BAR63715
augaaaauggcaucaaacgacgccgcuccuuccaaugacggagcagcagguuuaguacccgaagguaacaaugaaacacuaccacuagaaccaguagcaggugcugcaauagcagcaccuguaacaggucaaaacaauauaaucgacccauggauuagaacaaacuucguccaagcuccuaauggagaauuuacaguuucaccuagaaauucacccggagaaauacuauuaaaucuagaacuagguccagaucuuaacccauacuuagcacacuuaucaagaauguauaacggauaugcaggaggaguagaaguacaagucuuauuagcaggcaacgccuuuacagcaggcaaaauucuuuucgccgccguacccccaaauuuuccaguagaauucuuaucaccagcucaaaucacaaugcucccacacuuaauuguagacguaagaacacucgaaccaauaaugauaccuuuaccagauguaagaaauacauucuuccacuauaacaaucaaccaaacucacgcaugagacucguugcaaugcuuuauacaccacuaagauccaacggaucaggagacgacguauucacaguaucaugccgcguauuaacacgaccaacacccgauuuugaauucacauaucucgucccacccucaguagaaucaaaaaccaaaccauucucacucccuauacucacauuaucagaacuaacaaauucaagauucccuguuccaauagacucauuauucacagcucaaaauaauguacuccaaguacaaugucaaaacggacgauguacauuagacggagaacuacaaggaacaacacaacuauuaccaucaggaauaugugcauuccguggccgaguaacagcagaaaccgaccaucgagauaaauggcauaugcaacuacaaaauuuaaacggaacaacauaugauccaacagaugacgucccagcaccacuaggcacaccagacuucaaagguguaguauuuggaguagcuucacaacguaauguagguaacgacgcuccggguucaacuagagcucaugaagccguaauuucaaccuacucaccccaauuuguaccaaaauuaggaucaguaaacuuccgaagcaaugauaaugacuuucaacuucaaccaaccaaauucacaccaguaggaauaaacgacgacggagaucaccccuucagacaaugggaacuacccgauuacuccggauuauuaacucuaaauaugaauuuagccccaccagucgcaccuaacuuuccaggagaacaacuucucuucuuuaggucuuucguaccaugcucuggaggauauaaucaaggaauagucgauugccuaauaccacaagaauggauacaacauuuuuaccaagaaucugcacccucacaaucagauguagcauuaaucagauacguaaaucccgauacaggaagaacucuuuuugaagcaaaauuacaucgaucaggauauauaaccguagcacauucaggagacuaccccuuaguaguuccagcuaauggauauuuuagauucgacucaugggucaaccaauucuacuccuuagcgccaaugggcacaggaaauggacgaagaagagcacaauaa

SEQ ID NO: 31232 - RNA, 1617 nt, Artificial Sequence
  derived and/or modified sequence opt6 from capsid_protein_VP1__Norovirus__BAR63718
augaaaauggcuucaaacgaugccgcaccaucaaaugacggagcagcuggcuuaguaccagaagguaacaaugaaacacuaccauuagaaccaguagccggcgccgcuauagccgcacccguuacaggccaaaauaauauaauagauccauggauacgaacaaauuucguccaagcaccuaacggugaauuuaccgucucaccacgaaauucuccaggcgaaauccuauuaaaccuugaacuaggaccagacuuaaauccauaucuagcacaucuaucaagaauguacaacggauaugcaggaggaguagaaguacaaguuuuauuagcuggaaaugcauucacagcaggaaaaauauuauucgcugcaguaccacccaacuucccuguugaauuccuuucaccagcccaaauaacuaugcuaccacaccucauuguagacguaagaacauuagaaccaauaaugauaccauuaccagauguuagaaacacauucuuccacuauaacaaccaaccaaauucacgcaugagauuaguagccauguuauacaccccuuuaagaucaaacgguucaggugacgauguauuuacaguaucauguagaguuuuaacacgaccaaccccagauuuugaauucacuuaucucguuccuccauccguagaaucuaaaacaaaaccauuuucacucccaauacuaacacuaucagaauuaaccaauucaagauuuccaguaccaauugacucucuauuuacugcacaaaacaacguauuacaaguacaaugccaaaacggacgauguacauuagauggagaacuacaaggaacuacacaacuauuaccaucaggaauaugugcauuuagagguagaguaacagcagaaacagaccauagagauaaauggcacaugcaauuacaaaaucuaaauggaacaacauacgacccuacagacgacguaccugcaccuuuaggcacacccgauuucaaaggaguaguuuucggaguagcaucacaaagaaacguaggaaacgaugcaccaggcucaacaagagcccaugaagcuguaauaaguacauauuccccccaauuuguaccuaaacuagguagcguaaauuuccgaucaaaugauaaugacuuucaacuacaaccuaccaaauucacaccaguuggaauaaacgaugacggugaccacccauuuagacaaugggaacuaccagacuauagcggucuacuuaccuuaaauaugaaccuagcaccaccaguagcuccaaacuuuccaggagaacaauuacuauucuuucguucauuuguaccaugcuccgggggauacaaccaaggaauuguagauuguuuaauaccacaagaauggauccaacacuucuaucaagaaagugcuccaucucaaucugacguagcccuuauaagauauguaaauccugacacuggaagaacauuauucgaagcaaaacuucacagauccggauacauuacaguugcucacuccggugacuacccuuuaguaguaccugccaauggcuauuuucgcuucgacucauggguaaaucaauuuuauuccuuagcgccaaugggaacaggaaacggaagacggagagcacaguaa

SEQ ID NO: 31233 - RNA, 1617 nt, Artificial Sequence
  derived and/or modified sequence opt6 from capsid_protein_VP1__Norovirus__BAR63721
augaaaauggcaucaaaugaugcagccccauccaacgauggugcagcaggacuaguaccugaaggaaauaacgaaacccuuccacuagaaccugucgcaggagccgcaauugcugccccaguaacaggucaaaacaacauaauagauccauggaucagaacuaauuuuguccaagcacccaacggagaauuuacaguaucaccaagaaauucacccggagaaauucuccuaaaucucgaauuaggaccagaccuaaauccauauuuagcccauuuaucacguauguauaacggauacgcaggaggaguagaaguucaaguucuacuagcaggcaaugcauucacagcaggaaaaauucuauucgcagcaguaccaccaaacuuuccaguagaauuuuuaucaccagcccaaauaacaauguugccucaccuaauaguagauguuagaacucuagaaccaauaaugauuccauuaccagacgucagaaauacauucuuucacuacaacaaucaaccaaacaguagaaugcgacuaguagcaaugcuauacacaccuuuacgaucaaauggcucaggcgacgauguuuucacaguaucuugucgaguccuaacacgaccaacccccgacuuugaauuuacauaucuaguaccaccaucuguagaaucaaaaaccaaaccauuuucacuaccuauauuaacuuuaucugaauuaacuaauucacgauuuccuguaccuauagacucucucuuuacagcacaaaacaauguacuucaaguacaaugucaaaauggaagauguacauuagauggugaauuacaaggcaccacucaacuacuacccucuggaauaugugcauuuagaggaagaguuacugcagaaacagaccauagagacaaauggcauaugcaacuacaaaacuuaaacggcacaacauaugacccaaccgacgacguaccugcaccacuuggcacaccagauuuuaaagguguaguuuucggaguagcaucacaaagaaacguaggaaaugaugcaccaggaucaacaagagcacaugaagcaguaauauccacuuauagcccacaauuuguaccaaaauuaggaucugucaauuucagaucuaaugacaacgauuuucaauuacaaccaaccaaauucacaccugucggaaucaaugacgacggagaucauccauucagacaaugggaacuuccagacuacucaggauuauuaacacuaaacaugaacuuagccccaccuguagcaccaaauuuucccggagaacaacuacuauucuucagaucauucgugccauguucaggaggauauaaccaaggaauaguugacuguuuaauaccacaagaauggauacaacauuucuaucaagaauccgcaccaucucaaucagacguagcccuuauaagauauguuaacccagacacaggacguaccuuauuugaagcuaaauuacaucguucaggauauauaacaguugcacauucaggcgauuauccccuuguaguaccugcaaauggcuauuucagauucgauucuuggguaaaucaauuuuauucauuagcgccaauggguacuggaaaugguagaagacgugcacaauaa

SEQ ID NO: 31234 - RNA, 1623 nt, Artificial Sequence
  derived and/or modified sequence opt6 from capsid_protein_VP1__Norovirus__BAS02083
augaaaauggccucaucugaugcuaauccauccgauggcucagcugcaaacuuaguuccagaaguaaauaaugaagucauggcauuagaaccaguaguuggugcagcaauagccgcaccuguagcuggacaacaaaacguuauagauccauggauaagaaauaauuuuguacaagcaccaggaggugaauuuacuguauccccacgcaaugccccuggagaaauauuauggucagcaccacuaggacccgauuuaaacccauauuuaucacacuuagcacguauguacaacgguuaugccggaggcuucgaaguacaagucauacuugcuggaaaugccuuuaccgcuggcaaaguaauauuugccgcuguaccaccaaacuucccaacagaaggcuuauccccuucccaagucacaauguuuccacauauaguagucgacguaagacaauuagaaccaguacuaauuccacuacccgauguaagaaauaacuuuuaucacuauaaucaaucaaacgacccuacuaucaaacuaauagccauguuauacacaccauuaagagcuaauaaugcaggagaugauguauucacuguaaguugccgaguacuaacaagaccaucaccagauuucgacuucauauucuuagucccaccaaccguagaaucaagaacuaaaccauuuucaguaccagucuuaacagucgaagaaaugacaaacucccgauuuccaauaccacuagaaaaacuuuuuacagguccaucaucagcauuuguuguacaaccacaaaacggucgauguacaacugauggaguauuauugggaacaacacaacuuucucccguaaacaucugcacauuuagaggagauguuacccacaccacaggcucacauaauuacaccaugaauuuagcuucacaaaacugguccaacuaugacccaacagaagaaauaccagcaccacuaggaacaccugacuuugucggaaaaauacaaggaguacuuacucaaacaacaagaacugacggauccacucgcggacauaaagccacaguauauacaggcucagcugauuuugcaccuaaacuagguagaguccaauuugaaacagauacaaaucaugauuuugaagcaaaccaaaauacaaaauuuacuccaguaggcguaauacaagacgguggaaccacacacaggaaugaaccacaacaauggguauuacccucauauagcggaagaaauacuccuaacguucaccuugcaccagcaguagcaccaacauuuccaggugaacaacuauuauuuuuccguucaacaaugccuggaugcucaggauacccaaauauggauuuggauugucuucuuccacaagaauggguacaauacuuuuaccaagaagcagcuccagcacaaucagacguagcauuacuaagauucguuaacccagacaccggaagaguauuauucgaauguaaacuacauaaaucuggauauguaacggucgcucacacaggacaacaugacuuaguaauaccaccuaauggauauuuuagauuugacucauggguaaaucaauuuuauacccuagcaccuaugggaaauggcacuggacgcagaagagcucuauag

SEQ ID NO: 31235 - RNA, 1635 nt, Artificial Sequence
  derived and/or modified sequence opt6 from capsid_protein_VP1__Norovirus__CRL46952
augaugauggcaucaaaagaugccacaccaucagccgauggugcaacaggagcaggacaauuaguaccagaagucaacacagcagaccccauacccauagaucccguugccggaucuucaaccgcacuagcuaccgcaggucaagucaaccucauagacccauggauuauaaauaacuuuguucaagcaccacaaggagaauuuacaauaucaccaaauaauacaccaggugaugucuuauucgauuuacaauuaggaccucaucucaaucccuuucuaucacauuuaucccaaauguacaacggcuggguagguaauaugcgaguaagaguaguacuagcaggaaaugcauuuacugcagguaaaguaauaauauguugcguaccuccagguuuucaaucaagaacuuuaucaauugcacaagcaaccuuauucccccacguaauagcagacguucgaacauuagaucccguagaaguaccauuagaagacguaagaaauguauuauaucauaauaaugauacacaaccaacuaugagauuacucuguaugcuauauacaccauuaagaacuggaggugcauccggaggaacagacucauuugucguagccgguagaguacuaacaugucccggaccugacuuuaacuuuuuauucuuaguaccccccaccguagaacaaaaaacaaggccguuuacuguaccaaauauaccacuaaaauaccuaucaaacucaagaauaccuaauccaauugaaggcaugagcuuauccccagaccaaacacaaaacguccaauuucaaaauggaagaugcacaauagauggacaaccuuuaggcacaacaccaguaucaguaagucaacuaugcaaauuccgagguagaauaacauccggacaacguguacuaaaccuuacagaacuagacggauccccauuuauggccuuugcugcaccagccccagcagguuuuccagaccuagguucaugcgauuggcauauagaaauguccaaaauaccaaauuccucuacacaaaacaauccaauaguaguaaauucaguuaaaccuaauucacaacaauuuguaccucaucuauccucaauuacauuagaugauauuguaagcucuggaggagacuacauugguacaauacaauggacuucaccaccaucagacucaggaggagcaaacacaaauuuuuggaaaauaccagauuauggcuccucauuauccgaagcaagccaauuagcaccagcaguauacccaccaggauuuaacgaaguaauaguauauuuuauggcaucaauacccggcccaaaccaaucaggaucaccaaaucuagucccauguuuacucccacaagaauauauaacacauuuuaucucagaacaagcaccaauacaaggagaagcagcauuacuccauuauguagacccagacacuaaucguaacuuaggagaauucaaacucuauccaggaggcuauuuaacuugcguuccaaauucaucaucuacuggcccucaacaauuaccucuagauggugucuuuguauuugccucauggguaucuagauucuaucaacuaaaaccaguaggcaccgcaggaccagcaagaggucgcuuaggaguucgucgauaa

SEQ ID NO: 31236 - RNA, 1623 nt, Artificial Sequence
  derived and/or modified sequence opt6 from capsid_protein_VP1__Norovirus__CRL46955
augaugauggcaucaaaagacgcaccaacauccccagauggagcaucuggagcaggacaacuaguaccagaagcaaauacugcugaacaaauaaguauggaccccguagcaggugccucuaccgcaguagccacagcaggccaaguaaacaugaucgacccauggauauucaacaauuucguacaagccccacaaggcgaauuuacaauaucuccuaauaacacaccaggagacauacuauuugaucuacaauuagguccucacuuaaacccauuccuagcacaccuuucacaaauguauaauggcuggguuggcaauaugagaguucggauauuacuagcaggaaaugccuuuacagcuggcaaaauuauaauaugcugcguaccaccaggcuuugaugcuagaauucuaaccauagcacaagcaaccuuauucccacacuuaaucgcagacguaagaacucuagaacccguagaauuaccccuagaagauguacgaaauguauuauaucacaauucaucacaaccccaaccuacuaugcgacuaguagcaauguuauauacaccacuaagaacuggcggagguucaggcggaacagacgcuuuuguaguagcaggaagaguuuuaacauguccagcaccagauuucucauuuuuauuuuuaguaccucccucaguagaacaaaaaaccagaguauucuccguaccaaauauaccacuaaaagaccuaucaaauucaagaguacccgucccaauccaaggaauguucauguccccagacguaaaucaauccguacaauuccaaaaugguagaugucaaauagacggacaacuucaaggaaccacucccguaucccuaucucaacuauguaaaauucgaggaaaaacuucuucaaaugcaagaguauuaaacuuaucagaaguugacggaacaccauuuauuccuuuagaaucaccagccccaguaggauuuccagauuuaggaggaugcgacuggcacguaaauuucacauuucaagcucaaaaucaagauccaucucaauccguaacauuugcaacaaaugaugcaucauucguaccauaccuaggcucuauaucaccacauaauggcggagauuuucaugcaggugauauaauaggaucacuaggauggauaucugcaccaucagauaauagccaauuaaacguauggacaaucccgaaauacggaucuucauuaccagaugucacacacuuagcgccagcaguauuccccccaggauuuggagaaguaauacuuuauuuuuauucaacauuuccaggaucaggucaaccaucacaauuacaaguaccaugcuuacuaccacaagaauuuauuacacauuucuguaacgaacaagcuccuauagcuggugaagcagcauuacuccauuauguagauccagauacaggaagaaauuuaggagaauucaaacuauauccagacgguuuuaugaccuguguaccuaacucaguauccaguggaccucaaacacuaccaauaaauggaguauucguauuuguaucuugggucaguagauucuaccaauuaaaacccguaggaaccgcauccgcagcacgacgacuaggcuuaagaagaauauaa

SEQ ID NO: 31237 - RNA, 1623 nt, Artificial Sequence
  derived and/or modified sequence opt6 from capsid_protein_VP1__Norovirus__CRL46958
augaaaauggcaucaaaugaugcaaacccaucagacggcuccgccgcuaaccuaguaccagaaguuaacaaugaaguaauggcucuugaaccaguuguuggugccgcaauagcagcacccguagcaggacaacaaaauauuauagacccauggaucagaaauaauuuuguucaagcaccaggcggagaauuuacaguaaguccacgaaaugcuccaggcgaaaucuuauggagugccccacucggcccugaucuaaacccauaccuaucccauuuggcaagaauguacaacgguuaugcaggaggauucgaaguucaaguaauauuagccggcaaugcauucacagcugguaaaauaauauucgcugcugucccaccaaauuucccgacugaaggacucucaccaucacaaguaacaauguucccacacauaauaguagacguacgacaauuagaaccaguacuaauaccauuacccgacguacguaacaauuuuuaucacuauaaucaaucaaaugacucaacaauuaaauuaauagcuaugcuauauacaccauuaagagccaauaaugccggugaugaugucuuuacaguaagcugcagaguacuuacaagaccaucaccagacuuugacuuuauuuuccuugucccaccaacaguagaaucaagaacaaaaccauuuacaauaccaauacuaaccguagaagaaaugacaaauucaagauucccaauuccacuagaaaaacuauauacaggcccaucaucagcauuuguaguccaaccacaaaacggacgauguaccacagacggaguauuacuaggaacaacacaauuauccccaguaaacauaugcacauuuagaggcgacguuaccaauauucaaggaucucacacauacaccaugaacuuagcaucuuuaaauuggaauaauuaugauccaaccgaagaaacacccgcaccacuagguaccccagauuuugucggcaaaauacaaggaguacuuacacaaacaacaaaaggucaaggauccacaagaggucauaaagcuaccguauacacgggaucagcuaguuuuacaccaaaauuaggaucaguacaauuuagaaccgacacacaaaaugacuucguaacacaccaaaauacaaaauucacaccaguaggaguuauacaagauggagacacaacacauagaaaugaaccucaacaauggguacuaccuaacuauucaggaguaaauacacacaauguucauuuagcaccagccgucgccccaacaauaccaggagaacaauuauuauucuuucgaaguucaaugccagguuguaguggauaucccaacauggauuuagacugcuuaguaccacaagaauggguucaacauuuuuaccaagaagccgcaccugcacuaucagauguugcccuacuccguuucguuaauccugacacuggaagaguacuuuuugaaugcaaacugcacaaauccggauaugucaccgucgcacauacuggacaccacgaucuaguuauaccacccaauggauacuucagauucgacucauggguuaaucaauuuuacacacuagcaccaaugggaaauggaacaggacgaagacguguuuuauaa

SEQ ID NO: 31238 - RNA, 1623 nt, Artificial Sequence
  derived and/or modified sequence opt6 from capsid_protein_VP1__Norovirus__CRL46961
augaaaauggcaucuucagaugcaaauccauccgauggaucagcagcaaauuuaguaccggaagucaacaacgaaguaauggcccuagaacccguaguaggagcggcaauagcagcaccugucgcaggacaacaaaacguaauagacccguggauaagaaauaauuuuguacaagcaccaggaggcgaauucacugucucacccagaaacgcacccggagaaauacuauggucagcaccacuaggacccgaucuuaacccauauuuaucacauuuagcaagaauguacaacggauacgcgggugguuucgaaguacaaguuauauuagcaggaaacgcauuuacugcaggcaaaauaaucuucgcagccgucccaccaaauuucccaacagaaggucuaucaccaucucaaguaacaauguucccacauauaauuguagacguaagacaacucgaaccaguacuaauuccauuaccagauguacgaaauaauuuuuaccacuacaaucaaagcaaugauucaacaauaaaauuaauagcuaugcuauauacaccacuaagagcuaauaaugcgggcgacgauguauucacaguguccuguagaguauuaacaagacccuccccagauuucgacuucauauuucuaguaccaccaaccguagaaucaagaacaaaacccuucucaguaccaguauuaacaguugaagaaaugacaaacagccgauuuccuaucccacuagaaaaacucuuuacaggaccuucaucugcauucguaguucaaccacaaaacggacguuguacaacagacgggguacuauuagguacaacacaacuaucuccugucaauaucuguaccuucagaggcgacguuagccauauaacagguucuagaaauuauacaaugaaucuagcuagccaaaacuggaacaacuacgacccaacagaagaaauaccagcaccacuagguacaccagacuuuguaggaaaaauacaaggaauguuaacacaaacaacuagagcagauggaagcacuagaggacauaaagcaacaguauauacagguagcgcagacuuugccccaaaauuaggaagaguacaauuugaaacagacacagaucacgauuuugaagcaaaucaaaauacaaaauuuacaccaguaggaguaauacaagauggaagcacuacucauagaaacgaaccucaacaauggguucuaccaagcuauucaggacgaaacacacauaauguacacuuagcacccgcaguagcaccuaccuuuccaggagaacaacuauuauucuuucgaucaacuaugccuggaugcucaggauauccaaauauggaucuagacugcuuacuaccccaagaauggguacaauacuucuaccaagaagcagcaccagcacaaucugacguagcucuuuuaagauuuguaaacccugacacuggccguguacuauuugaaugcaaauuacacaaauccggauauguuaccguagcacacacuggacaacaugaucuaguaauccccccaaauggauauuuccgauucgauagcuggguaaaccaauuuuacacucuagcuccaaugggaaauggaacaggaagacguagagccguauaa

SEQ ID NO: 31239 - RNA, 1623 nt, Artificial Sequence
  derived and/or modified sequence opt6 from capsid_protein_VP1__Norovirus__CRL46964
augaaaauggccucaucugacgcuaauccaucagaugguucugcagcuaacuuaguaccagaaguaaauaaugaaguaauggcucuugaaccagugguaggugcagcuaucgcagcaccaguugcaggacaacaaaacgucauagacccauggauacgaaauaacuuuguacaggcaccaggaggagaauuuacaguaucaccucgaaacgcaccuggagaaaucuuauggucagcacccuuaggaccagauuuaaauccauaucuaucacaucuagcaagaauguauaaugguuacgcaggcggauucgaaguacaaguaauauuagccggaaaugcauuuacagcaggaaaaguuauauucgcagcaguuccaccaaacuuccccacagaaggccuaucacccucacagguuacuauguucccucacaucguaguugacgucagacaacuagaaccagugcuaauaccacucccagauguaagaaauaauuucuaucauuauaaucaaucaaaugaccccacuauaaaauuaauagcgauguuauauacaccccucagagcuaacaaugcaggagacgaugucuuuacugucaguuguagaguucuaacaagaccaucaccagauuuugauuuuauauuuuuaguacccccaaccguagaaucuagaacaaaaccauucucaguaccaguacuuacaguagaagaaaugacaaacucccgauuuccaaucccauuagaaaaacuauuuacagguccaucaucugacuucgucguccaaccucaaaacgguagauguacaaccgaugguguacuacuaggcacaacacaauuaucaccaguaaauaucuguacauuuagaggagacguaacacauacaacuggaucucgcaauuacacaaugaacuuagcuucccaaaauuggaauaacuacgacccaacugaagaaacuccagccccacuaggaacaccagacuuuguaggaaaaauccgaggaauguuaacacaaaccacuagagccgauggaagcacacgaggccacaaagcaacuguauauacuggcucggccgacuuugcuccaaaacuaggaagaguacaauucgaaaccgacacugacaacgauuuugaugcaaaucaaaacacaaaauucacuccagucgguguuauacaagauggaacaacaacccauagaaaugaaccaagacaauggguacuaccuucauacucaggaagaaacacacauaacguacaccuagcaccugcagucgcaccuacauuucccggagaacaauuacuauucuucagaucuacuaugccugguugcucaggauaccccaauauggauuuagacugucuccuaccccaggaauggguacaauucuucuaucaagaagcagccccagcacaaucagacguagcacuuuugagauuuguaaaccccgacacaggaagaguauuauuugaauguaaacuacacaaaucaggauacguuacuguugcucacacaggaccucacgaucuaguaauaccuccaaauggauauuucagauucgacucuugggucaaucaauucuacacauuagcaccaauggguaauggaacaggaagaagaagagcaguauaa

SEQ ID NO: 31240 - RNA, 1644 nt, Artificial Sequence
  derived and/or modified sequence opt6 from capsid_protein_VP1__Norovirus__CRL46967
augaaaauggcaucuaaugaugcagcaccgucaaacgauggagcagcuaauuuaguuccagaagcaacaucagaaguaauggcauuagaacccgucguaggagcaucaauagccgcaccuguaguuggucaacaaaauauuauugaccccuggauuagagaaaauuuuguacaagcuccacaaggagaauuuacaguaucaccuagaaacagcccaggagaaaugcuccuaaaucuugaauuaggaccugaacuuaaucccuacuuaucucacuuaucaaggauguauaauggauaugcaggcggaaugcaaguacaaguuguucuagccggaaacgcauuuacagcuggaaaaauaauauucgcagcuguuccuccacauuuuccaguagaaaauauaucagcagcccaaauaacaaugugcccacauguaauugucgauguccgccaacuugaaccaguauuacuuccauuaccugauauccgaaauagauuuuuucauuacaaccaagaaaacacaccacgaaugagauuaguagcaaugcuauauacuccuuuaagagcaaauucaggagaagauguauuuacaguuucauguagaguacuaacaagaccagcaccugauuuugaauucacauuucuaguaccaccaacaguggaaucuaaaacuaaaccauuuacauuacccauacuuacuuuaggcgaacuaucaaauucaagauucccagcaccuaucgauauguuauauacagacccaaaugaagcaauaguaguacaaccucaaaacggacgauguacucuagauggcacuuuacaaggaacaacucaacuagucccaacucaaauuuguucauuuagaggcaccuuaauuagucaaacuucaagaucagcagauuccacagauucagcucccagaguaagaaaccauccuuuacauguccaauuaaaaaauuuagacggaacacccuaugauccuacagaugaaguucccgcaguacucggagcaauagacuuuaaaggaacaguuuuuggaguagccucccaaagaaacacaacaggaucaaguauuggagcuacuagagcacaugaaguacacauagauacuaccaaucccagauacgcaccuaaauuaggaucaguccucauguacucagaaagcacugauuucgaugacggacaaccaaccagauuuacuccuauaggcaugggagcagaugauuggcaucaaugggaacuaccugaauacucaggccaucuaacucuaaauaugaaucuagcaccagcaguagcuccugcauuucccggagaacgaauauuauuuuuucgcuccguuguaccaucugcaggcggauauggaaguggccauaucgacugucuaaucccucaagaauggguucaacauuuuuaucaagaagcagcaccaucucaaucagcaguagcuuuaauaagauaugucaauccagauaccggaagaaauauauuugaagcaaaacuccaccgagaaggauuuauuacuguagccaacucaggaaauaacccaauaguagucccaccaaauggauauuuuagauuugaagcauggguaaaucaauuuuacacucuaacacccaugggaaccggacaaggcagaagaagaguacaauaa

SEQ ID NO: 31241 - RNA, 1647 nt, Artificial Sequence
  derived and/or modified sequence opt6 from capsid_protein_VP1__Norovirus__CRL46970
augaaaauggcaucaaaugaugcagcaccaucaaacgacggagcagccggccuaguaccugaaauaaacaaugaagcaauggcacuugaaccaguagcaggagcagccauagcugcaccacuaacuggacaacaaaauauuauagauccauggauaaugaauaauuuuguccaagcaccaggaggagaauuuacagucucaccacguaacagucccggugaaguauuacuuaaucuagaacuagguccagaaauuaaucccuaccucgcgcacuuagcuagaauguacaacggcuaugcagguggauuugaaguccaaguaguauuagcuggaaacgcauuuaccgcagguaaaauaauuuuugccgcaauaccaccuaacuucccaauugauaauuuaagugcagcucaaauuaccaugugcccacauguuauaguagauguaagacaauuagaaccaguaaaucuaccuaugccugauguaagaaauaauuucuuccauuacaaucaaggaucagauucccgccuucgauuaauagcaauguuauauaccccuuugagagccaauaacucaggagaugacguuuucacaguaucauguagaguauuaacaagaccaucaccagacuucucauuuaauuuucuaguaccaccaacaguagaaucaaaaacaaaaccauucucauuaccaauuuuaacaauuuccgaaauguccaauuccagauuucccguaccaauugacucacuacauacaucaccgacugaaaacauaguaguacaaugccaaaaugguagagucacacuagacggagaacuaaugggaacuacacaguuacuaccuucacaaauaugugcauuuagaggaguuuuaacaagauccacaucuagagcaagcgaucaagcagauaccgcaacuccacgccuauucaacuacuauuggcacauacaacuugacaacuugaacggcaccccauacgacccagcagaagacauaccaggcccacuaggaacuccagauuucagagguaaaguauucggaguagcaucacaaagaaaucuugacaccacuacaagagcacacgaagcuaaaauagacacaacauccggaagauuuacaccuaaauuaggaucccuagaaauaucaacagaaucaagugauuuugaccaaucucaaccaacuagauucacucccguuggaauuggcguggaccaugaagcagauuuccaacaauggacauuaccagacuacgcaggacaauucacacauaauaugaaccuugcaccagcaguagcccccaauuuuccaggcgaacaauuauuauucuuuagaucucauuuacccucaucgggaggaagaucaaaugguauauuagacugccuaguaccacaagaauggguacaacacuucuaucaagaaagugcacccucacaaucacaaguugcauuaguccgauauguaaauccagauacaggacgaguacuauucgaagcuaaauuacauaaacuuggcuucaugacaauagcaaaaaauggagacagcccgauuauaguaccaccuaauggauauuucagauuugaaucauggguuaauccuuuuuauacacuagcacccaugggaacuggaaauggacgacguagaauacaauaa

SEQ ID NO: 31242 - RNA, 1608 nt, Artificial Sequence
  derived and/or modified sequence opt6 from capsid_protein_VP1__Norovirus__CRL46973
augaaaauggcaucaaacgaugcagcaccaucaaacgacggagcugcaggauuaguacccgaagucaauaaugaaacaauggcacuagaaccaguugccggcgcaaguauagcagcaccacucacaggacaaaauaacguuauagacccauggaucagaaugaauuuuguacaagcacccaauggagaauucacaguaucuccaagaaauucaccaggugaaguacuauuagaauuagaacuuggaccagaauuaaauccauuuuuagcccaucuaucaagaauguauaauggauacgcuggagguguagaaguccaaguauuauuagcagguaacgcauucacagcuggaaaauuaguauuugccgcuauaccaccacauuucccccuagaaaacuuaaguccaggucaaauaacaauguuuccacauguaauaauagaugucagaacauuagaaccaguacuauuaccacuaccagacgucagaaauaacuuuuuucauuauaaucaacaaccagaagcaagaaugaaacuaguagcaaugcuauacacaccauuaagaucuaacggaucaggggacgacguuuucaccguaucaugccgaguacuuacaagacccucaccagauuucgacuuuaauuacuuaguacccccaacaguagaaucaaaaacaaaaccauucacucuaccaauacuaacaauaggagaacuuucaaauucuagauucccagucccaauagacauacucuacaccucaccaaacgaaggaguagugguacaaccacagaauggaagaucaacacuagauggagaacuacuaggaacaacacaaauaguuccaucaaacauaugugcacuaagaggaagaauaaaugcacacgucccuaacgagccaaaccaauggaaccuacaagucaccaaugcaaaugguacaccauucgauccuacugaagacguuccagcuccacuagguacccccgacuuccaagcaaacauauaugggguaacaggacaaagaaacuccgacucuucauguagagcacacgauggagucuuagcaacauggucaccaaaauucacacccaaauuagguuccguaguauuaggaacaugggaaaaagaagacuucaacauaaaucaaccaacacgauuuacaccaauaggauuacacaauaccgaacacuuuaaacaauggguauuaccaaacuauucagguaugcuaacauuaaauaugaacuuagcaccaucaguugcacccuuauuccccggugaacaaauacuuuucuucagaucguucauaccacuaaacggaggaaaauccgauggcgcaauagauugucucuuaccccaagaauggauacaacauuuuuaucaagaaucagcaccuucccccaccgauguugcacuaauccgauauacuaacccagacaccggaagaguccucuucgaagcaaaacuacauagacaaggcuuuauaacaguagcauccuccggaagcaaacccauaguuguaccaccaaauggauacuuccgauuugauuccuggguaaaucaauucuacucacucgcaccaaugggaacaggaaaugguagaagacgaguccaauaa

SEQ ID NO: 31243 - RNA, 1623 nt, Artificial Sequence
  derived and/or modified sequence opt6 from capsid_protein_VP1__Norovirus__CRL46976
augaagauggccucaaaugacgcugcccccucagauggauccacagcaaaucuaguaccagaaguaaacaaugagguaauggcauuagaaccaguaguaggagcagccauagcagcaccugucgccggacaacaaaauguaaucgacccauggauuagaaauaacuucguacaagcuccaggcggcgaauuuaccguauccccacgaaaugcaccaggagaaauauuauggucagccccauuaggaccagauuuaaacccauaccuaagucaccuagcaagaauguacaaugguuaugcuggaggauucgaaguacaaguaauacuagcuggaaaugcauuuacugccggaaaaaucauuuuugcagccguuccaccaaauuucccaacagaaggauuaucaccuucccaagucacaauguuuccacauauaaucgucgacguaagacaacuagaaccaguacuaauaccacucccagauguccgaaauaacuuuuaccauuauaaucaauccaaugacccaacaauaaaacuuauagccauguuauauacuccauuaagagccaacaaugccggcgaugacgucuuuacaguaucaugucgaguacuuacaagaccuucacccgauuucgacuucauauuucuaguaccacccacagucgaaucaagaacaaaacccuucucuguuccaguauuaacagucgaagaaaugacaaacuccagauuuccaauaccacuagaaaaacuauuuacuggaccauccucugcauucguaguccaaccacaaaauggcagaugcacaacagacggcguacucuuagguacaacucaauuaucaccaguaaauauaugcacuuuuagaggcgauguuauacauauaccaggaucacgcaauuauacaaugaaucucgcgucacaaaacuggaauagcuacgacccaacagaagaaauaccagcaccacuagguacacccgacuuuguaggaaaaauucaaggcguacuuacacaaacuacuagaacuaacggaucaacaagaggacacaaagcaacuguauauacaggaucggcagacuuuucaccaaaauuaggaagaguucaauucgcaaccgauacugauaaugauuuugaaacaaaucaaaacacaaaauucacacccguaggaguuauacaagaugguucaaccacaccacgaaacgaaccacaacaauggguauuaccaucauacucaggaagaaauauacauaacguacacuuagcuccugcaguagccccaacuuuuccaggagaacaacuauuauucuuucgaaguacaaugccuggaugcucagguuauccgaauauggaucuugauugcuuauuaccucaagaauggguccaguauuucuaccaagaagcagcaccagcucaaucagauguagcauuacuaagauucguaaacccagauacaggaagaguauuauuugaaugcaaacuacacaaaucuggauauguaacugucgcacauacaggacaacacgacuuagucauucccccaaacggcuauuuuagauucgauuccuggguaaaucaauuuuacacacuagcuccaaugggaaauggaacaggaagaagaagagcucuuuga

SEQ ID NO: 31244 - RNA, 1623 nt, Artificial Sequence
  derived and/or modified sequence opt6 from capsid_protein_VP1__Norovirus__CRL46979
augaaaauggcaucuucugaugcuaauccuagcgaugguucaaccgcaaauuuaguaccagaaguaaauaaugaaguuauggcauuagaaccaguaguaggugcagcaauagcagcaccaguagcaggacaacaaaacguuauugacccauggauuagaaauaauuucguacaggcaccuggaggagaauuuacaguauccccaagaaacgccccaggagaaauauuaugguccgcaccacuaggaccagaucucaauccauaucuuucucaccuugcacgaauguauaaugguuacgcaggaggauucgaaguacaaguaauacuagcagguaacgcauuuacagcaggaaaaauaauauucgcagcaguaccgccaaauuuuccaacagaaggucuaucaccaucacaagucacaauguuuccucacauuauaguagacguuagacaacuugaaccaguucucauuccacuaccggauguacgaaacaauuucuaccauuauaaccaaucaaacgaccccaccauaaaacuaauagcaaugcuauacacaccauuacgugccaauaaugcaggagacgauguauuuacaguuuccugucgaguuuuaacgcgcccaagcccagauuuugacuuuaucuuucuagucccaccuacagucgaaucaaggacaaaaccuuuuucaguaccaguauuaacaguugaagaaaugacaaacucaagauuucccauaccauuagaaaaauuauucacaggaccaucaucagcauuuguaguacaaccacaaaacggaagaugcacaacagacggaguauuacucggaacgacacaauuaucaccaguaaauauaugcacauuuagaggggauguuauacacauucccggaucaagaaauuacacuaugaaccuagcaucacaaaauuggaacucauacgauccaaccgaagaaauacccgcaccauuagguacaccagauuuuguuggaaaaauacaaggaguacuaacacaaaccacuagaacaaaugggucaacuagaggacacaaagcaacaguauacacaggaucagcagauuuuagcccaaaauuaggcagaguccaauucgcaaccgauacagauaacgacuucgaaacaaaccaaaauaccaaauucacaccaguaggcgucauucaagauggcucaaccacaccaagaaaugaaccucaacaauggguucuuccuuccuauucaggacgaaacauacacaacguacacuuagcgccagcuguugcaccaacauuuccaggagaacaacuuuuauucuuucgaucuacaaugccagguugcucuggauauccaaauauggaccuagacuguuuacuaccacaagaauggguucaauauuucuaucaagaagcagccccugcacaauccgacguagcauuacuaagauuuguaaauccagacacaggaagaguauuauucgaauguaaacuacauaaauccggauauguaaccguagcucauacuggacaacacgacuuaguaauaccaccuaacgguuauuuccgauuugacagcuggguaaaucaauuuuacacacuagcacccaugggaaacggaacaggacgaagaagagcccucuaa

SEQ ID NO: 31245 - RNA, 1623 nt, Artificial Sequence
  derived and/or modified sequence opt6 from capsid_VP1__Norovirus__ABC96332
augaaaauggcuccaaacgacgcuuccccaucugacgguucaacagcaaaccuaguaccagaaguuaacaaugaaguaauggcacuagaaccaguaguaggggcugcaauugcugcuccaguagcaggacaacaaaauguaauagauccauggauaagaaauaauuucguacaagcuccaggaggugaauuuacuguauccccaagaaacgcaccaggugaaauucuuuggucugcaccauuaggaccagaucuaaauccauaucuuucccaccuagcaagaauguacaacggauacgcaggcggauuugaaguacaagucaucuuagcaggaaacgcauucacugcaggaaaaaucauauuugcagcaguaccacccaacuuuccgacagaaggcuuaaguccaagucaaguaacaauguuuccacauauuauaguugacguucgccaacuggaaccaguacuaauuccauuaccagacguaagaaauaauuuuuaucacuauaaccaaucaaaugacucaacaauaaaauuaauugcuauguuauauacaccauuaagggcuaauaaugcaggagacgaugucuuuacagucaguugucguguucuaacuagaccaucuccugacuuugauuuuauauuuuuaguaccaccaacuguugaaucaagaaccaaacccuuuacaguaccaauacuaacagucgaagaaaugacaaacagccguuuuccaauuccauuagaaaaacuauuuacaggcccaucaucagcauuuguaguacaaccacaaaacgguagauguacaacagauggaguacuacuaggaacaacccaauuaucaccuguaucuauauguaccuuuagaggagauguaacacauauuccaggaacaagaauauauagaaugaauuuagcaucucagaacuggaacaauuaugauccaaccgaagaaaucccugcacccuuaggaacaccagacuucguagguaaaauacaaggaauguuaacacaaacaacaaaaggagauggaaguacaagaggucacaaagcuacaguaucaaccgguucuguagauuuuacaccaaaauuaggaucaguacaauuugcaacugauacagacaacgacuuugaaacaggccaaaauacccgcuucacuccaguagguguuauacaagacggaucauccgcucacagaaacgaaccacaacaauggguacuaccugauuacaguggaagaacaguacauaacguacaccuugcaccagccguugcaccaaccuuuccaggagaacaauuauuauuuuuuagaucaacaaugccagguuguuccggauaucccaauauggaccuagauuguuuacucccacaagaauggguacaacacuucuaucaagaagcagcaccuucucaaucagauguugccuuacuacguuuugucaauccugacaccggucgaguucuauucgaaugcaaauuacauaaagcagguuauguuacaguugcucacaccggacaacacgacuuaguuauaccuccaaauggauacuuuagauucgauucuuggguaaaccaauucuauacacuagcaccuaugggaaacggagcuggacgcagaagagcuuuauaa

SEQ ID NO: 31246 - RNA, 1623 nt, Artificial Sequence
  derived and/or modified sequence opt6 from major_capsid_protein_VP1__Norovirus__ADB27027
augaaaauggcauccaacgacgcgaccccaucagaugguucuacugccaacuuaguaccugaaguaaacaaugaagucauggcacuagaaccaguaguaggugccgcaauagcagcaccaguagcuggacaacaaaaugucauagauccauggauaagaaauaauuuuguacaagcaccaggaggagaauucacaguaagcccuagaaaugcaccuggagaaauauuaugguccgcucccuuaggaccagauuuaaacccauacuuaucucauuuagcccgaauguauaauggauacgccggaggauucgaaguacaaguuauacuugcagguaaugcauuuacagccggaaaaauaauauucgcagccguuccaccaaacuuuccaacagaaggucuuucaccaucacaaguaacaauguuuccucauauuauaguagacguucgacaacuagaaccagucuuaauaccacuuccagacguaagaaacaacuucuaccacuauaaccaaucaaaugacccaacaaucaaauuaauagcuauguuguauacuccccuacgagcaaacaaugcaggagacgauguauuuacaguauccugucguguacuaaccagaccauccccagauuucgauuuuauauuucuaguaccaccaacuguagaaucacgaacaaaaccauucucagucccaauacuaaccguagaagaaaugaccaacucacgcuuuccaauuccauuagaaaaauuauuuacuggaccaucuucagcauucguuguacaaccacaaaacggaagauguacaacagacgguguacuacuagguacaacccaauuaagcccaguaaauauaugcacauuccgaggagauguaacacauauugccggcucaagaaauuacacaaugaauuuagcaacacagaauuggaacagcuacgacccaacugaagaaauaccagcaccucuaggaacaccagacuuuguagguaaaauacaaggaguccucacccaaacuacaagagcagacggauccaccagaggacauaaagcaacaguauauacaggaucagcagauuuuuccccaaaauuaggaagaauacaauucgcaacagauacagauaacgauuuugaugcaaaucaaaacaccaaauuuacuccaguaggaguuauacaagauggaaauaccgcacauagaaaugaaccccaacaaugggucuuaccauccuauucaggacguaacucacauaauguacaucucgcaccugccguagcaccuaccuuuccaggagaacaacuccuauucuuucgaucuacaaugccaggaugcucagguuauccuaauauggaucucgacugccuacuaccacaagaauggguacaauauuucuaucaagaagcagcacccgcacaaucagauguagcucuauuaagauuuguaaauccugauacaggacgaguacucuuugaaugcaaacuacacaaaacaggauauguaacaguagcacacacaggacaacacgacuuaguaauaccuccuaacggauauuuucgcuucgauagcuggguaaaccaauuuuauacauuagcuccaaugggaaacggaacaggacguagaagagcauuauaa

SEQ ID NO: 31247 - RNA, 1626 nt, Artificial Sequence
  derived and/or modified sequence opt6 from major_capsid_protein_VP1__Norovirus__AEE10003
augagaaugucagauggagcagcaccaaaagcaaauggaucagaagcaaguggacaagauuuagucccaacagccgucgaacaagcaguaccaauucaaccuguugcuggagccgcacuagcagcuccagcugcuggacaaauaaaucaaauagauccauggauauuccaaaauuuuguacaaugcccauuaggagaauuuucaauaagcccaagaaauacaccaggagaaauacuauuugaucuugcacuuggcccaggauuaaauccauaucuagcucacuuaagcgcuauguauacaggaugggucggaaauauggaaguacaacuaguauuagcaggaaaugcauucacagcaggaaagguuguaguagcacuaguaccaccauauuuuccaaaaggaaguuuaacaacagcucaaauaacauguuucccacacguaaugugugacguuagaacgcuugaaccaauacaauuaccauuacuagauguaagaagaguucuauggcaugcaacacaggaccaagaagaaaguaugagacuaguauguaugcuuuauaccccacuacgaacaaauucaccuggagacgaaagcuuuguaguaagcggacgauuauuaucaaaaccagcagcugacuuuaacuuuguauaccuaacuccaccaauagaacgaacaauauacagaaugguagaucuaccuguuauacaaccacgucuauguacucaugcacgauggccagcuccuguauauggauuauuagucgaucccucauuaccauccaauccacaauggcaaaacggaagaguacgugucgaugguacauuacucggaacgacaccaguaagcggaagcuggguauccuguuucgccgcagaagcugccuaugaauuucaaucaggaacaggagaaguagcaaccuuuacacuaauugaacaagauggauccgccuacguaccaggagauagagcugcaccgcuaggauauccagauuuuucaggacaacuagaaauagaaguacaaacagagacuacaaaaacaggcgauaaauuaaaagucacaacuuuugaaaugguauuaggaccugaaacaaauguagaccaagccccuuaucaagguagagucuacgcaagcguaaacgcagcugcaucauuagaccuaguagaugguagaguacgcgcaguuccaagaucaguauauuccuuccaagauguaauaccugaauauaaugauggacuauuaguuccacuagcaccaccaauuggaccauuucuuccaggggaaguguuacuuagauuuagaacuuauaugagacaaauagacacuacugaugcagcagcagaagcaauagauugugcacuuccacaagaauucauaucaugguuugcaucuaaugcauucacaguacaaucagaagcauuauuacuaagauacagaaauacacuuacaggucaauuguuauuugaauguaaauuauacucggaaggauauauagcauuaucauauucaggaucaggagcacuaacauucccaacagaugguuuuuucgaaguaguaaguuggguuccuagacuauaucaacuagcaucaguaggaucauuagcaacaggaagaacauuaaaacaauga

SEQ ID NO: 31248 - RNA, 1626 nt, Artificial Sequence
  derived and/or modified sequence opt6 from major_capsid_protein_VP1__Norovirus__AEE10006
augagaaugucagauggagcagcaccaaaagcuaaugguucugaagcaucaggacaagaucuaguuccuacagcaguagaacaagcagucccaauucaaccaguagcaggugcagccuuagcugcaccagcagcaggacaaauuaaucaaauagacccauggauauuucaaaauuuuguacaauguccacuaggagaauuuaguauuagcccacgaaauacaccaggcgaaauuuuauuugacuuagcauuagguccaggacuaaauccauauuuagcucaucucucagccauguauacaggauggguaggaaauauggaaguacaauuaguacuagcaggaaaugcauuuacugcaggaaaagucguuguagcauuaguaccuccauauuuuccaaaaggcucccuaacaacugcacaaauaacauguuuuccccauguaaugugugacguuagaaccuuagagccaauucaacuacccuuacuagauguaagacgaguuuuauggcacgcaacacaagaucaagaagaaaguaugagauuagucugcaugcuuuacacaccacuaagaacaaauucuccuggagacgaaucauuugucgucuccggaagacuauuaucaaaaccagcugcagauuuuaauuucguauacuuaacaccuccaauagaacgcacaauuuauagaaugguagaucuaccugugauacaaccaagauuauguacacaugcuagauggccagcuccaguauauggauuauuaguagauccaucccuaccaucaaauccacaauggcaaaauggaagaguaagaguagauggaacucuacuuggaacaacaccaguuucaggaaguuggguaucaugcuucgcagcagaagccgcauaugaauuccaauccggaacuggagaagucgcaacauuuacacuaauagaacaagauggaucagcuuacguaccaggugauagagcugcacccuuagguuauccugauuuuucaggucaauuagaaauagaaguacaaacagaaacaacuaaaacaggagauaaacuaaaaguaacuacauuugaaaugguauuagguccagaaacaaauguagaccaagcuccauaucaaggacgcguuuacgcaucaguaaaugcagcugcaaguuuagauuuaguugauggccgaguacgagccguaccacgauccguauauucauuccaagauguaauaccagaauacaacgacggacuauuaguaccccuagcaccaccuauaggcccuuuucuaccaggcgaaguucuauuaagauuuagaaccuauaugagacaaauagacacaacugaugcugcagcugaagcaaucgacugugcauuaccacaagaauuuauaucuugguuugcuucuaaugcauuuacuguacaaagugaagcacuucucuuaagauauagaaauacacuaaccggacaauuacuauuugaauguaaauuauauucagaaggauacauugcacuaucauauucagguuccggagcacuuacauucccuacugacggcuucuuugaaguaguaucauggguaccaagguuauaucaacucgcaucaguuggaagucuagccacugguagaacauuaaaacaauaa

SEQ ID NO: 31249 - RNA, 1626 nt, Artificial Sequence
  derived and/or modified sequence opt6 from major_capsid_protein_VP1__Norovirus__AEE10009
augagaaugucagauggcgcugcacccaaagccaaugguagcgaagcaaguggacaagaucuaguaccaacagcuguugaacaagcuguaccaauucagccaguagcaggagcagcucuagcagcuccagcagcaggucaaauaaaccaaauagauccuuggauauuucaaaauuuuguacaauguccauuaggugaauuuucaaucucaccaagaaauacaccaggcgaaaucuuauuugauuuagcuuuaggaccaggacuaaauccuuauuuagcacauuuaucagcaauguacacaggauggguaggcaacauggaaguucaauuaguauuagcaggcaaugcauuuacagcaggaaaaguuguuguagcauuaguuccaccuuauuuuccaaaaggaucauugacaacagcucaaauaacauguuuuccacauguaaugugugauguaagaacauuagaaccaauacaauuaccauuacucgauguuagacgaguucuauggcaugcaacucaagaucaagaagaaagcaugcgucuaguuuguauguuauauacaccauuaagaaccaauucuccaggugaugaaucauuuguaguaagugguagauuacuaucaaaaccagcugcugauuuuaauuuuguauauuuaacacccccaauagaaagaacaauauauagaaugguagauuuaccaguaauccaaccccgauuauguacucacgcuagauggccagcuccaguauauggacuacucguugaccccucccuaccaucaaauccucaauggcaaaacggaagaguacgaguugacgguacccuacucggcacaacaccaguuaguggaaguuggguuucauguuuugcagcagaagcagcauaugaauuccaaucugguacaggagaaguagcaacauuuacacuaauagaacaagacggaucugcuuacguaccaggagaucgagcagccccauuagguuaccccgacuuuucaggacaauuagaaauagaaguacaaacagaaacaacaaaaacuggugauaaauuaaaaguuacaacauuugaaaugguuuuaggcccagaaacaaauguugaucaagccccuuaucaaggaagaguuuacgcuucaguuaaugcagcugcuucauuagaucuaguagaugggagaguuagagcaguaccacguucuguuuacucauuucaggauguaauaccugaauauaaugauggauuacuuguaccauuagcaccaccaauaggacccuuuuuaccaggggaagucuuacuacgauucaggacauauaugcgucaaauagauacaacugaugcagccgcagaagcaauagacugugcacugccacaggaauuuauuaguugguuugcaucaaacgcauucacaguacaauccgaagcauuauuacuuagauaucgaaauacauuaacuggacaauuauuauucgaauguaaacuauauucugaagguuauauagcuuugaguuauuccggaucaggugcucuaacauucccaacagauggauuuuuugaaguuguuaguugggucccaagauuauaucaauuagcauccguuggaagcuuagcaacaggaaggacucugaaacaauaa

SEQ ID NO: 31250 - RNA, 1626 nt, Artificial Sequence
  derived and/or modified sequence opt6 from major_capsid_protein_VP1__Norovirus__AEE10015
augagaaugagugacggagccgcaccaaaagcaaaugguucagaagccucuggccaagauuuaguaccaaccgcuguagaacaagcaguuccuauacaaccaguugcuggagccgcauuagcagcaccagcagcaggacaaauaaaucaaauugauccuuggauauuccaaaauuuuguacaguguccacucggugaauuuucaaucucuccaagaaauacaccaggggaaauacuauucgauuuagccuuagguccuggauuaaauccauaucuagcucaucuaucagcaauguauacaggauggguuggaaauauggaaguacaacuaguacuugcaggaaaugcauuuacagcaggcaaaguaguaguugcccuuguaccaccguauuuuccaaaaggcucucuaacaacagcacaaaucacauguuuuccacauguaaugugugauguaagaacacuagaaccaauucaacuacccuuauuagacguaagacgaguacucuggcaugcaacccaagaucaagaagaaaguaugagacucguuuguauguuauacacaccacuuagaaccaauucaccaggcgacgaaucuuucguuguuaguggacguuuacuaucaaaaccagcugcugauuucaauuuuguauauuuaacuccaccaauagaaagaacuauauauagaaugguagauuuaccuguaauacaacccagauuaugcacacacgcaagauggccagcaccaguauauggucuccuaguagauccaucccuaccaaguaauccacaauggcaaaauggacgaguacgaguagaugguacccuauuaggaaccacuccuguuucaggaucuuggguaucauguuuugcugcugaagcugcauaugaauuucaaucaggaaccggagaaguagcaacauuuacacuaauagaacaagauggaucagcauauguaccgggagauagagcagcgccguuagguuauccagauuuuucaggacaauuagaaauagaaguucaaaccgaaacaacuaaaacaggagauaaauuaaaaguaacaacauuugaaaugguacuaggaccagaaacaaaugucgaucaagcaccauaccaaggacgagucuacgcuucugucaaugcagcugcaucacuagauuuaguggauggacguguaagagcuguaccacgauccgucuacaguuuccaagacguaauaccagaauauaaugacggacucuuagucccucuagcuccuccaauaggacccuuccuaccaggagagguauuauuaagauucagaacauauaugagacaaauagauacuacugaugcugcagccgaagcuauagauugcgcacucccacaagaauucguuucuugguuugccucuaaugcuuucacuguucaaucagaagcauuauuacuaagguacagaaauacauuaacaggacaauuacuuuuugaauguaaacuauauagugaaggauauauagcauuaucuuauucaggaucuggagcacuaacuuucccaaccgacgguuuuuuugaaguaguaucuuggguaccaagauuauaucaacuagcaucaguaggaucauuagccacagguagaacauuaaaacaauaa

SEQ ID NO: 31251 - RNA, 1626 nt, Artificial Sequence
  derived and/or modified sequence opt6 from major_capsid_protein_VP1__Norovirus__AEE10018
augagaaugagugauggagcagcaccaaaagcaaacggaagugaagcaucuggacaagacuuaguccccacagcaguugaacaagcaguacccauucaaccuguagcaggugcagcauuagcugcaccagcagcuggacaaauaaaucaaauugauccauggauauuccaaaauuuuguacaaugcccauuaggugaguuuucuauaucaccaagaaauaccccaggcgaaauacuguucgauuuagcccuaggaccagguuuaaauccauacuuagcacauuuaagcgcaauguauacaggauggguaggaaacauggaaguucaacuaguacuagcagguaaugcauucacugcuggaaaaguaguaguagcacuuguaccaccauauuuuccaaaagguaguuuaacuacagcacaaauaacauguuucccucauguuaugugugacguuagaacacuagaaccaauacaauuaccuuuauuagauguaagaagaguauuauggcacgccacacaagaucaagaagaaucuaugagauuaguauguauguuauauacuccacuaagaacgaauucaccaggagaugaaucauucguuguaucaggacgauuauuaucuaaaccagcagcagauuuuaauuucguauauuuaacaccaccaauagaaagaacuauauauagaaugguagaucucccaguaauacaaccacgucuauguacacacgcacgauggcccgcgccaguauauggauuauuaguagauccaucauuacccucaaauccacaauggcaaaauggacggguuagagucgauggaacauuauuagguacaacucccguaucaggcaguuggguaaguuguuuugcugcugaagcagcuuaugaauuucaaucaggcacaggagaaguagcuacauuuacauuaauugaacaagauggaucagcauauguaccuggugauagagcagcaccccuaggcuacccugauuuuucuggacaacuugaaauagaaguacaaaccgaaacgacuaaaacuggagauaaauuaaaaguaacaacauuugaaaugguauuaggaccugaaacaaauguagaccaagcaccauaccagggucguguauaugcuucaguuaacgcagcggcaaguuuagaucuuguagacgguagaguaagagcaguaccaagaucaguuuacucauuccaagauguaauaccagaauauaaugacggccuauuaguacccuuagcuccacccauaggcccauuucuaccaggugaaguacuauuaagauuuagaaccuauaugcgucaaauagauaccacagaugcugcagcagaagcaauagauugugcacuaccucaagaauuuauaucaugguuugcuuccaaugcauuuacaguacaauccgaagcuuuacuucuaagauacaggaacacauuaacaggacaauuacuauucgaauguaaacuauauucagaaggauacauagcacuuaguuauaguggaagcggugcuuuaacauuuccaacagacgguuuuuuugaaguagucucauggguaccccgacuauaucaauuagcaucuguagguucacuugcaacuggacgcacacuaaaacaauaa

SEQ ID NO: 31252 - RNA, 1626 nt, Artificial Sequence
  derived and/or modified sequence opt6 from major_capsid_protein_VP1__Norovirus__AEE10021
augcgaauguccgacggugcagcaccuaaagcaaauggaagugaagcuucaggacaagauuuaguaccaacugcaguagaacaagcuguaccaauacaaccaguagcaggagccgcauuagcugcaccagcugcgggucaaauaaaucaaauugacccauggauauuucaaaacuuuguacaaugcccucuaggagaauuuuccauaucaccaagaaacaccccaggagaaauauuauucgauuuagcucucgguccaggcuuaaacccuuaccuagcacaccucucagcuauguauacuggcuggguaggaaauauggaaguacaauuaguucuugccggaaaugcauuuacugccgguaaagucguugucgcacuuguuccaccauacuuucccaaaggaucauuaacaacugcacaaauaacauguuucccucauguaaugugugauguacgaacccuagaaccgauacaacucccacuuuuagaugucagacgaguucuauggcaugcaacacaagaucaagaagaaucaaugagacucguauguauguuauauacaccucuuagaacaaacucccccggugacgaaagcuuuguaguaucaggaagacuauuaucuaaacccgcugccgacuuuaauuuuguauaccuaacuccaccuauagaaagaaccauauaccgaaugguugaucuaccaguaauucaaccuagauuauguacccacgcacgcuggccagcacccguuuauggauuauuagucgauccaucauuaccaaguaacccccaauggcaaaacgguagaguaagaguagauggaacauuauuaggaacaacaccaguaucugguucauggguguccugcuuugcagccgaagcagcauaugaauuccaauccggaacaggagaaguagcaacauuuaccuugauagaacaagauggaucugcuuauguaccuggagacagagcagccccacuaggauacccagauuuuucaggacaacuugaaauagaaguacaaacagaaacaacaaaaacuggagauaaauuaaaagucacaacauuugaaaugguacuuggcccugaaaccaacgucgaccaagcuccauaucaaggacgaguauaugcuaguguaaaugccgcagcaucauuagaucuaguagacggaagaguaagagcuguaccaagaagcguauauaguuuucaagauguuauaccagaauacaaugauggucuauuaguuccauuagcaccuccaaucggaccuuuuuuaccgggagaaguauuauuacgauuuagaacauauaugagacaaauagauacuacugaugcagcugccgaagcaauagauugcgcuuuaccacaagaauuuguaucaugguuugcaucuaacgcauuuacuguacaaucagaggcauuauuauuaagauauagaaauacauuaacaggacagcuucuauuugaaugcaaacucuauucugaagguuauauagccuuaucauauaguggaucaggugcauuaacauucccaacagauggauucuuugaaguaguaucauggguuccaagacuuuaucaauuagcaucaguaggaucauuagcuacaggaagaacccuaaaacaauaa

SEQ ID NO: 31253 - RNA, 1626 nt, Artificial Sequence
  derived and/or modified sequence opt6 from major_capsid_protein_VP1__Norovirus__AEE10024
augagaaugucagauggcgcagcuccaaaagcaaacggauccgaagcuucaggacaagaucuaguuccuaccgccguugaacaagcgguaccaauacaaccaguagcaggugccgcacuagcagcaccugccgccggucaaauaaaucaaauagacccauggauauuucaaaacuuuguccaaugcccucuaggagaauucucaauuucaccccgaaauacaccuggagaaauacuauuugacuuggcuuuaggaccaggauuaaauccauaucuagcacacuuauccgcaauguauacaggauggguaggaaauauggaaguacaacuagucuuagccggaaacgcauucacugcuggaaaagucguaguagcacuagugcccccauauuucccaaaaggaucauuaacaacagcacaaauaacauguuuuccacauguaaugugugacguaagaacuuuagaaccaauacaauuaccauuauuagauguacgucgaguacuauggcaugccacacaagaucaagaagaaucaaugagguuaguauguauguuauauacuccuuugagaacaaauucucccggagacgaaucauucguaguaucaggacgacuauuaucaaaaccagcagcagauuuuaacuuuguauauuuaacaccaccaauagaaagaacaauauaucgaaugguagacuuaccaguaauucaaccaagauuaugcacucacgcaagauggccagcuccaguauauggacuacuaguagauccuucuuuaccaaguaauccacaauggcaaaauggaagaguacauguagauggaaccuuauuaggaacaacaccaauaucaggaucauggguaucauguuuugcugcugaagcagcguaugaauuccaaucaggaauaggagaaguagcaacuuuuaacuuaauugaacaagaugguucagcuuauacaccaggcgauagggcagcaccccuaggauacccagacuuuucuggccaauuggaaauagaaguacaaacagaaacuacaaaaacaggagauaaacuaaaaguuacaacauucgaaauggcccuuggaccaaaaacaaacguagaucaaacaccauaccaagguagaguuuuugcuucuauaacaguagcagcaucucuagaucuaguagauggaagaguaagagcaguaccaagaucaguauauggcuuucaagauaccauaccagaauauaacgacggacuauuagucccuuuagcaccaccuauuggaccauuuuuacccggcgaaguuuuauuaagauucagaacauacaugcgucaacuagaugcuacugaugccgcagcugaagcuauagauugugcauuaccccaagaauuugucuccugguuugcaucaaacgcauucacuguacaaucagaagcuuuauuacuacgauacagaaauacauuaacaggucaauuauuauuugaauguaaacuauauucagaagguuacauagcuuuaaguuauucaggcucaggaccacuaacauuucccacugauggauuuuucgaaguaguuucaugggucccaagauuauaucaacuagcuucaguuggaucacucgcaacaggacgaacccuaaaacaauaa

SEQ ID NO: 31254 - RNA, 1626 nt, Artificial Sequence
  derived and/or modified sequence opt6 from major_capsid_protein_VP1__Norovirus__AEE10027
augagaaugagugauggagcugcaccaaaagcaaauggaucugaagcaucaggucaagauuuaguaccaacagcuguagaacaagcuguaccaauacaaccaguagcaggugcugccuuagcugcaccagccgcaggccaaauuaaccaaauugauccauggauauuccaaaauuucguucaauguccacuaggugaauuuagcauaucaccaagaaauacccccggagaaauacuuuuugaucuagcacuuggccccggcuuaaauccuuaucuagcucauuuaagugcaauguacacagguuggguaggaaauauggaaguacaauuaguauuagcagggaacgcuuuuaccgcaggaaaaguaguuguugcauuaguaccaccauacuuuccaaaaggaucauuaacaaccgcacaaauaacaugcuuuccacauguuaugugugacgucagaacacuagaaccaauacaacucccauuauuagacguuagaagaguuuuauggcaugcaacacaagaucaagaagaaucaaugcgauuaguuuguaugcucuauaccccauuaagaacaaauucuccaggugacgaaucuuuuguaguaucaggaagacuauuaucaaaaccagcugccgauuuuaauuuugucuauuuaacaccaccuauugaacguacaaucuauagaaugguagaucuuccaguuuuacaaccaagauuauguacucaugcuagauggccagcacccguuuauggauuacucguagacccuucacuaccaucaaauccucaauggcaaaacggaagaguucauguagacggaacacuuuuagguacaacaccaguaucuggaaguugggucagcuguuuugcagcagaagcagccuaugaauuucaaucaggaaccggagaaguagcaaccuuuaccaugauagaacaagacggaucugcauauguuccuggagauagagcagcuccauuaggauauccagacuacaguggacaauuagaaauagaaguacaaacugaaacaacaaaaaccggagacaaauuaagagucacuacauuugaaaugaucuuaggaccaacaacuaauguugaucaagcaccuuaccaaggaaaaguuuacgcaucauuaucaacaucagccucauuaaacuuaguagacgguagagucagagcaguuccuaggagcgucuauagcuuucaagacguuuuacccgaauacaaugauggauuacuagucccuuuagcaccaccucuagguccauuucuaccaggagaaguacucuuaagauucagaacauauaugagacaauuagauacugcagacgcaacagcccaaccaaucgauugugcacucccccaagaauucauaucaugguuugcauccaauaauuuuaccguucaaucagacgcacuacuaauaagauauagaaauacguuaacaggacaacuacuauucgaagccaaacuauauagcgaaggauacauugcagucucauauagcgguagcggaccucuuacauuuccuacagacggcuucuuugaagucguaucauggguaccacgauuauuucaacuggccucagucggaagcuuagccacaggcagaacacuuaaacaauaa

SEQ ID NO: 31255 - RNA, 1608 nt, Artificial Sequence
  derived and/or modified sequence opt6 from major_capsid_protein_VP1__Norovirus__AGI96385
augaaaauggcuucaaacgacgcugcucccuccaacgacggagcugccgguuuaguaccugaaguaaauaaugaaacaauggcauuagaaccuguagcaggcgcuucuauugccgcuccucuaaccggacaaaauaauguuauugacccauggauaagaaugaauuucguacaagcuccuaauggagaauuuacuguuucucccagaaauucacccggagaaguacuuuuaaaucuagaacuuggaccagaacucaauccauuucuagcacaccuuucccgaauguauaauggauaugcuggaggugcugaaguacaaguacuauuagccggaaacgcauucacagcuggcaaacuaguuuuugccgcuaucccaccacauuucccccuagaaaauuuaucaccaggacaaauaacaauguucccacacguaauuauagaugucagaacacuagaacccguucuauuaccauuaccagauguucgaaauaauuuuuuccauuauaaucaacaaccugaacccagaaugcgucuaguagcaauguuauauacaccucuaagaucaaauggaucaggagaugauguauucacaguaucuugucgaguccuaacaagaccaucuccugacuuugauuuuaauuaucuagucccccccacaguagagagcaaaacaaaaccauuuacauuaccuauauuaaccauaggagaacuaucaaauucaagauucccaguacccaucgaugaacuauacacuucaccuaaugaaggcguaauaguacaaccacaaaauggucgauccacauuagacggagaauuauuaggcaccacacaauugguaccuuccaauauaugugcacuaagaggacgaauaaacgcacaaguaccagaugaucaucaucaauggaaucuacaaguuaccaaugcaaauggaacauccuuugacccuacagaagacguuccaacaccuuuaggaacaccagacuuucuagcaaacauuuacgguguaacuucacaaagaaauccagauaauacuugccgagcacacgauggaguuuuagcuacauggagucccaaauuuaccccaaaacuaggaucugucguauuagguacaugggaagaauccgaucuugacuuaaaucaaccaacccgauucacaccaguaggucuauaugauacuaaucauuucgaccaauggauacuaccuaacuauucagguagauuaacucuaaacaugaaccuugcacccucaguagcaccauuauuuccaggugaacaaauauuauuuuucagaucacacauaccuuuaaaaggaggaacauccaauggugccauagauuguuuacuuccacaagaauggauacaacauuucuaucaagaaucagcacccucaccuaccgacguagcauugauacgauacacaaauccugauacaggucgaguacuuuucgaagcuaaauuacaucgucaagguuuuauaacagucgcaaacucaggaucacguccaauaguuguaccaccuaaugguuauuuuagauuugauuccugggucaaucaauucuauucucuugcaccuaugggaacaggaaaugguagaagaagaguacaauaa

SEQ ID NO: 31256 - RNA, 1644 nt, Artificial Sequence
  derived and/or modified sequence opt6 from major_capsid_protein_VP1__Norovirus__AGI96397
augaaaauggcaucuaaugacgcugcaccaucaaaugacggcgcagcaaaucuugucccagaggcaaacaaugaaguuauggcacucgaaccaguaguaggagcuucaauugcagcuccuguuguaggucaacaaaauauaauagacccauggauuagagaaaacuuuguacaagcaccucaaggagaauucacuguuucaccacgcaauucaccaggagagauguuauuaaaucuugaacuuggacccgaacuaaauccuuacuuaucacaccuaucaagaauguauaauggcuacgccggaggaaugcaaguucaaguaguacuugcuggaaaugcauuuacagcgggcaaaauaauauuugcugcagucccuccacacuuuccaguugaaaacaucaacgcagcacaaauaacaauguguccccauguuauaguagauguacgucaauuagaaccaguacuucuaccacuaccagauauucgaaauagauuuuuucauuacaaucaagaaaauacuucaagaaugagauuaguagcaauguuauauacaccucuuagagcaaacucaggagaagauguauuuacaguaucaugucgaguacuaacacgaccagcaccagacuuugaauuuacuuuucuaguuccuccaaccguugaauccaaaacaaaaccuuuuucacuaccuauucuuacauuaggugaauuaucaaacucaagauuuccagcaccuauagauauguuauauacagacccuaacgaaggcauaguuguacaaccacaaaauggaagguguacacuugauggaacacuacaaggaacaacacaacucguacccacacaaauaugcgcauuuagaggaacacuaauaggacaaacaucaagaucccccgauucaacagacucagcaccccgaagacgagaucacccccuacauguacaauuaaaaaacuuagacggaacacaauacgauccaacagaugaaguuccagcaguacuaggagccauagauuucaaaggaacuguuuucgguguugcaucacaacgagacgucucaggucaacaaguaggagcaacacgagcacaugaaguacauauaaauacaacugacccaagauacacaccaaaacuaggaucuauauuaauguauucagaaucagacgauuuuguuacuggacaaccuguacgauuuacaccuauagguaugggugacaaugacuggcaucaaugggaacuuccugauuauccaggacauuuaacacuaaauaugaauuuagcaccagcaguagcacccgcauuuccaggugaacgaauauuauuuuuuagaucaauagucccuucagccggcggauacgguuccggucaaauagauugucuaaucccucaagaauggguacaacacuucuaucaagaagcagcuccaucacaauccgcaguagcacuaauuagauauguaaauccagauacaggacgaaauauauucgaagcuaaauuacaccgggaaggauuuauaacagucgcaaauucuggaaacaauccaauaguaguaccaccaaauggauacuuuagauucgaagccuggguaaaucaauuuuacacacuuacaccaaugggcacuggucaaggaagaagaagagaucaauag

SEQ ID NO: 31257 - RNA, 1608 nt, Artificial Sequence
  derived and/or modified sequence opt6 from major_capsid_protein_VP1__Norovirus__AGI96398
augaaaauggcauccaaugaugccgcaccaucaaacgacggagcagccggacuaguuccugaagucaacaacgaaacaauggcauuagaaccuguggcaggagcaucaauugccgcaccauuaacaggccaaaauaacguaauagauccauggauccgaaugaacuucguacaagcacccaacggagaauuuacagucucaccacguaacucaccaggugaaguacuacuaaauuuagaauuagguccagaauuaaacccauuucuugcucaucuaucacgaauguacaauggauacgcaggaggcguagaaguacaaguucuauuagcagguaacgccuuuacugccggaaaauuagucuuugcagcaaucccuccacacuucccauuagaaaacuuaucuccaggacaaauaaccauguuuccacacguaauaauagauguaagaacccuagaaccaguauuauuaccccuaccagaugucagaaauaacuucuuccauuacaaucaacaaccugaaccacgaaugcgacuaguugcaaugcucuauacaccucuacgaucaaaugguucaggugaugacguauucacaguaucuuguagaguacuaacaagaccauccccagauuuugauuucaauuacuuaguaccuccaacagucgaaagcaaaacaaaaccauucaccuuacccauccucaccauuggagaauuauccaacucuagauuuccaguuccaauagaugaacuauacacaagcccaaaugaaggaguaauaguacaaccacaaaaugguagaucaacacuagauggagaacuauuaggaaccacccaacuuguaccaaguaacauaugugcacuaagaggaagaaucaaugcucaaguaccagacgaccaucaucaauggaacuuacaaguaaccaacgcaaacggaacaagcuuugacccaacagaagacguuccagccccacucgguacaccagauuuuuuagccaauauauauggaguaacaucucaacguaauccagauaauaccugcagagcacacgauggugucuuagcuacaugguccccaaaauucacacccaaauuaggaucagucguacucggcacuugggaagaaagugaccucgaucuaaaccaaccuacucgauucacaccaguuggcuuauacgauacaaaucauuuugaucaauggauacuaccuaacuacagcggaagauuaacucuaaacaugaauuuagcaccaucugucgcaccccuauucccaggagaacaaauauuauucuuuagaagccacauuccacuuaaaggagguaccucaaauggagcaauagacugccuucuaccccaagaauggauacaacacuucuaucaagaaucagcucccucaccaacugacguagcauuaauaagauacacuaauccugacacuggucgaguccuauuugaagcuaaacuacaucgacaaggauuuauaaccguugcuaacucuggcucacgacccauaguaguaccaccaaauggauauuuuagauucgauucauggguaaaucaauuuuauucauuagcaccuaugggaaccggaaacggaagaagacgaguucaauaa

SEQ ID NO: 31258 - RNA, 1608 nt, Artificial Sequence
  derived and/or modified sequence opt6 from major_capsid_protein_VP1__Norovirus__AGI96399
augaaaauggcaucaaacgaugcagcaccuuccaaugacgacgcagcuggacuaguacccgaaguaaacaaugaaacaauggcuuuagaaccaguagcuggagcaucaauagccgcaccucuaacaggacaaaacaacgucauagacccauggauacgaaugaacuuuguucaagcuccaaacggcgaauuuacaguaucacccagaaauucaccuggugaaguauuacuaaaccuagaacuaggaccagaacuaaacccauuccuagcccaccuaucaaggauguauaacgguuacgccggagguguagaaguacaaguacuacuagccggaaaugccuuuaccgcaggaaaauuaguauucgcagcaauaccaccacauuuuccauuagaaaaccuauccccuggacaaauuacuauguuuccucacguaauaauagauguaagaaccuuagaaccaguacuauuaccucuacccgauguacgaaacaauuucuuccacuauaaucaacaaccugaaccaagaaugagacucguagcaauguuguacaccccacuaagaucuaauggauccggagacgauguuuuuacagucagcuguagaguuuuaacacgacccaguccagacuuugacuuuaauuaucucguaccaccaacaguagaauccaaaacaaaaccuuuugcauuaccuaucuuaacaauaggagaacuaucaaauucaagauucccagucccaauagacgaacucuauacaagcccaaacgaaggaguaaucguacaaccccaaaacggaagaucaacucuugauggagaacuccuaggaacaacacaauuaguaccuucaaauauuugcgcacuucgaggaagaauaaacgcucaaguaccugacgaucaucaccaauggaaucuacaaguaacaaacgcaaacggaaccuccuucgauccaacagaagauguuccagccccuuuagggaccccagacuucuuagcuaauauauacgguguaacuucacaaagaaacccagauaacacaugcagagcacaugacggcguacucgcaacauggucuccuaaauucacacccaaacuugguuccguuguccuuggaacuugggaagaauccgacuuagauuuaaaccaaccaacacgauuuacuccaguaggacuauaugacacaaaccauuucgaccaauggauauuaccaaacuauucaggaagacuaacauuaaacaugaauuuagcuccaucaguagcaccccuuuuuccaggagaacaaauacuauuuuuuagaucacauauaccacuuaaaggaggaacaucuaacggagccauugacuguuuauuaccacaagaauggauccaacacuuuuaucaagaaucugcaccaucacuaacagacguggcccuaauacgauacacaaaucccgauacaggaagaguucuauuugaagcaaagcuacauagacaaggauucauaacaguagcaaacucuggaucacgcccaauaguaguucccccaaacggcuacuucagauucgacucaugggucaaucaauucuauucccuagcaccaauggguacaggaaacggaagacguagaguucaauaa

SEQ ID NO: 31259 - RNA, 1617 nt, Artificial Sequence
  derived and/or modified sequence opt6 from major_capsid_protein_VP1__Norovirus__AGJ52175
augauggcaucaaaagaugcaccuaccuccccagacggugcauccggcgcaggucaauuaguaccagaagcaaauaccgcagaacaaauaucaauggaucccguagcaggagcaucuacagcaguagccacagccggacaaguaaauaugauagauccauggaucuucaauaacuuuguucaagcaccucaaggagaauuuacaauaucuccuaauaacacaccaggagauaucuuauuugaccuacaacuaggaccacaucuaaauccauucuuagcucauuuaucacaaauguauaacggaugggucggaaacaugcgaguaagaauccuucuugcuggaaaugcuuuuacugcuggcaaaauaauaaucuguugcguaccuccaggauucgaugcaagaauacuaacuauagcacaagcaacacuauuuccacaccuaaucgcugauguuagaacacuagaaccaguagaacuaccauuagaagaugucagaaacguuuuauaccauaacucaucacaaccacaaccaacuaugcgacuagucgcaauguuauauacaccucuaagaacaggagguggauccggaggaacagaugcuuuuguaguagcaggaagaguccuaacaugcccagcaccagauuucuccuuuuuauuuuuaguccccccuucuguagaacaaaaaacuagaguauuuuccgucccuaauauaccauuaaaagaccuuucuaacucuagaguuccaguaccaauacaaggcauguuuaugucaccagaugucaaucaaucuguacaauuucaaaauggacgaugccaaauagauggacaauuacaaggaacaacacccguaaguuuaucacaacuauguaaaauaagaggaaaaacuucuucuaacgcacgaguccucaacuuaucggaaguagauggaacuccauucauuccauuagaaucuccagcuccuguaggauuuccagaucucggaggaugugauuggcacguaaauuuuuccuuucaaacccaagauagagauccaucacaaucaguaacauuugcaaccaacgacgcaucuuuuguaccauaucuaggaucaguaucaccacauaacggagaaggcuuccaggcaggagacaucauaggaucauuaggcuggauaucagcaccaucagauaauucucaauuuaaugucugggcaauaccaaaauacggaucuucacuacaaauguccccaauacuauuacuauuauguucacccagauuaugggaaguaauauuauauuucuacucaacauuccccggcucaggacaaccaucccaacuacaaguaccaugccuacucccucaagaauuuauuacucacuucuguaaugaacaagcacccauugcaggagaagcugcuuuacuacauuauguagauccagauacuggcagaaacuuaggagaauuuaaacucuauccagacgguuuuaugacauguguaccuaauucagucucuucagguccacaaaccuuaccaaucaacggagucuuugucuucguaucuugggucucuagauucuaccaauuaaaaccaguuggcacugcauccgccgcaagaagacucggauuaagaagaaucuaa

SEQ ID NO: 31260 - RNA, 1641 nt, Artificial Sequence
  derived and/or modified sequence opt6 from major_capsid_protein_VP1__Norovirus__AGX01092
augaugauggcaucaaaagacgcaccacaaagcgcagauggugcaucaggagcaggacaacuaguaccagaaguaaacacagcugauccauuaccaauggaaccuguugcagguccaacuacagcuguugccacagcaggacaaguaaauaugaucgauccuuggauaguaaauaacuuuguacaaucuccccaaggagaauucacaauuucaccaaauaauacacccggagauauucuauucgauuuacaacuuggaccgcacuuaaacccauuucuaucacauuuaucucaaauguacaacggauggguaggaaauaugagaguuagaauacuauuagccggaaaugcauuuuccgcaggaaaaauaauuguaugcuuuguaccaccaggauuuacaucauccucuuuaaccauugcacaagccacauuauuuccacauguaauugccgacguacgcacucucgaaccaauugaaaugccauuagaagauguacgaaacguauuauaccacaccaacgacaaucaaccaacaaugcgucuaguauguauguuauauacaccacuuagaaccggaggaggaucaggaucuuccgacucauucguaguagcaggacgaguacucacagcaccaucaucagauuucucuuuccuuuuucuaguaccuccaacuauugaacagaaaacaagagcauuuacuguuccaaauauaccauuacaaacccuaucuaauucaagauuuccaucuuuaauacaaggaaugauccuuucaccagaugcaucacaaguaguacaauuucaaaauggaagaugucuaauugacggacaauuacuaggaacaacaccagcaacaucaggacaacuauucagaguaagaggaaaaauaaaucaaggugcaagaacauuaaauuuaacagaaguagaugggaaaccauuuauggcuuuugacucaccugccccaguaggcuuuccagacuucggcaaaugcgacuggcauaugcgaauaucaaaaacaccaaauaacaccuccucuggagauccaaugagaaguguaucuguacaaacaaauguacaaggauuuguaccccaccucgguucuauacaauuugaugaaguuuucaaucaucccacuggcgauuauauaggaacaauagaauggaucucacaaccaucuaccccaccugguacugauauaaauuuaugggaaauaccagauuauggaagcucacuaucacaagcagcuaauuuagcaccuccagucuuuccaccaggauucggcgaagcauuaguauauuucgucucagcauucccaggaccaaauaacagaagcgcacccaaugauguaccaugccuacucccacaagaauacauuacacauuucguuucagaacaagcuccuacuaugggcgacgcugcacuucuacauuacguagaccccgacacaaauagaaaccuaggagaauuuaaacuauacccuggaggauaccuuacauguguaccaaauggaguuggagcuggaccccaacaacuuccucuaaaugguguauuuuuauucguaucauggguuucacgcuuuuaucaacuaaaaccuguaggaacugcaucaacagcaagaggacgacuggguguaagaagaauuuaa

SEQ ID NO: 31261 - RNA, 1647 nt, Artificial Sequence
  derived and/or modified sequence opt6 from major_capsid_protein_VP1__Norovirus__AGX01095
augaaaauggcaucaaaugacgccgcuccaucaaaugacggugcagccggacuaguaccagaaauaucaucagaagcuauggcccuagaacccguugcaggagccgcaauugcagcuccacuaacaggacaacagaauauaauagauccauggauuaugaauaauuucguacaagcaccaggaggagaauuuacuguauccccaagaaauagcccuggagaaguacuauuaaauuuagaauuagguccagaaauaaaucccuauuuagcacacuuagcaagaauguacaauggauaugcgggaggauucgaaguucaaguaguucuagccggcaaugcauuuacagcaggaaaaauuauauuugcagcaauaccaccaaauuucccaauugauaaucuaucugcugcucaaauaacaaugugcccacauguuauugucgacguaagacaacuugaaccagucaacuuaccuaugccugauguuagaaauaacuuuuuucauuacaaucaagguuccgacucacgauuaagauuaauagcaauguuauauacaccguuaagagcaaauaauucaggagaugacguauuuacaguaucuugccguguccuaacaagacccucaccugacuuuucuuuuaauuuucuaguacccccaaccguagaaucaaaaacaaaaccauuuagucuaccaauauuaacaauuucagaaauguccaauucaagauucccaguaccaauagacucuuuacacacuuccccaacagagaauauaguaguacaaugccaaaauggaagagucacccuagacggagaauuaaugggaacaacucaauuauuaccaucacaaauaugugcauuucgugguacacuuaccagaucuacaagcagagccagugaccaagcugauacagcaacaccaagacuuuuuaauuacuauuggcauauucaacuagacaauuuaaauggaacucccuacgauccagccgaagauauaccugcaccacucggaacccccgauuucagaggaaaaguauuuggcguugcaucacaacguaauccagaugcuacuacacgagcgcaugaagcuaaaauagauacaacaucaggcagauuuacaccaaaacuaggaucauuagagauaagcacugaaucuggagacuuugaccaaaaucaaccuacucgauucaccccaguaggaaucggaguagaucaugaaccagauuuucaacaaugggcauuaccagauuaugcaggacaauucacucacaauaugaaucuagcaccagcuguagcaccuaauuucccaggugaacaauuauuauuuuuccgaucccaauuaccuagcucaggcggucgaucaaaugguaucuuagauugucuaguaccccaagaauggguacaacacuuuuaucaagaaagcgcaccaagucaaacacaaguagcucuaguuagauacgucaauccugauacaggaagaguauuauuugaagcaaaacuacauaaauuacguuuuaugacaauagcaaaaagcggagauucaccaauaaccguaccuccaaauggauauuucagauuugaaucauggguaaauccauuuuacacauuagcgccaaugggaacaggaaacggacgccgacgaauccaauaa

SEQ ID NO: 31262 - RNA, 1623 nt, Artificial Sequence
  derived and/or modified sequence opt6 from major_capsid_protein_VP1__Norovirus__AGX01098
augaaaauggcauccuccgaugcaaauccaucagacggaucagccgcaaaucuaguacccgaaguuaacaaugaaguaauggcacuagaaccagucguuggagcagcuauagcagcaccagucgcaggucaacaaaacguaauugacccauggauaagaaauaauuucguacaagcacccggaggagaauuuacaguaucaccaagaaaugcuccaggagaaauacucuggucagcuccuuuaggacccgaucuaaauccuuauuuaucacaccuagcaagaauguauaacggcuacgcuggaggauuugaaguucaaguaauauuagcaggaaacgcauuuacagccgguaaaguaauuuuugccgcaguaccaccuaacuucccaacagaaggccuaucucccucacaaguaacuauguuuccacauauuguugucgacguacgacaacuagaaccaguacuaauaccucuuccagacguuagaaauaacuucuaucacuauaaucaaucaaacgaucccacuaucaaauuaauagcaaugcuauauaccccacucagagcuaauaaugcuggagaugauguuuucacaguaucuuguagagucuuaacucgaccaucacccgauuuugacuuuauauucuuaguacccccaacaguagaaucaagaacaaaaccauucucaguaccaguacuaacagucgaagaaaugacaaauucuagauuuccaauaccacucgaaaaacuauuuacaggcccaucuucagcauucguaguacaaccacaaaacggacgauguacaacagauggaguucuacuaggaacaacacaacuaucaccagucaauauauguacauuuagaggagaugucacacacauaacaggauccagaaauuacaccaugaaccuagcaucccaaaauuggaacaauuacgauccaacagaagaaauaccagcuccauuaggcgcaccagauuucguagguaaaauacaaggaguauuaacacaaacaacuagaacugauggcucaacacgaggacacaaagcaacaguauacaccgguucagccgacuucgcaccaaaauuaggaagaguacaauuugaaacagauacagaucacgacuucgaaguaaaucaaaacacaaaauuuacaccaguuggaguaauccaagaugguggaacaacucauagaaacgaaccacagcaauggguacucccaucauauucaggacgcaauacaccaaauguccauuuagcaccagcuguugcaccaacuuuccccggcgaacaacuacucuucuucagaagcacuaugccagguugcucaggauacccgaacauggauuuagauugucuccuaccacaggaauggguacaauauuucuaccaagaagcugccccagcacaaagugacguugcacuauuacgauucguaaaucccgauacaggcagaguauuauucgaaugcaaauuacauaaauccggauauguaacaguagcacauaauggccaacaugacuuaguaauuccccccaacggauauuuccgauucgauucauggguuaaccaauuuuacacacuugcaccgaugggaaacgguacaggacgaagacgugcuuuauaa

SEQ ID NO: 31263 - RNA, 1623 nt, Artificial Sequence
  derived and/or modified sequence opt6 from major_capsid_protein_VP1__Norovirus__AKI30060
augaaaauggccucaaaugaugcagcaccaucaaaugacggugccgcuggacuaguaccagaagguaacaacgaaacucucccauuagaaccagucgccggagcugcaauagcagcuccaguaacaggccaaaauaauaucauagauccauggauaagaacuaacuuuguacaagcaccaaacggagaauucacaguaucuccacguaacuccccuggugaaauacuuuuaaaccucgaacuagguccagacuuaaauccauaucuugcucaccuaaguagaauguacaacggauaugccggaggaguagaaguacaaguacuauuagcuggaaaugcauuuacagcaggaaaaauauuauucgcagcaguuccaccuaacuuuccaguagaauucuuaucaccagcucaaauaacaauguuaccacacuuaaucguagacguaagaacacuagaaccaauaaugauuccacuuccagauguacguaacaccuuuuuucacuacucaaaccagccaaauucaagaaugagauuaguagcaaugcuuuacacuccacuaagaucaaauggaucaggagaugacguauuuaccguuucaugucgcguacuaacacgaccuacaccagacuucgaauucacauauuuaguaccacccuccguagaaucaaaaacaaaaccauuuucacucccuauauuaaccuuaucagaauuaacaaauucaagauuuccaguuccuaucgacucucuauuuacagcucaaaauaacguacuucaaguacaaugucaaaacggcagauguacacuugacggugaacuacaagguacaacacaauuacuaccauccggaauaugugcuuuuagaggacgagucacugcacaaauaaaucaacgcgaucgcuggcacaugcaacuacaaaaccucaauggaacaacauacgauccaacagacgauguaccugcaccccuuggaacaccugauuucaaaggcgucguauuuggcaugguaucacaacgcaauguaggaaaugaugcaccaggaucaacaagagcacaacaagccuggguaucaacauacucaccacaauuuguaccaaaauuaggaucaauaaacuuaagaauaucugacaacgaugauuuucaguuucaaccaacuaaauuuaccccaguaggugucaaugaugacgacgauggucauccauuuagacaaugggaacuaccaaacuauucaggugaauuaacccuaaacaugaauuuagcaccuccaguugccccuaauuuuccaggugaacaacuacuuuucuuucgcuccuuugucccauguaguggcggcuauaaucaaggaauuauagauugcuuaauuccucaagaauggauucaacauuucuaucaagaaucagcaccaucucaaucugacgucgcccuaauaagauacguaaacccagacacagguagaacauuauucgaagcuaaauuacaucguucaggauauauaacugucgcucauucaggagauuauccacuaguuguaccagcaaauggacauuucagauucgauuccuggguuaaucaauucuauucacuagcaccaaugggaacaggaaauggaagaagaagagcccaauaa

SEQ ID NO: 31264 - RNA, 1626 nt, Artificial Sequence
  derived and/or modified sequence opt6 from major_capsid_protein_VP1__Norovirus__BAQ94514
augaaaauggcuagcaaugacgcagcaccuuccaacgacggagcagcuagcuuaguuccagaagcaauaaacgaaacaaugccacuagaaccaguagcaggagccucaauagccgcaccaguagcuggacaaaccaacauaauagacccuuggauacgaacaaacuuuguacaagcuccaaacggcgaauucacuguaucaccaagaaauucacccggagaaauccuacuaaaucuagaacuaggaccagacuuaaauccauacuuaucacaccuuucaagaauguauaacgguuaugccggugguguagaaguacaaguacucuuagcaggaaaugcuuuuacagcaggcaaaauacuauucgcggcuauaccaccuaauuuucccguagauaugaucucucccgcacaaauaacaaugcucccacacuuaauaguggauguaagaacucuagaaccuauaaugauaccauuaccagacguacguaacguuuuuuaucacuuuaacaaucaaccucaaccaagaaugagacuuguugcaauguuguacacuccacuucguucuaauggaucaggugaugaugucuuuaccgucuccuguagaguacuaacaagacccacaccagacuucgaauucuucuauuuaguacccccaucaguugaaucaaaaacaaaaucuuucacauuaccuauacuaacaaucagcgaaaugaccaacucacgauucccaauaccaauagaacaacuauauacagcaccaaacgaaacaaauguaguacaaugccaaaacggacgaugcacauuagacggagaauuacaaggaacaacacaacuucuauccucagcaauaugcucauaucgaggacgaacucuagcuaauaaugauucaugggaucaaaaccuacuacaauuaagcuauccaaauggagcaucauacgacccuacugacgaaguacccgcaccauuaggaacacaagacuucucugguauacuauacggcguucuaacccaagauaauguaacagaaggaacuggagaagcaaaaaacgcaaaagggaucuauauuucaacuacuucaggaaaauuuacaccuaaaauaggaucaauuggauuacauucaauaaccggagacguacaccacaaucaacaaucaagauucacaccaguuggaauagcaguuaaugaaaacacaccauuuaaacaauggguacuuccacauuauucaggaucacuagcucuaaauaccaaucuugcacccgcuguagcaccaacuuuuccuggagaacaauuacuauucuuucguucaagaguaccaugcguacaaggacuacauggacaagacgcauucauugacugccuacuuccucaagaaugggucaaccacuucuaccaagaagcagcuccaagccaaacugauguagcccuaauacgcuuuguaaacccagacacugguagaacacuauuugaagcaaaauuacacagaaguggauucauaacaguuucccacaccgguaauuauccauuaguuauacccccaaacggccauuuuagauuugacucuuggguaaaccaauuuuauucuuuagccccaaugggaacaggaaauggaagacgcagaauacaauaa

SEQ ID NO: 31265 - RNA, 1626 nt, Artificial Sequence
  derived and/or modified sequence opt6 from major_capsid_protein_VP1__Norovirus__BAQ94516
augaaaauggcauccaaugacgcagcacccagcaaugauggagcagcauccuuagucccagaagcaauaaacgaaacaaugccacuagaaccagucgcaggugcauccauagcagcaccaguagcuggucaaacgaauauaauagacccauggauuagaacuaacuucguucaagcaccaaacggugaauucaccguaucaccaagaaauagcccaggugaaauauuacucaacuuagaacucggaccagaccuuaacccauaccuaagccacuuaagcagaauguacaauggauacgccggcggaguagaaguacaaguccuccuagcaggaaaugcauuuacagcuggaaaaauauuauucgcagcaauaccaccaaacuuuccaguugacaugaucucaccagcacaaauaacuaugcuaccucaccucauuguagacguaagaacauuagaacccauaaugauaccauuacccgauguaagaaauguauucuaccauuuuaacaaucaaccacagccaagaaugcgccucguagcgaugcuauacacaccucuucgaaguaacggaucaggagacgacgucuuuacuguaucauguagaguacuaacaagacccacccccgauuuugaauuuuuuuacuuaguaccaccaucaguagaaucuaaaacaaaaccauucacacuaccaauuuuaacuauaucagaaaugacaaacagucgauuuccaauuccaaucgaacaauuauacacagccccuaacgaaacaaacguaguacaaugccaaaauggacguugcacauuagauggagaacugcaaggaacaacacaauuacuuucaucagcaauaugcagcuacagaggacgaacucucgcaaauaacgacucaugggaccaaaaucuacuucaauuaucauauccaaauggugcaaguuaugacccuaccgaugaagucccagcuccauuaggcacacaagacuuuucuggaaucuuauacggcguuuuaacacaagauaacguaacagaagguacaggagaagcaaaaaacgcaaaagguaucuauauaucaacaacuagcgguaaauuuacacccaaaauuggaucaauaggacuccauucuauaaccggagacguacaucauaaucaacaaucaagauuuacuccaguuggaauagcaguaaaugaaaauacaccauuuaagcaaugggucuuaccccauuauucagguucacuagcacuuaauacaaaccuugcuccagccguagcuccaacuuucccaggagaacaauuauuauuuuucagaucaagaguaccauguguacaaggacuucauggacaagacgcauucauugauugcuuauuaccccaagaauggguuaaucauuucuaccaagaagcugcaccaagccaaacagauguagcacuaauaagauuuguaaauccagauacaggaagaacacucuucgaagcaaaauuacaccgaucaggauuuauaacaguaucacauacaggcaacuauccacucguaauaccuccuaacggacauuuuagauuugacucauggguaaaucaauuuuauucauuagcuccaaugggaacaggaaauggcagaagacgaauccaauaa

SEQ ID NO: 31266 - RNA, 1629 nt, Artificial Sequence
  derived and/or modified sequence opt6 from major_capsid_protein_VP1__Norovirus__BAQ94520
augaaaauggcaucaaacgacgcagcucccucuaacgauggagcagcaagccuuguaccagaagccauaaaugaaacaaugccacuagaaccaguugcaggugcaucaaucgcagcacccguagcaggucaaacuaacauaauagaccccuggauaagaacaaacuucguacaagccccaaacggcgaauucacuguuucaccacguaauaguccaggcgaaaucuuacuaaaucuugaauuaggaccagauuuaaauccuuaucuagcacaucucuccagaauguacaauggauaugccggaggaguagaaguacaaguauuacucgcaggcaacgcauuuacagccggaaaaauauuauuugccgcaauaccaccaaauuucccuguagauaugaucucaccugcacaaauuacuaugcuaccacaccuaauaguagauguccgaacauuagaaccaauaaugauuccacucccagacguuagaaacguauucuaucauuucaacaaccaaccacaaccacgcaugagacuaguagccaugcucuauacaccacuaagauccaauggcagcggagaugacguauuuacaguaaguugcagaguacuaacuagacccacaccagauuuugaauucauauaccuaguaccaccaucaguugaauccaaaacaaaaccauucacucuacccauacuaacaauaucagaauuaacaaauucacgauuuccaauaccuauagaacaauuauauacagcacccaacgaaaacaacguaguucaaugucaaaacggacguuguacuuuagacggagaacuacaaggaacaacccaacuuuuaucauccgccguauguucuuaucgaggacgaacaguagccaacuccggagacaauugggaucaaaaccuauuacaacuaacauacccaucaggugcaucauaugacccaaccgaugaaguaccagccccucuaggaacccaagacuucucaggaauacuauacggaguccucacccaagacaacguuucagaaagaacaggagaagccaaaaacgcaaaaggaauauacauaucaacaacaucuggaaaauuuacccccaaaauagguucuauaggacuucauucaauaacagaaaacguucacccaaaucaacaauccagauucacaccuguaggagucgcacaaaaugaaaauacuccuuuccaacaauggguauuaccacacuacgccggagcauuagcauuaaauaccaaucucgcucccgcaguagcaccaacauucccuggagaacaauuauuauuuuucagauccagaguaccuugcguacaaggauuacaaggucaagacgcauucaucgauugucuacuaccacaagaauggguaaaccauuucuaccaagaagcugcccccucacaagcagacguagcacucauaagauacguaaacccugacacaggcagaacacuauuugaagcaaaacuacacagaucuggcuuuaucacaguuucccacacaggagccuacccauuaguagucccaccaaauggacauuucagauucgacucauggguaaaucaauuuuauucacucgcaccaaugggaacaggaaaugguagaagaagaguacaauaa

SEQ ID NO: 31267 - RNA, 1629 nt, Artificial Sequence
  derived and/or modified sequence opt6 from major_capsid_protein_VP1__Norovirus__BAQ94524
augaaaauggccucaaacgacgcagcacccucaaaugacggagcagccucccuaguucccgaagcaauaaacgaaaccaugccacuagaaccuguagcaggugcaagcauagcugcuccaguagcaggacaaacaaauauaaucgauccauggauacgaaccaacuucguucaagcaccaaacggugaauucacaguaucaccacguaacucacccggcgaaauauuauuaaauuuagaacuagguccagaccuaaacccauaccuagcacaccuaucccgaauguauaacggcuacgccggaggaguugaaguacaaguauuauuagcaggcaacgcuuuuacagcagguaaaauacuauuugcagcaauaccuccuaauuucccaguagacaugauuagcccagcccaaauaacaaugcucccucaucuuauuguagauguuagaaccuuagaaccaauaaugauaccauuaccugacguuagaaacguauuuuaucacuucaacaaccaacaccaaccaagaaugagacuaguagcaauguuauacacaccccuaagaucaaauggcuccggagacgauguauuuacagucucaugccgagucuuaacucgaccaacaccagacuuugaauuuauauaccucgucccucccucagucgaaucaaaaacuaaaccauuuacacuuccaauacuaacaauaucugaauuaacaaauucaagauuuccuauaccaauagaacaacuauauacagcaccaaacgaaaauaacguaguacaaugucaaaacggccguuguacacuagacggagaauuacaagguacaacucaacuuuuaucaucagcaguauguucauauagaggccgaaccguagccaauucaggagacaauugggaccaaaaccuauuacaacuuacauacccaucuggagcauccuacgacccuaccgacgaagucccggcaccacuaggcacacaagauuucuccgguauacuauacggaguauuaacacaagacaacguuuccgaaagaacaggagaagcaaaaaaugcaaaagguauauacauaucuacaaccaguggaaaauucacaccuaaaauuggaucaauaggauuacauucaauaacugaaaacguacaccccaaccaacaaucaagauucacaccagugggaguagcacaaaacgaaaauacaccauuccaacaaugggucuuaccacacuacgcaggagcacuagcacuuaauaccaacuuagccccagcaguagcaccaaccuuccccggcgaacaacuacuauuuuucagaucaagaguaccauguguacaaggucuacaaggacaagacgcuuucauugacugucuauuaccacaagaauggguaaaucacuucuaucaagaagcagcucccucccaagccgauguagcuuuaauaagauauguaaacccagauacaggacgaacauuauuugaagccaaauuacauagaucaggauuuauuacaguaucacacacaggagcauacccacucguaguaccuccaaacggucacuucagauucgauucauggguaaaccaauucuauucccuagccccuauggguacuggaaauggaagaagaagaguacaauaa

SEQ ID NO: 31268 - RNA, 1629 nt, Artificial Sequence
  derived and/or modified sequence opt6 from major_capsid_protein_VP1__Norovirus__BAQ94526
augaaaauggcaucuaacgaugcagcaccaucaaaugacggcgcagcauccuuaguacccgaagcaauaaaugaaacaaugccauuagaaccaguagcaggcgccucuauagccgcacccguagcaggucaaacaaauauaauagauccauggauaagaaccaauuucguccaagcaccuaauggugaauucacagugucaccaagaaacucaccuggagaaauacuccuaaaucucgaacuaggaccagaccucaacccauaucuagcacaucuauccagaauguacaacgguuacgccggagguguagaaguacaaguacuacuagcaggcaacgccuuuacagcaggaaaaauauuauucgcagcuauaccucccaauuucccaguugauaugauaucaccagcacaaauaacaaugcuaccacacuuaaucgucgauguuagaacauuagaaccaauaaugaucccucuaccagacgucagaaacguuuuuuaccauuucaacaaucaaccacaaccacgaaugcgucuuguugcaaugcuuuacaccccauuacguucaaacggcucaggagacgauguauucaccgucucaugcagaguauuaacaagaccaacaccagacuuugaauuuaucuaccucguaccuccaucaguugaaucuaaaacaaaaccuuucacauuacccauauuaacaacauccgaacuaacaaacucuagauuuccaauaccaauagaacaacuauauacagcaccaaaugaaaacaacguaguacaaugucaaaauggcagaugcacacuagacggagaauuacaaggcacuacacaauuauuaucaucagcagucugcucauaccgaggaagaaccguugcaaacucaggagauaacugggaucaaaacuuacuucaacuaaccuauccaucuggagcaucauacgauccuacagacgaaguaccagcaccuuuagguacacaagauuucucaggcauacuauauggaguacuaacacaagacaauguaucagaaagaaccggagaagccaaaaaugcaaaaggaauauacauaucaaccacuucagguaaauuuacaccaaaaauaggaucaauaggucuccacucaauuaccgaaaauguucacccuaaucaacaaucacgcuuuacgccaguagguguagcacaaaacgaaaauacaccauuucaacaauggguuuuaccucauuacgcaggagcgcuagcucuaaauacaaaucuugcacccgcuguugcacccacuuucccaggagaacaacuacuauuuuucagaucaagaguucccugcguccaaggucuacaaggacaagaugccuucauagauuguuuauuaccucaagaaugggucaaccauuucuaccaagaagcagcacccagucaagcagauguugccuuaauacguuacguaaauccugacaccggaagaacuuuauuugaagccaaacuccacagaucuggauuuauaacaguuucucauacuggagcauaccccuuaguuguaccacccaaugguuauuuccgauuugacuccuggguaaaccaauucuacucacucgccccaaugggaaccggaaauggaagacgaagaguacaauaa

SEQ ID NO: 31269 - RNA, 1587 nt, Artificial Sequence
  derived and/or modified sequence opt6 from VP1_capsid_protein__Norovirus__ACV89840
augaugauggcauccucagaugcaacaccuccaucugaaggagcuacuaaucuagucccagaaguaaauacacaaguaguuccacuagaaccuguagcaggagcagcagccgcagcacccuuuaccggacaaaauaauguuaucgaccccuggauauuucaaaacuucguacaagcaccacaaggagaauucacagucucaccaagaaauacuccaggagaaauauuauuaagaauaccacuuggaccaaaucuuaacccauuucucgcacaccuuucucguauguauaaugcauggguagguggaauggaagcagaaaugauauuagcugguaaugcuuucacugcagguaaauuauuaauaguagcuuuaccccccgguuuugaagccacucaacucacaccagcucaagcuacagcauuuccacauguaauagccgauguaagaaccuuagaaccaauaccaauuccacuucccgauaucagaaauguacuauuucauuauaauggagauccaacaccaacaauacaaaucguaguuauguuauacacaccccuaagaacaaaugguaauggagacgauguuuuuacaguaucaggaagacuccuaaccagaccagcaccagauuuuuccuucucuuuuuuagucccuccuacuguagaacaaaaaacaagaaguuucacuuuaccuaauuuagcugucucagacuuaucaaauucaagauucccagcucccguaaauauauuaagagcugacccaaacacaacuuuagcuuuagauuaccaaaacggacgauguacucuagauggagcauuacaaggaacaaccccaacaaauucuucuuuuuuaggauauuuaagaggaacagucgauagagucaauuccgaccaaguacauguucauuuaagagaaccaaauggagacccauuccaauuaggacuccccggaccacaaggaguuccugacuacagagcgacauuagauaucuauguagauugggaaaacaaaaaccacggaaaccccugcgaaggcacauuaaacacuggcucccaaaccgaauauacaccaggacuagguacuuuaacuuuuaauaaaacaucaggagacacaccugaacaaggagauccaguaauaaugagacuagucgcauuccguucuaacuuaacagaucaauuacccgcauauaauggagcauuuggacaaggagaaaauuuagcacccccuguaucuccacccguuccaggagaaguauuuuuacaauuugguucacgauacacccgucuaggagaacgugaacucgcaguucaaugucuauuacccucagaauggaucacacauuuuuacucugaagcagcaccaauacaaggagaagccaugcuacuaagauauguacaaccagaucuaggaagaauacuuuuugaagcaaaacuauauaaagaaggauucguaacugucgccggaggaacaaaccccguaacauucccaauagacggaacuuucgucgccguuucuuggguuucaagaaauuucguuuuaucuccaauggguucuggacaaggaagaagaagagcagcacuagcagaauaa

SEQ ID NO: 31270 - RNA, 1587 nt, Artificial Sequence
  derived and/or modified sequence opt6 from VP1_capsid_protein__Norovirus__ACV89843
augaugauggcauccucagacgcaacaccuccuucagaaggugcaacuaaucuaguucccgaaguaaauacacaaguuguaccuuuagaaccaguagcaggagccgcagcagcagcuccuuucacaggacaaaacaauguaauagaucccuggauauuucaaaauuuuguacaagcaccacaaggagaauuuacaguuuccccaagaaauacaccaggagaaauauuacuaagaauuccacuaggaccaaauuuaaaucccuucuuagcacaucuaucuagaauguauaaugcauggguaggaggaauggaagcagaaaugauucuagcaggaaaugcauuuacagcugguaaauuauuaauuguugcucuacccccaggcuucgaagcuacacaacuaacacccgcacaagcaacagcauuuccucaugucaucgcagauguaagaacccuagaaccuauaccaauaccauuacccgacauaagaaauguacuauuucauuauaauggagaucccacaccaacuauacaaauaguuguuauguuauauacaccacuacgaacaaauggaaauggagaugauguauuuacaguuaguggcagacuccuaacaagaccugcuccagacuuuucauuuucauuuuuaguucccccuacaguugaacaaaaaacaaggccuuuuacauuaccuaaucuagcaguaucugaucuaucaaauucaagauuuccagcuccaguaaauauccuaagagcagaccccaauacaaccuuagcauuagacuaucaaaacggaagauguacacuagauggagcacuacaaggcacaacaccaacaaacucuucauuucucggauauuuaaggggcacaguagauagagucaauucugaucaaguacauguucacuuaagagaaccuaauggcgacccauuucaauuaggucuaccaggaccccaaggaguaccagauuaucgagccacauuagauauauaugucgacugggaaaacaaaaaucacggaaaucccugugaagguacacuuaauacagguucacaaaccgaauauacaccugguuuaggaacacuaacuuucaauaaaacaaguggagauacuccagaacaaggagacccuguuauaaugagacuaguagcauuuagaucaaaccuuacagaucaauuaccagcauauaauggagcauuuggacaaggagaaaaucuugcacccccaguuucaccuccaguuccaggagaaguauuucuacaauuugguucuagauacacuagauuaggagaaagagaacuagccguucaaugucuauuacccagugaauggauaacccauuucuauucugaagcugcaccaauucaaggagaagcaauguuauuacguuauguacaaccugaucuaggcagaauuuuauuugaagcaaaauuauauaaagaaggauuuguaaccguagcuggcggaacuaauccuguuaccuuuccaauagaugggacuuuuguagcaguuucauggguaucaagaaauuuuguacuaucaccaaugggaucaggccaaggaagaagacgagcagcacuagcugaauaa

SEQ ID NO: 31271 - RNA, 1767 nt, Artificial Sequence
  derived and/or modified sequence opt6 from VP1_capsid_protein__Norovirus__AFV48046
augagacuacaaugggaagcauggagaucaacauuuccuggaaugcaaccucccugugucggcugugguuuaggacccucacuacuacgaccaagacgaauaguucaaccauaccuacuaaugagaaugucagaugcaguacacagaggaaaugcagcagauacacaaggugcaucugccggcgaagguucaaaccuaguuccaucaacaguagaucaagcuauuccuauccaaccaguugcaggagccgcaauugcugcaccaacagcaggacaaguuaaucaaauagacccauggauaagagaaaauuucguacaauguccauuaggcgaauuuacaguauccccgagaaauacgccaggagaaguauuauucaauuuagcacucggcccaggauuaaauccauaucuaucucaccuugcagccauguauacuggauggguaggaaacauggaaguacaauuaguacuagcugguaaugcauuuacagcaggaaaagucguagucgcacuaauuccaccauauuucaacaugcaaacuuuaacaacaucacaaauaacuuguuuuccacauauaaugugcgauguacgaacucuagaaccaauacuacuuccucuacuagauguucgaagaacauuauggcacccuacaaauagugaagaugauacaaugagguuaguaugcaugcuuuauacaccacuucgaacaaacaguccaggcgaugaaucauucguuguaaguggaagacuauuauccagaccaucuuuggauuuuaauuuucuauaucuaacaccaccaauugcacaaacaccauaugaauuaccaacaguaccacgaauggucccuucagaaaugacacauucaagauggccagcaccaauauaccaaguuguagcagaucccagcuuaguagccaacccucaauggcaaaauggaagaguaacaauugacggacaacuauuaggaacaacaccaauaucaucuacguggguauguucaauugcuggcacagcagauuacagauacauagcagguacagacucauuugaagaaugcaaauuagcauuaucacaaccaaacgguucuccuuuuguaguuggagaugcaccagccccauaugguuauccagauuuuaaugcaacaauaucauuuucguuucaaguagaaacccgacaaaauucagcuuacaguguuagagaauucucacuaaccacaucuucucaaacaauaaaccaaucuccuuacacaggaacaguauauauggauagaucagaaacucaagauuaucaauaucaagaugaucgaauaagaggaguaccacacucuguccaaucauuuaaagaucagcuaccugauuacguugaaucaggucaaccaccaaauuuagcaccuccaaucgguccuuuuaugcccggagaaguauuagucagauuuagaacuuacguaagacaagaagcaaccgccgcauuauaccaagaucaaccaauagacugugcacuaccccaagaauucguaacacaccuagcaacucaugguuauacauuaggaucggacgcacuacucuuaagauauagaaauuuaagaacaggucaacuaaucugugaagcaaaacuauaugcugaaggauuucuugcaauaucauauucaggcacaggaccacuacaauuaccuaccgacgguguauuugaaguaguaucuuggguucaaagauuauaucaacuggcuccuguaggaaccucaacagcaggccgaucacuugguucauaa

SEQ ID NO: 31272 - RNA, 1767 nt, Artificial Sequence
  derived and/or modified sequence opt6 from VP1_capsid_protein__Norovirus__AFV48048
augagacuacaaugggaagcauggagaucaacauuuccagguaugcaaccuccauguguuggcuguggauuagguccaaguuuauuaagaccuagaagaauaguacaaccauaccuccuaaugcgcaugagugacgcaguacauagaggaaacgcagcagauacacaaggagcaucagcgggcgagggcucuaaucuaguaccaucaacuguagaucaagcuauaccuauacaaccaguagcaggagcagccauagcagcaccaacagcagggcaaguuaaccaaauagacccauggauaagagagaacuucguccaauguccauuaggcgaauucacuguauccccacguaauacaccuggagaagugcuuuucaauuuagcuuuagguccuggacuaaauccuuaucuaucucaccuagcagcaauguauacagguugggugggcaauauggaagugcaacuuauacuagcaggcaacgcuuucacagcaggcaaagucguaguagcccuuaucccacccuauuucaauaugcaaacacucacaacaucccaaauuacaugcuuuccacacauuaugugugauguacgcacacuugaaccaauucucuuaccacuauuagauguaagacgaacucuauggcauccuacaaauucagaagaugacacaaugagauuagucuguauguuauauacaccuuuaagaacaaauucaccuggagaugaaucauuuguuguuucagguagacuuuuaucaagaccaucccuugacuuuaauuuuuuauaucucacaccaccuauagcacaaacuccauacgaauuaccaaccguaccaagaaugauaccuucagaaaugacucacucaagauggccugccccuauauaucaaguaguagcagaccccucacuauuagcaaauccccaauggcaaaacggucgaguaacuauagacggucaauuacuaggaacaacaccaaucucuagcacguggguuuguucaauagcaggaaccgcagauuauagauacauuucugguuccgauucuuuugaagaaugcaaauuagcgcuaucacaaccaaauggaucaccauuuguagucggagaugcacccgcacccuaugguuauccagauuucagcgcuacaauaucuuuuucuuuccaaguagaaacacgucaaaacucagcuuacucaguaagagaauuuucauuaacaacaucaucucaaacuauaaaucaaaguccuuacacuggcacugucuauauggaucgaucagaaacacuagauuaccaauaucaagaugacagaaucagaggcguaccacauucaguccacgcguuuagagaucaacuccccgauuacgucgaaaguggucaaccaccuaaucuugcaccucccauaggcccauuuaugccaggagaaguacugcuaagauucagaacauaugucagacaagaagcuacagcagcauuauaccaagaucaaccaauagacugugcacuaccacaagaauuuguaacacaccuugcuacacaugguuauacacuuggaucagacgcacuccuuuuacgauaucgaaauuuaagaacaggucaauuaauaugugaagccaaacucuaugcagaaggauucuuagcaaucucuuauagugguacaggcccauuacaacuuccuauugaugguguauuugaagucguaucuuggguacaaagacuauaucaauuagccccuguuggcacaucaacagcuggcagaaguuuagcaucauaa

SEQ ID NO: 31273 - RNA, 1623 nt, Artificial Sequence
  derived and/or modified sequence opt6 from VP1_capsid_protein__Norovirus__AGH06682
augaugauggccucaaaagaugcaccaacaucuccagacggagccucuggagcaggacaacuaguaccugaagccaacacagcagaacaaauauccauggauccaguagcuggagcauccaccgccguagccacagcaggacaaguaaauaugauugacccuuggauauucaauaacuuuguacaagcaccgcaaggagaauuuacaauuucgccaaacaauacccccggagauauucuuuuugauuuacaauuagguccacaucuaaacccauuccuugcccauuuaagucaaauguauaacgguuggguaggaaauaugcgcguuagaauccuuuuagcuggaaaugcuuuuacugcagguaaaauaauaauauguuguguuccuccugguuuugaugcacguauccuaacaauagcucaggcaacacuauucccacauuugauagcagauguuagaacucuagaaccagucgaacuaccccuugaagaugucagaaauguauuauuucauaacagcagucaaccucaaccuacaaugcgauuaguagccaugcuuuacacaccguuaagaacaggaggaggaucuggaggaacagaugccuuuguaguagcaggaagaguccuaacuugcccagcuccagauuuuucauuuuuauuuuuaguucccccaucaguugaacaaaaaacaagaguuuuuucuguaccaaauaucccacuaaaagaucuaucaaauucaagaguaccaguaccaguacaaggaauguuuaugucuccagauguuaaucaaucaguucaauuucaaaacggccguugucaaaucgacgggcaacuacaaggaacuaccccaguauccuuaucacaauuauguaaaauucgaggaaaaacuucaucaaaugcucgaguuuuaaaucuuucugaaguugauggaacaccuuucauaccauuagaauccccagcuccuguaggcuucccagaucuagguggaugugacuggcauguaaauuuuacauuccaagcccaaaaucaagauccaucucaaucaguaacauucgcuacuaacgaugccucauucgugccguacuuaggcucaauaucaccacacaauggcggcgauuuucaugcaggcgauauaauuggaucauuaggcuggaucucagcaccauccgauaauucacaauuaaauguauggacaauaccaaaauacggaucuucuuuaccagacguaacucaucuugcaccagcuguauucccaccuggauucggugaaguuaucuuauacuucuauucaacauucccaggauccggacaaucgucacaacuacaaguuccaugcuuauuaccucaagaauuuauuacacacuuuugcaacgaacaagcaccuauagcaggugaagcugcauuacuucacuauguagauccagacacaggacgaaaccuaggagaauuuaaacuauauccagauggcuuuaugacuugcguaccaaauucuguaucaucaggaccccaaacauuaccaaucaauggaguauuuguuuuuguaucaugggucucaagauucuaucaauuaaaaccuguaggaacugcaucagcagccagaagacuuggucuaagaagaaucuaa

SEQ ID NO: 31274 - RNA, 1620 nt, Artificial Sequence
  derived and/or modified sequence opt6 from VP1_capsid_protein__Norovirus__AGL98413
augaaaauggcuucaucagaugccaauccaucugauggaagcgccgcaaaucuugucccugaaguuaauaacgaaguaauggcacuagaaccaguaguuggagcagcaauagcugcacccgucgcaggacaacaaaacauaauagauccuuggauuagaaacaauuuuguacaagcuccaggaggcgaauucacugucucaccucgaaaugcacccggugaaauauuauggucagcaccacuaggaccagaccuaaacccauaucuaagucaucucucuagaauguauaauggcuacgcaggaggauucgaaguacaagucauauuagcuggaaaugccuuuacagccggaaaaguaauauucgcagcagucccaccaaauuucccaacagaagguuuaucuccuucacaaguaacaauguucccacauauaauuguagauguaagacaauuagaaccuguacuaauuccacuaccagauguaagaaauaauuucuaccacuauaaccaagcacacgauucaacauuaaaauuaauagcaauguuauacacaccauuacgugcaaacaaugcaggagaugauguuuuuaccguaucaugucgaguauuaacacgaccaucacccgauuuugauuuuauauucuuagucccuccaaccguagaaucaagaacaaaaccauucacaguaccaauacuaacaguagaagaaaugucaaacuccagauucccaauaccacuagaaaaacuauauacaggaccauccucagccuuuguaguucaaccucaaaauggcagauguacaacagacggaguauuauuaggaaccacccaauuaucagcaguaaauaucugcaauuuuagaggagacguaacuagaguugguacaucacacgacuacacaaugaaucuaguaucucaaaauuggaauaauuaugacccuacagaagaaauaccagcuccauuaggcaccccugacuuuguaggaaaaauacaaggacuacuuacccaaaccacaagagcagauggcucaacaagagcucacaaagcaacaguaucuacaggaucaguacauuucacaccaaaacucggaagcguacaauucacaacugacacagacaaugacuuccaaaccggacaaaauacaaaauucacucccguagguguaauacaagauggugaccaucaccaaaaugaaccacaacaauggguacuaccaaauuauucaggcacaucuggacauaacgugcaucuugcaccagcuguagcuccagcauuucccggagaacaauuacuauuuuuuagaucaaccaugccaggaugcucuggauaccccaauaugaaccucgauugcuuauuaccacaagaaugggucuuacacuucuaccaagaagcagcuccagcucagucagacguagcauuacuacgauuuguaaacccagauacagguagaguauuauuugaaugcaaauuacauaaaucaggauacauaacaguugcacacaccgguccauacgaccucgucauuccaccaaacggauacuucagauucgacucuuggguaaaccaauucuacacacuagcacccaugggaaacggaaccggacgccgaagagcacuuuaa

SEQ ID NO: 31275 - RNA, 1620 nt, Artificial Sequence
  derived and/or modified sequence opt6 from VP1_capsid_protein__Norovirus__AGL98414
augaaaauggcuucaucugaugcaaacccuuccgauggaucuucugcaaaucuagucccagaagucaauaaugaaguaauggcccucgaaccaguaguuggagccgcuauugcagcacccguugcaggccaacaaaacauaauagacccauggauaagaaauaacuuuguacaagcaccagguggagaauucacaguauccccuagaaacgcaccaggagaaaucuuauggucagcuccauuaucuccagaccucaaccccuaucuaucacauuuaucacgaauguauaacggauaugcuggaggauucgaaguacaaguaauacuagcaggaaaugcauucaccgcaggaaaaauaguauuugcugcaguaccuccaaacuucccaacugaaggccucucaccaagucaaguaaccauguuuccccacauaauaguagacguacgccaauuagaaccagucuuaauaccucuaccagacguacgcaacaacuucuaccacuacaaccaagccaaugacucaacuuuaaaauuaauagccauguuauauacaccauuaagagcaaauaacgcaggagacgacguauucacuguaucaugcagagucuuaaccagacccucaccagauuucgacuuuaucuuucucguuccuccaacaguagaaucaagaaccaaaccauucacaguaccaguacuuacaguagaagaaaugaccaauucaagauucccuauuccauuagaacgacuuuuuacuggacccucuacagcauuuguaguacaaccccaaaauggaagaugcacaacagaugguguauuacucggcacaacucaauuaucagcagucaacauaugcaacuuucgaggagaaguaaaccacauagcaggcacccacgacuacacaaugagacuaacaucucaaaauuggaauaauuaugauccuacagaagaaaucccugcaccucuuggcacaccagauuuugucggcagaauucaaggaguacucacacaaacaacaagauccgacggaucaacacguucacacaaagccacagucucaacaggcucaguacauuuuacaccaaaacuuggauccguccaauuuacaacagacacuacaaaugaccuaaacgccggacaaaauacaaaauucacuccaguaggaguagaacaaacaucaggagaccaucaaucagaaccucaacaauggacuuuaccaaacuacucuggaacccccaaccacaacguccacuuagccccagcuguagcuccaacuuucccaggagaacaacuucuauucuuuagaucaacucuaccaggaugcggaggcuacccaaauaugaauuuagauugccuauuaccacaagaauggguacuacauuuuuaccaagaagcagcaccagcacaaucugacguagcauuacucagauucguaaacccagauacaggaagaguauuauuugaaugcaaauuacacagaucaggauucaucacaguagcucacucaggcucucaugacuuaguaauaccaccaaacgguuauuucagauuugacucaugggucaaccaauucuacacacuugcuccaaugggaaacggaucaggaagaagaagaguugucuaa

SEQ ID NO: 31276 - RNA, 1617 nt, Artificial Sequence
  derived and/or modified sequence opt6 from VP1_capsid_protein__Norovirus__AGL98416
augaaaauggcauccaacgaugcaaauccaagcgauggcagcgcugcaaacuuaguaccugaaguaaacaacgaaguuauggcacuagaaccuguugucggugcggcgauagcagcaccagucgcuggacaacaaaauguuauagauccauggauaagaaauaauuucguacaagcuccuggaggagaauuuacaguaucuccacguaacgcaccaggugaaauacucuggucaaugccauuaucaccagaacuaaauccuuaucuaucucaucuaagcagaauguauaacggcuaugccggaggauuugaaguacaaguuauacuugcuggaaaugcauuuaccgcaggaaaaauaauauuugcagcuauuccuccaaauuuuccuacugauggucuaucaccuucacaaguaacaauguucccucauauaauaguagacguucgucaacuagaaccuguucuaauaccacuaccugauguaagaaauaauuuuuaucacuauaaccaagcaaacgacucaaccuuaaaauuaauagcaaugcuuuacacaccacuaagagcuaauaaugcaggagacgacguauuuaccguaucaugccguguacuuacacgaccuuccccagacuucgauuuuauauuuuuaguaccaccaacaguagaauccagaacaaaaccauuuacuguucccauauuaacaguagacgaaaugacaaacucaagauuccccacaccacuagaaaaauuacauacaggucccaauaauucaauaguuguacaaccgcaaaauggaagauguacaauugacggaguccuccuuggaacaacacaauuaaguacgguuaauauaugcaacuuuagaggaaguacgacaagagccggacaaucacaugcauauaccaugaaucuaguaucucaaaauuggaacaauuacgauccaacagaagaaaucccagcaccacuaggaacacccgauuuuguaggcaaaauaguaggaauguuaucacaaacuacaagagaaaauucauccacaagagcacacaaagcaaccguaucaacuggugaugcacacuuuacuccuaaaucaggaucaguacuauucacaacagauacagaugacuuacaaaauggucaaaauacaagauucacuccaguaggaguugcacaagauggagaaccacaccaaaacgaaccucaacaauggagacucccaaacuacucaggaaccccaggacauaauguacaccuagcaccucccguagcaccaacauuuccaggagaacaacuacuuuucuucagaucaacaaugccagguugcggagguuauccaaacauggauuuagauugucuacuaccacaagaauggguucgucauuucuaucaagaagcagccccagcucaaucagauguugcauuauuaagauuuguaaauccagacacaggaagaguacuuuucgaaugcaaacuacacaaagcaggauauauaacaguaucucauacuggaccauaugaccuaguuauaccaccuaauggauauuuucgauuugacucaugggucaaucaauucuacgcacucgcuccaauggggacaggaacaggcagacgcagagcccuauaa

SEQ ID NO: 31277 - RNA, 1629 nt, Artificial Sequence
  derived and/or modified sequence opt6 from VP1,_capsid_protein__Norovirus__BAL60749
augaaaauggcaucaaaugaugcagcaccaucaaccgauggugcagcaggucuaguacccgaaucaaauaaugaaguaauggcccuagaaccaguagcaggagcagcucuagcagcaccaguaacaggucaaacaaauauaauagauccuuggauucgcgccaacuuuguacaagcaccuaacggagaauuuacaguaucuccccguaaugcuccuggagaagucuuacuaucauuagaauuagguccagaacuaaauccauacuuagcucauuuagcuagaauguauaauggauaugcaggaggaauggaaguccaaguaaugcuugcugguaacgcauucacagcaggaaaauuaguauuugcagcaguaccaccacauuuuccaguagaaaauuuaucaccccaacaaauaacaauguuuccacauguuauaaucgacguacgaacauuggaaccaguucuacuaccacuuccagacguaagaaauaacuuuuuucauuacaaucaaaaagaugauccaaaaaugagaauaguugcaaugcuguauacaccacuuagaucaaauggcuccggcgaugacguauucacaguuaguugcagaguuuuaacucgcccaaguccugauuuugauuucacuuacuuaguuccaccaaccguugaauccaaaacaaaaccuuuuacccuaccaauauuaacauuaggagaauuaucaaauucuagauucccagucucuauugaccaaauguauacaucacccaaugaaguaauaaguguacaaugccaaaauggacgaugcacacucgacggugaacuacaaggaaccacucaacuucaagucucaggcauuugugcauuuaaaggagaaguaacagcacauuuacacgauaacgaucaccuauauaauguaacaaucacaaaucuuaaugguucaccauuugacccaucagaagauguaccagcaccccucgguguacccgauuuucaaggaagaguauuuggcguaauuucacaacgagauaaacaaaacgcagcuggacacaaugaaccagcuaauagaggacaugaugcaguaguaccaaccuauacugcucaauauacaccaaaauuaggucaaguacaaauaggaaccuggcaaacagaugacuuacaaguaaaucaacccgucaaauuuacuccaguuggauuaaaugacacagaacacuucaaucaauggguaguaccacgauaugcaggugcccuaaaccuaaacacuaaucuugcaccaucaguugcaccaguuuuuccaggagaaagauuacuuuuuuuucgaucauauauaccacuuaaagguggauauggaaacccagcuauagauugucuauuaccucaagaauggguacaacauuuuuaucaagaagcagcacccucaauguccgaaguagcauuaguucgauacauaaaucccgacaccggaagagcauuauucgaagccaaauuacacagagcagguuucaugacaguaucuucaaacacaagcgcaccaguaguagugccugcaaaugguuacuuccgcuucgauuccuggguuaaucaauuuuacucucuagcacccaugggaacuggcaauggaagaagaagaguacaauaa

SEQ ID NO: 31278 - RNA, 1629 nt, Artificial Sequence
  derived and/or modified sequence opt6 from VP1,_capsid_protein__Norovirus__BAL60753
augaaaauggcaucuaaugaugcagcaccaucaaccgacggugcagcagguuuaguuccagaaucuaauaaugaaguaauggcauuagaacccguugccggugccgccuuagcagcaccaguaacaggacaaacaaauauuauagauccauggauaagagcaaacuuuguacaagcaccaaacggagaauuuacaguuuccccucguaaugcaccaggagaaguacuauuaaaucuugaauuaggaccugaauuaaauccauaucuagcacaucuagcaagaauguauaauggauacgcaggagguauggaaguacaaguaaugcuagcagggaaugcauuuaccgccggaaaauuaguauuugcagccguaccaccacacuuuccuguagaaaauuuaucaccacaacaaauaacuauguucccacauguaauaauagauguaagaacucuagaacccguauuacuaccucuuccagauguaagaaacaauuucuuccacuauaaccaaaaagacgauccaaaaaugagaaucgucgccauguuauauacaccacuaagaucuaacggaagcggagacgacguauuuacuguuucuuguagaguacuaaccagaccuucccccgacuucgauuucacauauuuaguaccaccaacuguugaaagcaaaacuaaaccuuuuacacuaccuauuuuaacauuaggagaauuaucaaauucaagauuuccuguuucaauagaucaaauguauacaucaccaaaugaaguuauaucaguacaaugccaaaacgguagaugcacauuagacggcgaacuccaaggaacaacacaauuacaaguaucaggcaucugugcauuuaaaggugaaguuacugcacacuuacacgacaaugaucacuuauacaacguaacuauuacaaaccuaaacgguucaccauucgaucccucugaagauauaccagcaccacuuggagucccugacuuucaaggacgaguauuuggaguuauuucucaaagagauaaacauaauucaccaggacauaaugaaccagcuaaucgaggucacgaugcaguugucccaaccuauacaucucaauauacacccaaauuaggacaaauucaaaucgguacauggcaaacugacgauuuaacuguaaaccaaccugucaaauuuacaccaguaggauuaaaugauacugaacauuuuaaccaauggguaguaccacgcuaugcaggugcauuaaauuuaaacacaaaccuagcaccaucaguugcucccgucuucccaggcgaaagauuauuauucuuccgcucuuauauuccauuaaaaggaggauaugguaauccugccauagacugucuucuaccacaagaauggguacaacauuuuuaucaagaagcugccccaucuauguccgaaguggcauuaguuagauauauaaaccccgacacuggaagagcacuauucgaagcaaaacuacauagagcagguuucaugacuguaagcuccaauacuucggcaccuguaguaguaccagcaaaugguuauuucagauucgauucguggguaaaucaauucuacucucuugcaccaaugggaacuggaaacgguagaagaagaguucaauaa

SEQ ID NO: 31279 - RNA, 1629 nt, Artificial Sequence
  derived and/or modified sequence opt6 from VP1,_capsid_protein__Norovirus__BAL60755
augaaaauggcaucaaaugaugcagcaccaucaaccgacggcgcagcugguuuaguccccgaaaguaacaacgaaguuauggcuuuagaaccuguagcaggugcagcuuuagcagccccaguaacaggacaaacaaacauaauugacccuuggauacgagcaaauuucguacaagcaccaaauggcgaauuuacuguaucaccaagaaaugcacccggagaaguacuucuaaaccuagaacugggcccagaacuaaauccauaucuagcacaccucgcuagaauguauaauggauacgcuggaggaauggaaguacaaguuaugcuugcuggaaacgcuuuuacugcaggaaaauuaguauuugccgcaguaccaccacauuuuccaguagaaaauuuaagcccacaacaaauaacaauguucccucaugucauaauagauguaagaaccuuagaacccguccuauuaccauuaccagacguaagaaauaacuucuuucauuauaaucaaaaagaugaccccaaaaugagaauuguagcaauguuauacacaccauuaagauccaauggaucaggagaugacguauuuacaguuuccugucgaguacucacaagaccaucacccgauuuugauuuuacguaccuaguaccaccaacaguagaaaguaaaacaaaaccuuucacacuaccaauacuuacacucggagaauuaucuaacucaagauuucccguaucaauagaccaaauguauacaucaccuaaugaaguaauaucaguucaaugucaaaacgguagauguacccuugacggagaacuacaaggaacaacacaauuacaagucucuggaauaugugcuuucaaaggagaaguaaccgcacaucuacacgauaaugaucacuuauauaauguuacuauaaccaaucuaaauggcuccccauucgauccauccgaagacauacccgcaccauuaggcguaccagauuuucaaggaagaguauucggcgucauaucccaaagagauaaacauaauuccccuggacacaaugaaccagcgaauaggggucaugaugcaguuguaccaacauacacuucacaauauacaccaaaauuaggacaaauacaaauuggaacauggcaaacagaugaucuaaccguaaaccaaccaguaaaauucacuccaguaggacuaaaugauacagaacauuuuaaccaauggguaguaccaagauacgcaggagcauuaaaccucaacacaaacuuagcacccucagucgccccaguauuuccaggagaaagauuacucuuuuuuagaucauauauaccauuaaaaggaggauauggcaacccugcuauagauugccuacuaccacaagaauggguacaacacuucuaccaagaagccgcaccaucaaugucugaagucgcacuuguccgauauauaaauccagauaccggaagagcauuauucgaagcaaaauuacaucgagccgguuuuaugacaguauccucaaauacaucagcaccaguaguaguccccgcaaauggauacuuuagauuugauucauggguuaaccaauuuuauagcuuagcacccaugggcacaggaaauggacgaagaagaguacaauaa

SEQ ID NO: 31280 - RNA, 1629 nt, Artificial Sequence
  derived and/or modified sequence opt6 from VP1,_capsid_protein__Norovirus__BAL60759
augaaaauggcuucuaacgacgcugcacccaguacagauggagcugcaggauuaguaccugaaucaaauaaugaaguaauggcuuuagaaccaguugcaggugcugcucucgccgcaccaguaacaggucaaacaaauauaauagauccauggauacgugcaaacuucguacaagcaccuaauggugaauuuacaguaucaccuagaaaugcuccaggagaaguauuauuaucacuugaacuuggaccagaauuaaauccuuacuuagcacaucuagccagaauguacaacggacaugcaggaggaauggaaguacagguuaugcuagcaggaaaugcauucacagcuggcaaacucguauucgcagcugucccaccacacuucccagucgaaaaucuaucaccacaacaaauaacaauguuuccucacguaauaauagauguacguacacuagaaccagucuuacucccucucccugaugucagaaauaacuuuuuucauuacaaucaaaaagacgacccaaaaaugcgcauaguagcaauguuauauacaccucuacguucaaauggaucaggagacgauguauuuacagucucauguagaguauuaacuagaccaucucccgauuucgauuuuacauacuuaguaccccccacaguagaaucaaaaacaaaaccauuuacacucccaauauuaacccuaggagaacuauccaauucuagauuuccuguuucuauagaucaaauguauacaucuccaaacgaaguaauauccguccaaugucaaaauggaagauguacauuagacggcgaauuacaagguacuacucaacuacaaguuuccggcauuugugcuuuuaaaggagaaguuacagcucaucuacaugacaacgaccaucuauauaauguaacuauaacaaaucuaaacggaucaccauucgauccaucagaagacguaccagcuccuuuaggaguaccagauuuucaagguagaguauuuggaguaauaucucaacgagacaaacaaaaugcugcaggacauaacgaaccagcuaacagaggacaugaugccguaguaccuacauauacagcacaauauacaccaaaauuaggacaaguacaaauaggaacauggcaaacagaugacuuacaaguaaaccaaccaguaaaauuuacaccaguugguuuaaaugacacagaacacuuuaaccaauggguaguaccacguuaugcuggagcauuaaaccuaaauacaaaucuagcaccuaguguugcaccaguauuuccaggagaaagacuccuauuuuuucguucauacauuccacuaaaaggaggauauggcaaccccgcaauagauuguuuacuaccucaagaauggguacaacauuuuuaccaggaagcugcuccaagcaugagugaaguugcauuaguacgauacaucaaucccgauaccggaagagcacuauuugaagcaaaauugcaucgagcaggcuucaugacaguaucuucaaacacuucugcaccuguaguaguaccugcaaaugguuacuuucgauucgacucauggguuaaccaauuuuacucauuagcaccaaugggcacaggaaauggcagaagacgaguacaauaa

SEQ ID NO: 31281 - RNA, 1629 nt, Artificial Sequence
  derived and/or modified sequence opt6 from VP1,_capsid_protein__Norovirus__BAL60767
augaaaauggcaagcaacgaugcagcaccaucaacagacggugcagcagguuuaguuccagaaaguaauaaugaaguaauggcacuagaaccaguagcaggagcagcauuagcugcuccuguuacuggccaaacaaauauaauugauccauggauaagagccaauuuuguucaagcaccaaauggagaauucaccguaucuccaagaaaugcaccaggcgaaguccuauuaaauuuagaacuaggucccgaauuaaauccauauuuagcccacuuagccagaauguacaauggauaugcaggaggaauggaaguucaaguuauguuagcaggaaaugcauuuacugcuggaaaacuugucuucgcagcaguaccaccacauuuuccaauugaaaaccuauccccccaacaaauaacaauguuuccacacguaauaauagacguacgcacuuuagaaccaguauuauuaccauuacccgauguaagaaauaauuuuuuucacuacaaccaaaaagaugauccuaaaaugcggauaguagcaaugcuauacacaccacuaagaucuaaugguucaggagacgacguuuucacaguauccugucguguacuaacaagaccaucuccugacuuugacuuuaccuaccuaguaccccccacaguagaaucaaaaacaaaaccauucacacuccccauauuaaccuuaggcgaacuaucaaauucacgauucccuguaucaauagaucagauguacacaucuccaaacgaaguuauaucaguccaaugccaaaauggaagauguacauuggauggagaacuucaagguacaacucaauuacaaguaucaggaauaugcgcauuuaaaggagaaguuacagcacauuuacaugacaaugaucaucuauacaauauaaccauaacaaaccuaaauggaucaccauuugauccaagugaagauauaccugcaccacuagguaugccugauuuucaaggaagaguauuugguauaauaucucaaagagacagacacaauucaccuggacauaaugaaccagcaaauagaggucacgaugcagucguccccacauauacagcacaauacacuccaaaacuaggucaaauucaaauuggaacauggcaaacagacgaucuaacaguaucacaaccuguaaaguuuacucccguaggacuaaaugauacagaacauuucaaccaaugggucguaccacgcuacgcaggagcauuaaaucuuaauacaaaccuagcacccuccguagcaccaguauuuccaggagaacgauuauuauucuuucgaucauauauaccuuuaaaaggaggcuacggaaauccugcaauagauugccucuuaccucaagaguggguucaacauuucuaccaagaagcagcuccuagcaugucugaaguugcuuuaguaagauauauaaauccugacacaggaagagcauuauucgaagcaaaauuacauagagccggauucaugacaguaagcaguaauacaucagcaccuguuguaguuccagcuaacggauauuuccgauucgauucuuggguaaaucaauucuacucauuagcaccuaugggaacaggaaauggccguagaagaguacaauaa

SEQ ID NO: 31282 - RNA, 1629 nt, Artificial Sequence
  derived and/or modified sequence opt6 from VP1,_capsid_protein__Norovirus__BAL60769
augaaaauggcuucuaacgacgccguaccaucaacagacggagccgccggauuaguaccagaaucgaacaaugaaguuauggcauuagaaccaguugcuggugccgcacuagccgcaccaguaacuggacaaacuaacauaauugacccauggauuagagcaaacuuuguacaagcuccaaacggagaauuuacagucucaccucgaaacagcccaggcgaaguauuacuaaauuuagaauuagguccagaauuaaauccauauuuagcacacuuagccagaauguauaacgguuacgccgguggaauggaaguccaaguaauguuagcaggaaacgcauuuacagcaggcaaauuaguauucgcugcaguaccaccucacuuuccaguagaaaaucuaucaccucaacaaauaacuauguuuccacacguaauuauugauguaagaacacuagaaccugucuuacuucccuuacccgauguaagaaauaauuucuuucacuacaaucaaaaagacgauccuaaaaugcguauaguagcaauguuauacacacccuuaagauccaacggauccggagacgauguuuucacaguuucuugcagaguccuaacaagacccucuccagacuuugacuucacauauuuagucccaccuacaguugaaucaaaaacaaaaccauucacacuuccuauacuaacacuaggagaacucucuaauucuagauucccaguaagcauugaccaaauguauacaucaccaaaugaagucauaucuguacaaugccaaaacggcagauguacauuagacggugaacuucaagguacaacucaauuacaaguaagcggaauaugcgcauuuaaaggagaaguaaccgcucacuuacacgacaaugaacaucuauauaacguaacaauaacaaaucuuaacggaagcccauuugaucccuccgaagacauaccagcuccauuaggaguuccugacuuucaagguagaguuuucggaguaauaucacaacgcgauaaacauaacacaccaggacacaaugaacccgcaaaccgagcacacgaugcaguaguaccuacauacaccgcucaauauacaccaaaacuaggacaaguacaaaucggcacauggcaaacagacgaucuaacugacaaucaaccaguaaaauucacaccaguaggauuaaaugauacugaacacuuuaaccaauggguaguaccacgcuaugcaggugcauuaaaccuuaauacaaauuuagccccaucuguagcaccaguuuuuccaggcgaaagacuauuauucuuucgaucuuacaucccccuaaaaggagguuauggcacacccgcaauagauuguuuauuaccacaagaauggguucaacacuuuuaccaagaagccgcccccuccaugucagaaguagcccuuguaagauacauuaacccugacacuggcagagcauuauucgaagcaaaacuucauagagcagguuucaugacuguuuccucaaauacauccgcaccuguaguagucccagccaauggauacuuuagauuugacucuuggguuaaccaauuuuacucacuagcaccuaugggaaccggaaauggacguagaaggauacaauaa

SEQ ID NO: 31283 - RNA, 1629 nt, Artificial Sequence
  derived and/or modified sequence opt6 from VP1,_capsid_protein__Norovirus__BAL60771
augaaaauggcuucaaaugaugcugcaccaucuacagauggagcagcuggccuaguacccgaaucuaacaacgaaguaauggcauuagaacccguagcaggagcagcacuugccgcaccaguaacaggccaaacuaauauaauagacccauggauaagagcaaauuuuguacaagcaccaaacggagaauucacaguaucaccucguaacgccccuggagaaguauuacuaaaccuagaacuaggacccgaacuaaaucccuaccuagcacaucucgcuagaauguacaacggauaugcaggagguauggaaguacaagucaugcuagcaggaaacgccuuuacagcaggcaaacuaguauuugcagcaguaccaccacacuuuccuguagaaaaucucucaccacaacaaauuacaauguuuccucauguaauuauagacguaagaacauuagaaccuguccuacuaccucuaccagacguacgaaauaacuuuuuccauuauaaccaaaaagaugacccaaaaaugagaauuguugcaaugcuauacacaccacuucgaucaaacggaucaggagacgauguauuuacaguauccuguagaguacucacuagacccucuccagacuuugauuuuacuuaucuaguuccaccaacaguagaaucuaaaacaaaaccauucacacuaccaauacuaacacucggagaauuauccaacagcagauuuccaguauccauagaccaaauguauacaucacccaacgaaguaauaucuguacaaugucaaaacgguagauguacacucgacggugaauuacaaggaacuacccagcuacagguaucagguauaugcgccuuuaaaggugaaguaacagcacacuuacacgauaaugaucacuuauauaauauaacuauaacaaaccuuaaugguuccccuuuugauccaagugaagauauaccagcaccauuaggagucccugauuuucaaggcagaguauuuggaauaauaucacaaagagacaaacacaacucuccaggacacaacgaaccagccaauagaggacaugaugccguuguaccaacauauacagcacaauacacaccaaaacuaggacaaauccaaauaggaacauggcaaacagacgaccuaacaguuucacaaccaguuaaauucacaccugucggauuaaaugacaccgaacauuuuaaucaauggguaguuccaagauaugcaggcgcacuaaacuuaaauacaaauuuagcaccaagcguugcaccaguauuucccggcgaaagauuauuauucuuucgaucuuauauaccacuaaaagguggauauggaaauccagcaauagauugccuuuuaccccaagaauggguacaacacuuuuaucaagaagcagcucccucaaugucagaaguagcacuaguaagauauauuaauccagauacuggaagggcacuuuucgaagccaaauuacaccgugcagguuuuaugacaguaucauccaacacaucagcaccaguagucguacccgcaaacggauauuuccgauucgauuccugggucaaucaauuuuauucacuugcacccaugggaacaggaaauggacguagacgaguucaauaa

SEQ ID NO: 31284 - RNA, 1629 nt, Artificial Sequence
  derived and/or modified sequence opt6 from VP1,_capsid_protein__Norovirus__BAL60773
augaaaauggcuucaaaugaugcagcaccaucaaccgauggugcugcaggauuaguuccagaaucaaacaacgaaguuauggcauuagaaccaguagcaggagcagccuuagcagccccuguaacaggucaaacaaauauaaucgauccauggauaagagccaauuucguccaagcaccuaacggagaauucacaguaagcccacgcaaugccccaggagaaguacuacuaaaucuagaacucgguccagaacuaaacccauauuuagcacacuuagcaagaauguacaacgguuacgcuggcggcauggaaguacaaguaauguuagccggaaacgcauuuacagcaggaaaauuaguuuucgcagcaguaccaccacauuucccugucgaaaacuuaucuccacaacaaauuacaauguucccacaugucauaauugacguucguacauuagaaccaguauuacucccccuaccagauguacguaauaauuuuuuccacuauaaucaaaaagaugauccaaaaaugcgaauagucgcaauguuauacacaccauuaagaucaaacggauccggagaugaugucuuuacaguuuccuguagaguacuaacaagaccaucaccugacuucgacuuuacauauuuaguaccaccaacagucgaaucaaaaacaaaacccuuuacacuaccaauacuaacuuuaggugaacuaucaaauucacgauuccccguaucaauagaccaaauguacaccucacccaaugaaguaauaucaguacaaugccaaaauggaagauguacacuagauggagaacuacaaggaacaacacaacuucaaguaucugguauaugcgcauuuaaaggcgaagucacagcacaucuucacgauaacgaucauuuauauaaugucaccauuacuaaccuaaauggaucaccauucgacccuucagaagauauacccgcaccacuagguguaccagacuuucaaggccgaguauucggaauaauaagccaaagagauaaacauaauucaccuggacacaacgaaccagcaaacagaggccacgacgcaguaguaccaaccuauacagcccaauauacaccaaaacuaggucaaauacaaaucggaaccuggcaaacagaugaucuaacaguaaaucaacccguuaaauuuacaccaguaggacuaaacgauaccgaacacuucaaucaauggguaguuccacgauaugcaggagccuuaaaccucaauacaaaccuagcacccucaguagcuccaguauuccccggugaaagauuauuauucuucagaucauauauacccuuaaaaggaggauacggcaaucccgcaauagauuguuuauuaccacaagaauggguccaacauuucuaucaagaagcagcaccaucuaugagugaagucgcauuaguaagauauauaaacccugauacaggacgugcauuauucgaagccaaacuacauagagcaggauuuaugaccgugucauccaauacauccgcacccguaguaguaccugcaaauggauauuuucgauucgauuccugggucaaucaauuuuauucacuagcaccuaugggaaccggaaauggaagacgacgaguacaauaa

SEQ ID NO: 31285 - RNA, 1629 nt, Artificial Sequence
  derived and/or modified sequence opt6 from VP1,_capsid_protein__Norovirus__BAL60775
augaaaauggcaucuaacgaugccgccccaucaacugacggagcagcaggauuaguacccgaaucuaacaacgaaguuauggcucuagaaccuguagcaggagcugcauuagccgcaccaguaacaggacaaacaaauaucauagacccuuggauaagagccaacuuuguccaagccccuaauggugaauucacuguuucacccagaaacgcuccaggagaaguauuacuaaacuuagagcuuggaccagaauuaaauccauaccuagcacauuuagcacgaauguauaacggcuacgccggagguauggaaguucaaguaauguuagcaggaaaugcauuuacugcugggaaauuagucuuugcugcuguaccaccacacuuuccaauagaaaaccuaucuccucaacaaauaaccauguuuccacauguaauaauagauguuagaacucuagaaccuguucuacuuccacuaccagauguaagaaacaauuucuuucacuauaaucaaaaagaugacccaaaaaugcgaauaguagccaugcuauacacaccauuaagauccaaugguucaggagacgacguauuuacaguuuccugucgaguuuuaacuagaccuucaccagauuuugacuuuacauauuuaguaccacccaccguagaaucaaaaacaaaaccauuuacguuacccauacuaacauuaggagaacuaagcaacuccagauucccagucucaauugaccaaauguauacaucaccuaaugaaguuauaucuguucaaugccagaauggaagauguacacuagacggcgaauuacaaggaacaacacaauuacaaguauccggaaucugcgcauucaaaggugaaguaacagcacacuuacaugauaaugaucacuuauacaauauuacaauaacaaaccuuaaugguucuccuuuugauccuucagaagauaucccagcaccauuaggaguaccagauuuccaaggaagaguauucggaauaauaucacaaagggauaaacacaacucaccaggacacaaugaaccagccaauagaggacacgaugcagucguaccaacauauacugcccaauacaccccuaaacuuggacaaauacaaaucgguacauggcaaacggaugauuuaacaguaucacaaccugucaaauuuacuccaguaggccuaaaugauacagaacauuuuaaucaauggguaguaccucguuaugcaggugcauuaaaccuuaauacaaaccuugcccccucaguugcaccuguauuuccaggugaaagacuauuauuuuuuagaucauauauuccucuaaaaggcggauauggaaauccugcaauagauugucuacuuccucaagaauggguucaacauuucuaccaagaagcagcaccaagcaugucugagguagcccucguacgauacaucaauccagauacuggacgagcacucuuugaagcuaaauuacaucgagcaggauucaugacagucuccucaaacacuucugccccagucguaguaccagcaaacggauauuucagauucgauagcuggguaaaucaauucuacucuuuagcaccaaugggaaccggaaauggacgaagacgaguucaauag

SEQ ID NO: 31286 - RNA, 1629 nt, Artificial Sequence
  derived and/or modified sequence opt6 from VP1,_capsid_protein__Norovirus__BAL60777
augaaaauggcauccaacgacgcugcuccaaguacagacggagcagcaggauuaguaccugaaucaaacaacgaaguaauggcucuugaaccaguagcaggagcagcccuagcugcaccuguaacuggacaaacuaauauaauagaccccuggauuagagccaacuuuguacaagcuccaaacggagaauucacaguaucuccacgaaaugcaccaggagaagucuuacuaaaucucgaacucggaccagaauuaaauccauaucuagcacaucuagcaagaauguacaaugguuaugccggcggaauggaaguacaaguaauguuagcaggaaaugcauucacagcaggaaaacuaguuuucgcagccgucccuccacacuucccaauagaaaaucuaucaccacaacaaauaacaauguucccccauguaauaauagauguucguacacuagaaccuguacuccuaccacuaccagacguaagaaauaacuucuuucauuauaaucaaaaagacgacccuaaaaugagaauaguagcaauguuauacacaccuuuaagauccaauggaucaggagaugauguauucacaguaucaugccgaguacucacaagaccuucuccagacuuugacuuuacauauuuaguaccaccuaccguugaaucaaaaacaaaaccauucaccuuacccauccuaacacuaggagaauuauccaacucaagauuucccgucucaauagaccaaauguacacaucaccaaaugaaguaauaucaguacaaugccaaaauggacgauguacacuagauggagaacuacaagguacaacacaacuacaagucucaggaaucugcgcauucaaaggcgaaguaacagcucaccuucacgacaacgaccaccuuuauaauauaaccauaaccaaccuaaacggaucaccauucgauccaucugaagacauaccagcaccccuaggcguaccagacuuccaaggucguguuuuugguauaauaucucaaagagacaaacauaacucacccggucacaacgaaccagcaaaucgcggacaugaugcuguaguuccaacauacacugcacaauauacacccaaguuaggacaaauucaaaucggaaccuggcaaacugacgacuugacaguaucccaacccguaaaauucacaccaguaggacuaaaugauacugaacacuuuaaucaauggguaguaccaagauacgccggugcacuaaaucuaaacacaaauuuagcaccaucugucgcacccguauuuccaggagaaagauuauuauucuucagaucauauauuccucuaaaaggaggauauggcaaccccgcuauagacuguuuacuuccccaagaauggguacaacacuuuuaucaagaagcagcaccaucaaugucugaaguagcauuaguaagauacauaaauccagacacaggaagagcacuauuugaagcaaaacuucaccgcgcaggauuuaugacuguaucuucaaacacuucagcacccguaguaguaccagccaauggauauuuuagauuugauucauggguaaaccaauuuuauucauuagcacccauggguacaggcaauggcagaagaagaguacaauaa

SEQ ID NO: 31287 - RNA, 1629 nt, Artificial Sequence
  derived and/or modified sequence opt6 from VP1,_capsid_protein__Norovirus__BAL60779
augaaaauggcaucuaaugacgccgcaccuucaaccgauggcgcagcuggcuuaguaccagaaucuaacaaugaaguaauggcacuagaaccagucgcaggagcagcccuagcagcacccguaacuggccaaaccaauaucauugacccauggauucgagcaaacuucguacaagcuccuaacggagaauucacaguaucaccaagaaaugccccuggagaaguacuacuaaaccucgaacuaggccccgaauuaaacccauaucuagcacacuuagcuagaauguacaacggauaugcaggaggaauggaaguccaaguaaugcuagcaggcaaugcauucacagcaggaaaauuaguauucgcugcaguaccaccucauuuuccaauagaaaaucucucaccccaacaaauuaccauguuuccccacguuauaauagacguuagaacacuugaaccaguauuacuaccacuaccagacguaagaaauaauuucuuucacuauaaucaaaaagaugauccaaaaaugagaauaguagcaaugcuauauacacccuuaagaucaaaugggucaggugacgauguauuuacaguaagcuguagaguacuaaccagaccaucuccagacuuugacuuuacauaucuuguaccccccacaguagaaucaaaaacuaaacccuuuacacucccaauacuaacucuuggagaacucucaaacucuagauuuccuguaucaaucgaucaaauguauacaucaccaaaugaaguaauaucaguccaaugucaaaacggaagauguacauuagauggagaacuucaagguacaacucaauuacaaguuagcggaauaugugcuuuuaaaggugaagucacagcucacuuacacgacaaugaucauuuauacaauauuacuauaacuaaucuaaauggaucuccauucgacccaucagaagacaucccagccccucuagguguuccugacuuucaaggaagaguauucggaauaauaucacaaagagacaaacauaacucaccaggacauaacgaaccagcaaauagaggacaugaugcaguaguaccaacauacaccgcacaauauacuccaaaacuaggacaaauacaaauaggaaccuggcaaaccgacgaucuaacaguaucucaacccguaaaauucacaccaguaggacuaaaugauacagaacacuuuaaccaauggguaguacccagauacgcaggugcacuaaacuuaaacacaaauuuagcuccaucaguagcuccagucuuuccaggagaaagauuauuauuuuuucgaucauauauaccucucaaaggaggauacggaaacccugcaaucgacuguuugcucccccaagaauggguacaacauuucuaucaagaagcagcaccaucaaugucagaaguagcauuaguccgauauauaaauccagauacaggaagagcgcuuuuugaagcaaaacuacaucgagcaggauuuaugacuguaucaucaaacacaucagcacccguaguaguaccugcaaacggauauuuucgcuucgauuccuggguaaaucaauuuuacucacuagcuccaaugggcaccggcaauggaagaagaagaguucaauaa

SEQ ID NO: 31288 - RNA, 1629 nt, Artificial Sequence
  derived and/or modified sequence opt6 from VP1,_capsid_protein__Norovirus__BAL60781
augaaaauggcuucaaaugaugcagcaccaagcacagacggugcagcgggcuuagucccugaaucaaacaaugaaguaauggcucuagaaccaguugcaggagcagcauuagcagcaccaguaacaggccaaacaaauauaauugauccauggauaagagccaacuuuguacaagcacccaauggugaauuuacaguaucaccaagaaaugcaccaggcgaaguauuauuaaaucuagaacuaggucccgaacuuaauccuuauuuagcacacuuagcaagaauguauaauggauaugcuggagguauggaaguacaaguuauguuagcaggaaaugcauuuacagcaggcaaauuagucuucgcugcaguaccuccccacuuuccaguagaaaacuuaucaccacaacaaauaacaauguuuccacauguaauaauugauguaagaaccuuagaacccguacuauuaccacuaccagauguacgaaacaacuucuuccauuauaaucaaaaagaugacccuaaaaugagaauagucgccaugcuuuacaccccauuacguucaaaugguaguggugacgauguauuuacaguaucauguagagucuuaacucgcccauccccagacuucgacuucacauauuuaguaccaccuacaguagaaucaaaaacuaaaccauuuacauuacccauauuaacauuaggagaacuaucaaacucaagauuuccaguuuccauagaccaaauguacacaucaccaaacgaaguaauauccguacaaugucaaaaugguagaugcacuuuagauggugaauuacaaggaacaacucaacuccaaguaucaggaauuugugcauucaaaggagaaguaacagcucacuuacacgauaacgaccaccuuuacaacguaacaauaacaaaccuaaacggaucaccauucgauccaucagaagauauucccgcuccucuaggaguaccagacuuucaaggacgaguuuuuggcauagucucucaaagagacaaacacaacucaccuggucacaaugaaccagcaaauagaggacaugaugcaguuguccccacauacacagcacaauacaccccuaaacuuggacaaauacaaauaggaacuuggcaaacagacgauuuaacuguaaaucaacccguaaaauuuacaccaguuggacuaaacgauauagaacauuucaaccaauggguuguaccacgauaugcuggugcauuaaaccuuaauaccaacuuagcaccuucuguagcaccuguuuuuccaggagaaagacuauuauuuuuuagaucauacauuccauuaaaaggaggauauggaaacccagcaauagacuguuuauuaccccaagaauggguucaacacuuuuaucaagaagcagcaccuaguaugucagaaguugcacuuguaagauauauaaacccagacacaggaagagcacuauucgaagccaaacuacaucgagcaggcuuuaugacaguaucuucaaacaccucugccccuguuguuguaccagccaauggcuauuucagauuugacuccuggguaaaucaauuuuauucauuagcaccuaugggaacaggaaacggcagaagaagaguccaauaa

SEQ ID NO: 31289 - RNA, 1629 nt, Artificial Sequence
  derived and/or modified sequence opt6 from VP1,_capsid_protein__Norovirus__BAL60783
augaaaauggcaucuaaugacgcagcaccaucaacagacggagcagcaggcuuaguaccagaaucaaauaaugaaguaauggcuuuagaacccguagcaggagcagccuuagcagcaccuguaacagggcaaacaaauauaauagacccauggauaagggcaaauuucguacaagcaccuaacggagaauucacagucucaccaagaaauaguccaggagaaguauuauuaaaucuagaauuaggaccagaauuaaauccauauuuagcacaucucgccagaauguauaacgguuacgcaggcggaauggaaguacaaguaaugcuagccggaaaugccuuuacugcaggaaaauuaguauucgcagccguucccccacacuuuccagucgaaaaucuaucaccacaacaaauuacaauguucccacauguaauuauugacguacgaacguuagaaccaguauuauuaccacuaccugauguacgaaacaacuuuuuccauuauaaucaaaaagaugaccccaaaaugagaauaguagcuaugcucuacacgccauuacgauccaacgguagcggagacgauguuuuuacaguaucauguagaguucuaacaagaccaucaccugauuucgacuuuacauaucuugucccaccaacaguagaaucaaaaacaaaaccauuuacauuaccaauuuuaacauuaggcgaacuaucaaauucccgauuuccugucucaauagaccaaauguauacaagcccaaaugaaguuauauccguacaaugccaaaauggaagauguacauuagauggagaacuucaaggaacaacucagcuacaaguauccggaauaugugcauuuaaaggugaaguaaccgcucaucuacaugauaacgaacaccuauacaacguaacuauaauaaacuuaaauggcucacccuucgaucccagugaagauauaccugcaccacuagguguaccagauuuccaaggacgaguauucggaguaauuucucaaagagacaaacauaauaccccaggacacaacgaaccugcuaauagagcucacgaugcaguaguacccacauauacagcacaauauaccccaaaauuaggacaaauacaaauagguaccuggcaaacagaugauuuaacuaauaaccaaccaguaaaauucacaccaguaggacucaaugauacagaacacuuugaccaaugggucguaccuagauacgcaggugcauuaaaucucaauacaaaccuugcacccucaguagcaccuguuuuuccaggagaacgauuacuauucuuccguucauacauaccauuaaaaggaggauauggaacccccgcaauagauugccuuuuaccccaggaauggguacaacauuuuuaucaagaagcagcaccaaguaugagugaaguugcacuuguucgauauauaaaucccgauacaggccgagcccuauucgaagcaaaacuacauagagcaggauuuaugacaguuuccaguaauacaucagcaccaguuguaguaccagcaaacggauacuucagauucgauuccuggguaaaucaauuuuauucacuagccccaaugggaacuggaaauggcagacgaagaauccaauaa

SEQ ID NO: 31290 - RNA, 1629 nt, Artificial Sequence
  derived and/or modified sequence opt6 from VP1,_capsid_protein__Norovirus__BAL60785
augaaaauggcaucgaaugacgcagcaccuucaacugauggagcagcaggauugguaccagaaucuaauaacgaaguaauggcauuagaaccuguagcaggcgcugcacuagcugcacccguaacaggccaaacuaauauuauagauccuuggauacgagccaacuuuguacaagcaccaaacggagaauuuacuguauccccuagaaaugcaccaggagaaguauuacuaaaucucgaacuuggaccagaauuaaauccauaucucgcucaucuagcaaggauguauaacgguuacgcagguggaauggaaguccaaguuaugcuagcaggaaaugcuuucaccgcaggaaaauuaguuuucgcugcaguaccaccucacuuuccaaucgaaaauuuaucaccacaacaaauaacaauguuuccucaugucauaaucgacguaagaacacuagaaccaguauuacuaccauuaccagauguaagaaauaauuuuuuucauuauaaucaaaaagacgauccaaaaaugagaaucguagcuauguuauauacaccacuaagaucaaaugguucaggagaugauguauuuaccguaucaugucgaguacuaacaagacccucacccgauuuugauuuuacauaucuaguacccccaacagucgaaagcaaaacgaaaccauuuacauugccaauauuaacauuaggugaauuaucaaacucuagauuuccggucucaauagaucaaauguacacuucaccuaaugaaguaauauccguacaaugucaaaauggaagauguacacuagauggcgaauuacaagguacaacucaauuacaaguauccggaaucugcgcauuuaaaggagaaguaacagcucacuuacacgauaacgaccaccuauauaacgucaccaucacaaaucuaaauggaucaccuuuugauccaagcgaagacauaccagcacccuuaggaguaccugauuuucaaggacgcguauuugguauuauaucgcaaagagacaaacauaauucgccaggccaaaaugaaccagcaaauagaggacaugaugcagucguaccaacauauacagcccaauauacaccaaaacuuggacaaauccaaauaggaacauggcaaacagaugaucuaacaguaucccaaccaguuaaauuuaccccaguaggauuaaaugacacagaacauuucaaucaaugggugguuccucgauaugcaggagcuuuaaaucuuaauacuaaucucgcaccuuccguagccccaguauucccaggcgaaagacucuuauucuuucgaucauacauaccucuaaaaggagguuacggaaacccagcaauugacugucuacuuccucaagaauggguacaacacuuuuaucaagaagcagcuccaucuaugucagaagucgcacuuguaagauacauaaacccugauacuggcagagcucuauuugaagcuaaacuacaucgagcaggauucaugacuguaucuaguaacacaucagcaccagucguuguaccagccaauggauacuuuagauuugacucuuggguaaaccaauuuuacucuuuggcuccaauggguacagguaacggacgaagaagaguucaauaa

SEQ ID NO: 31291 - RNA, 1629 nt, Artificial Sequence
  derived and/or modified sequence opt6 from VP1,_capsid_protein__Norovirus__BAL60791
augaaaauggcaucaaaugacgcugcacccaguacugacggggcagcaggacuaguaccagaaucuaauaacgaaguaauggcauuagaaccaguugcaggagcagcauuagcugcacccguaacaggacaaacaaauauaauugacccauggauacgagcaaacuuuguccaagcaccuaauggagaauuuacagucucaccuagaaaugcaccuggcgaaguccuauuaaaucuagaauuaggaccagaacucaacccauaccuagcacacuuagcccguauguacaauggauacgccggcggaauggagguucaaguuaugcuagcaggaaaugcauuuacagcuggaaaacuaguauucgcugcaguaccaccucacuuuccuauagaaaaccuaucaccacaacaaauaacaauguucccacacguaaucauagacguaagaacacuagaaccaguucuacuuccauuaccugauguaagaaauaacuucuuucauuauaaccaaaaagacgauccaaaaaugagaauaguagcaaugcuuuacacaccacuaagaucaaauggauccggagacgauguuuuuacugucucaugccgaguacuaacaagaccaucccccgacuuugacuuuaccuaccuaguaccaccuacaguagaaagcaaaacaaaaccuuucacacuaccaauacuaacucuaggagaacuaucuaacucaagauucccaguaucaaucgaccaaauguacacaucacccaaugaaguaauaucaguacaaugucaaaacggacgauguacauuagacggagaacuacaaggcacaacucaacuccaaguuucaggaaucugugcauuuaaaggagaagucaccgcccaucuccaugacaacgaucauuuauacaauauaacuauaacaaaucuuaaugguaguccauuugauccaucagaagacauaccagcgccucuaggaguuccugacuuccaaggcagaguauuuggaauaauaucacaaagagacaaacauaacucaccuggacauaaugaacccgccaauagaggacacgacgcaguagucccaacauacacagcacaauauacaccuaaauuaggucaaauacaaauuggaaccuggcaaacagacgaucucacaguaucccaaccaguuaaauuuacaccaguaggucuaaacgauaccgaacacuuuaaccaauggguaguaccuagauaugccggcgcauuaaaccuuaacacaaaucuagcaccaucaguagcaccuguuuuucccggagaaagauuacuuuucuuucgaucauacaucccacucaaaggaggauacggaaaucccgcaauugacugcuuacuuccacaagaauggguacaacacuuuuaucaagaagcagcuccauccaugucugaaguagcacucguuagauauauaaauccugacacaggaagagcacucuucgaagcaaaacuacauagagcaggauucaugacuguaucaucaaauacauccgcaccaguuguaguaccugcaaauggauauuuccgauuugauucauggguuaaccaauuuuacucacuugcacccaugggaacuggaaacgguagaagacgaguacaauaa

SEQ ID NO: 31292 - RNA, 1629 nt, Artificial Sequence
  derived and/or modified sequence opt6 from VP1,_capsid_protein__Norovirus__BAL60793
augaaaauggcaucuaaugaugcugcaccaucuacagauggagcagcaggauuaguuccugaauccaacaacgaaguuauggcucuagaaccaguagcaggugcagcacuggcugcaccaguuacaggacaaacaaauauaauagacccuuggauacgagcaaacuuuguacaagcccccaacggagaauuuacagucucaccaagaaaugccccaggagaaguauuauuaaaccuagaauuagguccagaacuaaauccauaccuagcacaccuggcaagaauguauaacggauacgccggaggcauggaaguacaaguaauguuagcaggaaacgcauuuaccgccggaaaacuaguuuucgcugcgguaccaccacacuuuccaauagaaaaucuaucuccacaacaaauaaccauguucccacauguaauaauagacgucagaacauuagaaccaguucuacuaccacuaccagauguacgaaauaauuucuuucauuacaaucaaaaagacgaccccaaaaugcgaauaguagcaauguuauacacgccacuacgcucaaacggauccggcgacgauguauuuacuguaucaugucguguauuaacacgaccauccccugacuuugacuucacauauuuagucccaccaacaguagaaaguaaaaccaaaccauucacacuaccaauacuaaccuuaggcgaacuauccaacucacgauuuccuguauccauagaccaaauguauacaucuccaaaugaaguaauaucuguacaaugccaaaaugguagauguacacuagauggagaauuacaagguacaacccaacuacaaguaucaggaauaugugcauuuaaaggagaaguaaccgcucauuuacacgauaaugaucaucucuacaauauuacaaucacuaauuuaaacggaucacccuucgauccaucagaagauaucccugcuccauuaggaguaccagacuuucaaggaagaguauucggcauaauaucccaacgagauaaacauaacuccccaggacacaacgaacccgcaaauagaggacacgaugcuguuguaccuaccuauacugcccaauacacuccaaaacuuggacaaauacaaauagguacauggcaaacagaugacuuaacaguaucucaaccaguaaaauucaccccaguugguuuaaaugauacagaacauuuuaaucaaugggucguaccaagauacgcaggcgcauuaaauuuaaauacaaaucuugcaccuuccguugcaccaguuuuuccaggugaaagauuauuauuuuuucgaucauacauaccauuaaaaggaggauacggaaauccugcaauagacugccuacuuccucaagaauggguucaacacuuuuaucaagaagcagcacccuccaugucugaaguagcacuaguuagauauauaaacccugacacuggacgagcacucuuugaagcaaaauuacauagagcuggauucaugacaguuucuucuaacacaucagcaccaguagucguacccgcaaacggcuauuuuagauuugacucauggguuaaccaauucuauucauuagcacccaugggaacugguaauggcagacgcagaguacaauaa

SEQ ID NO: 31293 - RNA, 1629 nt, Artificial Sequence
  derived and/or modified sequence opt6 from VP1,_capsid_protein__Norovirus__BAL60795
augaaaauggcuucaaaugacgcagcccccucaacagacggugccgcuggcuuaguaccagaaucaaauaaugaaguaauggcacuagaaccaguagcaggagcagcuuuagcagcaccaguaacaggccaaacaaacauaaucgacccauggaucagagcaaauuuuguacaagcaccaaacggcgaauuuacaguaucaccuagaaacgcaccuggagaaguacucuuaaaccuagaacuaggcccagaauuaaauccuuauuuagcacaucuagcaagaauguauaauggauaugcaggaggaauggaaguacaaguaaugcucgcaggaaaugcauucacagccgguaaacuaguauuugcagcaguaccaccacauuuuccuauagaaaauuuaucaccacaacaaauaacuauguucccacacguaauaauagacguaaggacauuagaaccaguacuacuaccccuuccagacguaagaaauaauuucuuucauuauaaccaaaaagaugauccaaaaaugagaauaguagcaauguuauacacaccacucagaucaaauggauccggagaugauguauuuacaguaucauguagaguauuaacucgaccauccccagauuuugacuucacauacuuagucccaccaacggucgaaagcaaaacaaaaccauucacccuucccauuuuaaccuuaggagaacuaucaaacagcagauucccuguaaguauagaucaaauguauaccucucccaaugaaguuauaaguguacaaugucaaaauggaagguguaccuuagauggugaauuacaaggaacaacucaacuacaaguaucuggcauaugugcauucaaaggagaaguaacagcccaccuucaugauaaugaccaccuauauaauaucacaauaaccaaccuaaauggaucaccauucgauccaucugaagacauaccagcaccucuaggaguuccagacuuucaaggaagaguauuuggaauaauaucucaaagagauaaacauaacagcccaggccacaaugaacccgcaaaucgaggucacgacgcugucguaccuacauauacagcacaauacacuccaaaauuaggacagauacaaauaggcacuuggcaaacugacgaccucacaguuucucaaccaguaaaauuuacuccaguugguuuaaaugauacagaacacuuuaaucaaugggucguuccaagauaugcuggagcauuaaaucuaaauacaaaucuagcuccuucaguagcacccguauuuccaggagaaagacuccuauuuuucaggucuuauauaccuuuaaaaggcgguuaugguaauccagccauagauugccuauuaccacaagaauggguacaacacuucuaucaagaagcagcaccaucuauguccgaaguagcauuaguccgauauauaaacccagacacaggaagagcccuauuugaagcaaaauuacauagagccggauuuaugacuguaucgucaaauacauccgccccaguaguaguaccagcaaauggauacuuuagauuugauucauggguuaaucaauuuuacucauuagcaccaaugggaacagguaacgguagacgccgaguacaauaa

SEQ ID NO: 31294 - RNA, 1629 nt, Artificial Sequence
  derived and/or modified sequence opt6 from VP1,_capsid_protein__Norovirus__BAL60797
augaaaauggcuucaaacgacgcugcaccauccaccgauggcgcagccggacuaguaccagaaaguaacaacgaaguaauggcauuagaaccuguugccggagcagcacuagcagcaccaguuacaggucaaacaaauauaauagacccauggauaagagcaaacuucguacaagcuccaaacggagaauucacaguaucacccaggaacgcacccggugaaguacuauuaaauuuagaacuugguccagaacuaaauccauacuuagcccaccuugcaagaauguauaacgguuaugcaggagggauggaaguacaaguaaugcuagcaggaaaugcauuuacagcaggaaaauuaguauuugcagcaguucccccccacuucccaauagaaaaucuauccccacaacaaauaacaauguuuccacauguuaucauagacguaagaacccuagaaccaguuuuacuuccacuuccagacguaagaaauaacuuuuuucacuauaaccaaaaagacgacccaaaaaugcgaauaguagcuaugcuuuacacaccuuuaagaucgaacggaucaggagaugauguauuuacaguaucaugccgaguauuaacaagaccaucuccagauuuugauuuuacauaucucguaccaccaacagucgaaucaaaaacaaaaccauuuacacuucccauucuuacacuuggugaacucucaaacucuagauucccuguauccauagaccaaauguacacuuccccuaacgaaguaauaagcguccagugucaaaauggaagaugcacauuagauggcgaacuacaaggaacaacacaauuacaagucucugguauaugugcauucaaaggagaaguaacagcacacuuacaugacaaugaccaccuauacaauaucacaauaacaaaucuuaacgguuccccauucgauccaucagaagauauaccagcaccccuugguguuccagacuuucaaggaagaguauucggaauaauaucacaacgcgauaaacauaauucaccaggccacaaugaaccagcaaauagaggacacgacgcaguagucccuacuuauacugcacaauauacaccuaaacuaggacaaauacaaauaggaacauggcaaaccgaugauuuaacaguaucacaaccuguaaaauucaccccaguuggauuaaaugauacagaacauuucaaccaauggguuguaccaagauaugcaggugccuuaaaucuaaacacaaauuuagcaccuucaguugccccuguauucccaggcgaacgacuccuuuucuuucgaagcuauauaccccucaaaggaggauauggaaaucccgcaauagauuguuuacuaccucaagaguggguacaacacuuuuaucaagaagcagccccaucaaugucagaaguagcauuagucagauauauuaacccugacacuggcagagcuuuauucgaagcaaaauuacacagagcuggauuuaugacuguaucaucaaacacauccgcaccaguaguaguaccagcuaauggauauuucagauuugacucauggguaaaccaauuuuauucacuagcaccaaugggcacaggaaauggaagaagaagaguacaauaa

SEQ ID NO: 31295 - RNA, 1629 nt, Artificial Sequence
  derived and/or modified sequence opt6 from VP1,_capsid_protein__Norovirus__BAL60799
augaaaauggccucaaaugaugcagcaccaucaacugacggagcugccggauuaguaccagaaucaaauaaugaaguaauggcauuagaaccaguagccggcgcagcauuagcagcaccaguaacaggacaaacaaacauuauagaucccuggauuagagcuaauuuuguacaagcaccaaauggcgaauuuacggucuccccuagaaacuccccaggugaaguauuacuaaaccucgaauuaggcccagaacuaaauccguacuuagcccaucuagcuagaauguacaauggcuacgcuggaggaauggaaguccaaguaaugcucgcuggaaacgcauuuacagcaggaaaauuaguuuucgccgcagucccaccacauuuuccaguagaaaauuuaucuccacaacaaauaaccauguuuccacaugucauaauagacguacgaacauuagaaccaguacuauuaccacuuccugauguacgaaacaauuucuuucauuauaaucaaaaagacgaccccaaaaugagaauaguagcuauguuauauacaccacuaagaucuaauggaucuggagaugacguauucacagucucgugucggguuuuaacaagaccaagcccagauuucgacuuuacauaccuaguaccuccaacaguagaaucaaagacaaaaccauuuaccuuaccaauacucacuuuaggagaacuauccaauucuagauuuccagucucaauugaccaaauguacacuucacccaaugaagucauaucaguacaaugucaaaacggaagaugcacacuagacggagaauuacaaggaacaacacaauuacaaguaagcggaauaugugcauuuaaaggagaaguaacugcacaucuucacgauaaugaucaucuauacaacguaacuauuacaaaucuaaauggaucaccauuugacccaucugaagacauccccgcaccauuaggaguaccagauuuccaaggaagaguauuugguguaaucucucaaagagauaaacauaauacuccaggacauaacgaaccagcaaauagagcacaugacgcaguaguaccaacuuauacagcacaauauacaccaaaauuaggacaaauacaaauugguacauggcaaaccgacgaucucacaguaaaucaaccaguaaauuuuacaccagcaggacuaucagauacugaucauuucaaucaauggguaguaccacgauacgccggagcacuaaaucuaaauaccaacuuagccccaaguguugcaccuguauuuccaggagaaagauuacucuuuuuuagaucauauauaccuuuaaaagguggcuauggcacccccgcaauugauugucuucuuccacaggaauggguacaacauuucuaucaagaagcagcuccaucaaugagcgaaguagcucuagucagauauauuaauccagacacaggaagagcacuauucgaagcaaaacuacauagagcuggcuuuaugacaguaucuucuaauacuucagccccuguagucguucccgcaaacggauauuuucguuucgauucauggguaaaucaauucuauuccuuagcuccuaugggaacaggaaauggacgaagacgaauucaauaa

SEQ ID NO: 31296 - RNA, 1629 nt, Artificial Sequence
  derived and/or modified sequence opt6 from VP1,_capsid_protein__Norovirus__BAL60801
augaaaauggcuucaaacgacgcugcaccaucaacagauggagccgcaggacucguaccagaaucaaauaacgaagucauggcuuuagaaccaguagccggagcagcacuugcagcaccaguaacaggucaaaccaauauaauugauccuuggauaagagcaaauuuuguacaagcaccaaauggagaauuuacuguaucuccacguaaugcaccaggcgaaguuuuacuaaaucuagaauuaggucccgaacuaaaucccuaucuagcacaucuugcucgaauguauaacggauacgcuggagguauggaaguacaaguaaugcuagcaggaaaugccuuuacagccggaaaacuuguauuugcagcaguaccuccacacuuuccaaucgaaaaucucucaccacaacaaauaacaauguucccgcacguuaucauagauguaagaacacuagaacccguucuauuaccauuaccggacguacgaaauaauuucuuccacuauaaucaaaaagaugauccaaaaaugagaauaguagcuaugcuauauaccccacuacgaagcaacggaagcggugaugauguauucacaguaaguugucgaguacuaacccgaccauccccagacuuugacuuuacauacuuaguaccaccaacaguagaauccaaaacaaaaccuuuuacauuaccaauauuaacuuuaggagaacuaucuaacucaagauuuccaguauccauugaucaaauguauacaucuccaaacgaaguaauaucaguccaaugccaaaauggcagauguacauuagauggagaacuucaagguacuacacaauuacaaguaucuggcauuugugcauuuaaaggcgaaguuacagcgcauuuacacgauaaugaccaucuauauaacaucacaauaacaaacuuaaaugguucuccauucgacccaucagaagacaucccugcaccauuagguguaccugauuuucaaggccgagucuucggaauaauaucacaaagagauaaacacaauucaccuggacacaaugaaccagcaaaccguggccaugaugccguagucccaacauauacagcccaauauacaccaaaauuaggacaaauacaaauuggaacauggcaaacagacgauuuaacagucucucaaccaguaaaauuuacaccaguaggcuuaaaugauacagaacauuuuaaucaauggguaguaccaagauaugccggagcacuaaaccuaaacacaaaccuggcaccaucaguagcaccaguauucccaggagaaagacuuuuauuuuuuagaucauauauaccauuaaaaggaggauauggaaauccugcaauugauuguuuauuaccccaagaauggguacaacauuuuuaucaagaagcagcaccuucaaugucugaaguagcauuaguuagguacauuaacccagacacuggaagagcauuauuugaagcaaaacuacauagagcugguuucaugacaguauccucaaacacaucugcacccgucguagucccagccaauggauauuucagauucgacucauggguuaaucaauucuauucuuuagcaccaaugggaacaggaaaugguagacgaagaguccaguaa

SEQ ID NO: 31297 - RNA, 1629 nt, Artificial Sequence
  derived and/or modified sequence opt6 from VP1,_capsid_protein__Norovirus__BAL60803
augaaaauggcaucaaaugaugcugccccaucuacagauggagcagccggccuaguaccagaaucaaauaaugaagucauggcacuagaaccaguugcaggagcugcucuagcugcuccuguaacaggucaaacaaauauaauagacccauggaucagagcaaauuuuguacaagcacccaacggagaauucacaguaucaccaagaaaugcaccaggagaaguacuauuaaauuuagaacuaggaccagaacuaaauccauaccuagcacaucuagcacguauguauaauggauaugcaggcggcauggaaguucaaguaaugcuagcaggaaaugcuuucacugcugguaaacuaguauuugcagcuguccccccacacuucccuauagaaaaucuuucuccccaacaaauaacaauguucccacacguaauaauagauguuagaacucucgaacccguacuacucccucuuccagacguacgaaacaacuuuuuccacuauaaccaaaaagaugauccaaaaaugcgaauaguagcaaugcuuuauacuccacuaagaucaaauggaucaggagaugacguauuuacaguuucaugccgaguguuaacaagaccuagcccagauuuugauuucacuuaucuaguaccaccuacaguugaaucuaaaacaaaaccauuuacacuaccaauauuaacuuuaggagaauuaucaaacaguagauuuccgguaucgauagaccaaauguauaccucacccaaugaaguaauaucaguacaaugucaaaacgguagauguaccuuagacggugaacuccaagguacuacacaauugcaaguuucagguauaugugccuuuaaaggcgaaguaaccgcacauuuacaugauaaugaccaccuauauaauauaacuauaacaaauuuaaauggaucaccauuugauccuucagaagauauaccagcaccauuaggcguuccagauuuucaaggacgaguauuuggaauaauaucccaaagagauaaacacaauucaccaggucauaaugagccagcaaaucgaggucaugaugcaguuguuccaacauacacagcacaauauacaccaaaauuaggucaaauccaaauaggaaccuggcaaacagaugacuuaacaguaucacaaccagucaaauuuacaccaguagguuuaaacgauacagaacacuuuaaucaauggguaguucccagauaugcuggagcacuaaaucuaaacacaaaucuagcacccaguguagcaccaguuuuuccaggagaacgucuccuauucuucagaucauauauaccauuaaagggaggauauggcaauccagcaauagacugucuauuaccacaagaauggguucaacauuuuuaucaagaagccgcaccuucaaugucugaagucgcacuaguacgauacauaaauccugacacagguagagcauuauuugaagccaaauuacacagagcugguuuuaugacaguauccucgaacacaucagcaccagucgucguaccagcaaacggcuauuuucgauucgauucauggguaaaucaauuuuauagucuagcuccaaugggaacagguaacggaagaagaaggguacaauaa

SEQ ID NO: 31298 - RNA, 1629 nt, Artificial Sequence
  derived and/or modified sequence opt6 from VP1,_capsid_protein__Norovirus__BAL60805
augaaaauggcauccaacgacgcagcuccaucaacagacggugcagcuggauuaguaccagaaucuaacaaugaaguaauggcacuugaaccuguagcaggcgcagcuuuagccgcaccuguaacuggacaaacaaauauaauugacccauggauccgcgcaaacuuuguacaagcaccuaacggagaauucacagucucaccacgaaaugcaccuggugaaguauuacuuaaucuagaauuagggccugaauuaaacccauacuuagcacaccuagcaagaauguacaacggacaugcugguggaauggaaguccaaguaaugcuagcaggaaacgcauuuacagcagguaaauuaguauucgcagcuguuccaccacauuuuccaaucgaaaaccuuucaccacaacaaauaaccauguuuccucacguaaucauagacguaagaacucuugaaccagucuuacuaccacuaccagauguucgaaauaacuucuuccauuauaaccaaaaagacgacccaaaaaugagaaucguagcaauguuauacacaccacuuagauccaacggaucuggugacgacguauuuacagucucauguagaguuuuaacaagaccauccccagauuuugauuuuacauauuuagucccaccuacaguagaaucaaaaacaaaaccuuuuaccuuacccauauuaacauuaggugaauuauccaauucaagauucccaguuucaauagaucaaauguacacaucaccuaaugaaguuauuucuguccaaugucaaaacggcagauguacauuagauggagaauuacagggcacaacacaacuucaaguaucaggcauaugcgcauucaaaggagaaguaacagcucauuuacacgauaaugaccacuuauauaacauaacaauaacuaaccuaaauggaucaccauuugauccuagcgaagacauaccagcuccauuaggaguuccagauuuccaaggcagaguauucggaauaauaucacaaagagauaaacacaacucucccggacacaacgaaccagcaaauaggggacacgaugcgguaguaccuacauauacagcacaauauacaccuaaacuaggacaaauacaaauaggaacauggcaaacagaugaucuaacaguaucucaaccaguaaaauucacaccaguugguuuaaaugacacugaacauuuuaaucaauggguuguaccucgauaugccggugcucuaaauuuaaauacaaacuuagcaccaucuguagcaccaguauuucccggagaacgacuacuuuuuuucagaucauauauaccacuaaaaggcggauacgguaauccagcaauugauuguuuacuaccacaagaauggguacaacacuuuuaucaagaagcagcuccaucuauguccgaaguagcccuaguaagauacauaaauccagacacuggaagagcauuauucgaagcaaaacuacauagagcugguuuuaugaccguuucauccaauacgucagcaccuguaguaguacccgcuaacggauauuuucgauuugacucauggguuaaccaauucuauucauuagccccaauggguacaggaaaugguagaagacgaguccaauag

SEQ ID NO: 31299 - RNA, 1629 nt, Artificial Sequence
  derived and/or modified sequence opt6 from VP1,_capsid_protein__Norovirus__BAL60809
augaaaauggcaagcaacgacgccgcaccaucaacagauggagcugcaggucuaguucccgaaucuaauaaugaaguaauggcacuagaaccaguagcaggagcagcacucgcugccccaguaacaggacaaacaaauauaauagauccauggauaagagcaaauuucguacaagcaccaaacggagaauuuacaguaucuccaagaaacucuccaggagaaguacuucuaaaccuagaauuaggaccagaacuaaacccuuauuuagcucacuuagccagaauguauaacggauacgcuggaggaauggaaguacaaguaaugcucgcaggaaacgcauuuacagcaggaaaacuaguauuugcagcagucccaccacacuuuccaguugaaaauuuaaguccucaacaaauuacaauguucccucacguaaucauugacguacgaaccuuagaaccaguauuauuaccauuaccagacguaagaaauaauuuuuuucauuacaaccaaaaagaugacccuaaaaugagaauaguugcaauguuauacacaccauuaagaagcaauggaaguggagacgacguauucacugugagcugucgaguacuaacucgacccucaccagacuuugacuucaccuaucuaguaccuccaacaguagaaucaaaaacaaaaccauucacauuaccaauacuaacauuaggagaauuaucaaauucucgcuuucccguuucaaucgaccaaauguacacaucaccaaacgaagucauuucaguacaaugucaaaacggaagauguacacuagacggugaacuacaaggaacaacacagcuacaaguuaguggaauaugugcuuuuaaaggcgaaguaacagcacauuuacacgauaaugaccauuuauauaacguuacaauaacaaaccuaaauggaucacccuucgauccaucugaagauauaccagcaccucuaggaguaccagacuuccaaggaagaguuuucggaguaauaucacaaagagacaaacacaauaccccaggacauaacgaaccagcaaacagagcacacgacgccguaguaccaacauacaccgcacaauauacuccaaaacuaggucaaauacaaauaggaaccuggcaaacagacgaucuaacaguaaaccaaccaguaaauuuuacaccaguaggccucucagacaccgaucauuuuaaucaauggguagucccacgauaugcaggugcacuuaauuuaaacacaaauuuagcaccauccguagcaccaguuuuucccggagagagauuacucuucuuuagaucauauauaccauuaaaagguggauauggaacacccgcaauagauugucuauuaccacaagaauggguacaacacuucuaucaagaagcugcaccauccaugucugaaguagcauuaguaagauacauuaauccagauacaggacgugcucucuucgaagcaaaacuacauagagccggauucaugacuguaucaucaaauaccucugcaccaguaguaguuccagcaaauggauacuuucgauucgacucauggguaaaucaauucuacuccuuagcaccuaugggaaccggcaacggaagacgaagaauacaauaa

SEQ ID NO: 31300 - RNA, 1629 nt, Artificial Sequence
  derived and/or modified sequence opt6 from VP1,_capsid_protein__Norovirus__BAL60811
augaaaauggcuucaaaugacgcagcaccaucaacagacggagcagcaggucuaguaccagaaucaaacaaugaaguaauggcacuugaaccaguagcaggugcagcauuagcagcaccuguaacaggacaaacuaacauaauugaucccuggauaagagcaaauuuuguacaagcaccaaauggagaguuuacuguaucaccaagaaaugcaccaggagaaguuuuauuaaaucuagaauuaggaccugaacuaaaucccuacuuagcacaccucgcacgaauguauaacggauacgcugguggaauggaaguacaaguaauguuagccggaaacgcauucacggcagguaaacuaguuuuugcagcaguaccuccgcauuuuccaguagaaaauuuaucuccacaacaaaucacaauguuuccacauguaauaaucgacguuagaacacuagaaccaguacuauuacccuuaccagacguaagaaauaauuuuuuucauuauaaucaaaaagaugaucccaaaaugagaauaguagcuaugcuuuauaccccauuacgcucaaauggaucaggagacgauguauuuacaguaucauguagagucuuaacccguccuucaccagacuuugacuucacuuaccuuguaccccccacuguagaaucaaaaacuaaaccauuuacauuaccaaucuuaacccuuggagaacucucuaauucaagauuuccaguaucaauugaccaaauguacacaucaccaaaugaaguaauuucaguacaaugucaaaacggucgauguacauuagauggagaauuacaaggcaccacucaacuacaaguuucagguauaugugcauuuaaaggagaaguaacagcucaucuucaugauaaugaucacuuauacaauauaacaauuacaaaucuaaacgguucgccauuugacccaucagaagacauaccugcccccuuaggaguaccagacuuucaaggucgaguauuuggaauuauaucacaaagagauaaacacaacaguccaggacacaaugaaccagccaauagaggccaugacgcaguaguaccaaccuauaccgcucaauacacaccaaaauuaggucaaauucaaauaggaacuuggcaaaccgaugaucucacaguaucacaaccaguaaaauuuacaccaguaggacuuaaugacacugaacacuuuaaucaauggguaguaccaagauaugcaggagcucuaaauuuaaauacuaaucuagccccaaguguagccccagucuucccuggagaaagacugcuauuuuuucguucuuacauaccauuaaaaggaggauauggagauccagcaauugauugucuccuaccacaagaauggguacaacauuuuuaucaagaagcagcaccaucaaugucagaaguugcccuuguacgauacauaaacccagacaccggacgagcuuuauuugaagcaaaauuacaucgagcuggauuuaugacaguuucaaguaacacaucugcuccuguaguaguaccugcuaauggcuauuucagauuugauuccuggguuaaucaauucuacucacuagcaccaauggguaccggaaauggaagacgacggguacaauaa

SEQ ID NO: 31301 - RNA, 1629 nt, Artificial Sequence
  derived and/or modified sequence opt6 from VP1,_capsid_protein__Norovirus__BAL60813
augaaaauggcaucaaacgacgcagccccaucaacagauggugcugccggccuuguuccagaaucaaacaaugaagucauggcauuagaaccaguagcaggagcagcauuagcugcuccugucaccggucaaacaaacauaauagauccauggauaagagcuaacuucguacaagccccaaauggagaauucacaguaucaccucgaaaugcaccuggagaaguacuacuaaaccuugaauuaggccccgaacuaaauccauauuuagcacauuuagcgagaauguauaaugguuacgcaggcggcauggaaguacaaguaauguuagccggaaaugcauucaccgcagguaaauuaguauuugcagcaguuccaccacauuuuccaguugaaaaucuaucaccccaacaaauaacaauguucccacacguuauaauugauguuagaacacucgaaccaguauuauuaccauuaccagacgucagaaauaauuuuuuccacuauaaccaaaaagacgacccaaaaaugagaauaguggcaauguuauauacaccacuuagaucaaauggcucaggagacgacguauuuacugucucauguagaguauuaacaagaccaucaccugauuucgacuucacuuauuuaguaccacccaccguagaaucuaaaacaaaaccauucacacucccaauacuuacacuaggagaacuaucuaauucucgauuuccaguuucaauagaccagauguauacaucucccaacgaaguaauaucuguacaaugucaaaacggcagauguacucuagauggcgaauuacaaggaaccacacaauuacaagucucuggaauaugcgcuuuuaaaggagaaguaacagcacacuuacaugauaacgaccacuuauauaacauuaccauaacuaauuuaaacggaucaccguuugauccaucagaagacauuccugcuccauuagguguaccagauuuucaaggaagaguauuuggcauaauaucacaacgcgauaaacauaauucaccuggucauaaugaacccgcaaauagaggacaugaugcaguuguaccaacauacacagcacaauacacacccaaacuaggccaaauacaaauagguacauggcaaacagacgaccuuacuguaucacaaccaguaaaauucacaccagucggauuaaaugauacagaacauuucaaucaguggguuguaccaagauaugcaggagcauuaaauuuaaacacaaauuuagcaccuucaguugcuccuguauuuccaggagaaagauuauuauucuuuagaagcuauauaccauuaaaaggagguuacggagauccagcaaucgauugucuacuuccacaagaauggguacaacacuuuuaccaagaagccgcaccaucaauguccgaagucgcauuagucagauacauaaauccugauacuggcagagcccucuucgaagcaaaacuccauagagcuggauucaugacaguuucaucaaacacaucagccccaguaguagucccagcuaacggauauuuuagauucgauucauggguaaaccaauuuuacucauuagcaccaaugggaacuggaaauggaagacgucgaguucaauaa

SEQ ID NO: 31302 - RNA, 1629 nt, Artificial Sequence
  derived and/or modified sequence opt6 from VP1,_capsid_protein__Norovirus__BAL60815
augaaaauggccucaaaugaugcagcuccuucaacagauggagcagcuggcuuaguucccgaaucuaauaacgaaguaauggcccuugaaccagucgcuggagcagcacuugcugcaccuguaaccggacaaaccaauaucauugauccauggauucgagcuaacuuuguacaagcaccaaauggugaauuuacaguaucaccaagaaauagcccaggagaaguauuacuaaaccuagaacuugguccagaauuaaauccauaucuagcucaccuugcaagaauguauaauggauaugcugguggaauggaaguacaaguaauguuagcuggaaaugccuucacugcagguaaacucgucuuugcagccguuccaccacauuuucccgucgaaaacuuauccccacaacaaauaacaauguucccccauguaauaauagauguaagaacauuagaaccuguauuacuaccucuaccugauguacguaauaacuuuuuucacuauaaucaaaaagacgacccuaaaaugagaauaguagcaaugcucuauacaccacuaagaucaaacggaucaggagaugauguauuuacaguauccuguagagucuuaacaagaccaucaccagauuuugauuucacauacuuaguaccaccaacaguugaaucaaaaacaaaaccauuuacacuuccaauccuaacuuuaggagaacuaucuaauaguagauuuccaguaucaauagaucaaauguacacaagcccuaacgaaguaauaucaguacaaugucaaaaugguagauguacauuagacggagaacuacaaggaacaacccaauuacaaguauccggaauaugcgcauucaaaggugaaguuacagcccaucuacaugauaaugaucacuuauacaauguaacaauaacaaaucucaauggaucuccauuugauccuucagaggauauuccagcuccccucggaguuccagacuuccagggacgagucuucgguguuauaucacaaagggauaaacauaacacacccggacauaaugaaccagcaaaucgagcccacgaugcagugguaccaacauauaccgcacaauauacucccaaacuaggccaaauacaaauaggaacauggcagacagacgauuuaacuguaaaccaaccaguuaacuuuacaccagugggucucucugauacagaucacuuuaaucaaugggucguaccuagauaugcaggggcuuuaaaucuaaauacaaaucuagcacccucaguugcaccaguuuucccaggagaaagacuauuauucuucagauccuauauaccauuaaaaggaggcuacggaacuccugcaauagauugucuacuaccacaagaauggguccaacacuuuuaucaagaagcagcccccucuaugucagaaguagcacuaguaagauauauuaacccagacacaggcagagcuuuauuugaagcuaaacuacauagagccggauuuaugacaguuuccucaaacacaucugccccuguuguugucccagccaauggauacuuccgguuugauucauggguaaaccaauucuauucauuagcaccaaugggcacuggaaauggaagaagaagaauacaauaa

SEQ ID NO: 31303 - RNA, 1629 nt, Artificial Sequence
  derived and/or modified sequence opt6 from VP1,_capsid_protein__Norovirus__BAL60817
augaaaauggcaucaaacgaugccgcaccaucuacugacggagcagcuggcuuaguacccgaaucaaacaaugaagucauggcauuagaaccaguagcaggugcagcauuagcagcaccaguuacaggacaaacuaacauaauagauccauggauacgagcaaacuucguccaagcaccuaauggagaauucacaguaucaccaagaaacgcaccaggagaagucuuauuaaauuuagaacugggaccagaacuuaauccauauuuagcacauuuagcaagaauguauaacggauacgcaggagguauggaaguacaaguaaugcuagcaggaaaugcauucacagcagguaaacuaguuuuugccgcaguaccaccacacuuuccaauugaaaacuuaucaccucaacaaaucacaauguuuccucaugucauaauugacguaagaacauuagaaccugucuuauuaccuuuaccagauguaagaaacaacuuuuuccauuacaaucaaaaagaugauccaaaaaugagaauagucgcaaugcucuauacaccacucagauccaauggaucaggugacgauguauuuaccguaucauguagaguuuuaacaagaccuucuccagacuuugacuuuacauaucucguuccaccuacaguugaaucaaaaacaaaaccuuucacacuaccuauuuuaacacuaggagaacuaucaaauucccgauuuccaguuuccauugaucaaauguauacauccccaaaugaaguaauaucaguucaaugucaaaacggaagauguacacuugacggugaauuacaaggaacuacucaauuacaagucuccggcaucugugcauuuaaaggcgaaguaacagcacaccuacacgauaaugaccaucucuacaauaucacuauaacaaaucuuaacggaucaccauuugacccaucugaagauauaccugcaccacuuggaguuccagacuuucaaggacgaguauucggaauaauaucccaaagagauaaacauaauucaccaggucauaacgaaccugcuaaccgaggccacgaugcuguuguaccaacuuacacagcacaauauacuccaaaauuaggucaaauccaaauaggaacauggcaaacagacgaccuaacugucucccaaccagucaaauuugcaccggucggauugaaugacacugaacacuucaaccaauggguagucccaagauaugcaggagcacuaaaccuuaauauaaaccuagcuccuuccgucgcuccuguauuuccuggagaaagacuacuauuuuucagaucauauaucccacuaaaaggcggauaugguaauccagcaauagacugccuucucccucaagaauggguacaacacuucuaucaagaagcugcaccaucaaugucagaagucgcuuuagucagauacaucaauccugacacagguagagcucuauucgaagcaaaacuacauagagcgggcuuuaugacuguauccucuaauaccucagccccuguaguugucccagccaaugguuauuuucgcuucgauucauggguaaaucaauuuuacucauuagcccccaugggcacagguaauggaagaagacguguacaauaa

SEQ ID NO: 31304 - RNA, 1629 nt, Artificial Sequence
  derived and/or modified sequence opt6 from VP1,_capsid_protein__Norovirus__BAL60819
augaaaauggcaucuaaugacgcagcaccuucaacagacggugcagcaggauuaguuccagaauccaacaaugaaguaauggcuuuagaacccguagccggagcagcacuugcagcaccaguuacaggacaaacuaacauaauagauccauggauaagagccaauuucguucaagcaccaaacggugaauuuacaguaucuccaagaaaugcaccuggagaaguauuauuaaaucuagaauuagguccagaacuaaauccuuacuuagcacacuuagcacgaauguauaacggauacgcagguggcauggaaguacaaguaaugcuagcaggaaacgcauuuaccgcaggaaaauuaguauucgcugcaguuccuccacauuuuccaaucgaaaaucuaucuccacaacagauaaccauguucccacacguaauaauagacguaagaacucuugaaccaguacuauuaccacuaccagacgucagaaacaauuucuuccacuauaaccaaaaagacgacccaaaaaugcguauaguagcaauguuauacacuccauuaagaucuaauggaucuggagaugauguauucacaguaucuuguagaguacucacuagaccuucaccugauuuugacuucacauauuuaguacccccaacagucgaaucaaaaaccaaaccauucacacuccccauauuaacauuaggcgaacuaaguaacuccagauuuccaguaagcauugaccaaauguauacaucaccaaacgaaguuauaagcguacaaugucaaaacggaagauguacauuagacggagaacuucaaggcacaacacaacuucaaguauccggaaucugugcauucaaaggagaaguuaccgcacaccuccacgauaacgaucacuuauauaauauaacaauaacuaaucuaaacgguuccccauuugauccaucugaagacauaccagccccacuagguguacccgauuuccaaggaagagucuucggcauuauaucacaacgugauaaacauaauucaccuggacauaacgaaccagcaaaucgaggacaugaugccguaguuccaacuuauaccgcacaauauacuccuaaacuaggacaaauacaaauaggaacauggcaaacggacgaucuaacaguuucacaaccugucaaauucaccccagucggauugaacgauacagaacauuucaaucaauggguugucccaagauaugcaggagcacucaaucucaacacaaaccuagcaccaagcguagcaccaguuuuuccaggagaacgccuauuauucuucagaucauauauaccauuaaaaggagguuauggcaauccagcaauagacugccucuuaccacaagaauggguacaacauuuuuaucaagaagcugcaccaagcaugucagaaguagccuuaguacgauauauaaacccagauacaggaagagcuuuauuugaagcaaaacuacacagagccggcuuuaugaccguaucaagcaacaccuccgccccaguaguaguaccugcaaacggauauuuucgauucgacucauggguaaaccaauuuuauucauuagcuccaaugggaacaggaaacggaagaagaagaguacaauaa

SEQ ID NO: 31305 - RNA, 1629 nt, Artificial Sequence
  derived and/or modified sequence opt6 from VP1,_capsid_protein__Norovirus__BAL60821
augaaaauggccucaaaugacgcugcccccaguaccgacggagcagcaggcuuagucccagaauccaacaaugaaguaauggcauuagaaccaguagcaggagcagcacuagccgcaccagucacuggacaaacaaauauaauagauccuuggauaagagcaaauuucguacaagccccaaauggcgaauuuacaguaucaccucgaaacgcaccuggagaagucuuauuaaauuuagaauuaggaccagaacucaauccauaucuagcacauuuagcacgaauguauaauggauaugcuggcggaauggaaguacaaguaauguuagcaggaaacgcauuuacagcaggaaaauuaguuuucgcagcaguaccaccacacuuucccauagaaaaccuaucaccacaacaaauaaccauguucccacacguaauaauagauguuaggacacuagaaccaguccuacuuccacuacccgacguaagaaacaauuucuuucauuauaaccagaaagacgacccaaaaaugagaaucguagcaauguuauauacuccacuaagaucuaaugguucuggcgacgauguauucacuguaaguuguagaguacuaacuagaccaucuccagauuucgauuucaccuauuuaguuccacccacagucgaaucuaaaacuaaaccauuuacucuaccaauauuaacauuaggcgaacuaucaaauuccagauuuccagucucuauugaccaaauguauacaucccccaaugaaguuauaucaguacaaugucaaaacggaagauguacacuagacggagaauuacaaggaacgacacaauuacaagucucagguauaugugcauuuaaaggcgaaguuacagcacaccuccaugauaacgaucacuuauacaauauaacaaucacaaaucuaaacggauccccuuucgauccaucugaagacauucccgcaccuuuagguguaccagauuuccaaggacgaguuuuuggaauaauuucucaaagagacaaacauaacucaccaggucauaaugaacccgcaaaccgaggacacgaugccgucguaccaacauauaccgcacaauacacaccaaaauugggccaaauacaaaucgguacauggcaaacagacgaccuaacuguaucucaaccaguaaaauuuacucccgucggauuaaaugauacagaacauuuuaaucaauggguagucccacgcuaugcaggagcuuuaaacuuaaacacaaauuuagccccaucaguagcuccuguauuucccggagaaagauuauuauucuuuagaucauauaucccacuaaaaggaggauauggaaauccagcaauugauugcuuacuaccacaagaauggguacaacacuucuaucaggaagcagcgccaucuaugucagaaguagcccuaguuagauacauuaauccugauacaggacgagcauuauuugaagcaaaauuacauagagcagguuuuaugacuguaucaaguaauaccucagcaccaguaguaguuccagcuaauggauauuuccgauucgacucauggguaaaucaauucuacucucuagcaccaauggguacaggaaauggacgcagaagaguacaauaa

SEQ ID NO: 31306 - RNA, 1629 nt, Artificial Sequence
  derived and/or modified sequence opt6 from VP1,_capsid_protein__Norovirus__BAL60823
augaaaauggcaaguaaugaugcagcaccaucaacagauggagcagcaggauuaguuccagaaagcaauaaugaaguaauggcucuagaaccuguagcaggugcagcccuagcagcacccguaacaggacaaacaaauauaauagaucccuggauaagagcuaacuuuguacaagcuccaaauggugaauucacaguaucaccaagaaacgcacccggagaaguacuuuuaaaucuagaacucggaccagaacuaaacccuuaucucgcacaccuagcaagaauguauaacggauaugcuggaggucuagaaguacaaguaaugcucgcaggaaaugcauuuacagccggaaagcucguauuugccgcagucccuccacacuucccaauugaaaaucuaucaccacaacaaauaacaauguuuccccacguaauuauagauguaagaacacuagaaccaguauuacuacccuuaccagacgucagaaauaacuuuuuccacuauaaucaaaaagacgacccaaaaaugagaaucgucgcaauguuauauaccccacucagaucuaacggaucaggcgaugauguuuucacaguuucauguagaguacuaacuagaccaucaccagacuuugauuucacuuauuuaguuccaccaacuguagaaucaaaaaccaaaccauuuacauuaccuauacuaacacucggagaacuaucuaauucuagauuucccguaucaauagaucaaauguauacgucaccaaaugaaguuauaucuguacaaugccaaaacggaagauguacccuagacggugaauuacaaggaacaacacaacuccaaguaagcggcauuugugcuuuuaaaggugaagucacagcacacuuacaugauaacgaucauuuauauaauauaacuauuacaaacuuaaauggaucuccuuucgauccaucagaagacauaccugcaccuuuaggaguaccugacuuccaaggcagagucuucggaauaauaucucaacgcgacaaacauaauucaccaggacauaaugaaccugcaaauagaggacacgaugcaguuguaccuacauauacugcacaauacacaccaaaauuaggacaaauacaaauagguacuuggcaaaccgaugauuuaacaguaucacaaccuguaaaauuuacuccaguuggacuaaaugauacggaacacuuuaaccaauggguaguaccucguuaugcaggagcacuaaaucuaaacacuaauuuagcaccaucaguugcaccaguauucccaggcgagcgacuccuauuuuuucgauccuacauaccccuaaaagguggcuauggaaacccagccauagauugcuuacuaccucaagaauggguacaacauuuuuaucaagaagcagccccaucaaugucugaaguagcacuaguaagauauauuaaucccgauacaggcagagcauuauuugaagcaaaauuacaucgagcaggcuuuaugacagucucaucaaacacaucugcaccuguagucguaccagcgaacggauauuucagauucgacagcugggucaaucaauucuauucacuagcaccuauggguacaggaaauggcagaagacgaguacaauaa

SEQ ID NO: 31307 - RNA, 1629 nt, Artificial Sequence
  derived and/or modified sequence opt6 from VP1,_capsid_protein__Norovirus__BAL60825
augaaaauggccucaaaugacgcugcacccucaacagacggagcagcaggauuaguaccagaaucaaauaaugaaguaauggcacucgaaccaguagcaggcgcugcucuagcagcuccaguuacaggacaaacaaauaucauagacccauggauaagagcaaacuuuguacaagcaccuaauggagaauuuacagucucuccaagaaauuccccaggagaaguuuuacuuaacuuagaacuagguccagaacuuaacccauauuuagcccaucuugcaagaauguacaauggcuaugcuggaggaauggaaguacaaguaaugcuagcaggaaaugcuuuuacagcuggaaaacuaguauuugccgcaguaccaccacauuuccccgucgaaaaucucucuccucaacaaauaacaauguuuccacacgucauuauagacguaagaacauuagaaccaguacuauuaccauuacccgauguaagaaauaauuucuuccacuauaaucaaaaagaugauccuaaaaugagaauaguagcaauguuauacaccccauuaaggucuaacggaagcggugacgauguauucacaguaucauguagaguuuuaacaagaccaucuccugauuucgacuuuacuuaucuaguaccuccaacaguugaaucuaaaacuaagucauucacucuaccaaucuuaacacuaggagaacuaucuaauucacguuucccaguuucuauagaccaaauguauacaucaccuaaugagguaauauccguacaaugucaaaauggcagaugcacacuugacggugagcuacaagguacuacccaauuacaaguuucaggaaucugugcauuuaaaggagaaguaacagcacacuuacaugauaaugaccaucuauacaaugucacuauaacaaauuuaaacggaucuccuuuugauccaucagaagacauaccagcaccauuaggaguaccugacuuccaagguagagucuuugguguaaucucacaaagagauaaacauaauacaccuggucauaaugaaccugccaauagagcacaugaugcaguuguaccaacauacacagcacaauauacaccaaaauuaggacaaauacaaauaggaaccuggcaaacugacgaucuaacaguuaaucaaccaguaaacuuuacaccaguaggauuaucagauacagaucacuuuaaccaauggguggucccaagauaugcaggcgcuuuaaauuuaaacacaaaucucgcuccauccguagccccaguauuuccaggagaaagacuacuauucuucagauccuauauaccucuaaaaggagguuauggaacacccgcaauagauuguuuauuaccacaagaauggguccaacauuucuaucaagaagcagcacccucaauguccgaagucgcacuaguaagauacaucaaucccgauacaggccgugcauuguucgaagcaaaacuacacagagcaggauuuaugacuguguccucaaauacuucagccccuguaguuguaccagcuaacgguuacuuucguuucgauuccuggguaaaucaauuuuauucauuagcaccaaugggaacaggaaaugguagacgacguauacaauaa

SEQ ID NO: 31308 - RNA, 1629 nt, Artificial Sequence
  derived and/or modified sequence opt6 from VP1,_capsid_protein__Norovirus__BAL60827
augaaaauggcaucgaaugaugcagccccuucaacugacggagcagcaggacucgucccagaaucaaacaaugaaguaauggcauuagagccugucgcaggagcagcacucgcagcaccuguuacaggacaaacaaauauaauagacccauggauaagagccaauuucguacaagccccaaacggagaauuuacaguaucucccagaaacgcaccaggagaaguauuacuaaaucucgaacuuggaccugaauuaaaccccuacuuagcacacuuagcaagaauguauaacggcuacgcaggaggcauggaaguacaaguaaugcucgccgguaaugcauuuacugccgguaaacuaguauucgcugcaguaccaccucacuuuccuauugaaaauuuauccccccaacaaauuacaauguuuccucauguaauuauugauguaagaacauuagaacccguacuacucccacuaccagacguacgaaauaauuuuuuucauuauaaucaaaaagacgauccuaaaaugagaauaguagccauguuauacacuccauuaagaagcaacggaucaggcgaugauguauuuacaguaucuuguagaguccuaacuagaccaucaccagauuuugacuuuacauacuuaguuccaccaacaguagaaucaaaaacaaaaccauucacauuaccaauacuaacauuaggcgaauuauccaacucacgauuucccguuucaauagaucaaauguacacaucaccaaacgaaguuauaaguguacaaugccaaaacggacgcuguacacuugacggugaauuacaaggaacuacacaauuacaaguaucaggaauuugcgcauuuaaaggagaaguuacagcucaucuacacgauaacgaccaucuauacaauauaacaauaacaaaccucaacgguucuccuuucgaucccucagaagauauuccugcaccauuagguguaccugauuuucaagguagagucuucggcauuaucucccaaagagauaaacacaauucaccaggacauaacgaacccgcuaacaggggacacgaugcaguaguaccaacauauaccgcccaauauacaccaaaauuaggacagauacaaauaggaaccuggcaaaccgaugaccucacagucucucaaccaguaaaauucacaccaguaggauuaaacgauacugaacauuucaaucaauggguagucccacgauaugcaggagcacuaaaccuaaacacaaaucuagcaccaucagucgccccaguauuuccaggcgaacgacucuuauucuuuagauccuacauaccccuuaaaggagguuauggaaauccagcaauugauugucuacuaccucaagaauggguacaacacuucuaucaagaagcagcaccaucaaugucagaaguagccuuaguacguuauauuaacccagauacaggacgugccuuauucgaggcaaaauuacacagagcuggauuuaugaccguaucuucaaauacaucagcuccaguaguuguaccagcaaaugguuauuucagauuugauagcuggguuaaucaauucuauucacuugcuccaaugggcacaggaaacggacgacgccgcguacaauaa

SEQ ID NO: 31309 - RNA, 1629 nt, Artificial Sequence
  derived and/or modified sequence opt6 from VP1,_capsid_protein__Norovirus__BAL60829
augaaaauggcgucaaacgaugcagccccuucaacagacggagcagccggacuugucccagaaucaaauaaugaaguaauggcucucgaaccaguagcaggagcggcacucgcagcaccaguaaccggucaaacaaacauaaucgaucccuggauaagagcaaauuuuguccaggccccaaacggagaauuuacagucuccccaagaaaugcuccuggagaaguauuauuaaauuuagaacucggaccagaacuaaauccauaucuagcucauuuagcucgaauguauaacggauaugcaggaggaauggaaguacaaguaaugcucgcaggaaaugcauucacagcagguaaauuaguuuuugcagcuguaccaccacauuuuccaauagaaaauuuaucaccacaacaaaucacaauguucccccauguuauuauagauguaagaacauuagaaccaguacuauuaccacucccugauguacgaaacaauuucuuccauuauaaccaaaaagaugacccaaaaaugcgaauagucgcaauguuauacacaccauuaagaucuaacggaucaggugaugauguuuucacuguauccuguagaguucuaaccagaccaucucccgauuuugacuuuacuuaucuaguaccucccacaguagaaucaaaaacaaaaccauuuacauuaccaauuuuaacauuaggagaauuaagcaauucaagauuuccaguaucaauagaucaaauguacacuucaccaaacgaaguuauuucaguacaaugccaaaacggcagauguacuuuagacggagaacuacaaggaaccacacaacugcaaguuucaggcauaugugcauuuaaaggagaaguaacagcacauuuacacgauaaugaccacuuauauaauauuaccaucacaaauuuaaauggaucaccauucgaucccucagaagacauaccagccccauuaggaguaccagauuuucaaggcagaguauuuggcauuauuucacaacgagauaaacacaacucaccaggucacaaugaaccugccaauagaggacacgaugcaguaguucccacauacacagcccaauacacacccaaauuaggacaaauucaaauaggaacauggcaaacugacgauuuaaccguaucacaaccaguaaaauuuacuccaguaggauuaaacgauaccgaacauuuuaaucaauggguaguuccuagauaugcaggagccuuaaaucuaaauacaaaccuugcaccuucaguagcaccaguauuuccaggagaacguuuacuauuuuuuagaucauauauuccacuuaaaggaggcuauggcaauccagcaauagacugcuuacuaccacaagaauggguucaacauuuuuaucaagaagcagcaccaagcaugucagaaguagcuuuaguacguuauauaaacccagacacaggacgagcauuauuugaagcuaaauuacaccgagcuggauuuaugacuguaucaucaaauacauccgcaccagucguuguuccagcaaaugguuacuuuagauucgacucauggguaaaucaauucuauucuuuagccccuaugggaacaggaaacggaagacguagaguccaauaa

SEQ ID NO: 31310 - RNA, 1629 nt, Artificial Sequence
  derived and/or modified sequence opt6 from VP1,_capsid_protein__Norovirus__BAL60831
augaaaauggcuuccaaugacgcagcaccaucaacagacggagcagcaggacuaguaccagaaucaaacaacgaaguaauggcucuagaaccaguugcuggcgcagcuuuagcugcaccaguaacaggacaaacaaauauaauagauccauggauacgagcaaacuuuguacaagccccaaauggagaauuuacaguaucaccaagaaacgcaccaggagaaguauuacuaaauuuagaacuagguccugaacucaacccauaucuagcacacuuagcacgcauguacaauggauacgcaggagguauggaaguacaagucaugcuagcaggaaaugcauuuacagcaggaaaacucguauuugcagcugucccgccacacuucccaauugaaaaucucucaccacaacaaauaaccauguucccacacguuauaauagaugucagaacucuagaaccaguucuacuaccauuaccagauguaagaaacaauuuuuuucacuauaaccagaaagaugauccuaaaaugagaauugucgcaaugcucuauacaccacuaagaucaaauggaucuggagacgauguauucaccguauccuguagaguccuaacaagacccucaccugauuuugauuuuacauauuuagucccacccacagucgaaucaaaaacaaaaccuuucaccuuaccuauauuaacacuaggagaacuaucaaauucaagauuuccaguaucuauugaccaaauguauaccucccccaaugaaguaauaucaguacaaugucaaaacggacgcuguacuuuagacggagaacuucaaggaacaacccaauuacaaguaucaggaaucugugcauuuaaaggagaagugacagcccacuuacacgauaaugaccacuuauacaauauaacuauaacuaaccuaaacggaaguccauucgaucccagugaagacauaccagcuccacuagguguaccugauuuucaagguagaguauucggaauaauuucacaaagagauaaacauaacuccccaggacauaaugaaccagcaaaccgaggucacgaugcaguugucccuacuuauaccgcacaauacacacccaaauuaggucaaauacaaauagguacauggcaaacagaugacuuaacuguaucccaaccaguaaaauucacccccguuggauuaaacgauacugaacacuucaaucaauggguuguuccuagauaugcgggugcauuaaaccucaauacuaaccuagcacccaguguagcaccaguauuuccaggagaaagauuauuauuuuucagaucauacaucccacuuaaaggcggauauggaaacccagcaauagauugccuacuaccacaagaauggguccaacauuuuuaucaagaagccgcaccaucaaugucagaaguagcucuugucagauacauaaacccagauacuggaagagccuuauucgaagccaaauuacacagagcaggauucaugacuguaucuucaaauacauccgcuccaguugucguaccagcuaauggauauuucagauuugacuccugggucaaucaauuuuacucuuuagcaccaaugggaacagggaauggaagaagaagaguacaauaa

SEQ ID NO: 31311 - RNA, 1629 nt, Artificial Sequence
  derived and/or modified sequence opt6 from VP1,_capsid_protein__Norovirus__BAL60833
augaaaauggcaaguaaugacgcggcuccuucaacagacggagcagcuggacuaguacccgaaaguaacaaugaaguuauggcacuagaaccaguagcaggcgcugccuuagcagcaccaguaacuggacaaacaaacaucauagauccauggauacgagccaacuuuguacaagcaccaaacggcgaauuuacuguuucaccaagaaauagcccaggagaaguauuauuaaaucuagaauuagguccagaacuaaacccauauuuagcacacuuggcaagaauguauaacgguuacgcaggggguauggaaguacaagucaugcucgcuggaaaugcauuuaccgcaggaaaacuaguauucgcugcaguuccaccacacuuuccaguagaaaaucuauccccacaacaaauaacaauguuuccacacguaauaauagaugucagaacguuagaaccaguuuuauuaccacuaccagauguuagaaauaauuucuuucacuacaaccaaaaagaugauccaaaaaugcguauuguagcuauguuauauacucccuuaagauccaauggaucuggugacgacguauuuacaguuucauguagaguacuuacaagaccaucaccagauuuugacuucacauauuuaguaccaccuaccguagaaucuaaaacuaaaccauucacauuaccaauauuaacauuaggagaacuaucaaauuccagauuuccaguuucgauagaucaaauguauaccucccccaaugaaguuauuuccguacaaugucaaaacggaagauguacuuuagauggagaauuacaaggaacaacacaacuacaaguauccgguauuugugcauucaaaggagaaguaacagcacauuuacaugauaaugaucaucucuauaauguaacuauaacaaacuuaaacggaucaccuuucgauccaucagaagacauaccagccccucuuggcguaccugauuuucaaggcagagucuucgguguaaucucucaaagagauaaacauaacacaccaggacacaaugaaccagcuaaucgagcucaugacgcaguaguuccuacauacacugcacaauacacaccaaaacucggacaaauacaaauagguacauggcaaaccgacgaucuaaccguaaaucaaccuguuaacuucacaccaguaggacuaaacgacacugaccacuuuaaucaauggguagucccacgauaugccggagcacuuaaccuuaauacaaaucuagcaccuucaguagcaccaguauuuccaggagaaagacuuuuauuuuucagauccuauaucccacucaaagguggauauggaacaccagcaauugacugcuuacuuccacaagaauggguacaacauuucuaucaagaagccgcaccuucaaugucagaaguagcacuuguaagauauaucaauccugacacaggcagagcacuauuugaagcaaaacuucauagagccggauuuaugaccguuucaucaaauacaucagcacccgucguaguuccagcuaauggauacuuuagauuugauucauggguaaaucaauuuuauucauuagcaccuaugggcacaggaaacggacgcagacguauccaauaa

SEQ ID NO: 31312 - RNA, 1629 nt, Artificial Sequence
  derived and/or modified sequence opt6 from VP1,_capsid_protein__Norovirus__BAL60835
augaaaauggcuuccaacgaugcugcaccaucaacagauggcgccgccggucuaguaccagaaaguaauaaugaaguaauggcauuagaaccuguagcaggagccgcacuagcagcaccuguaacaggucaaacaaauauaauagaucccuggaucagagcaaacuucguacaagcuccaaauggagaauuuacuguaucuccuagaaauuccccuggugaaguucuacuaaaucuagaauuaggaccugaauuaaauccauaucucgcccauuuagcacgcauguauaacggauacgcagguggaauggaaguacaagucaugcuagcaggaaacgcauuuacagcuggcaaauuaguauuugcagccguaccuccacacuuuccaguugaaaaccuaucaccacaacaaauuacaauguuuccacauguaauaauugauguacgaacccuugaaccaguucuauuaccuuuaccugauguuagaaauaauuucuuccacuacaaccaaaaagaugauccaaaaaugcgaauagucgcuaugcuauacacaccacuuagaucaaacggcucaggagacgauguauucacuguauccugucguguacuaacaagaccaucaccagauuucgacuucacauaucuagucccaccaacaguagaaucaaaaacaaaaccauuuacuuuaccaauauuaacuuuaggugaauuauccaacucaagauuuccaguaucaauagaccaaauguauacaucaccaaaugaaguaauaucaguucaaugccaaaauggaagauguacacuagauggagaauuacaaggaacuacucaauuacaaguaucaggaauuugugcauuuaaaggagaaguaacagcacaccuacacgacaaugaucacuuauauaauguaaccauaacaaauuuaaacggaucuccauucgacccaagugaagauauaccagcaccucuaggagucccagacuuucaaggaagaguauuuggaguaauaucacaacgagacaaacauaacaccccaggccauaaugaacccgcaaauagagcucacgaugcaguaguaccaacauacacggcucaauauacaccaaaacuaggacaaauacaaauagguaccuggcaaacagacgaccuaacuguaaaucaaccagcaaacuuuacuccagucgguuuauccgauacagaucacuuuaaucaauggguaguuccgagauacgcaggugcacucaacuuaaacacaaaucuagcaccaagugucgcuccuguauucccaggagaaagauuauuauuuuuuagaucauauauaccauuaaaaggcggauacggaacaccugcuauagacugccuccuaccucaagaauggguacaacacuuuuaucaagaagcagcaccaucaauguccgaaguagcccuagugagauauauuaauccagauacaggaagagcauuauucgaagcaaaacuacauagagcaggauuuaugacaguauccuccaauacauccgcuccaguuguaguacccgcuaacggauauuuccguuuugauucuuggguaaaccaauucuauagucuugcaccaaugggaaccgguaauggucgucgacgaauacaauaa

SEQ ID NO: 31313 - RNA, 1629 nt, Artificial Sequence
  derived and/or modified sequence opt6 from VP1,_capsid_protein__Norovirus__BAL60837
augaaaauggcaucaaaugacgcagcaccaucaacagacggagcagcuggacuaguaccugaaucaaauaaugaaguaauggcacuagaaccagucgcaggagcagcacuagcugccccagucaccggccaaacaaacauaauugacccuuggauaagagcaaacuuuguccaagcaccaaauggagaauuuacuguaucaccacgaaacuccccaggagaagucuuauuaaauuuagaacuuggaccagaacucaacccauacuuagcucaccuagccagaauguacaaugguuacgcaggcggaauggaaguacaaguaaugcuugcaggaaaugcauuuacagcuggaaaacuaguuuuugcagcaguaccaccacauuuuccaguagaaaauuugucaccacaacaaaucacaauguucccacauguuauaaucgauguaagaacuuuagaacccguacuacuacccuuaccagauguaagaaauaacuucuuucauuauaaccaaaaagaugacccaaaaaugagaauugucgcaauguuauacacaccacuaagaucuaacggcuccggagaugauguauuuacaguaucaugcagaguacuaacucgaccaagccccgauuucgauuuuacauaucuaguuccaccaacuguugaaucaaaaacuaaaccuuucacauuaccuauacuuacccuaggagaacuaucaaacucaagauuuccuguuucuauagaucaaauguacacaucaccaaacgaaguaauauccguacaaugccaaaacggucgaugcacuuuagacggugaacuccaaggaacaacacaacuucaaguaucagguauaugugcauuuaaaggugaaguaacagcacaccuccacgauaaugaucacuuauauaauguaacuauuacuaaucuaaauggauccccauucgaucccucagaagauauccccgcaccucuagguguaccagacuuccaaggaagaguauucgggguaauaucucaacgagauaaacauaacacaccaggccauaacgaaccagccaaucgagcucacgaugcaguaguaccaacauacacugcacaauauacuccaaaacuaggacaaauacaaauaggaacauggcaaacugacgaccuuaccguaaaucaaccaguuaauuucacaccaguaggacuaucugauacagaucauuucaaucaaugggucguaccuagauaugcaggcgcauuaaauuuaaauacaaacuuagccccauccguagcuccuguauuuccaggugaaagacuacucuuuuuuagaucauauaucccauuaaaaggaggauauggaacuccagcaauagauugccuacuuccucaagaauggguacaacacuucuaucaagaagccgcgccaucaaugucagaaguugcuuuaguaagguacauaaauccagauacuggacgagcccuauucgaagcuaaacuacauagagcuggauuuaugacaguaaguucaaacaccucugcaccaguaguaguaccagcaaacggauauuuuagauucgauucauggguaaaccaauucuauucccuugccccaaugggaacugguaauggcagaagaaggauccaauaa

SEQ ID NO: 31314 - RNA, 1629 nt, Artificial Sequence
  derived and/or modified sequence opt6 from VP1,_capsid_protein__Norovirus__BAL60839
augaaaauggccucaaaugacgcugccccaucaacugauggagcagcuggauuagucccagaaucaaacaaugaaguaauggcauuagaaccaguagcaggagcagcucuagcagccccaguaacuggacaaacaaauauaauagacccauggauucgagcaaauuuuguacaagccccgaacggagaauuuacagucucaccuagaaauucacccggagaaguacuacuaaauuuagaacuagguccagaacuaaauccauaucuagcucacuuagcaagaauguauaauggauacgcagguggaauggaaguccaaguuauguuagcuggaaaugcauuuacagcaggaaaacuaguauucgcagcaguaccaccacauuuuccaguagaaaauuuaucaccacaacaaauaacaauguucccacacgugauaauugauguuagaacauuagaaccaguucuacuaccccucccagaugucagaaacaauuucuuucacuacaaccaaaaagaugacccaaaaaugcgcauaguagcaaugcuauacaccccacuacgaucaaauggaucuggugacgauguauuuacaguaucaugcagaguucucacaagaccaucaccugauuuugacuucaccuaucuaguaccaccaacuguagaaaguaaaacaaaaccauuuacauuaccaauacuaacacuaggagaauuauccaacucgagauuuccaguaucaauagaucaaauguacacuucuccaaaugaaguaauaaguguacaaugccaaaacggacgcuguacacuagacggcgaacuucaaggcacaacacaguuacaagugucaggaauuugugcauuuaaaggugaaguaacagcacacuuacaugauaaugaucacuuauauaauguaacuauuacaaacuuaaauggaucaccauucgaucccucagaagauauaccagcaccacuagguguaccagauuuucaagguagaguuuuugguguaaucucucaaagagauaaacauaacaccccaggacauaaugaaccagccaauagagcacaugacgcaguagucccaacauacacagcacaauauaccccaaaacuuggacaaauccaaauaggaacauggcaaacagacgaucuuacuguaaaccaaccuguaaauuucacaccuguaggauuaucagacacagaccauuuuaaucaauggguugucccacguuaugcaggcgcauugaacuuaaauacaaaccuugcaccuucaguugcacccguauucccuggugaaagacuacuauucuucagaucauacauaccauuaaaaggaggauacggaacuccagcaaucgacugcuuacuuccacaagaauggguacagcauuucuaucaagaagcagcaccauccaugucagaaguagcccucguaagauauaucaauccugauacagguagagcacuuuucgaagcuaaacuacauagagcaggauuuaugaccguaucaaguaauacaucagccccggucguaguaccagcuaauggauacuucagauucgauucaugggucaaucaauucuacucacuagcucccauggguacaggaaaugguagaagaagaauacaauaa

SEQ ID NO: 31315 - RNA, 1629 nt, Artificial Sequence
  derived and/or modified sequence opt6 from VP1,_capsid_protein__Norovirus__BAL60841
augaaaauggcaucaaacgaugcagccccaucuacagacggcgcagcaggacuaguaccagaaucaaacaaugaaguaauggcacuagaaccaguagcaggcgcagcuuuagcagcacccguaacaggacaaaccaauauaauagaucccuggauaagagcaaauuuuguccaagcaccaaauggugaauuuacagucucaccaagaaauucuccaggagaaguucuauuaaauuuagaauuaggaccagaacuaaacccuuacuuagcucaccuagcuaggauguauaacgguuaugccgguggaauggaaguacaagucaugcuugcugguaaugcauuuaccgcagguaaacuaguauucgcagcaguaccaccacauuuuccaguagaaaauuuaucaccacaacaaauaacaauguuuccacauguaauuauagauguacgaacacuagaaccaguacuauuaccucuuccagauguacgaaauaacuucuuucauuauaaucaaaaagaugacccaaaaaugagaauaguagcaauguuauacacacccuuacgcuccaacggcucaggcgacgacgucuuuacagugucauguagaguacuuacaagaccaucaccagacuuugacuuuacauaucuaguaccaccaaccgucgaaucaaaaaccaaaccauuuacauuaccaauuuuaacacucggagaauuaucuaacuccagauuucccguaucaauagaccaaauguauacaucccccaaugaaguaauuuccguccaaugccaaaauggaagguguaccuuagacggugaacuucaagguacaacacaacuucaaguauccgguauuugcgcauuuaaaggagaaguaaccgcacacuuacacgacaacgaucacuuauauaauguaacuauaacaaaucucaacggauccccuuucgauccaucagaagauauaccagccccuuuaggagucccagauuuucaaggaagaguguuuggaguaauaucacaaagagacaaacacaacacuccaggacauaaugaaccagcuaacagagcucaugaugcaguaguaccuacauauaccgcacaauacacacccaaacucggacaaauacaaauaggaaccuggcaaacagacgauuuaacaguaaaucaaccaguaaaauucacccccgucggauuaaaugauacugaucacuuuaaccaauggguaguaccacgcuaugcuggagcacuuaacuuaaauacaaaucucgcaccaaguguugcaccaguuuucccaggagaacgacuccuauucuuucguuccuacauaccacuaaaaggaggcuaugguacuucagcaaucgacugcuuacuaccacaagaauggguucaacauuucuaucaagaagcagcaccaucuaugucagaaguagcacuaguaagauauauuaauccagacacaggccgagcacuauuugaagcuaaauuacaucgagcuggauuuaugacuguaucaaguaauacaucugcaccaguuguaguaccagcaaauggauauuuccgcuuugauucuuggguaaaucaauuuuauucauuagcuccaaugggaaccggaaaugguagaagacgaauccaauaa

SEQ ID NO: 31316 - RNA, 1629 nt, Artificial Sequence
  derived and/or modified sequence opt6 from VP1,_capsid_protein__Norovirus__BAL60843
augaaaauggcaucaaacgacgcagcaccaucuacagacggagcagcaggucuaguaccugaauccaauaaugaaguuauggcuuuagaaccaguagcaggcgcagcauuagcugcgcccguuacuggacaaacaaacauaauagauccauggauucgagcaaacuuuguacaagcaccaaauggcgaauuuacaguaucgcccagaaaugcccccggagaaguucuccuuaauuuagaauuaggcccagaacucaaucccuauuuagcacauuuagcaagaauguauaacggauaugcaggaggaauggaaguucaaguaaugcuagcaggaaacgcuuuuacagcaggcaaauuaguguuugcagcaguaccaccacauuuuccaauagaaaaucuuaguccccaacaaauuacaauguucccacauguaauaauugaugucagaacauuagaaccaguauuauuaccucuaccagacguuagaaauaacuuuuuucauuacaaccaaaaagaugauccaaaaaugagaauaguagcaaugcuauauacaccauuaagaucaaauggaucuggcgaugacguauucacaguaucauguagaguauuaacuagaccaucgccugauuuugacuuuacuuaucugguaccaccaacaguagaaucuaaaacaaaaccauuuacauuaccaauacugacacucggugaauuaaguaauucuagauuccccgucagcauugaccaaauguauacuucaccaaaugaaguaauaucaguacaaugucaaaaugguagaugcacacuagauggagaacuacaaggcacaacacaauuacaaguaucaggaauaugugcuuuuaaaggagaaguuacagcacaccuacacgacaaugaccaucuuuauaauauaacaauuacaaaucuaaauggaucuccauucgaccccucagaagacauaccagcucccuuaggaguaccagauuuucaaggaaggguauucggcauaauuucucaaagagauaaacauaauucaccaggacauaaugaaccugcuaacagaggacaugacgcaguaguaccaacauauacagcacaauacacaccaaaacuaggacaaauucaaauaggaacauggcaaacugaugaccuuacaguaucucaaccuguaaaauucaccccaguuggacuaaacgauaccgaacacuuuaaucaauggguaguuccaagauacgcaggugcacuaaaucuaaauacaaauuuagcaccuucuguagccccaguauucccaggugaacguuuacuauuuuuucgaucauauauaccucuaaaaggaggauacgguaauccagcaauagacugucuacuaccacaagaauggguccaacauuuuuaccaagaagcggcucccagcaugucagagguagcacuaguuagauauauaaauccugauaccggacgagcucuauuugaagccaaauuacauagagcaggcuucaugacaguaucuucaaauacaagugcaccaguaguaguaccagccaacggauauuucagauucgacucuuggguuaaccaauucuauucacucgcaccaaugggaacaggaaauggacgaagaagaguccaauaa

SEQ ID NO: 31317 - RNA, 1629 nt, Artificial Sequence
  derived and/or modified sequence opt6 from VP1,_capsid_protein__Norovirus__BAL60845
augaaaauggcaucaaaugacgcagcuccaucaaccgauggugcugccggauuaguacccgaaucaaauaaugaagucauggcccuagaaccaguugcuggcgcugcacuagcugcaccaguaacaggacaaacaaauauaauagacccuuggauacgcgccaauuuuguucaagcaccaaauggcgaauuuaccguaucaccaagaaauucaccaggagaaguacuacuaaauuuagaacucggaccagaacucaacccuuaucuagcccaucuugcccguauguauaacgguuacgcaggaggcauggaaguacaaguaaugcuagcaggaaaugcauucacagcaggaaaauuagucuuugcugcaguaccaccacacuuuccaguugaaaauuuauccccacaacaaauaacaauguuuccucacgucaucaucgacguaagaacacucgaaccaguuuuauugccacuaccagauguacgaaacaacuucuuucacuauaaucaaaaagaugaccccaaaaugcgaaucguagccauguuauauacuccccuuagaucuaacggaucaggcgacgauguauuuaccguauccuguagaguauuaacaagaccaucaccagacuuugacuuuacauacuuaguaccuccaacaguagaauccaaaacaaaacccuucacuuuaccgauauuaacacucggagaacuauccaauucaagauuuccaguauccauugaccaaauguauacuucaccaaaugaaguaauaaguguacaaugccaaaacgguagauguacauuagacggugaauuacaaggaacuacacaauuacaaguaucaggaauaugcgccuuuaaaggagaaguaacagcacaucuacacgauaaugaccacuuauauaauguuacaauaacuaauuuaaacggaagucccuucgacccuucagaagauauaccagcaccguuaggaguaccagacuuucaaggaagaguauuuggaguuauaucucaaagagauaaacauaacaccccgggacacaaugaaccagcaaacagagcacaugacgcaguugucccuacauauaccgcacaauauacacccaaacuaggacaaauacaaaucggaaccuggcaaacagacgaucuuacaguaaaucaaccaguuaacuuuacacccgucggccuaaaugauacagaucacuuuaaucaauggguuguaccuagauacgcuggagcauuaaaccuaaacacaaaccuugcaccuucaguugcaccaguuuuuccaggagaaagacuuuuauucuuuagaagcuacauaccacuuaaaggaggauacggaacuccagcaauagauugccuauuaccucaagaauggguucaacauuucuaccaagaagcagcuccaucaaugucagaaguugccuuagucagauacaucaacccagacacaggacgugcauuauucgaagcaaaauuacauagagcuggauuuaugacaguaucuucuaauacaucagcaccaguaguugucccagcaaauggauauuuccgauucgacucuuggguaaaccaauucuauucucuagccccaauggguacaggcaacggaagacgacgcauacaauaa

SEQ ID NO: 31318 - RNA, 1629 nt, Artificial Sequence
  derived and/or modified sequence opt6 from VP1,_capsid_protein__Norovirus__BAL60847
augaaaauggcgucuaaugaugcagcaccaucaacagacggugcagccggucuggucccagaaucaaacaaugaaguaauggcuuuagaacccgucgcaggagcggcauuagcagcaccaguaacuggccaaaccaauauaauagaucccuggauaagagcaaacuucguacaagcaccaaauggcgaauuuaccguaucuccaagaaauucccccggagaaguauuacuaaauuuagaauuaggaccagaauuaaacccauaucuagcacacuuagcaagaauguauaauggauacgcuggugguauggaaguacaagucauguuagccggaaacgcauuuacugccgguaaacuaguuuuugcugcaguaccaccucauuuuccaguagaaaauuuaucaccccaacaaauaacuauguucccacauguaauaauagauguaagaacuuuagaaccaguacuauuaccacuucccgauguacgcaacaacuuuuuucacuacaaucaaaaagaugauccaaaaaugagaauuguagcaauguuguacacaccuuuaagaucuaacggcuccggagacgauguauuuacaguuuccugcagaguacuaacuagaccaucuccagauuuugacuucacauaccuaguuccucccaccguagaaucaaaaacuaaacccuucacauuaccaauauuaacccuaggagaauuauccaacucacgauuuccaguaucaauugaccaaauguauacaucaccaaacgaagucauaucaguacaaugccaaaacggaagauguacacuugauggcgaacuucaaggaaccacucaauuacaaguauccggaauaugugcauucaaaggagaaguuacagcacauuuacaugacaacgaucaucuauacaacguuaccaucacaaaccuuaauggaucaccauuugaucccucugaagacauaccugcaccacuagguguaccagauuuucaaggccgaguauucgguguaauaucacaacgagauaaacauaauacuccaggccacaaugaaccagcaaauagagcacaugaugcaguaguuccaaccuauacagcacaauauacaccaaaauuaggacaaauacaaauagguacauggcaaacggaugaucuaaccgucaaucaaccaguaaacuuuacacccguaggauuaagugacacagaucacuuuaaucaaugggucgucccaagauacgccggagcacuaaaucuaaauacaaaucuagcccccucaguagcaccaguauuuccaggcgaaagacugcuauuuuuuagaucauacauuccucuaaaaggcggcuauggaacuccagccauagauugucuucuaccacaagaauggguucaacauuucuaucaagaagcagcuccauccaugucugaagucgcauuaguacgauacauaaauccagauacaggaagagcauuguuugaagccaaacuacacagagccgguuuuaugacaguaucaucaaacacauccgcuccagucguaguaccagcaaaugguuauuucagauucgacaguuggguaaaccaauucuauucucuagcaccaaugggcacaggaaauggaagaagacgcauacaauaa

SEQ ID NO: 31319 - RNA, 1629 nt, Artificial Sequence
  derived and/or modified sequence opt6 from VP1,_capsid_protein__Norovirus__BAL60849
augaaaauggcuuccaaugaugcagcaccaucaacugauggcgcagcaggauuaguaccggaaucuaauucagaaguaauggcauuagaacccguugcaggagcagcauuagcugcaccuguaacaggacaaacgaauauaauagauccauggauaagagcaaacuucguacaagcaccaaauggugaauuuaccguuucaccacgaaaugcuccaggugaagugcuacuuaauuuagaauuaggacccgaauuaaacccauaucuagcacaucuagcuagaauguacaacggcuacgcaggaggaauggaaguacaaguaaugcuagcaggaaacgcauucacagcagguaaacuagucuuugcugcaguacccccacauuuuccaauugaaaaucuaucaccacaacaaauaacaauguuuccacauguaauaauugacguccguacacuagaaccaguacuccuaccacuaccagauguaagaaacaauuucuuucacuacaaucaaaaagacgacccaaaaaugagaauuguagccauguuauauacuccacuuagaucaaacggcucaggagaugauguauuuacuguaucuuguagaguauuaacaagaccaucuccugauuuugacuuuacuuaucucguaccaccuacaguagaaaguaaaacuaaaccuuucacauuaccaaucuuaacacuuggcgaacucucaaauucaagauuuccaguaucaaucgaucaaauguacacaucacccaacgaaguaauaucaguacaaugccaaaauggaagaugcacuuuagacggagaauuacaaggaacaacucaacuccaaguuaguggaauaugcgccuuuaaaggugaaguuacagcucaccuacaugacaacgaucaccuuuauaauauaaccauaacaaaucuaaauggaucaccuuuugaucccucugaagacauaccugcaccacuaggaguaccagacuuccaaggaagaguauuuggaauaauuucccaacgagacaaacauaauucuccaggccauaacgaaccagccaauagaggacaugacgccgucguaccaacauacacagcccaauauaccccaaaauuaggacaaauacaaauaggcacauggcaaaccgacgaucuaacaguuucccaaccagucaaauucacuccugucggacuaaacgacacagaacacuuuaaccaauggguaguaccaagauacgcaggagcccuaaacuuaaacacaaacuuagcaccuuccguugccccuguauuuccaggagaacgauuacucuucuuuagaucauacauaccauuaaaagguggauauggaaauccagcuauagauuguuuauuaccucaggaauggguacaacauuucuaucaagaagcagcaccuucaaugucagaaguagcauuaguaagauauauuaauccugacacuggaagagcauuauucgaagcaaaacuccauagagccggcuuuaugaccguaucaucuaauaccagugccccaguaguuguucccgcuaauggcuauuucagauucgauucauggguaaaucaauuuuacucauuagcaccaaugggaaccggaaauggaagacgaagaguacaauaa

SEQ ID NO: 31320 - RNA, 1629 nt, Artificial Sequence
  derived and/or modified sequence opt6 from VP1,_capsid_protein__Norovirus__BAL60851
augaaaauggcuucaaacgaugcugcuccaucaaccgauggagcagcaggccuaguccccgaaucaaauaaugaaguaauggcucuagaaccaguugcaggagcagcacuagcugcacccguaacaggacaaacaaauauaauagaccccuggaucagagcaaacuuuguacaagcaccaaacggagaauucacaguuuccccaagaaaugcaccaggagaaguacuacuuaauuuagaacuaggaccagaauuaaacccauaccuugcacaccuugcaagaauguacaaugguuacgcaggaggaauggaaguacaagucaugcucgcaggcaacgcauuuacugcaggaaaauuaguuuucgcugcaguccccccucacuuuccaauagaaaauuuaucaccacaacaaauaaccauguuuccccacgucauaaucgacguuagaacucuugaaccaguucuacuuccacuaccagacguucgcaauaacuucuuucacuauaaucaaaaagaugauccaaaaaugagaauuguugcaaugcuauauacaccacucagaucaaacggaucaggagacgauguuuuuacaguuuccugccgaguacuaacuaggccaucaccagauuucgacuucacauaucuaguucccccaacuguagaaucuaaaacuaaaccauuuacacucccaauacuaacacuaggagaacuuuccaacagccgauuuccaguaucaauagaccaaauguauacaucaccaaaugaaguaauaucuguucaaugucaaaacggaagauguacuuuagauggagaauuacaagguaccacacaauuacaaguaucuggaauaugugccuuuaaaggugaagucacagcacaccuacacgauaaugaucacuuauacaauauaaccauaacaaacuuaaauggaucaccauucgauccaucagaagauauacccgcaccacuaggaguaccugacuuccaaggaagaguauucggaauaauuucucagagagacaaacauaacucaccaggacacaacgaaccugccaauagaggccacgacgcaguaguaccaaccuauaccgcacaauacacuccaaaacuuggacaaauacaaauagguacauggcaaacugacgauuuaacagucagucaaccaguaaaauuuacaccagucggacuaaaugacacagaacauuucaaccaauggguaguaccacgauaugcaggagcacuaaaccuuaauacuaacuuagcaccaucaguagcaccaguauuuccaggagaaagauuacucuuuuucaggucauacauaccauuaaaaggaggauacgguaauccagcuauugacuguuuauuaccacaagaauggguacaacauuucuaccaagaagcagcaccuucuaugucagaaguagcuuuaguaagauacauaaaucccgacacuggaagagcacucuucgaagcaaaauuacauagagcaggauucaugacaguuucaucaaauacaucugcaccaguaguagucccugcaaaugguuacuucagauuugauuccuggguaaaccaauucuauucucuagcaccaaugggaacuggaaauggccgaagaagaguacaauaa

SEQ ID NO: 31321 - RNA, 1647 nt, Artificial Sequence
  derived and/or modified sequence opt6 from VP1__Norovirus__AAT00378
augaaaauggcuucaaaugaugcuacaccauccaaugauggagcugcuggauuaguuccugaaauaaauaaugaagcaauggccuuagaccccguagcaggagcagcaauagcagccccacuaaccggucaacaaaacauaauagauccauggauaaugaacaacuucguacaagcaccaggaggagaauuuacaguaucuccaagaaauaguccaggagaaguccuacucaaccuagaacuaggcccugaaauaaauccauaccuagcucauuuagcaaggauguauaauggcuaugcuggaggauucgaaguccaagucguacuagcaggaaaugccuuuacugcagguaaaauaaucuuugcagcaauaccaccaaauuucccaauagauaaucuauccgcagcacaaaucacaaugugcccccauguaauaguagauguaagacaguuagaaccaguaaaucuuccuaugccagauguaagaaauaauuuuuuucacuauaaccaagggucagacucaagacuaagauuaauagcaaugcuauauacaccauuaagagcaaauaauucaggagacgacguauuuacuguaucaugucgcguauuaacacgaccaaguccagauuuuucauuuaacuuuuuaguuccaccuacaguagaaucaaaaaccaaaccauucacuuuaccaauauuaaccauuuccgaaaugucaaauuccagauucccaguaccaauagacucauuacauacaucuccaacugaaaauauuguaguacaaugccaaaauggaagaguaacauuagauggugaguuaaugggaacuacucaacuauuaccaagccaaauaugugcuuuucgcggaguucucacacgaucuacaucuagagcaucugaucaagcugauacaguaacaccaagacuuuucaauuacuacuggcacauucaauuggauaauuuaaauggaacacccuacgacccugcagaagacauaccagguccacuagguacuccagacuuccgagguaaaguauucggugucgccucucaaagaaauccagauucaacaacuagagcacaugaagcaaaaguagauacuacugcaggaagauuuacaccuaaacuagguucucuagaaauuagcacagaaucugacgauuuugaucaaaaucaacccacaagauucgcaccaguugguauagguguagaucgagaagcaggauuccaacaauggaguuuacccgacuauucaggacaauuuuccagaauaaugucauuagcuccagcaguagcaccaaucuuuccaggugaacaauuauuauucuuuagaagucaauuacccucaucaggcggcagaucaaaugguauauuagacugccuaguaccacaagaauggguacaacacuuuuaccaagaauccgcaccagcacaaacucaaguagcuuuaguacgcuauguaaauccagauaccgguagaguauuauuugaagcuaagcuacacaaauuaggauuuaugacaauugccaaaaacggagauucgccaauaacaguaccaccuaauggauauuuuagauucgaaaguuggguaaauccauuuuacacauuggcaccaaugggaacaggaaauggaagacgaagaauccaauaa

SEQ ID NO: 31322 - RNA, 1626 nt, Artificial Sequence
  derived and/or modified sequence opt6 from VP1__Norovirus__ABD95934
augaaaauggcaucaaaugacgcagccccaucaaacgauggagccgcaggacuaguaccagaaauaaauaccgaaacucuuccacuugaaccuguagccggagcagcccuagcugccgcaguuaccggacaaucaaacaucauugacccuuggauacgaaccaauuuuguacaagcaccuaacggagaauuuacaguaucccccagaaauucaccuggagaaguacuacucaaucuagaacuaggaccagacuuaaauccauauuuagcacaccuaucaagaauguacaacgguuacgcagguggaguagaaguccaaguauuauuagcaggcaaugcauuuacugcuggaaaaauuuuauucgcugcugucccuccuaauuuuccaguagaauuccuuucacccgcacaaauuacaauguuaccccacuuaauagucgauguaagaacacuagagcccauaaugauacccuuaccagacgucagaaacacauuuuuucacuauaauaaccgcccaucagaacguaugcgauuaguagcaaugcuauacaccccauuaagauccaacggaucaggagaugauguuuuuacuguauccuguagaguccuuacuagaccuacacccgacuuugaauuuacauacuuaguaccaccaucuguagaaucaaaaacaaaacccuuuucacuaccaauucuuacaauaucagaacucacuaauucccgauuccccgcaccuauagacucucuauucacagcacaaaauaauaaucuuaauguacaaugucaaaacggaagauguacauuagauggagaauuacaaggaacaacacaacuucuacccacuggaauaugugcauuuagaggaaaaaucucagcagacguacaaaauucccaucaagaccguuggcacaugcaauuaacaaaccuuaauggaaccccuuuugaccccacagaugaugugcccgcuccucuaggaacaccagauuuuaccggauuacucuuuggaguugcaucucaaagaaauguuggaggcacaggaaacaauacaacaagagcucaugaaguaguaauugcaacuacaucaacacaauuuguaccuaaauuaggaucaauaaauuucgguagcgaaucagaagacuuucaaguaggcccaccaacuaaauuuaccccaguaggaauaaaaauagagacaggucauucauuucgacaaugggauccaccaaacuacucaggagcacuaacacuaaauaugaaccuagcaccacccguagcaccaaacuuuccaggagaacaauuauuauucuuccgaucaaaugucccuugcgcaggaggaguaucagaagguauaauagacugcuuacucccacaagaauggauacaacauuucuaccaagaauccgcaccaucccaaucagauguugcuuuaauacgauacguuaauccugacaccggcagaacucucuucgaagcaaaauuacauagaacaggauacauaacaguagcacauuccggggauuauccauuagucguacccucaaacgguuauuuucgcuucgacuccuggauaaaccaauucuauagucucgcacccaugggaacugguaauggaagacgcagaguacaauaa

SEQ ID NO: 31323 - RNA, 1623 nt, Artificial Sequence
  derived and/or modified sequence opt6 from VP1__Norovirus__ABG49509
augaaaauggcaucaaaugaugcaaaccccucagauggaucuacugcaaaccuaguaccagaaguaaacaaugaagucauggcccuagagcccguaguuggagcagcaauugcugcaccaguagcuggacaacaaaacgucauagacccauggauaagaaacaacuuuguucaagcaccaggaggcgaauuuacaguaucaccacgaaacgcaccaggagaaauauuauggucagcaccauuaggacccgaucuaaauccauacuuaucacacuuagcaagaauguauaauggauaugcaggcggauuugaagugcaaguaauucuagcuggaaaugcauuuaccgcaggaaaaauaauauuugcagcugucccuccaaacuucccuacagaaggauuaucucccucucaaguaacaauguuuccacauauaaucguagauguaagacaacuagaaccaguucuuauaccauuacccgauguacgaaacaacuuuuaucacuauaaccaaucaaaugauccuaccauaaaauugauagcaaugcuuuacacacccuugagagcaaacaacgcaggagaagauguauucacuguauccuguagaguauuaacaagaccuucaccugauuuugacuucauauuuuuaguaccacccacugucgaaucaagaacuaaaccuuuuacuguaccaauauuaacaguagaagaaaugacaaacuccagauucccaauaccacuagaaaaacuauucacaggacccucaggagcauucguaguacaaccacaaaauggaagauguacaacugaugguguauuauuaggaacaacccaacuauccccaguaaacauauguaccuuuagaggcgacguuacacauauagcugauacccauaauuacacaaugaaucuagcaucacaaaacuggaacaauuaugacccaaccgaagaaauaccagcaccucuaggaacaccggauuucguagguaaaauccaaggaauguuaacacagacaacuagaggugauggcuccacaagaggacauaaagcaacuguaucaacuggagauguucauuucacacccaaacuuggaucuauucaauucaauacagauacaaauaacgacuucgaaacaggacaaaacacaaaauucacuccuguugguguaguacaagaugguaacggaacacaucaaaaugaaccucaacaauggguccuaccauccuacuccggacgaacaggacauaacguacacuuagcuccagcaguagcacccacguuucccggugaacaacuacuauucuucagaucaacaaugccagguugcucaggauauccuaauaugaauuuagauugucuucuaccccaagaauggguacaacacuucuaucaagaagcugcaccagcccaaucagacguagcauuauuacgcuuuguaaacccagacacaggaagaguauuauucgaaugcaaauuacacaaaucgggauauguaacaguagcacauacuggacaacacgaccuuguaauaccaccaaauggcuauuuucguuucgauucauggguaaaucaauuuuauacacuagcuccaaugggaaauggaacaggucgaagacgugcacuauaa

SEQ ID NO: 31324 - RNA, 1623 nt, Artificial Sequence
  derived and/or modified sequence opt6 from VP1__Norovirus__ABP88833
augaaaauggcuacuaaugaugcaucaccaucugauggaaguacugcaaacuuagucccagaagucaacaaugaagugauggcauuagaaccuguaguuggagcagcaauagcagcaccaguagcaggacaacaaaacguuaucgauccauggauacguaauaauuuuguacaagcaccaggaggugaauuuacaguaucaccucgaaaugcuccaggugaaauuuuaugguccgcacccuuagguccugaucuaaauccauacuuaucacaucuugccagaauguacaaugguuaugcaggaggauucgaaguugaaguaauccuggcaggaaaugcuuucacagcagguaaaauaauuuucgccgcuguaccaccaaacuuuccuacagaaggacuaucuccaucacaaguaacuauguuuccacauauaauagucgaugucagacaguuagaaccaguacuuauaccauuaccagacguaagaaauaauuuuuaucacuauaaucaaucuaacgacucaacaauuaaauuaauagccauguuauacacaccuuuacgugcaaauaaugcaggagaugacguauuuacaguaucaugcagaguuuuaacaagaccaucaccagacuuugauuucauauuuuugguaccaccaacaguugaaucacgaacaaaaccauucaccguaccaauacuaaccguagaagaaaugacuaauucaagauuuccaauuccacuagaaaaacuauucacaggaccaucuucugcauuagucguacaaccacaaaauggacgaugcacaacagacggaguauuauuagguacaacacaauuaucaccugucaauaucuguacauucagaggugauguaacacauauuuccggaacacguacauacagaaugaauuuagcaucacaaaacuggaacaauuaugacccaacagaagaaauacccgccccuuuaggaacaccugacuuuguuggaaaaauacaaggcaugcuaacacaaacaacaaaaggagauggauccacaagaggccauaaagcuacaguaucaacagguucaguagauuuuaccccaaaauuaggaucgguccaauucgcaacugauacagauaaugauuuugaaacuggacaaaauacucgcuuuacaccaguaggaguuauccaagauggaaguucagcacauagaaacgaaccacaacaauggguucuuccggacuauagcggacgaacaguacauaacguacaucuagcaccagcaguagcaccaacauuccccggagaacaacucccuuuuuucagaucuaccaugccaggauguucagguuauccuaauauggaucuagauugucuauuaccacaagaauggguacaacacuuuuaucaagaagcagcaccaucacaaagugauguagcauuacuaagauuuguaaacccugacacaggacgaguuuuauuugaaugcaaacuacauaaagcaggauaugucacuguagcucauacaggucaacacgaucuaguaauaccccccaacgguuacuuccgcuuugauucauggguaaaucaaaguuauaccuuagcuccaauggggaauggagcaggcagaagaagagcuuuauaa

SEQ ID NO: 31325 - RNA, 1623 nt, Artificial Sequence
  derived and/or modified sequence opt6 from VP1__Norovirus__ABY27560
augaaaauggcaucaucagaugcuaguccuagcgauggaucaacagcaaauuuaguaccagaagucaacaacgaaguaauggcacuagaaccaguagucggagcagcaaucgcugcuccgguagcuggucaacaaaacgucauagauccuuggaucagaaacaacuucguucaagcaccaggaggugaauuuacuguauccccaagaaaugcacccggagaaauccuauggucugcaccauuaggacccgauuuaaauccuuaucuaucccauuuagcacgaauguauaauggauacgcaggaggauuugaaguacaaguaauucucgcagguaaugcauuuacagcaggaaaaauaauauucgcagcuguaccaccaaacuuucccacugaaggacuaaguccaucccaaguaacaauguuuccacauauaauaguugacguccgacaauuagaaccaguauuaauuccacuaccagacguucgaaacaacuuuuaccacuacaaucaaagcaaugaccccacaauaaaguuaauugcaaugcuauacacgcccuuacgugcaaacaacgcaggagaugacguauuuaccguaucaugucguguacucaccagaccuucccccgauuuugacuuuauauuccuaguaccaccaacaguagaaucucgaacaaaaccauucacaguaccaauacuaacuguagaagaaaugacuaacucucgauuuccaauaccauuagaaaaauuauuuacgggaccaaguggagccuucguaguacaaccacaaaauggaagauguacaacugauggaguuuuauuaggaaccacucaauuaucuccaguaaacauauguacauucagaggagacguuacucacauagcaggcacacacgauuauacaaugaaucuagcuucacaaaauuggaacaauuacgacccaacugaagaaauucccgcaccgcuagguacaccugauuuuguuggaaaaauacaaggaguauuaacacagacaaccagaggagauggaagcacuagaggacacaaagcaacaguuucuacagguuccguacacuuuacccccaaacuaggaucaguccaauucacaacagauacaaauaacgacuuagaaacuggucaaaauacaaaauucacuccuguagguguaguacaagauggaaacucagcccaucaaaaugaaccacaacaauggguauuaccaaacuauagcggaagaacaggccauaauguacaccuagcaccagcaguagcaccaacauuccccggugaacaauuauuauuuuuuagaucaacaaugccaggauguucaggauaccccaacaugaaucucgacugucuauuaccacaagaauggguucuacauuucuaucaagaagcagccccugcucaaucagacguagcacuacuaagauuuguaaaccccgauacaggcagaguauuauucgaaugcaaacuacacaaaucaggcuauguaacugucgcacacacaggaccacacgaucucguaauaccuccaaacggauauuuucgauuugauucaugggucaaucaauucuacacauuagcaccuaugggaaacggagcuggacguagacgugcucuuuaa

SEQ ID NO: 31326 - RNA, 1620 nt, Artificial Sequence
  derived and/or modified sequence opt6 from VP1__Norovirus__ACT76139
augaaaauggcauccucagaugccaaucccucugacgguucagcagcaaauuuaguaccggaaguuaauaaugaaguaauggcccuagaaccaguugucggagcagcuauagccgcuccaguagcaggacaacaaaauauaauugauccauggauaagaaauaacuucguacaagcccccggaggagaauucaccguaucccccagaaacgcaccaggcgaaauacuuuggucagcuccacuaggaccugacuuaaacccuuauuuaagucaccuaucaagaauguauaacgguuaugcaggagguuuugaaguacaaguaauacuugcaggaaaugcauuuacagcuggcaaaguuauauucgcagcaguaccucccaauuucccaacugaaggacuuucuccaucucaaguaacuauguucccucacauaauaguagauguuagacaauuagaaccaguauuaauaccacucccagacguaagaaauaacuucuaucauuauaaucaagcacacgauucaacuuuaaaacuaauagcaaugcuauauacaccacuccgagcaaacaacgcaggagacgacguauucacaguuucaugucguguacuuacaaggccaucuccagauuucgauuuuaucuuccuuguaccaccaacaguagaaucaagaaccaaacccuuuacuguaccaauccuaacaguagaagaaaugucaaauucacguuuuccaaucccacuagaaaaauuauacacuggaccuucuucagccuuuguagugcaaccacaaaacggaagauguacaacugaugguguauuacucggaacuacacaauuaucagccgucaacauaugcaauuucagaggagacgucacaagaguaggaauaucucaugacuauacuaugaacuuaguaucacaaaacuggaauaacuaugaucccacagaagaaauaccagcuccacuaggaaccccagauuuuguagguaaaauucaaggcuuauuaacucaaaccacaagagcagacggauccacaagagcacacaaagcaacaguuucaaccggaucuguacacuucacaccaaaauuaggaucaguacaauuuacaacugauacaaauaaugacuuucaaacaggacaaaacacaaaauucacaccaguaggcguaauacaagauggugaccaccaccaaaacgaaccacaacaauggguacuucccaauuauucaggaacuucaggacauaauguucaccuagcaccagcaguagcacccacauucccuggcgaacaacucuuauuuuuucgaucuacuaugccaggaugcucugguuauccaaauaugaacuuagauugucuauuaccacaagaauggguacuacauuuuuaccaagaagcagcaccagcucaaucagacguugcauuacugcgauucguaaauccagacacagguagaguacuuuuugaaugcaaauuacacaaaucuggcuacauuacuguagcacacacugguccuuaugaucuaguaauaccaccgaauggauauuuucgauucgauucauggguaaaucaauuuuacaccuuagcaccaauggguaauggaaccggacgaagacgugcacuauaa

SEQ ID NO: 31327 - RNA, 1620 nt, Artificial Sequence
  derived and/or modified sequence opt6 from VP1__Norovirus__ACT76142
augaaaauggcuuccuccgaugcaaauccaucagaugguuccacugcaaaccucguaccagaaguaaauaaugaaguaauggcacuugaaccugucgucggugcugcaauagcagcaccaguagcuggacaacaaaauauaauagacccuuggauaagaaacaauuucguacaagcaccaggaggugaauuuacaguauccccacgcaaugccccaggagaaauacuauggagcgcaccucuauccccagaucuaaauccauauuuaucucauuuaucacgaauguauaacggauaugcaggaggauuugaaguacaaguaauacuugccggcaaugcauucacugcuggaaaaauaauuuuugcagcaauaccucccaauuucccuacagaaggacuaucccccucucaaguaacuauguucccucacaucauaguagacguacgacaauuagaaccaguauuaaucccccuacccgacguuagaaacaacuucuaucauuauaaccaagcacaugacucuacacuaaaacuaaucgcaaugcuauauacuccccuacgagcaaauaaugcaggagaugacguauuuacaguuuccugucgaguacuaaccagacccucaccagacuucgauuucaucuuuuuaguuccucccacaguagaaucuagaacaaaaccuuuuacaguaccaauacuuacaguagaagaaaugucaaacucuagauuuccaauaccacuagaaaaacuauacacaggaccaucaucagcauuuguaguacaaccacaaaacggaagaugcaccacugacggaguuuuauuaggaacuacccaacuauccgcaguaaauauaugcaauuuccgaggugauguuacacgaguuggaauaucacacgacuacacaaugaaccuaguaucccagaacuggaauaauuaugauccaaccgaagaaauaccagcaccauuaggaacuccagacuuuguaggcaaaauacaagguuuauuaacacaaacaacacgcgcugauggaucaacaagagcacauaaagccacagucucuacuggaucaguccauuucacaccaaaauuaggaucaguacaauuuacaacagauacaaacaacgauuuccaaacaggacaaaacaccaaauucacaccaguaggaguuauccaagauggugaccaucaccaaaacgaaccacaacaauggguacuuccaaacuacaguggaacuucuggacacaauguacaccuagcaccugcaguagccccaaccuuuccuggcgaacaacuacuauucuuucgauccacaaugccaggauguucaggcuacccuaauaugaaccuagacugcuuacuaccucaagaauggguaucacauuuuuaucaagaagcugcuccagcucaaucagacguagcacuacuaagauuuguaaauccagacacaggcagaguacuauuugaauguaaacuacacaaaucaggcuacaucacuguagcccauacaggaccauaugaccuaguaauaccaccaaacggauauuucagauuugauuccugggucaaccaauuuuauacauuagcaccaaugggaaacgguaguggaagaaaaagaguacuauaa

SEQ ID NO: 31328 - RNA, 1620 nt, Artificial Sequence
  derived and/or modified sequence opt6 from VP1__Norovirus__ACT76145
augaaaauggcuucaucagacgcaaaccccucagauggcuccgcugcaaauuuaguaccugaagucaauaacgaagucauggcacucgaacccguuguaggagccgcuauagcugcaccuguagccggacaacaaaauauaaucgauccauggauaagaaacaauuuuguacaagcaccuggaggagaauucacaguuuccccccgaaaugccccuggagaaauacucuggucagcuccuuuaggaccugaucuaaaccccuaccucagucaccucucaagaauguauaacggauaugcaggaggauucgaaguacaaguaauucuagcaggcaaugcauuuacggcuggaaaaguaauauucgcagcagucccacccaacuuuccaacagaagguuuaucuccgucucaaguaacaauguucccacacaucaucguagacgucagacaauuagaaccaguccuaauaccauuaccagauguacgaaacaauuuuuaucauuauaaucaaucacaugacucaacacucaaacuuauagcaauguuauauacaccucuucgagccaacaaugcaggagacgacguuuucacaguuuccuguagagucuuaacaagaccuaguccagauuuugauuuuauuuuccuaguuccuccuacaguagaaucuagaacaaaaccauucacaguacccauauuaacaguagaagaaaugucaaauagucgauucccuauaccacuagaaaaacucuauacagguccaucuucugcauucguaguacaaccacaaaauggaagauguacaaccgauggagucuuacucggaacaacucaacuuuccgcuguaaacauaugcaauuuuagaggagacgucacacauauaguaggaucccacgacuacacaaugaaucucguuucacaaaacuggucuaauuacgauccuacagaagaaauaccagccccacuaggaacaccagacuucguaggcaaaauacaagguuuacuuacacaaacuacucgagcagauggaucaacaagagcccauaaagcaacaguaucaaccggaucaguacacuuuacaccaaaacuuggauccguacaauucaccaccgauacaaauaacgauuuucaaacuggccaaaacacaaaauucacaccaguuggaguaauacaagacggagaucaccaucaaaacgaaccccaacaauggguauuacccaacuacucaggcagaacaggacauaauguacaccuugcaccagcaguagcaccaacauuuccaggcgaacaauuacuauuuuucagaucaacaaugccagguuguucaggauacccaaacaugaauuuagauuguuuauuaccacaagaauggguauuacauuuuuaccaagaagccgcacccgcacaaagugaugucgcuuuauuacguuuuguuaacccugauacaggaagaguacuauuugaauguaaacuccacaaaucuggcuacaucaccguugcccauaccggaccauacgacuuaguaauuccaccaaacgguuacuuuagauuugacuccuggguaaaucaauucuauacauuagcacccaugggaaacggcacaggcagacgaagagcacucuaa

SEQ ID NO: 31329 - RNA, 1620 nt, Artificial Sequence
  derived and/or modified sequence opt6 from VP1__Norovirus__ACT76148
augaaaauggcaaguaacgaugcaaauccauccgacgguucagcagcaaaucuaguuccagaaguaaauaaugaaguaauggcacuagaaccuguaguaggagcagccauagcagcaccagucgcaggccaacaaaacguuauagauccauggauacgaaacaauuucguucaagcaccagguggagaauucacaguaucuccacgaaacgcuccaggugaaauacuuuggucagcaccacuaggcccagauuuaaacccuuaucuuucacauuuaucuagaauguacaauggauacgccggaggauuugaaguacaaguaaucuuagccggaaaugcuuuuacagccgguaaaguaauauuugcagcgguacccccaaauuucccaacagaaggauuaucacccucacaagucacaauguuuccucauauaauaguagacguacgacaacuagaaccuguuuuaaucccacuaccugauguuagaaauaacuuuuaccacuauaaucaagcacacgauuccacuuuaaaauuaauugcaaugcuauauacaccacuaagagcuaauaaugcuggagaugauguauuuacaguaaguuguagaguauuaacacgaccaucaccagacuuugacuucauauuucuuguaccaccaacaguugaaucaagaacaaaaccauuuacaguccccauauuaacaguugaagaaaugucaaauucuagauuccccauaccacuagaaaaauuauacacuggaccauccuccgcauuuguaguccaaccucaaaaugguagaugcacaaccgacggaguacuauuaggaacaacucaauuaucugcaguuaacauauguaauuuccgaggugacguaacacauauugucggaucacacgauuauacaaugaaccuaguaucacaaaacuggucuaacuaugacccaacagaagaaauacccgcaccacuaggcacaccugacuucguaggcaaaauacaaggacuacuaacacaaacuaccagagccgacggaucaacacgagcccacaaagcaacaguaaguacaggaucuguacacuuuauuccuaaacucggaucaguacaauuuacaacagauaccaacaaugauuuucaaaccggacaaaacacaaaauucacaccaguaggugucauucaagauggagaucaccaucaaaaugaaccacaacaauggguacuaccaaauuacucuggacgaacaggacauaauguacaccuagccccggcaguugcaccaacauuuccaggcgaacaacuauuauuuuuuagaucaacugucccaggaugcucuggauaccccaauaugaaccuagacugucuauuaccucaagaauggguuagucauuucuaucaagaagcagcaccagcacaauccgauguugcacucuuaagguuuguaaauccagauacagguagaguacuauucgaaugcaaacuacauaaaucaggauacauaacaguagcccacaccggacccuacgaucuaguucuuccuccaaacggauauuucagauucgauucauggguaaaucaauucuacacacucgcaccuauggguaauggaaccggacgaagaagagcacuauaa

SEQ ID NO: 31330 - RNA, 1620 nt, Artificial Sequence
  derived and/or modified sequence opt6 from VP1__Norovirus__ACT76151
augaaaauggccucaucagacgcuaacccaucagauggaucagcagcaaacuuaguucccgaaguuaauaaugaaguuauggcuuuagaaccaguaguaggagcagcaauagcagcaccuguagcaggacaacaaaacguaauagauccauggauuaggaauaauuuuguacaagcaccaggaggugaauuuacaguuucaccaagaaacgcaccaggagaaauauuaugguccgcaccacuaggucccgaucuaaaucccuaucucucacaccuaucaagaauguacaacggauacgcaggaggauucgaaguccaaguaauauuagcaggcaaugcguuuaccgcaggaaaagucauauuugccgccgugccaccaaauuucccuacagaagguuuaucacccucucaaguaaccauguucccacauauuauaguugacguaagacaacuagaacccguauuaauaccacuaccagauguacguaauaauuuuuaucacuauaaccaagcacacgauucaacucuuaaacuuauagcaauguuauacacaccacuaagagccaacaaugcaggagacgacguauucacaguaaguuguagaguacuaacaagacccucaccugacuuugauuuuauauuucuuguacccccaacaguugaaucucgaaccaaaccauucacaguacccauacuaacaguagaagaaaugucuaacuccagauuuccaauacccuuagaaaaacuauauacaggaccuuccucggcuuucguuguccaaccucaaaacggccgaugcacaaccgacggcguucuacuagguacaacacaauuaucagcagucaauauauguaauuuuagaggcgauguuacucgagucggaauaucucaugauuacacuaugaaucuuguaagucaaaauuggaacaauuaugacccaacugaagaaauacccgcaccauuaggaacaccugacuuuguaggaaaaauacaaggauuauuaacucaaacaacuagagcagauggcucuacacgagcacacaaagcaacaguaucaacaggaucaguacauuucacacccaaauuaggcucaguacaauuuaccacagauaccaauaaugauuuucaaaccggacaaaauacaaaauuuacaccaguaggcguaauucaagacggugaccaucaucaaaaugaaccacaacaauggguauuaccaaacuauucaggaacauccggccauaacguacacuuagcaccagcuguagcaccaacuuuuccuggagaacaauuauuauuuuuccguucaacaaugccuggcuguuccggauacccuaacaugaacuuagacugucuauuaccccaagaauggguacuacauuuuuaccaagaagcagcaccagcacaaucagauguagcacuccuaagauucguaaauccagauacaggccgagucuuauuugaauguaaauuacacaaauccggauacauaacuguugcacacaccggaccauaugaccuuguaauaccaccuaacggauacuucagauuugacucauggguaaaucaauucuauacacucgcaccuaugggaaacggaacaggacgccgaagagcauuauaa

SEQ ID NO: 31331 - RNA, 1623 nt, Artificial Sequence
  derived and/or modified sequence opt6 from VP1__Norovirus__ACX31821
augaaaauggcaucaaaugacgcaaauccaucagacggauccacagcaaaccuagucccagaaguaaacaaugaaguuauggcauuagaacccgucguaggagccgcaauagccgcaccaguagcaggacaacaaaaugugauagacccauggauaagaaauaauuuuguacaagccccaggaggagaauuuacagucucaccaagaaaugccccaggagaaauacuaugguccgccccacuagguccagauuuaaauccauauuuaucacauuuagcacguauguacaacggcuacgcaggcggauucgaaguacaaguaauacuagcugguaaugccuuuacagcaggaaaaauaauuuuugccgccguaccaccaaauuuuccaacugaaggauuaucacccucucaaguaacaauguuuccacacauuauuguugacguaaggcaacuagaaccaguauuaauacccuuacccgacguacguaauaacuucuaucauuauaaccaaucuaacgaccccacaauaaaauuaauagcaaugcuauacacaccacuaagagcaaacaaugcaggcgaugacguauucaccguuucaugucgaguccuaacacgaccaagucccgauuuugacuuuauauucuuaguacccccaacaguugaaucuagaacaaaaccuuucacaguuccaauauuaacaguagaagaaaugacaaacucaagauuuccaauaccacuugaaagacuuuauacagguccaucaucagcuuuuguaguacaaccacaaaacggaagaugcacaacugacggaguauuacuaggaacaacacaauuaucagccguaaauauuuguacauuuagaggagacguaacacauauagcaggaucaagaaauuacacaaugaaccuagccucacaaaacuggaacaauuaugauccuaccgaagaaauaccagcuccauuagggacaccagacuuuguagguaaaauacaagguaugcuaacacaaacaacucguucagacggaucaacucgaggacauaaagcaaccguauuuacaggaucagcagacuuugcaccuaaauuaggaagaguacaauucgcaacagauacugacaacgacuuugaaucaggucaaaauacuaaauucacaccagucggaguaauacaagacggauccacaacacauagaaacgaaccacaacaauggguauuaccgaacuacucaggcagaaccgggcauaacguacauuuagcaccagcuguagccccaacauacccuggagaacaauuauuauuuuuccgauccacaaugccaggaugcaguggauacccaaauauggacuuagauugccuacuaccucaagaauggguccaacauuuuuaccaagaagcagcuccugcucaaucagacguagcacuacuaagauucguaaauccagauacaggaagaguccuauucgaaugcaaauuacacaaaagcggcuaugucacaguagcacauacgggacaacacgauuuaguaauaccaccaaauggauauuuuagauuugauucaugggucaaucaauucuacacuuuagcaccaaugggaaauggcaccggaagaagacgagcauuauaa

SEQ ID NO: 31332 - RNA, 1623 nt, Artificial Sequence
  derived and/or modified sequence opt6 from VP1__Norovirus__ACX31837
augaaaauggcaucaaaugacgcaaauccaucagauggauccgcagcaaacuuagucccagaaguaucaaaugaaguuauggccuuagaaccaguagucggagcagcaauagcagcuccuguagcuggucaacaaaauguaauagauccauggauaagaaauaacuucguccaagccccagguggagaauuuacaguuuccccaagaaaugcaccaggugaaauacuuuggucagcaccuuuaggcccagacuuaaauccauaucucucacauuuagcaagaauguauaacggauacgccggagguuuugaaguacaaguaauauuagcaggaaaugcauucacagcagguaaaaucauauuugcagccguaccaccuaacuuucccacugaaggacuaucaccaucacaaguuaccauguucccacauauuauaguagacguaagacaauuagaaccaguucuaauaccauuaccagauguacgcaacaacuuuuaucacuauaaucaaaguaaugacucuaccauuaaauuaauagcaauguuauauacaccauuaagagcaaacaaugccggcgaagaugucuuuacaguaucauguagaguccuaacaagaccauccccagauuuugacuuuauauuuuuaguuccaccaacagucgaaucaagaacaaaaccauucacaguaccaauacuaaccguugaagaaaugaccaauuccagauuuccuauaccauuagaaaaauuguucaccggaccaucuggagcauucguaguucagccacaaaauggaagauguaccaccgaugguguacuucuaggaacuacacaacuaucaccagucaauauauguacauuuagaggagacguuacacacauugcaggcucaagaaauuacacaaugaaucuagcaucuuuaaacuggaacaacuacgaucccacagaagaaauaccugcaccauuagggacaccagauuuuguagguaaaauacagggaguauuaacacaaacaacaaaaggagacggcucaacaagaggacacaaagcaacagucuauacaggcucagcuccauucacaccuaaacuagguucaguacaguucucuacagauaccgaaaacgauuucgaaacacaucaaaauacaaaguucacacccguaggaguaauccaagacggaucaaccacacacagaaaugaaccccaacaauggguacuuccaucuuacuccgguagaaacguacauaacguucaccucgcaccugcaguugcaccaacuuuuccaggugaacaauuacuauuuuuucgaucuacuaugccuggauguagcggauauccuaacauggacuuagauugcuuauuaccccaagaauggguccaacauuucuaucaagaagcagcacccgcccaaagcgacguagccuuacuaagauuugucaaccccgacacaggaagaguauuauuugaauguaaacuacauaaauccggauauguaacuguagcccauacaggacaacaugaccuaguuaucccuccaaauggauacuuuagauuugauucauggguuaaucaauuuuacacacuagcaccaaugggaaacggaacuggaagaagaagagccuuauag

SEQ ID NO: 31333 - RNA, 1623 nt, Artificial Sequence
  derived and/or modified sequence opt6 from VP1__Norovirus__ACX31841
augaaaauggcauccaaugacgcaaauccuagcgauggaucagccgcuaauuuagucccagaaguaucaaaugaaguaauggcauuagaaccaguuguaggagcagccauagcagcaccuguagcaggucaacaaaauguaauagacccauggauaagaaauaacuuuguacaagccccaggaggugaauuuaccguaucaccaagaaaugcuccaggcgaaauacuauggucagcaccuuuaggaccagaccuaaauccauaucuaucucacuuagcuagaauguauaacggauacgcugguggauuugaaguacaaguaauauuggcaggaaaugcauucaccgcaggcaaaauaauauucgcagcaguacccccaaauuuuccaacagaagguuuauccccaucucaagucaccauguucccacauauuauaguagauguccgacaauuagaaccaguacuaauaccauuaccagauguaagaaauaauuucuaccacuauaaccaaucaaacgauucaacaaucaaacuaauagccauguuauacacccccuuacgugcaaauaaugcaggagaagacguauuuacaguaucauguagaguacuaacaagaccaucacccgauuuugacuuuauauuuuuaguuccaccuacagucgaaucaagaacaaaaccuuucacugugccaauacuuacaguagaagaaaugaccaauagucguuuuccaauaccauuagaaaaacucuucacaggaccauccggugcauucguaguacaaccacaaaauggucguuguacaacagacggaguauuacuaggaaccacacaauuaucucccguuaauauaugcacauuucgaggagauguaacacauaucgccggcucuagaaacuacacaaugaaucuggcaucacuaaauuggaauaauuaugauccaacagaagaaauaccugccccucucggaacacccgacuuuguagguaaaauacaaggaguacuaacacaaacaacaaaaggcgauggaucaacaagaggacacaaagcaacaguauacacaggaucaacaccauucacaccaaaauuaggcucaguucaauuuucaacagacacagaaaacgauuucgaaacacaucaaaacacaaaauucacaccaguaggaguaauucaagauggaucaacaacccaucgaaaugaaccccaacaauggguccuuccaaguuacucaggacgagauguacauaacguacaccuugcucccgccguagccccuacuuucccuggagaacaacuacuguucuuuagaucaacaaugccaggauguucagguuauccuaacauggauuuagauugcuuacuaccacaagaauggguacaacacuucuaucaagaagcugcuccagcacaaucagauguagcccuacuaagauucguuaacccagacacaggacgaguucuauuugaaugcaaacuacacaaaucaggauauguuacagucgcacacacuggucaacaugaccuaguaaucccaccaaacggauauuuuagauucgauucauggguaaaucaauucuacacuuuagcaccuaugggaaauggaacaggaagaagaagggcauuauaa

SEQ ID NO: 31334 - RNA, 1623 nt, Artificial Sequence
  derived and/or modified sequence opt6 from VP1__Norovirus__ACX31851
augaaaauggcauccaaugacgcaaacccaagcaauggaucugcagccaaucucguaccugaagucaacaaugaaguaauggcauuagaacccguaguuggagcugcaauagccgcaccaguugcaggacaacaaaacguaauugacccauggauaagaaauaauuuuguccaagcaccuggaggagaauucacaguaucaccccgaaacgccccaggagaaauacuuuggucagcaccacuaggaccagaucuaaauccauaucuaucacauuuagcaagaauguauaacgguuacgcaggaggauucgaaguucaaguaauucucgcaggaaacgcauuuacagcagguaaaauaauauucgcagcaguucccccaaacuucccaacagaaggauuaucaccgucacaaguuacaauguucccacauaucauaguagauguacgccaauuagaaccaguauuaaucccacuaccugauguaagaaauaauuuuuaucacuauaaucaaucaaaugauucaacuauaaaacuuauugcaauguuauauacaccauuaagagcuaacaaugcaggagaagauguauuuacuguaucauguagaguacugacaagaccauccccagacuuugauuuuauauuuuugguacccccaacagucgaaucuagaacaaaaccuuucacaguuccaauauuaacaguagaagaaaugacaaacucaagauuuccaauuccccuagaaaaacuuuuuacuggaccaucuucagcauucguaguacaaccacaaaauggaagauguacaacagacggcguauuauuagguacaacucaauuaagcccuguaaauauauguacauuuagaggagaugucacccacauugcaggauccagaaacuauacuaugaauuuagcaucauuaaacuggaauaacuaugauccaacagaagaaauaccagcaccauuaggaacuccugacuuuguaggcaaaauacaaggaguauuaacucaaacaacaaaaggagacgguucaacaagaggacacaaagcaacaguauauacaggcuccgcaccauuuacgccaaaacuaggauccguacaauuuucuacugauaccgaaaacgacuucgaaacgcaccaaaacacaaaauucacaccuguaggaguaauacaagacggaggaacuacacauagaaaugaaccacaacaauggguauuaccaucuuauucaggccguaacguaccaaacguccaccuagcaccagcaguagcaccaacuuuuccaggagaacaacuauuauuuuuuagaucaacaaugccaggcuguagcggcuacccaaauauggauuuagacugccuauuaccacaagaauggguacagcauuucuaucaagaagcagcaccagcucaaucagacgucgcuuuauugcgauucguuaauccagacaccggaagaguacuauuugaaugcaaauuacauaaaucaggauauguuacagucgcacauacaggacaacacgaucuaguaauacccccaaacggcuauuuuagauuugauucaugggucaaucaauuuuauacacuagcuccaauggguaacggaaccggaagaagacgcgcacuuuaa

SEQ ID NO: 31335 - RNA, 1623 nt, Artificial Sequence
  derived and/or modified sequence opt6 from VP1__Norovirus__ACX31856
augaaaauggcaucaaaugaugcuaaccccagcgauggaagcgcagcaaacuuaguaccagaagucaacaaugaaguaauggcccuagagccaguagucggugcagcaauagcagcaccuguagcuggacaacaaaauguaauagauccauggauacgaaauaacuucguccaagcuccaggaggagaauucacaguaucaccaagaaaugcaccaggugaaauacuuuggucugcuccacuaggaccagaccuaaacccuuaucuaucucaucuagcacgaauguauaaugguuaugcagguggauucgaaguacaaguuauucuagcuggaaaugcauuuacagcaggaaaaaucauuuuugcugcuguaccaccuaacuuuccaacagaagggcuuucuccuucccaaguaaccauguuuccacacauaauaguugauguucgacaacucgaaccaguauuaauaccauuaccagacguuagaaacaauuuuuaccauuauaaccaaaguaaugauuccacuauuaaauuaauagcuaugcuuuacacuccauugagagcaaacaaugccggagaagacguauuuacaguaucaugcagaguucuaacucguccaucaccagauuuugauuuuauuuuucuaguaccaccaacaguugaaucaagaacuaaaccuuucacaguaccaauacucacaguugaagaaaugacuaacucacgauuuccgauaccauuagaaaaauuauuuacagguccauccucugcuuucguuguacaaccucaaaacggacgauguacaacagaugguguacuauuaggaacuacacaauuaucaccuguaaacauuuguacauuucgaggagacguaacacacauugcaggaucacgaaacuacacaaugaauuuagcaucauuaaauuggaauaauuaugauccaacugaagaaauaccagcaccacuaggaacaccagacuuuguagguaaaauacaaggaguauuaacccaaacaaccaaaggagauggauccacaagaggucacaaagcaaccguauauacaggauccgccccuuuuacaccaaaacuugguucaguacaauucucaacugauacugaaaacgacuuugaagcacaccaaaacaccaaauuuacaccaguaggaguaauucaggacggagguacaacccacagaaacgaaccucaacaaugggucuuaccaucauauucaggucgcaacguaccuaacguacaucuugcuccagcaguagcgccaaccuuuccaggugaacaauuacuauuuuuucgcucaacaaugccuggauguucuggauacccaaauauggaucuagauugcuuacuaccacaagaauggguacaacauuucuaucaggaagcagcaccagcacaaucagauguagcacuucuacgcuuuguaaauccagacacuggaagaguacuuuuugaaugcaaacuacauaaaaguggauacguaacaguagcacauaccggacaacacgacuuaguaauaccauccaacggauauuucagauucgauucuugggucaaucaauuuuacacacuagcaccaaugggaaacggaacaggaagaagacgaguauuauaa

SEQ ID NO: 31336 - RNA, 1623 nt, Artificial Sequence
  derived and/or modified sequence opt6 from VP1__Norovirus__ACX31860
augaaaauggcaucaaaugacgcaaauccaucugauggauccgcagcaaacuuaguaccagaaguuaauaaugaaguaauggcauuagaaccuguaguaggagcagccauugcugcaccaguugcaggccaacaaaaugucauagacccuuggauacgaaauaauuucguucaagccccaggaggugaauucacaguaaguccacgcaaugcuccaggcgaaauuuuauggucugcaccauuaggcccagacuuaaauccauaucuaucacauuuagccagaauguacaauggauaugccggaggauucgaaguacaagucauauuagcaggcaacgcauucacugcaggaaaaauaauauuugcugccguaccaccuaauuucccuacugaaggacuaucaccaucccaaguaacaauguucccacauauaaucguugauguaagacaauuagaaccaguauuaauaccauuaccugauguaagaaauaauuuuuaccauuauaaucaaucaaaugacucaacaauaaaacuaauagcuaugcuauauacaccuuuacgcgcaaacaacgcaggagaugaugucuuuaccgucucauguagaguuuuaaccagaccuucccccgauuuugauuuuauauuccucguuccucccacaguagaauccagaacaaagcccuuuacuguaccaauauuaacaguagaagaaaugacaaacagcagauuucccauaccacuagaaaaauuauuuacuggaccgagcggcgcauuuguuguacaaccacaaaacggaagauguacuacagacggaguacuauugggaacaacacaacuaaguccaguaaauauuuguacauuuagaggagaugucacacauauagcaggaagucgagacuauacaaugaauuuagcaucuuuaaauuggaacaacuaugacccuacagaagaaauaccagcaccacucgggacaccagauuuugucggaaaaauacaaggaguuuuaacacaaacaacagaaggagacggaucaacacgaggacacaaagcaaccguuuauacaggaucagcuccuuuuaccccaaaacucgguucuguacaauuuucaacagacacugaaaacgauuuugaaacucaccaaaauacuaaauuuacacccguaggaguaauucaagauggaucaaccacacacagaaaugaaccucaacaauggguacuuccaaguuauucuggaagaaauguacauaacguucauuuagcuccagcaguagcacccacauuuccaggagaacaauuauuauucuucagaucuacuaugccuggauguaguggauauccuaauauggauuuagacugcuuacuaccacaagaauggguacaacauuuuuaucaagaagcagcaccagcacaaucagacgucgcauuauuaagauuuguaaauccagauacaggaagaguucuuuuugaaugcaaauuacauaaaucuggauacguaacaguagcacacacuggucaacaugaucuaguuauacccccuaaugguuauuucagauucgacucauggguaaaucaauucuauacauuagcccccaugggaaacgguacaggucguagaagggcuuuauaa

SEQ ID NO: 31337 - RNA, 1623 nt, Artificial Sequence
  derived and/or modified sequence opt6 from VP1__Norovirus__ACX31864
augaaaauggcaucuuccgacgcaaaccccucugauggaucaaccgcaaauuuaguuccagaaguuaauaacgaaguaauggcacuagaaccaguaguuggagccgcaauagcugcaccuguagcuggacaacaaaacguaauagaccccuggauaagaaauaauuuuguacaagcaccaggcggagaauuuaccguauccccaagaaacgcaccaggugaaauauuauggagugcaccuuuaggcccugacaugaauccuuaucuaagccauuuagcacgaauguauaacggauacgcaggagguuucgaaguccaaguuauuuuagcaggaaaugcauuuacagcuggaaaaaucauauucgcagcuguaccaccaaauuuuccaacagaaggucuaucaccaucacaaguaacaauguuuccacacaucauaguagauguuagacaacuagaaccaguauuaauaccuuuaccagauguacgaaauaauuuuuaucacuacaaucaaucaaacgauccaacuauuaaacuaauagcuaugcuauacacaccacuuagagcaaacaacgcaggagacgaugucuucacagucucauguagaguauuaacaagaccaucacccgacuuugacuuuauauuucuaguaccuccaacaguagaaaguagaacaaaaccauucucaguuccuauacuaacuguagaagaaaugacuaauucacgcuucccaauaccacuugaaaaacuauuuacuggaccaucaucagcauucguaguacaaccacaaaacggcagauguacuacugacggaguauuacuuggcacaacacaauuaucaccuguuaauauauguacauuccgaggagaugucacacauauagcaggaucuagaaacuacaccaugaaucuugcaucacaaaacuggaacucauacgacccaaccgaagaaaucccagcuccacuaggaaccccagacuuuguaggaaaaauacaaggcguacuaacacaaacaacacgaacagaugguucaacaagaggucacaaagcaacuguauacaccggaucagccgacuuuucaccaaaacuuggaagaguacaauucgcaacagacaccgauaaugauuucguagcaaaucaaaauacaaaauucacacccgucggaguaauacaagauggaaacacagcccacagaaacgaaccacaacaauggguucuuccaucauauuccggacgaaauacacauaauguacaucuagcuccugcaguagcaccuacauucccuggagaacaacuacuauuuuuuagaucaacaaugccaggaugcucuggauacccaaacauggaccuagauugccuccucccacaagaauggguccaauauuucuaccaagaagcagccccagcccaaucugauguagcauuacucagauuuguaaacccugacacaggcagaguacuauucgaaugcaaauuacauaaaucaggauauguaacaguagcacauacaggacaacacgaccuagucauaccgccaaauggauacuucagauucgacucauggguaaaucaauuuuacacauuagcaccaaugggaaauggcacaggacgucguagagcacuauaa

SEQ ID NO: 31338 - RNA, 1623 nt, Artificial Sequence
  derived and/or modified sequence opt6 from VP1__Norovirus__ACX31889
augaaaauggcauccucagacgcaaacccuucagauggaucaacagcaaacuuaguaccagaaguuaacaaugaaguuauggcuuuagaaccagucguaggugccgcaauagcugcaccaguagccggacaacaaaacgucaucgauccauggauacguaauaauuuuguacaagcaccaggcggugaauuuacaguauccccaagaaacgccccuggugaaauacuauggagugcuccccuaggaccagauaugaauccuuaucugucucaccuagcuaggauguauaauggauacgcaggaggauucgaaguacaaguuauacuugcagguaacgcauuuacagcaggaaaaauaauuuuugcugcaguaccacccaauuuucccacugaaggccuauccccaucccaaguaacaauguuuccacacauaauuguagauguaagacagcuagaacccguacucauaccccuaccagacguaagaaauaauuucuaucacuauaaucaaucaaaugaccccacaauaaaauuaauagcaauguuauauacaccauuacgcgcaaauaaugcaggagacgauguauuuacaguaucaugccguguccuuacaagaccaucuccagacuuugauuucauauucuuaguuccuccaaccguagaaucaagaacaaaaccuuucucaguaccaauauuaacaguagaagaaaugacaaacuccagauucccaauuccccuagaaaaacuauuuacuggaccaucaucugcuuucguuguacaaccacaaaacggacgcuguacaacagacgguguauuacuaggaacaacacaacuaucaccagucaacauauguacauuuagaggagacguaacacauauagcaggaucaagaaauuacaccaugaaucuugcaagccaaaacuggaauucuuacgacccaacagaagaaauaccagcaccacuaggaacaccagacuuuguagguaaaauucaagguguauuaacccaaacaaccagaacugauggcucuacacguggccauaaagcaacaguauauacaggaucagcagacuuuucaccaaaacuuggcagaguacaauucgcaaccgacacagacaacgauuuugaugcaaaccaaaacacaaaauuuacaccaguaggaguaauacaagauggaaauacagcccacagaaaugaaccccaacaauggguauuaccgucauauucuggacguaacacucauaauguacacuuagcacccgccguagcaccuaccuuucccggagaacaacuauuauuuuuuagauccacuaugccaggcugcucuggauauccaaacauggaucuagacuguuuauuaccacaagaauggguacaauauuucuaucaagaggccgcaccagcacaaucagacguugcauuacucagauuuguuaauccagauaccggaagaguauuauuugaaugcaaacuacacaaaucuggauauguaacagucgcccauacaggucaacaugaucuagucauaccaccuaauggauauuuuagauucgauucauggguuaaccaauuuuauacacuagcucccaugggcaauggaacuggaagacgcagagcacuauaa

SEQ ID NO: 31339 - RNA, 1608 nt, Artificial Sequence
  derived and/or modified sequence opt6 from VP1__Norovirus__ACX31893
augaaaauggcguccaacgaugcagcaccaucaaacgauggugcagccggauuggucccagaaguaaacaaugaaacaauggcacuugaaccaguagccggcgcaucuauagcagcacccuuaacaggacaaaauaauguaauagauccauggauaagauuaaauuuuguccaagcaccuaacggagaauuuacagucucaccuagaaauucaccaggagaaguacuucuuaaucuagaauuaggaccugaacuuaauccauauuuagcacauuuaaguagaauguacaauggauacgcaggaggaguugaaguacaaguauuacuagcagguaacgcauucaccgcagguaaauuaguauucgccgcuguaccaccacauuucccauuagaaaauauaaguccuggacaaaucacaauguucccacacguuauaauagauguaagaacacuagaaccuguucucuuaccuuuaccagauguuagaaacaacuuuuuucauuauaaucaacaaaaugaacaaaggaugagauuaguagccaugcuuuauacaccuuuaagaagcaauggaaguggagaugauguauuuacuguaucaugcagaguacuaacccgcccaucaccagacuuugauuuuaauuaccuaguuccccccacaguugaaucaaaaacaaaacccuuuacguuaccaauacuaaccaucggugaauuaaccaauucaagauuucccgucccaauagaugaacuauauacaucaccuaaugaaucacuuguaguacaaccacaaaacggccgaugugcguuagacggagaauuacaaggaacaacgcaauuauuaccaacagcaauuugcuccuuccgcggucgaauaaaccaaaaaguuucaggagaaaaucaugucuggaacaugcaaguaacaaacauaaacgguacuccauuugacccaaccgaagacgucccagccccauuaggcacacccgauuucucaggaaaauuauuuggaguacuaucacaaagagaccaugacaaugcauguagaucacaugacgcaguaaucgccacaaauucagcaaaauucacaccaaaacuuggagccauacaaauaggaacaugggaacaagaugauguacauauaaaucaaccaacaaaauucacccccguaggacuuuuugaaucagaaggauuuaaucaauggacauuaccaaacuauucaggugcauuaacacuaaacauggguuuagcaccaccaguugcacccacuuuucccggagaacaaauuuuauucuuucgaucacauauuccauuaaaaggcggcguagcugauccaguaauugauugccuacucccacaagaauggauacaacaucuauaccaagaaucagcuccaucacagacugacguagcauuaauaagauucacaaacccagacacaggcagaguauuauuugaagccaaauuacacagaucagguuauaucacaguugcuaauaccggcucccgacccauaguaguaccagcaaauggcuacuucagauuugacagcuggguaaaccaauucuacaguuuagccccaauggguacaggaaacggaagaagaagaguacaauaa

SEQ ID NO: 31340 - RNA, 1749 nt, Artificial Sequence
  derived and/or modified sequence opt6 from VP1__Norovirus__ACX69259
augaaaauggcuucuaaugacgcagcuccuccuucgucagauggagcagcuaaucuuguuccugagauaaauaacgaaguaauggcacuagaaccagucgccggagcacaacuugcagccccuguugccggacaauuuaacgccauugauccuuggauacgccaaaauuuuguccaagcaccugaaggugaauuuaccguaucacccagaaacgcaccaggagaaauucuauuaaauuuagaacuuggaccacaucuuaauccauucuuacaacauuuagcucaaauguacaaugccuacgcaggaggaauggaaguacaaguuguccuagcaggaaaugcuuuuacugcaggaaaaauaauauucgccgcaauacccccacacuucccaccagaacgauuauccgcugcucaagccacacaauuuccacaugucauuguagauguacgacaacuugaaccaauaguccuaccuuuaccagacguaagacacaaccuauuucauuucaaucaacaaaaugaugaaaggaugcauuuaguugcauuucuauauacaccuuuaagagcuaauucuggaaauggagaugauguauuuacaguuaguuguagaguacuaacaagaccaagucaagacuuugaguucauguuuuuaguaccaccuacaguggaaaaaaaaacuguagccuucucucuaccacaacuagcaguaggagaaaugucaaacucaagauggccugcaagaauaacagguauggucguagauccccgacuaccacaaguuuuacauauccaaaauggaagauguacacuagacgguaccuuaaugggaacaacacaauuaaauccaaaugauauauguagaauuagagguuacuuuucaucuucaagaccggaauuacuaugugaaggagaagagagugaaguaaauacaacacccacagauucaggagcaaccggagaucaaacaccagaaguacgaacaggaacacgagcaacucaaaggugguuugccguaaccgaauuaaacggacaaguauacgauccauucggagaccaaccagcacccuuagguguaccagacuucaaagcacgaauauuaggagcauuaaugcgacuucccggcacaaauccaacuucuaacagccguuuugaagaugcuuggguagaaacaaauaaucaaacgacauaugcaccagcuacaggaguaguagcuauuacaacaaaugauaacucaucaggaaauuaugccaacgaucaaaccugugaauucguucccuuagguauagaaauaacagacagcgcuccuuauaacgaauuugaucuuccuucauauggaggagcagcaucaucagguaauagaaauuuagcuccaacaguagcuccuaccuuuccaggagaagcuauacuacuauuuggaucaaauaugccaguauacaacagaucaucaggaacugauaauaaagauauaagaugucuacuacccaacgaauauguacaacacuuauaugacacccaagcacccucacuaucagacguagcuuuaguuagauacguuaauagagauacaggcagaguacuuuuugaagcaaaacuacacagagaugguuucaugacuguaaacgcaagcucaacaacaguacuaccaguagauggauauuucagauucgacuccuggguaaaucaauuuuaugcgcuaucccccguuggaaaugcuucuggacgcagaggaagauccagacaggccaauuaa

SEQ ID NO: 31341 - RNA, 1647 nt, Artificial Sequence
  derived and/or modified sequence opt6 from VP1__Norovirus__ADF47131
augaaaauggcaucaaaugaugccgcuccaucaaaugauggcgcagcagguuuaguaccagaaauaaauaacgaagcaauggcuuuagaaccaguagcaggugcagcuauagccgccccuuuaacuggacaacaaaacaucauagauccauggaucaugaauaacuucguacaagcaccaggcggagaauuuacaguaucaccuaggaauucaccaggcgaaguacuauuaaacuuagaacuaggcccagaaauuaaccccuacuuagcacauuuagcacgaauguacaacggauacgcuggaggauucgaaguacaaguaguucuagcaggaaaugcauuuacagcaggaaaaauaauauuugcugcaauaccuccuaauuucccaauagauaauuuaucagcagcacaaauaaccauguguccucacgucauaguagauguacgacaauuagaacccguaaaucuuccaaugccagacguacgaaauaauuuuuuccacuauaaccaaggaucugacucuagauuaagacuaguagcaaugcuauauacacccuuaagagcaaacaauucaggagaugauguuuuuacaguuucaugcagaguacuaacaagaccaucaccagacuuuucauuuaacuuuuuagucccaccaaccguagaaucaaaaacaaaaccuuucacauuaccaauauuaacaauaucagaaaugucaaacuccagauucccaguacccauagauucucuacauacuucaccaacagaaaacaucguaguacaaugucaaaauggucgugucaccuuagacggugaacuaaugggaacaacacaauuauuaccuucacaaauaugugccuucagagguguacuaaccagaagcacuucaagagcaucagaucaagccgauacugcaacaccaagauuauucaauuauuacuggcauauacagcuagacaaucucaacggaacuccauacgacccagcugaagacauacccggcccucuaggcacaccagauuucagagguaaaguauucggaguagcuucccaaaggaauccagauuccaccacacgcgcccaugaagcaaaaguagauacuacagcuggaagauuuacaccaaaacuaggaucucuagaaauaucuacagaaucaggcgauuuuaaucaaaaucaaccuacaagauucacuccaguagguauaggcguagaucacgaagaagauuuucaacaaugguccuuaccagauuauuccggacaauuuacacauaauaugaaccucgcaccugcaguugcaccuaacuuucccggugagcaauuacucuucuuucgaucccaacuaccaucuaguggaggaagaucaaacggaauucuugauugccucguaccucaagaauggguucaacauuuuuaccaagaaucagcuccaacccaaacacagguagcuuuagucagguacgucaacccagauacagguagaguacucuuugaagcaaaauugcauaaauuaggcuuuaugacuaucgcaaaaaauggcgauucaccaauuacaguaccucccaacggauacuuccgauuugaaucaugggucaacccuuucuacacccuagcuccuacaggcacagaaaauggacggcgacgaguacaauaa

SEQ ID NO: 31342 - RNA, 1623 nt, Artificial Sequence
  derived and/or modified sequence opt6 from VP1__Norovirus__ADR78869
augaaaauggcaucaaacgaugcaaauccaucugaugguucagcagcuaauuuaguuccugaaguaaauaaugaaguaauggcucuagaaccaguagucggagcagcuauagcagcaccaguagcaggacaacaaaauguaaucgacccauggauaagaaauaacuuuguacaggcaccugguggagaauuuacaguaucaccaagaaaugcgccaggcgaaauuuuauggucagccccacuaggaccagacuuaaauccauauuuaucacaccuagcuagaauguauaacggauaugcagguggauuugaaguacaaguaauacucgcuggaaacgcauuuacagccggaaaaauaaucuucgcagcagucccaccaaauuuuccaaccgaaggacuauccccaucucaaguuacaauguucccucacauuauuguagacguucgucaauuagagccuguauuaaucccauuaccagauguaagaaacaacuucuaucacuauaaccaaaguaaugacaguacaauuaaacuaauagcaaugcuauacacaccauuaagagcaaacaaugcaggagaagauguuuuuaccguaagcugccgaguacuuacuagaccaucaccugauuuugacuuuaucuuucuaguuccuccaacuguagaaucaagaacaaaaccuuucacaguuccuauauuaacagucgaagaaaugacaaacucucgauuuccaauaccacuagaaaaauuauuuaccggaccuucaggagcauuugucguccaaccccaaaacgguagaugcacaacagauggaguacuacuaggaacaacacaacuaucaccagucaauauauguacauuuagaggcgauguuacccauauagcaggcucaagaaacuacacaaugaaucuagcuaguuuaaauuggaauaacuacgauccaacagaagaaauaccugccccacuaggaacaccagauuuuguuggaaaaauacaaggaguuuugacacaaacaacaaaaggagacggaucaacuagaggacacaaagcuacaguauauacaggauccgccccauucacacccaaauuagguucaguacaauucucuacagacacagaaaacgauuucgaaacccaccaaaauacaaaauuuacaccaguaggaguaauacaagauggaaguacaacacaccgcaaugaaccacaacaauggguacuaccuucuuauuccgguagaaacguacacaacguacaucuugccccugcaguagcacccaccuucccaggagaacaacuacuuuuuuuuagaucaacaaugccagguugcucaggcuacccaaauauggauuuagacugccuacucccacaagaauggguucaacauuuuuaucaagaagcugcuccagcccaaucugacguagcacuccuuagauucguaaauccagauacaggaagaguacuauucgaaugcaaacuccauaaaucaggauauguaacagucgcucauacaggacaacacgaucuagugauuccuccaaaugguuauuuccgauucgauucaugggucaaccaauucuauacuuuagcaccaaugggaaauggaacuggacguagacgagcauuauaa

SEQ ID NO: 31343 - RNA, 1623 nt, Artificial Sequence
  derived and/or modified sequence opt6 from VP1__Norovirus__ADR78872
augaaaauggcuuccaaugaugcaaacccuucugauggaucagcugcaaaccuuguuccagaaguaaacaacgaaguaauggcacuagaaccaguuguaggcgccgcaauagcagcccccgucgcaggucaacaaaacguaaucgacccuuggauaagaaauaacuucguacaagcaccaggaggagaauuuacaguaucaccaagaaaugcuccaggugaaauauuauggucagcaccacuagguccugaucuaaauccauaucuaucucacuuagcuagaauguauaacggcuacgcaggagguuuugaaguacaaguaauacuagccggcaaugccuuuacagcuggcaaaaucauauucgcagcagucccaccaaauuuucccaccgaaggcuuaucuccaucacaaguuacaauguucccacacauuauaguagacguaagacaacuagaaccaguucuuauaccucuuccagaugucagaaauaauuuuuaucauuauaaucaaucuaaugauuccacuaucaaauuaauagcuauguuauacaccccauuaagagccaacaaugccggcgaagauguauuuaccguaucauguagagucuuaaccagaccauccccagacuucgacuuuauauuucuuguuccuccaacaguagaaucccgaacuaaaccuuuuacuguaccaauacuaacuguagaagaaaugacuaacucaagauuuccaauucccuuagaaaaacuauuuacaggcccaucuggagcauucguaguccaaccacaaaacggaagauguacaacagauggaguacuacuaggaaccacacaacuauccccaguaaacauaugcacauuccgaggagauguaacacacauauccggaucacgaaacuacacuaugaaucucgcaagccuaaauuggaacaauuacgaucccacugaagaaauuccugccccauuagguacaccugauuucguagguaaaauucaaggcguucuaacacaaacaacuaaaggagacggcucaacucgaggucauaaagccacaguauauacagguuccgcaccauuuacaccaaaacuuggauccguacaauucucaacagauacagaaaaugauuuugaaacacaccaaaauacaaaauucacaccaguaggcguaacucaagauggaucuacuacacauagaaaugaaccacaacaauggguacucccaucauacucaggccgaaauguacauaacguucaccuagcaccagcaguagccccaacauuucccggagaacaacuacuauuuuuucgaucaacaaugccagguugcucugguuauccaaacauggaucuagauugcuuauuaccacaagaauggguucaacauuuuuaucaagaagccgcacccgcucaaucagacguagcauuauuaagauucgucaacccagauacaggaagaguucucuuugaaugcaaauuacacaaauccggauacguuaccguagcacacacuggacaacacgauuuaguaauaccuccaaauggauauuucagauucgauucauggguuaaccaauuuuacacuuuagcaccaaugggaaacggaacaggaagaagaagagcacuauaa

SEQ ID NO: 31344 - RNA, 1623 nt, Artificial Sequence
  derived and/or modified sequence opt6 from VP1__Norovirus__ADR78875
augaaaauggcuuccaaugacgcaaauccaucagauggaucugcagcaaaccuuguaccagaaguaaacaacgaaguaauggcuuuagaaccagucguaggugcagcuauagcagcaccuguagcaggacaacaaaauguaaucgacccauggauuagaaauaacuuuguacaagcaccuggaggagaguucacagucucuccacguaacgcuccaggugaaauauuauggucagccccacucggacccgauuuaaaucccuacuuaucacaccuugcaagaauguauaacggauaugcaggaggauucgaaguucaaguaauacuagccggaaacgcauuuacagcaggaaaaauaauauucgccgcaguacccccaaacuuccccacagaaggacuaucaccaucacaagucacaauguucccucacauaaucguagacguacgccaacuugaaccaguauuaauuccacuacccgacguaagaaacaauuuuuaucacuauaaucaaucuaaugacuccacaauaaaauuaauagcuaugcuuuauacuccauuaagagcaaauaacgccggagaagacgucuuuacaguuucauguagaguacuaacacgaccuucaccagauuuugacuuuaucuuuuuagucccaccaacaguugaaucacguaccaaaccauuuacuguaccaauacuuacuguagaagaaaugaccaauucucgcuucccaauaccacuagaaaaacuauucacaggaccauccggagccuucguaguacaaccacaaaacgguagauguacaacagauggaguacuacuaggaacaacucaacuaucccccguuaauauauguacuuuucgaggagacguaacacauauagcaggcucaagaaacuauacaaugaaucuagcaucuuuaaacuggaacaauuaugaccccacugaagaaauuccagcaccucuagguacaccugacuuuguaggaaaaauacaaggaguauuaacacagacaaccaaaggggacggcuccacaagaggccacaaagcaacaguauacacagguucagcaccauuuacaccuaaacucggaucuguccaauuuucaacagauacagaaaaugacuuugaaacccaucaaaacacaaaauucacacccguuggaguuauucaagacggaucaacuacacauagaaaugaaccucaacaaugggugcuaccaucauauucaggaagaaauguucauaauguacacuuagcacccgcuguagcaccuacauucccaggcgaacaacuucuuuucuuucgaucaacaaugccaggauguucagguuauccaaauauggaucuagauugcuuacuaccacaagaauggguacaacacuuuuaucaagaagccgcaccagcacaaucagacguugcauuacuacguuucguaaaccccgacacuggaagaguacuauuugaauguaaauuacauaaauccgguuacguaacaguagcucauacaggacaacaugaucuaguuauaccaccuaacggcuacuucagauuugauucauggguaaaucaauuuuauacacuugcacccaugggaaacggaaccggaagacgaagagcucuuuaa

SEQ ID NO: 31345 - RNA, 1623 nt, Artificial Sequence
  derived and/or modified sequence opt6 from VP1__Norovirus__ADR78878
augaaaauggcaucuaaugacgcaaacccuuccgauggaucagcagcaaacuuaguaccagaaguaaacaaugaaguuauggcacuugaacccguaguaggugccgcuauagcagcaccugucgcaggacaacaaaauguuauugacccauggauaagaaacaacuucguucaagcaccuggaggugaauuuacaguaucaccacgcaacgccccaggagaaauauuauggucagcacccuuaggacccgacuuaaauccauaucuaucucauuuagcaagaauguacaacggauacgcaggaggauucgaaguacaaguuauauuagcuggaaaugcauucacagcuggaaaaaucauuuucgcugcaguaccaccaaacuucccaacagaaggacuaucaccaucucaaguaacaauguucccacauaucauaguagacguuagacaauuagaaccaguucuaauaccccuaccagacguaagaaacaacuucuaucauuacaaucaaucuaaugacucaacaauaaaacucauagcaauguuauacacaccauuaagagcaaacaacgccggagaagauguauuuacaguuucauguagaguucuaacaagaccuucaccagacuucgacuuuauauuuuuaguuccaccaaccguugaaucaagaacuaaaccauucacaguuccuauauuaacaguagaagaaaugacuaauucccgauuuccaauaccacuagaaaaacuauucacaggaccaucaggagcauuuguuguccaaccucaaaacggucgaugcaccacugacggaguauuacuuggcacaacacaauuaucuccaguaaauauauguacauuucguggagacguaacacauauagccggaaguagaaauuacacaaugaaucuagccagccuaaacuggaacaacuacgacccaacagaagaaauaccugcaccauuaggaacaccugacuuugucgguaaaauacaaggaguacucacacaaacaacaaaaggagacgguucaacacgcggacacaaagcuaccguauauacaggcucagcacccuuuacaccaaaacuaggauccguccaauuuaguacagacacagaaaaugacuuugaaacacaccaaaacacaaaauuuacaccaguaggaguaauacaagauggaucuacaacacauagaaaugaaccacaacaauggguacuacccuccuauuccggaagaaauguacauaauguucacuuagcaccagcaguugccccaacauucccaggugaacaacuccuauucuuuagaucaacuaugccaggaugcucaggauauccaaauauggauuuagauugucucuuaccccaagaauggguacaacacuucuaucaggaagcagccccagcucaaucagauguagcauuauuaagauucgugaacccagauaccggaagaguccuuuuugaaugcaaauuacacaaaucaggauaugucacagucgcacacacaggacaacacgaucucguaauaccacccaauggauauuucagauuugauucaugggucaaucaauuuuacacauuagcaccaaugggaaacggaacaggacgaagacgagccuuauaa

SEQ ID NO: 31346 - RNA, 1623 nt, Artificial Sequence
  derived and/or modified sequence opt6 from VP1__Norovirus__ADR78881
augaaaauggcaucaaacgacgcaaacccaucugacgguucugcugcaaaccucguuccugaaguaaauaaugaaguuauggcacuagaaccuguaguaggcgcagcaauagcugcaccaguagccggacaacaaaauguaauagacccauggauaagaaauaacuuuguucaagcacccggaggagaauuuacaguuucuccuagaaaugcaccaggugaaauauuauggucagccccacuaggcccagaccuuaacccauaccuaagccaucuagcaagaauguauaacggauacgcaggagguuucgaaguacaagugauacucgcagguaacgcauuuacagcaggaaaaauaauuuuugccgcaguaccaccuaauuucccaacagaaggacuauccccaucacaaguuacaauguuuccucacauuauaguagauguacgccaacuagaaccaguacuaauuccacuuccagacguuagaaauaauuucuaucacuauaaccaaucaaaugauucaacaauaaaacuaauagcuaugcuauacacaccacuacgagcaaacaacgcgggagaagauguauucacugucagcuguagaguauuaacaagaccuucaccugacuuugacuuuauauuccuaguaccaccuacuguagaaucccguacaaaaccauucacuguuccaauacuaacagucgaagaaaugacaaauaguagauuuccaauaccauuagaaaaacuauuuacaggaccaucaggagcauucgucguacaaccucaaaacggaagaugcacaacagauggaguauuauuagguacaacccaacuaucaccagucaauauauguacuuucagaggagacguuacacauauagcuggcucacguaacuauacuaugaaucuagcaucacuuaacuggaauaacuacgauccaaccgaagaaauaccagcacccuuaggaacuccagauuuuguaggcaaaauucaaggaguacuaacacaaacaacaaaaggcgacggaucuacaagaggacacaaagcaacuguauauaccggaagugcucccuuuacaccaaaauuaggaucaguacaauucucaacagauacagaaaacgauuuugaaacacaccaaaauacaaaauucacacccguaggagucauccaagauggaucaacuacacaccgaaaugaaccacaacaauggguacuacccucauacucaggcagaaauguacauaacguucacuuagcaccagcaguagcaccaacuuucccaggugaacagcuacuauuuuuuagaagcacuaugccaggauguucaggauauccuaauauggacuuagauugccucuuaccacaagaauggguucaacacuucuaucaagaagccgcaccagcacaaucagaugucgcuuuacuuagauucguuaaccccgauacugguagagucuuauuugaaugcaaauuacacaaaucaggauauguaacuguagcacauacaggucaacacgauuuaguaauacccccaaauggauauuuuagauucgacucauggguaaaccaguucuauacacucgccccaaugggaaacggaacaggaagaaggcgcgcacuuuaa

SEQ ID NO: 31347 - RNA, 1623 nt, Artificial Sequence
  derived and/or modified sequence opt6 from VP1__Norovirus__ADR78884
augaaaauggcauccaaugacgcaaauccauccgacggaucagccgcuaacuuagucccagaaguaaacaaugaaguaauggcccucgaaccaguaguaggcgcagcuauagcagcaccuguagcuggacaacaaaacguaauugaucccuggauuagaaauaacuuuguacaagcaccuggaggagaauucacaguaucaccaagaaacgcaccaggagaaauacucuggucagcaccacucggaccagaccuaaacccauacuuaucacaccuagcaagaauguauaacggauaugcuggaggauucgaaguacaaguaauacuagcagguaacgccuucacagccggaaaaauaauauuugcagcaguaccaccaaauuuuccaacagaaggacuaaguccaagccaaguuacaauguucccacacauaauaguugacguaagacaacuagaaccaguuuuaauaccccuaccagauguuagaaauaauuuuuaccacuauaaccaaucaaaugauaguacaauaaaacuaaucgcuauguuauauacaccucuuagagcgaacaacgcaggugaagaugucuuuacaguuucaugccgaguacuaacaaggccaucgcccgacuuugauuuuauauuuuuaguuccaccuacaguagaauccagaacaaaacccuuuacugucccaauccuuacagucgaagaaaugacuaacucuagauuuccaauuccacuagaaaaauuauucacuggaccaucuggagccuucguagugcaaccucaaaaugggagauguacuacugacggaguucucuuaggaacaacucaauuaucaccagucaauauauguacauuccguggagacguuacacacauagcuggcucuagaaauuacacuaugaaucuagcaucacuaaauuggaauaacuacgauccaacagaagaaauuccugcaccuuuaggaacaccagacuucgucggaaaaauacaaggcguauuaacucaaacaacaaaaggagacggaucaacccgaggacacaaagcaacaguauauacaggaucagcuccauuuacaccaaaacuuggcuccguacaauuuagcacagauacagaaaaugacuucgaaacacaccaaaauacaaaauucaccccagucgguguaauacaagauggcagcaccacacacagaaaugaaccccaacaauggguacuccccucauauucaggaagaaacguacauaacguucauuuagcaccagcaguugcuccaacauucccaggcgaacagcuccuauucuuuagaucaacaaugccaggaugcucaggauaccccaauauggauuuagacugccuacucccccaagaauggguccaacauuucuaucaagaagcagcuccugcacaaucagacguugcauuauuaagauuuguuaaucccgauacuggacguguacuauucgaaugcaaacuccauaaaagugguuacguaacaguagcacauacaggacaacacgaucuuguuauuccaccaaaugguuauuuuagauuugacucuuggguaaaucaauuuuacacacuagcaccaauggguaauggcacuggaagaagaagagcccuauaa

SEQ ID NO: 31348 - RNA, 1623 nt, Artificial Sequence
  derived and/or modified sequence opt6 from VP1__Norovirus__ADR78887
augaaaauggcuucaaacgacgcuaauccuucagaugguucagcagcaaacuuaguaccagaaguuaacaaugaaguuauggcacuagaaccaguaguaggugcagcaauagcagcucccguagcuggccaacaaaaugucauugacccuuggauacgaaauaacuuuguacaagcaccaggaggagaauuuacaguaucaccaagaaacgcacccggugaaauuuuauggagugcaccauuaggcccagaccuuaacccauauuuaucacauuuagcaagaauguauaacggauaugcaggcggauucgaaguacaaguaauucucgcaggaaacgcauuuacagcaggaaaaauaauauucgcagcaguaccaccaaacuuuccaaccgaaggucuuucaccaagucaaguaacaauguuuccacacauaauuguagacguacgccaacuagaaccaguuuuaauaccacuaccagauguccgaaauaauuucuaucauuauaaucaaagcaaugauucaacaauaaaacuaaucgcaaugcuauacacaccacuaagagcaaacaaugcaggagaagauguauuuacagucuccugucgaguacuaacucgaccaucgccagauuuugacuucauauuuuuaguaccaccaacaguagaaucaagaacaaaaccuuucaccgucccaauacuuacaguugaagaaaugacaaacucaagauuuccaauaccuuuagaaaaauuauuuaccgguccgucuggugcauucguagugcaaccacaaaaugguagauguacaacagacggaguauuacucggaacaacucaauuaucaccaguaaauauauguacauuuagaggagauguaacucauauagcaggaucaagaaacuacacaaugucacuagccucuuuaaauuggaacaauuacgauccaacagaagaaaucccagccccauuagguacaccagacuuuguaggcaaaauacaaggaguacuaacccaaacaacaaaaggugacggaucaacucguggucacaaagccacagucuauaccggaucugcuccauucacaccaaaacuaggaucuguacaauuuagcacagacacugaaaaugauuuugaaacacaucaaaacacaaaauuuaccccagucggaguaauucaagacggauccacaacccauagaaacgaaccccagcaauggguacuacccucauauagugggcgaaacguucauaacguacaucuagcaccugcaguagcaccaacauuuccaggagaacaacugcuauucuuuagauccacaaugccaggcuguucaggauacccaaauauggaccuagauugcuuacuaccacaagaauggguucaacacuucuaucaagaagccgcacccgcucaaucugacguagcacuacuuagauucguuaauccagauaccggcagagucuuauucgaauguaaacuccacaaaucaggcuacguaacaguagcacacacaggacaacacgaucucguaauaccaccaaauggauacuucagauucgauucauggguaaaucaauuuuauaccuuagcuccaauggguaacggaaccggacgccgaagggcacuauaa

SEQ ID NO: 31349 - RNA, 1623 nt, Artificial Sequence
  derived and/or modified sequence opt6 from VP1__Norovirus__ADR78890
augaaaauggccucuaacgacgcaaacccauccgauggauccgcagcuaacuuaguaccagaaguuaauaaugaaguaauggcauuagaacccguaguaggcgcagcuauugcugcaccuguagcuggacaacaaaauguaauagaccccuggauucgaaacaauuuuguccaagcaccaggaggcgaauuuacagucucuccaagaaaugccccuggagaaauacuauggagcgcaccuuuaggaccagaccuaaauccauaucucucacaccuugccagaauguauaacggauacgcagguggauucgaaguacaaguaaucuuagcaggaaacgcuuuuacagccgguaaaauaauuuucgcugcaguaccuccuaacuuuccuacugaaggacuuuccccaucucaaguaacuauguucccacauauaauaguagauguaagacaauuagaacccguacuaauaccacuaccagauguccgcaacaauuucuaccacuacaaucaaucaaacgacuccacaauaaaauuaauagcaaugcucuacacaccacuacgagccaacaaugcuggagaagacguauuuacagugucauguagaguauuaacucgaccauccccagauuuugacuucauauuuuuaguaccaccuacaguugaaucuagaacaaaacccuucaccguaccuauacuaacaguugaagaaaugacaaauucaagauuucccauacccuuagaaaaauuauuuacaggaccaucaggagccuuuguaguacaaccucaaaauggcagauguacaacagauggaguccucuuaggaacaacccaacuuucaccaguaaauauuugcacauuuagaggagacguuacccauauagcagguucaagaaauuacacuaugaaccuagccucucuaaauuggaacaacuacgauccaacagaagaaauaccugcaccacuagguacaccagacuuugucggaaaaauacaaggaguauuaacacaaacaacaaaaggugauggaucaaccagaggacauaaagccacaguauauacaggaucagcaccauuuacacccaaacuuggaucuguacaauucucaacagauacagaaaaugacuuugaaacacaucaaaauacaaaauuuacacccguaggaguaauacaagaugguucaacuacccacagaaaugaaccucaacaaugggucuuaccaucauauucuggaagaaacguucauaacguucacuuagcaccagcaguagcacccacauuuccaggagaacaauuauuauuuuucagaucaaccaugccaggauguagcggauacccaaauauggaccuugauugucuccuaccucaagaauggguucaacacuucuaucaagaagcagcaccagcacaaucagacguagcucuacuaagauucguaaauccagauacuggaagaguauuauuugaaugcaaauuacauaaaucaggcuauguaacaguagcacacacaggacaacaugauuuaguaauaccuccuaauggauauuuuagauucgauucauggguaaaccaauuuuacacucuagcuccaaugggaaauggaacuggaaggagacgugcuuuauaa

SEQ ID NO: 31350 - RNA, 1623 nt, Artificial Sequence
  derived and/or modified sequence opt6 from VP1__Norovirus__ADR78893
augaaaauggcauccaacgacgcaaacccuuccgauggaucagcugcaaacuuaguuccagaaguaaacaaugaaguaauggcauuagaaccaguaguaggugcagcuauagcugcaccaguagccggccaacaaaacguaauugauccauggaucagaaauaauuuuguacaagcuccaggcggugaauucacaguaucaccacgaaacgccccaggcgaaauauuauggucugcaccauuaggcccagauuuaaauccauacuuaucucauuuagcacgaauguauaacgguuacgcgggagguuuugaaguacaaguaauacucgcagguaacgccuuuaccgcuggaaaaauaauuuuugcagcaguaccaccaaacuuuccaacugaaggguuguccccaucccaaguaacaauguucccucacauaauaguagacguaaggcaacuagaaccaguauuaauaccacucccagacgucagaaacaacuucuaucauuacaaucaaucaaaugacucaacaauuaaauuaauagccaugcuuuacaccccauuaagagcuaauaacgcaggcgaagacguauuuacaguauccugccgaguccuaacaagaccauccccagauuuugauuuuauauuucuaguaccaccaaccguagaaucaagaacaaaaccauuuacaguaccaauacuaaccguugaagaaaugacaaacucuagauucccaauaccauuagaaaaauuauuuacuggcccaucaggagcauuuguaguacaaccacaaaacggcagaugcacaacagacgguguauuacuaggaacaacucaauuaucaccaguaaauauauguaccuucagaggagacguaacacauauagcuggcuccagaaauuacacaaugaauuuagccucuuuaaauuggaauaauuacgauccaacagaagaaaucccugcaccauuagguacaccugacuucguaggaaaaauacaaggugucuuaacacaaacaaccaaaggugacgguucaaccagaggccacaaagcaacaguauauacagguucagcuccauucacacccaaauuaggaaguguccaauuuucaaccgacacagaaaacgauuucgaaacacaucaaaauacaaaauuuacaccaguuggaguaauacaagacggauccacaacacauagaaaugaaccgcaacaauggguuuugccaucauacucaggaagaaauguacauaacguacauuuagcacccgcugucgccccuacauuuccaggagaacaacuauuauuuuuucgaaguacaaugcccggauguaguggauaccccaauauggauuuagacugucucuuaccacaagaauggguucaacauuucuaucaagaagcagccccugcacaaucagauguugcauuacuaagauucguaaacccugauaccggaagaguccuauuugaauguaaacuacacaaauccggcuaugucacuguagcacacacaggacaacacgauuuaguaaucccuccaaauggauacuuucgauucgacucauggguaaaucaauuuuacacucuagcaccaauggguaauggaacaggacgaagacgagcauuauaa

SEQ ID NO: 31351 - RNA, 1623 nt, Artificial Sequence
  derived and/or modified sequence opt6 from VP1__Norovirus__ADR78896
augaaaauggccucuaaugacgccaaucccucagacggaucagccgcuaacuuaguaccagaaguaaacaaugaaguaauggcacuagaaccagucguuggcgccgcuaucgcagcaccaguagcgggucaacaaaauguaauagacccauggaucagaaacaauuuuguacaagccccuggaggagaauuuaccguaucaccaagaaaugcuccaggcgaaaucuuauggucagcuccacuuggcccagauuuaaaucccuauuuaucacaccuagcaagaauguauaacgguuacgcgggcggauucgaaguacaaguuauacuagccggaaaugcauucacagcaggaaaaauaauauucgcagcuguuccacccaacuuuccaacagaaggcuuaucacccucacaaguaacaauguucccucauauaauaguagacguaagacaacuagaaccaguacuaauaccuuuaccagauguacgaaacaauuucuaccauuauaaccaaucuaaugacaguacaauaaaauuaauagccaugcucuauacucccuuacgagcuaacaaugcaggagaagauguauuuacaguuucaugcagaguauuaacaagaccaucaccagacuuugauuuuauuuuuuuaguuccaccuacaguagaaucccgaacuaaacccuuuacaguccccauacuuacaguagaagaaaugacaaauucaagauuuccaauaccucuagaaaaauuauucacaggaccaucaggagcauucguaguccaaccucaaaauggaagaugcacuacagacggaguauuacuaggaaccacacaacuaucaccaguaaauauauguaccuuucgcggagacguaacacacauugcaggaagucgaaauuauacaaugaaccuagcaucacuaaacuggaacaauuacgaucccacagaagaaaucccugcaccacuaggaacaccagacuuuguuggaaaaauacaaggaguuuuaacacaaacuacuaaaggagauggaucaacaagaggacacaaagcaacaguauauacagguagugcaccauucaccccuaaacuagguagcguacaauuuucuacagacacagagaacgacuuugaaacacaccaaaauaccaaauucacaccaguaggcguaauacaagacgguucaacuacacauagaaaugaaccucaacaauggguacuaccuuccuacucuggaagaaauguacauaauguacaucuagccccagcugucgcaccaacuuuuccuggagaacaacuauuauucuuuagaucaacuaugccugguugcucaggcuauccuaauauggacuuagauuguuuacucccacaagaauggguucaacauuucuaucaagaagccgcaccagcucaaucugacguagcauuauuacguuuuguaaaccccgacacaggacgaguauuauuugaauguaaauuacacaaaucaggauauguaacaguugcacacacuggacaacaugauuuaguaauaccaccaaauggcuauuucagauucgacucuuggguuaaucaauucuauacucuagccccaauggguaauggaacaggaagaagaagagcacuauaa

SEQ ID NO: 31352 - RNA, 1623 nt, Artificial Sequence
  derived and/or modified sequence opt6 from VP1__Norovirus__ADR78899
augaaaauggcaaguaacgaugcaaacccuagugauggaagugcagccaaccuuguaccagaaguuaacaaugaagucauggcauuagaaccaguaguaggcgcagcaauugcugcaccagucgccggucaacaaaaugucauagaccccuggauaagaaauaauuuuguccaagcuccaggaggagaauuuacaguuagcccaagaaaugcuccaggagaaauacuauggucugcaccacuaggaccagaccuaaaucccuaccuaucacaucuagcaagaauguauaauggauacgcuggcggauucgaaguacaaguaauauuagcaggaaaugccuuuacagcuggaaaaauaauuuuugcagcaguuccaccaaacuuucccacagaaggucucaguccaucccaaguaacaauguucccccacauuauagucgaugucagacaacuugaaccaguacuuauaccacucccagaugucagaaauaacuucuaucacuauaaucaaucaaaugacucuacaaucaaacuaauagccaugcuauauacaccccuuagagcaaauaacgcuggcgaagauguuuuuacaguaagcuguagaguacuaaccaggccaucucccgacuucgauuuuauauuucuaguaccaccaacagucgaaucaagaacaaaaccuuucacaguaccaauccuaacuguagaagaaaugaccaauaguagauuuccaauaccauuagaaaaauuauucacaggacccucuggugcauuuguaguacaaccacaaaaugguagauguaccacagacggaguacuauuaggaaccacacaacuaagcccagucaauauauguacuuuuagaggagacgucacacauauagccggaucaagaaacuacaccaugaaucuagcaucuuuaaauuggaacaauuaugaccccacugaagaaauaccugccccacuaggugcaccugacuucguagguaaaauacaaggaguacuuacacaaacaacaaaaggagacgguuccacacgcggacauaaagcaacaguauauacaggaucagcaccauuuacacccaaacuaggcucaguucaauuuucaaccgacacagaaaacgauuucgaaacacaucaaaacacaaaauucacaccagucgguguuauacaagauggaucaacaacacaucgaaaugaaccacaacaauggguauuaccaucauauucaggaagaaauguccauaacguucaucuagcaccagcaguugcaccaacauuuccaggagaacaacuacuauucuuucgaaguacaaugccaggcuguucuggauacccaaauauggaccuagauugccuauuaccacaagaauggguccaacauuucuaccaagaagcugcaccagcccaaucagacguagcauuacucagauucguaaacccagacacaggaagaguucuauucgaaugcaaacuucacaaaucaggauacguuacuguagcacauacaggccaacaugauuuagugauaccaccaaacggcuacuuuagauuugauucuuggguaaaucaauucuauacauuagcaccaaugggaaaugggacaggacgaaggcgagcucuuuag

SEQ ID NO: 31353 - RNA, 1623 nt, Artificial Sequence
  derived and/or modified sequence opt6 from VP1__Norovirus__ADR78902
augaaaauggccucaaacgaugcaaaccccucagauggaucagccgcaaauuuaguuccugaaguaaauaaugaaguaauggcuuuagaaccugucguaggagcagcaauagcugcuccaguagcuggacaacaaaauguaauagauccuuggauacgaaacaauuucguccaagcaccaggcggagaauuuacuguaucaccaagaaacgccccaggugaaauauuauggucagcaccauuaggacccgauuuaaaccccuaccuaucucauuuagcacgaauguauaaugguuacgcugguggcuuugaaguacaaguaaucuuagcaggcaacgccuucaccgcaggaaagaucauuuucgcagcuguucccccaaacuuccccacagaaggacucucacccucacaaguuacaauguucccacacauaauaguagauguacgccaacuagaaccaguacuaauacccuuaccagacguaagaaacaauuucuaucacuauaaucaaucaaaugacucuacaauaaaacuaauagcaaugcuuuacacaccccuacgagcuaacaaugcuggugaagacguuuucacaguaagcugucgaguguuaacaagaccaucaccagacuuugauuuuauauuccuuguacccccuacaguagaaaguagaacaaaaccauuuacagucccaauauuaacaguugaagaaaugacaaacagccguuucccaauaccacucgaaaaacuauuuacaggacccucaggcgcauuuguaguacaaccucaaaacggacgauguacaacagacggaguauuacuuggaacaacacaauuaucacccguaaauauuuguacauuuagaggagacguaacacauauugcaggcucaagaaacuauacuaugaacuuagcaagcuuaaauuggaacaauuaugacccaacagaagaaauaccugcaccacuagggacaccagacuuuguugguaaaauccaaggaguauuaacccaaacaacaaaaggagacgguaguacaagaggccacaaagcaacaguauauaccggauccgcaccuuuuacaccaaaacuagguucuguacaauuuucaacagauacagaaaacgauuuugaaacacaucaaaacaccaaauuuacaccuguaggaguaauacaagacggaagcacaacacaucgaaaugaaccacaacaauggguuuuaccaucuuacucaggaagaaauguacacaauguacauuuagcaccugcaguagccccaacauuuccaggugaacaacuauuauucuuucgaucaacuaugcccggcuguuccggauauccuaacauggauuuagauugccucuuaccucaagaauggguacaacauuuuuaucaagaagcagcuccagcacaaucagauguagcuuuacuacguuucguaaacccagauacaggacgaguauuauuugaauguaaacuccauaaaucaggcuauguuacuguugcacauaccggacaacaugauuuagucauaccaccaaauggauauuucagauuugacucauggguaaaucaauucuacacuuuagcaccaaugggaaauggcacuggacgacgacgugcacuuuaa

SEQ ID NO: 31354 - RNA, 1623 nt, Artificial Sequence
  derived and/or modified sequence opt6 from VP1__Norovirus__ADR78905
augaaaauggcuucuaaugaugcuaacccaagcgauggaucagcagcaaauuuaguuccugaaguaaauaaugaaguaauggcacuagaaccaguaguaggagcggcaauagcugccccagucgcaggacaacaaaaugucauagacccauggaucagaaacaacuuuguacaagcaccaggcggagaauuuaccguaucaccaagaaaugcuccaggagaaaucuuguggucagccccucuagguccagaucuaaauccuuaucuaucacacuuagcacguauguacaacggguaugccggagguuucgaaguacaaguaauauuagcaggaaacgcauuuacagcuggaaaaauaauuuucgcagcagucccucccaacuucccaacagaaggauuaucacccucacaaguaaccauguucccacacauaauaguagacguccgacaacuagaaccaguucuaauacccuuaccagacguccgaaacaauuuuuaucacuauaaccaaucaaacgauucaacaauuaaacuuauagcuaugcuauacacaccauuacgagcuaacaacgcuggagaagacgucuuuacaguaaguuguagaguauuaacucgaccaucacccgauuuugacuucauauuuuuagucccaccuacagucgaaucacgcacaaaaccauuuacuguccccaucuuaacaguagaagaaaugaccaacaguagauuuccgaucccacuugaaaaauuauucaccggcccuucuggagcauuugucguacaaccucaaaauggaagauguacuacagacgguguauuacuaggcaccacacaauuaucaccagucaauauauguaccuucagaggagauguaacccacauagcuggaucaagaaauuacacaaugaauuuagcuucucuaaauuggaacaauuaugaucccacugaagaaauaccagcaccacuugguacacccgacuuuguaggaaaaauucaaggagucuuaacccaaacaacuaaaggagauggauccacaagaggacacaaagcuacagucuauaccggaucagcacccuucacaccuaaacuuggaucaguacaauuuuccacagacacagaaaaugauuuugaaacccaccaaaacacuaaauuuaccccagucggagucauacaagacggaucuacaacacaccgaaaugaaccacaacaauggguauuaccuucuuauucaggaagaaacguacauaacguacaccuagcaccagcaguugcucccacauuuccaggagaacaacuauuauuuuuuagaucaacaaugccuggauguucaggauauccaaauauggaccuagauugccuauuaccucaagaauggguacaacauuucuaucaagaagcagcacccgcacaauccgauguagcauuauuaagauucgucaacccagacacuggacguguauuauuugaauguaaauuacauaaaaguggauauguaaccguagcccauacaggacaacaugacuuaguaauaccaccaaauggauauuuucgauucgacucuuggguaaaucaauucuacacacuagccccuaugggaaauggaacaggacgaagacgugcauuauaa

SEQ ID NO: 31355 - RNA, 1623 nt, Artificial Sequence
  derived and/or modified sequence opt6 from VP1__Norovirus__ADR78908
augaaaauggccuccaaugacgcuaacccaucagauggcucagcagcaaaccucguaccagaaguuaacaaugaaguuauggcauuagaaccaguuguaggagcagcaauagcagcaccuguugcuggacaacaaaacguaaucgauccuuggauaagaaacaacuuuguacaagcaccaggaggagaauucaccguaucaccaagaaaugcaccuggugaaauauuauggucagcaccauuaggacccgacuuaaacccauaccuuucacauuuagcaagaauguauaauggauacgcuggaggauucgaaguacaaguaauccuagcaggcaacgcauucaccgcuggcaaaaucauauucgcagcuguaccaccaaacuuuccaacagaaggccuaucaccaucucaaguaaccauguuuccacauauaauaguugauguuagacaauuagaaccuguauuaauacccuuaccagauguaagaaauaauuuuuaucacuauaaccaguccaaugacucaacaauaaaauuaaucgcaauguuauauacaccacuacgagcaaacaaugcuggagaggacguauuuacuguuaguugcagaguuuuaacucgucccucaccggacuuugauuucaucuuucuaguuccaccaacagucgaaucacgaacuaaaccauuuacaguacccauauuaacugucgaagaaaugacaaacucaagauuucccauaccccuugaaaaauuauucacuggucccaguagcgcuuuuguaguucaaccacaaaaugguagaugcaccacagacgguguacuucuaggcacaacucaauuauccccuguaaacaucugcacauuuagaggugacguaacccauauugcagguagcagaaacuacacaaugaaucuugccuccuuaaauuggaauaauuacgauccaacagaagaaauaccugcaccauuaggaacaccagacuucguaggaaaaauccaaggaguccucacccaaaccacaaaaggagauggauccacacgaggacacaaagcuaccguauacacaggaucagcaccauuuacaccuaaacuuggcucaguacaauucucuacagauacagaaaacgauuucgaaacacaccaaaauacaaaauuuacaccaguaggaguaauucaagacggcucaacaacccacagaaaugaaccacaacaauggguacuaccuucuuauuccggacgaaauguccacaacguacaccuagcaccagcaguagcuccaacauuuccuggagaacaacuacuuuuuuuuagauccacaaugccagguuguucaggauaccccaauauggaucuagacugcuuacuaccccaagaauggguccaacacuuuuaucaagaagcugcuccagcacaaucagacguagccuuacuacgauucguaaacccagauacaggaagaguacuauucgaaugcaaacuacacaaauccggguauguaacaguagcacauacaggacaacacgacuuaguaauaccaccaaacggauauuuccgauucgacagcuggguaaaucaauuuuauacauuagccccuaugggaaauggaaccgguagacgacgugcacuauaa

SEQ ID NO: 31356 - RNA, 1623 nt, Artificial Sequence
  derived and/or modified sequence opt6 from VP1__Norovirus__ADR78911
augaaaauggcuuccaaugacgcaaccccaucagauggaucaaccgcaaaccuaguacccgaaguaaauaaugaaguaauggcacuagaaccagucgucggagcugcuauagcagcaccuguagcuggccaacaaaacguaaucgacccuuggauacgaaauaauuucguucaagccccaggaggugaauuuaccguaucuccaagaaaugcuccaggagaaauacuuuggagcgcaccauuaggaccagaucuaaaucccuaucuuucacauuuagcacgaauguauaacgguuacgcaggagguuucgaaguacaaguaauacuugcaggaaaugcuuucacagcagguaaaauaauauuugcagcuguaccuccaaauuuuccaacagaaggucucucaccaucacaaguaaccauguuuccucauauaauaguagacguuagacaacucgaacccguacuaaucccauuaccggauguacgcaauaacuuuuaccacuacaaccaaucaaacgacccgacuauuaaacuaauagcaaugcucuauacuccacuaagagcaaacaacgcuggagacgauguuuucacaguaucuuguagaguucuaacaagaccauccccugacuuugauuuuauauuuuuagucccaccuacuguagaaucaagaacuaaaccuuuuucaguacccauacuaacaguugaagaaaugacaaacucccgcuuuccuauuccacuugaaaaauuauuuacagguccauccucugcauuuguuguacaaccccaaaauggaagauguacaacagacggaguucuuuuaggaacaacucaauuaucuccagucaauauauguaccuuuagaggagacguuacacauauagcgggcacacaaaacuauacuaugaauuuagcaucacaaaauuggaauaauuaugauccuacagaagaaauaccagcaccauuaggcacuccagauuuuguaggaaaaauucaaggaguacuaacacaaaccacuagaagagacggaucaacaagaggucacaaagccaccguauccaccggaucuguacacuuuacaccaaaauuaggaucaguacaacucucaacugauacauccaacgauuuugaaacaggccaaaauacccgauucacuccaguaggaguaguccaagacggaagcacuacacaucaaaaugaaccccaacaauggguccuacccgacuauucuggaagagauucacacaacguacacuuagcaccagcaguagcaccaacauuuccaggagaacaacuauuauucuuuagaucuacaaugccaggaugcucaggauauccaaauaugaauuuagacuguuuacuaccucaagaauggguacaacauuuuuaucaagaaucagcaccagcccaaucagacguagcacuucuaagauucguaaacccagauacaggacgaguacucuuugaaugcaaauuacacaaaucaggauauguuacaguugcacacacaggucaacaugauuuaguaauaccaccaaaugguuauuucagauucgauagcuggguaaaccaauucuauacacucgcaccuaugggaaauggagcuggaagacgaagagcacuauaa

SEQ ID NO: 31357 - RNA, 1623 nt, Artificial Sequence
  derived and/or modified sequence opt6 from VP1__Norovirus__ADR78914
augaaaauggcauccaaugacgccacaccaucagauggaucaacagcuaaccuaguuccugaaguaaacaaugaaguuauggcccuagaaccaguaguuggagcagcaauagccgcaccaguagcaggccaacagaaugugauagacccauggauucguaauaauuuuguccaagcacccgguggagaauuuacaguaucaccaagaaaugcaccaggagaaauacucuggucugcuccacuaggaccagauuuaaaucccuauuuaucucaccuagcacgaauguauaacggauacgcaggcggauuugaaguacaaguaauacuagcuggcaaugcauuuacagcaggaaaaaucauauucgcugcaguucccccuaacuuucccaccgaaggucuauccccaucucaaguaacaauguucccacauauaauaguugacgucagacaacuagaaccuguacuuauuccauuaccagacguacgaaacaacuucuaucauuacaaccaaucaaacgaccccaccauaaaauuaauagccaugcuuuauacaccucuaagagccaacaaugcaggagacgauguuuuuacaguaucaugccgaguucucacaagacccucaccugacuuugacuuuauauuucuaguaccaccaacuguagaaucaagaacaaaaccuuuuuccguaccuauauuaacaguagaagaaaugaccaacucacgauuucccauaccauuagaaaaacuauuuacaggaccaaguucagccuucguaguacaaccucaaaauggucgaugcacaaccgacggaguauuacucggaacaacacaauugaguccugucaauauauguacuuucaggggagacgucacacauauagcuggcacacaaaauuauacaaugaaucucgccucacaaaauuggaacaauuacgauccaaccgaagaaaucccagcuccuuuaggaacaccagacuuugucggaaaaauucaaggaguacuaacacaaacaacuagaagagacggaucaacaagaggacauaaagcuacuguuucaacaggaucaguacauuucacaccaaaauuagguucaguucaauucucaacagacacaucaaacgauuuugaaaccggacaaaauacaagauuuacacccguaggcguaguacaagacggaucaacaacucaucaaaaugaaccccaacaauggguuuuaccugauuauucaggaagagacucacauaacguacaucuagcccccgcuguugccccuacauucccuggugaacaacuucuauucuucagaucaacaaugccagguuguuccggauauccaaacaugaauuuagacugccuauuaccacaagaauggguucaacacuucuaucaagaaucugcaccagcucaaucggauguagcacucuuaagauucguaaauccagauacaggacgaguacuuuucgaaugcaaauuacauaaaagcggauauguuacaguugcacacacaggacaacaugaucuaguaauaccuccaaauggauacuucagauucgauucauggguaaaucaauuuuauacgcuagccccaaugggaaauggagcaggaagacgcagagcauuauaa

SEQ ID NO: 31358 - RNA, 1623 nt, Artificial Sequence
  derived and/or modified sequence opt6 from VP1__Norovirus__ADR78917
augaaaauggcaucaaacgaugcaacuccaucugacgguucaacagccaaccuagucccagaaguaaacaacgaaguaauggcacuagaacccguaguaggcgcagcuauagcagcaccaguagcaggccaacaaaauguaauagacccauggauaagaaauaauuuuguucaagcacccggaggcgaauuuacagucucaccacgaaaugcacccggagaaauacucuggucagccccacuuggaccagaucuaaaucccuauuuaucacauuuagccagaauguauaacgguuaugcuggaggcuucgaaguacaagucauacuagcaggaaacgcauuuacugccgguaaaauaauauuugcagcaguaccuccuaacuucccuacugaaggacuaucuccaucacaaguuacaauguuuccgcacaucauuguugauguuagacagcucgaaccaguucuaauuccacuaccagaugucagaaacaauuuuuaucauuacaaccaaagcaacgacccaacaauaaaacuaauagcaauguuauauacaccccuaagagcuaauaaugcaggagacgauguauuuacaguuucaugcagaguacuaacacgaccauccccagacuucgacuuuauauuucuaguaccaccuacuguagaaucacguacaaaaccuuuuucaguacccauauuaacaguagaagaaaugacuaacucucgauucccaauaccacuagaaaaacuauucacaggacccucuuccgcuuucguaguacaaccacaaaacggucgcuguacaaccgauggcguacuauuaggaacaacccaacuaucacccgucaauauauguacauuuagaggagacguaacacauauagcaggaacucaaaauuacacaaugaaccuagcuucacaaaacuggaacaauuacgauccaacugaagaaauaccagccccacuaggaacacccgacuuuguaggacgcauacaaggaguacuuacacaaacuacaagacgagacggcucaacuagaggacacaaagcaacagucaguaccggaucaguacauuucacaccuaaauuaggaucaguacaauucucaacagauacaucaaacgauuuugaaacuggccaaaauacaagauuuacacccguaggaguaguccaagacggaagcacaacacaucaaaaugaaccccaacaauggguuuuaccagauuauucagguagagacucacauaauguucauuuagcaccggcuguugcaccuacuuuuccaggagaacaauuauuauucuuucgaucaaccaugccaggcuguucaggcuauccaaacaugaaccuugacugucuucucccgcaagaauggguccaacacuucuaccaagaaagugcaccagcccaaucugauguagcauuacuaagauucguuaauccagauacaggaagaguacuauucgaaugcaaauuacauaaaucaggauauguaacaguagcacacacaggacaacaugaccuaguaaucccacccaacggauauuucagauuugauucaugggucaaucaauuuuacaccuuagcaccaaugggcaauggagccggacgacgaagagcccuauaa

SEQ ID NO: 31359 - RNA, 1623 nt, Artificial Sequence
  derived and/or modified sequence opt6 from VP1__Norovirus__ADR78920
augaaaauggcaucaaaugaugcaacaccuucagauggaucaacagcuaauuuaguaccagaaguaaauaacgaaguaauggcucucgaaccaguaguuggugcagccauagcagcaccaguagcaggacaacaaaauguaauugacccauggauccguaauaacuuuguacaagcaccaggaggagaauucacaguaucuccaagaaacgcaccaggagaaauauuauggucagcaccacuaggccccgaccuaaauccauaucuaucacaucuagcacgaauguauaacggcuaugcaggaggauuugaaguacaaguuauacuagccggaaacgcauuuacagcaggaaaaauaauauucgccgcaguaccaccaaacuuuccaacagaaggacuuucaccuucacaaguaacaauguuuccacacauaauaguagauguaagacaauuagaaccaguauuaauaccacuaccagauguccgaaacaauuuuuaucacuacaaccaaucaaaugacccaacaauuaaacuaauagcaaugcuauauacuccucuaagagcaaacaacgcaggagacgaugucuuuacaguaucaugccgaguacuaacucgaccuucaccugacuuugauuucauauuucuugucccaccaacaguagaaucaagaacaaaaccauuuucaguaccaauacuaacaguagaagaaaugacuaauucacgcuuccccauaccacucgaaaaauuauuuacagguccaagcuccgcauucguaguacaaccacaaaacggacgauguaccacugacggaguacucuuaggaaccacucaauuaagccccguaaauauaugcacauucagaggugacguuacucauauagcaggcacacaaaacuacacaaugaaucuagcaucacaaaauuggaacaauuaugauccaacagaagaaauaccagcuccauuagguaccccagacuucguuggaaaaauucaaggagucuuaacacaaacaacuagaagagacggaucaacaagaggacacaaagcaacaguuucaacaggcuccguucacuuuacaccuaaacucggaucaguacaauuuucaaccgacacaucaaaugacuucgaaacaggucaaaacacaagauucacaccaguaggaguuguacaagauggagauacuacccaucaaaaugaaccacaacaguggguauuacccgacuauucaggcagagauucucauaauguacaccuagcaccagcaguagccccuacuuuccccggagaacaauuacuauucuuuagaagcacaaugccagguugcucugguuacccaaacaugaauuuagauugcuuauuaccacaagaauggguacaacauuuuuaucaagaaucagcuccagcacaaucagacgucgcauuauuaagauucgucaacccagacacaggacgaguauuauucgaauguaaacugcauaaaucagguuacguaacaguugcucacacaggacaacaugaccuagucauuccaccaaacggcuauuuuagauucgacucauggguaaaccaauuuuauacauuagcuccaaugggaaacggagcaggaagacgaagagcacuauaa

SEQ ID NO: 31360 - RNA, 1623 nt, Artificial Sequence
  derived and/or modified sequence opt6 from VP1__Norovirus__ADR78923
augaaaauggcuucaaaugacgcuaccccaucagacggauccacagcaaauuuaguuccggaaguaaacaaugaaguuauggcacuagaaccaguagucggagcagcaauagcagcaccaguagcaggacaacaaaaugucauagacccauggauacgcaauaacuuuguacaagcuccaggaggagaauuuacugucucaccaagaaaugcaccaggagaaauacuauggucugcaccacuaggaccagacuuaaauccauauuuaucacaucuagccagaauguauaacgguuacgcaggaggcuuugaaguacaaguaauacucgcaggaaaugcauucacagcuggaaaaauaauuuucgcagcuguaccacccaauuuuccaacagaaggacucucuccaucacaaguaacaauguuuccucauauaaucguugauguuagacaacuagaaccuguauuaauaccauuaccagauguacguaauaacuuuuaucacuauaaccaaucuaaugacucuacaauaaaacuuauagcaauguuguauaccccauuaagagcuaauaaugccggagacgauguauuuacaguaucaugccgaguauuaacacguccuucuccagacuuugacuucauauuuuuaguaccaccaacuguagaaucacgaacaaaaccuuuuucaguaccaauuuuaacagucgaagaaaugacuaauucucgauuuccuauaccacuugaaaaacuauuuacaggacccuccucagcauucguaguacaaccacaaaacggaagauguaccaccgacggaguacuauuaggaacaacucaauuaucuccagucaauaucuguacuuucagaggcgauguaacacauauugcagguacucaaaacuacacaaugaaccucgcuucacaaaacuggaacaauuacgauccaacagaagaaaucccagcgccacuaggaacaccagauuuuguaggaaaaauacaagguguuuuaacucaaacuacaagacgugaugguaguacacgcggucacaaagccacaguauccaccggaucaguacauuuuacaccuaaauuaggaaguguacaauucucaacagauacaucaaacgacuucgaaacaggucaaaauacacguuuuacuccaguaggaguaguacaagacggaucaacaacacaccaaaacgaaccacaacaauggguacuaccagacuauucagguagagauucccauaacguacaccuagcuccagcagucgccccuacauuuccaggagaacaauuacuauucuuuagaucaacaaugccaggaugcuccgguuauccaaauaugaaccuagauugccuucuaccucaagaauggguacaacacuuuuaucaagaauccgcaccugcccaaucagauguagcuuuacuuagauucguaaacccagacacaggaagaguauuauuugaaugcaaacuacauaaaucaggauauguaacaguagcacacacaggccaacacgaccucguuauuccaccaaacggauacuuuagauucgauucauggguuaaucaauuuuacacacucgcaccaaugggcaacggcgcaggccguagaagagcccuauaa

SEQ ID NO: 31361 - RNA, 1623 nt, Artificial Sequence
  derived and/or modified sequence opt6 from VP1__Norovirus__ADR78929
augaaaauggcaucaaaugaugcuucaccaagugacggaucuacagcaaacuuaguacccgaagucaacaaugaaguaauggcacuugaaccaguaguaggagcagcaauagccgcucccguagccggacaacaaaauguaauugauccauggauacguaauaacuuuguacaagcaccaggaggggaauuuacagucucacccagaaaugccccaggagaaauacuauggucugcaccauuaggcccagauuuaaacccauauuuaucccacuuagcuagaauguauaacggauacgcuggaggauuugaaguacaagucauacucgcaggaaacgcauuuacagcuggcaaaauaauuuuugcugcaguaccccccaacuucccaacagaaggacuuucaccaucacaaguaacaauguuuccacacauuaucguagauguaagacaacuagaaccaguauuaauaccauuaccugacguaagaaacaacuucuaucacuauaaucaaaguaacgacucaacaaucaaauuaauagcuauguuauauacaccauuaagagcaaauaaugcgggagacgauguuuucacaguaucauguagaguccucaccagaccuucaccagauuuugacuucauauuccuagucccaccaaccguagaaucuagaacaaaaccauucacaguaccaauacuuaccguagaagaaaugacaaacucaagauucccaauuccacuugaaaaauuauuuacaggaccaucaucagcauucguaguacaaccucaaaaugguagauguacaacagacggcguacucuuaggaacaacacaacuuucacccguuaacauauguacauuuagaggcgacguaacacauauaaguggaacaagaacauaccgaaugaaucuugccucccaaaacuggaacaauuacgaucccacagaagaaauccccgcuccacuugguacaccugacuuuguaggaaaaauacaaggaaugcuaacacaaacaacaaaaggugacgguucaacacgcggacacaaagcuacaguaucaacuggaucaguagacuucacaccaaaacuugguucaguacaauuugcuaccgauacagauaacgauuuugaaaccggacaaaauacgagauucacaccaguaggaguaauacaagaugguucuucagcacaucgaaaugaaccucaacaauggguuuuaccagacuacucaggaagaaccguacauaacguucaucuugcaccugcuguugcaccuacauuuccaggagaacagcuauuauucuuuagaucaacaaugccaggauguagcggauaucccaauauggaucuagauugcuuacuaccucaagaguggguucaacacuucuaucaagaagcagcaccaucacaauccgacguagccuuacuacgcuucguaaaccccgacacuggacggguuuuauucgaauguaaauuacauaaagcaggauauguaacuguagcucacacuggacaacacgaucuaguuauaccuccaaauggcuauuuuagauucgauucuuggguaaaucaauuuuauacauuagcuccuaugggaaacggagcaggcagaagacgugcacuuuaa

SEQ ID NO: 31362 - RNA, 1623 nt, Artificial Sequence
  derived and/or modified sequence opt6 from VP1__Norovirus__ADR78932
augaaaauggcuucauccgaugcaucacccuccgacggaagugcagcaaacuuaguuccagaaguaaacaaugaaguaauggcacuagaaccaguaguuggugcagcuauagcagcaccaguagcaggacaacaaaauguuaucgauccauggauacgaaacaauuuuguacaagcaccaggaggcgaauuuacaguaucuccaagaaaugcaccaggagaaauacucuggucagcaccauuagguccagaucuaaacccauaccuaucucaccuagcaagaauguauaacggcuacgcaggaggauuugaaguccaagucauacuagccggaaaugcauuuacagcaggcaagauaauauucgccgcaguaccaccaaacuuuccaacagaaggacuaucaccaucacaaguaacaauguuuccacauauaauaguugacguaagacaauuagaaccaguccuaauaccacuacccgauguucgaaacaacuuuuaccauuacaaucaaucaaaugacucaacaauaaaauuaauagcaauguuauacaccccauuaagagcaaacaacgcaggagaugacguuuuuacaguaucauguagaguuuuaacaagaccaucaccagauuuugauuuuauauucuuaguaccaccaacaguugaaucacgaacaaaacccuuuacaguaccaauauuaacaguagaagaaaugacaaauucaagauuuccuauaccuuuagaaaaacuauuuacaggaccaucuagugcauuuguaguccaaccacaaaauggaagauguacaacagacggaguauuacucggaacaacucaauuaucuccaguaaauauauguaccuuucgaggagacgugacacauauaucaggcucuagaaauuaccgaaugaaccucgcaucacaaaacuggaacaauuaugacccaacagaagaaauuccugcaccucuaggaacaccagauuuugucgguaaaauucaaggcauguuaacccaaacuacaaaaggugacgguucaacaagaggucacaaagcaacagucucaaccggauccguagauuuuacaccaaaacuaggaucaguacaauuugcaacagauacagacaacgacuuugaaacaggacaaaauacuagauuuaccccaguaggugucauacaagacgguucaucagcccauagaaaugaaccacaacaauggguacuaccagauuacucuggaagaaccguacauaacguccaccucgcaccagcaguagcaccaacuuuccccggugaacaauuauuauuuuuucgaucaacuaugccaggaugcuccggcuauccaaauauggaccucgauugccuauuaccacaagaauggguacaacauuuuuaccaagaagcagcaccuucacaaucagacguagcauuauuaagauucgucaacccugacaccggccgaguuuuauuugaguguaaacuacauaaagcaggcuauguaacagucgcacauacuggacaacacgaucuuguaauuccacccaauggauauuucagauuugacucuuggguaaaccaauuuuacacauuagcaccaaugggaaauggcgcugguagacgaagagcuuuauaa

SEQ ID NO: 31363 - RNA, 1623 nt, Artificial Sequence
  derived and/or modified sequence opt6 from VP1__Norovirus__ADR78938
augaaaauggcaaguaaugacgcaucuccuagcgacggcucaacagcaaaucuaguuccagaaguaaauaaugaaguaauggcacuugaaccaguaguaggugcagcaauagcagcuccagucgcaggucaacaaaauguaauagacccauggauacgaaauaacuuuguccaagccccaggaggagaauuuaccguuucaccuagaaacgcacccggugaaaucuuauggucagcucccuuaggaccugacuuaaauccuuauuuaucacaucuugccagaauguauaacgguuaugcaggugguuuugaaguacaagucauacuagcaggaaaugcauuuacagcagguaaaauaauauuugcagcaguuccacccaacuucccaacagaaggucuaucaccaucacaaguaaccauguuuccacacaucaucguagacguaagacaauuagaaccuguacuaauuccacuaccagauguaagaaauaauuuuuaccauuauaaucaaucuaacgauucaaccauaaaauuaauagccaugcuauauacaccuuuaagagcaaauaaugcaggagaugauguuuuuacuguuucauguagaguacuaacacguccaucaccagacuuugacuucauauuucucguaccaccaacaguugaaucaagaaccaaaccuuucacaguaccaauacucaccguugaagaaaugacaaauucaagauuuccaauaccauuagaaaaauuauucaccggaccaucaagcgcuuuuguaguacaaccacaaaauggacgcuguacaacagacggaguccuauugggaacaacccaacuaucaccgguaaauaucuguacuuuuagaggcgacguaacacauauaccaggaacaagaucauacagaaugaaucuagcuucccaaaacuggaauaacuacgauccuacugaagaaaucccagcaccacuaggaacaccagauuuuguagguaaaauucaaggaauguuaacacaaacaaccaaaagagauggaucgacaagaggccauaaagcuacuguaucaacuggaagcguugacuucaccccaaaauuaggaucaguucaauucgccacugauacagacaacgacuuugaaacaggucaaaacacuagauuuacuccaguaggaguaauacaagauggcucaaguacccacagaaaugaaccacaacaauggguacuaccugacuauucuggcagaaccguacauaacguacaccuagcaccagcuguagcaccaacauucccaggugaacaacuacuauucuuucgaaguaccaugcccggauguucaggauacccaaacauggaucuagacugucuacucccacaagaauggguacaacauuucuaucaagaagcagcaccaucacaaucagacguagcacuucuaagauucguuaauccagauacagguagaguauuauucgaauguaaauuacauaaagcaggcuauguaacaguugcacauacuggacaacaugacuuaguuaucccaccaaacggcuacuuuagguucgauucauggguaaaucaauuuuauacacuagccccaaugggaaauggagcaggaagaagaagagcacucuaa

SEQ ID NO: 31364 - RNA, 1623 nt, Artificial Sequence
  derived and/or modified sequence opt6 from VP1__Norovirus__ADR78941
augaaaauggcaucuaaugacgcuagccccucagacggaucaacagcaaaccuaguucccgaagucaacaaugaaguaauggccuuagaacccguaguaggagcagcuauagccgcaccuguugcuggccaacaaaauguaauagacccauggauaagaaauaauuuuguccaggcuccaggaggagaauucacaguauccccacgcaacgcacccggagaaaucuuguggucugcaccguuaggaccagacuuaaauccauaucuuucacaucuagcuagaauguacaacggauaugcuggaggauuugaaguacaagucauauuagcugguaaugcauucacagcaggaaaaauaaucuuugcagcaguuccaccuaacuucccaacagaaggauuaucuccaucccaagucacaauguucccucacauaauaguagacgucagacaacuagaaccaguacucauaccacuacccgaugucagaaauaauuucuaucauuauaaucaaucuaaugauucaaccauaaaacuaaucgcaaugcuauacacaccauuaagagcaaauaacgcaggagacgauguauuuacaguuucaugcagaguacuaacaagaccaucaccagacuuugacuucauauucuuaguccccccgacaguagaaucacgaacaaaaccauuuacuguaccaauacuaacaguagaagaaaugacuaauaguagauuuccaauaccacucgaaaaacuauuuacaggaccuaguucagcauucgucguccaaccacaaaacggcagauguacaacugacgguguauuacuagguacaacacaauuauccccaguaaauauauguaccuucagaggagacguaacacauauacccgguacuagaacauacagaaugaaccucgcaucucaaaauuggaauaauuaugauccaacagaagaaauaccggcaccacuuggcacaccugacuuugucggaaaaauacaaggaaugcuaacacaaaccacaaaaggugacggauccacuaggggccacaaagccacuguaagcacaggaucagucgauuucacaccuaaauuaggaaguguacaauucgcaaccgauacagauaaugacuucgaaaccggccaaaauacaagauuuacuccaguagguguaauacaagacggaagcucaacccaucgaaaugaaccacaacaauggguacuaccagacuacucaggacgcaccguacacaacguacaucuagcaccagcaguagccccuacauuuccaggugaacaacuauuauucuuuagauccacaaugcccggaugcucaggauaucccaacauggaucuagauuguuuacuaccacaagaauggguacaacacuuuuaucaagaagcagcaccaucucaaucagauguagcacuacuaagauucguaaacccugauacuggaagaguacuauucgaaugcaaacuacauaaagcaggcuauguaacaguagcucacacaggacaacacgaucuaguaauaccaccuaauggauauuuucgauuugauucauggguaaaccaauuuuauacacucgcaccaaugggcaauggagcaggucgacgcagagcauuauaa

SEQ ID NO: 31365 - RNA, 1623 nt, Artificial Sequence
  derived and/or modified sequence opt6 from VP1__Norovirus__ADR78944
augaaaauggcauccaacgaugcaucccccagcgacggcagcacagcaaaccuaguaccagaaguuaauaacgaaguaauggcacuagaaccaguugucggagcugcaauagcagcaccuguugcuggacaacaaaacguaauagaccccuggauaagaaauaacuuuguccaagcuccaggaggagaauucacaguaucaccaagaaacgccccuggagaaauucuauggucugcaccauuaggaccagaccuaaauccauauuuaucacacuuagcaagaauguacaacgguuacgcuggaggauuugaaguccaaguuauacuagcaggaaaugcauuuacagcaggaaaaauaauauuugcagcaguccccccuaauuucccaacagaaggauuaucuccaucacaaguaacaauguucccacauauaauaguugauguccgacaauuagaaccaguacuaauaccauuacccgauguaagaaacaauuucuaucacuauaaccaauccaacgacucaaccauaaaacucauagcaaugcuauauacgccccuacgagcaaacaacgccggugaugacguauuuacaguaucaugccgaguacuaacucgaccaucaccagacuuugacuuuauauuccucguaccaccaacagucgaaucuagaacaaaaccauucacaguaccuauccuaaccguagaagaaaugacuaacucuagguucccaauaccauuagaaaaacucuuuacaggucccucaucagcauucgucguacaaccacaaaacggcagauguacaaccgacggcguauuacuaggaacuacacaauuaucaccuguaaauauuuguacauuccguggagauguaacucauaucucuggaucacgaacauauagaaugaaccuagcaucccaaaacuggaacaauuacgauccaacagaagaaaucccagcaccauuaggaaccccagacuuugucggaaaaauucaaggaauguuaacacaaacuacaaaaggagacggaucaacacgaggacacaaagcaacaguaucaacaggaagugucgacuuuacaccaaaauuaggcaguguacaauuugcaacagauacugauaacgauuucgaaacaggacaaaacacacgauuuacuccuguaggaguaauacaagacggaucaucaacacacagaaacgaaccacaacaauggguucuaccagauuauucuggacgaacaguccacaauguucacuuagcacccgcuguagcacccacuuuuccaggugaacaauuacucuuuuuucgaucaacaaugccaggaugcucaggauacccaaacauggauuuagacugucuuuuaccacaagaauggguucaacauuuuuaucaagaagcagcaccaucccaaucagauguagcacuacuuagauucguaaacccugauacuggaagaguacuuuucgaaugcaaauuacauaaagcaggcuaugucacuguagcacacacuggucaacacgaucuaguaauaccccccaacgguuacuuucgauuugacucauggguuaaucaauuuuauacacuugcuccaaugggcaauggugcaggcagaagaagagcacuauaa

SEQ ID NO: 31366 - RNA, 1623 nt, Artificial Sequence
  derived and/or modified sequence opt6 from VP1__Norovirus__ADR78947
augaaaauggcuucuaaugaugcuuccccaucagauggaucuacagcaaaucuaguuccugaaguaaacaacgaaguaauggcacuagaaccuguaguaggagcagcaauugccgcacccguagccggacaacaaaauguuauagauccuuggauaagaaacaacuuuguacaagccccaggaggagaauuuacuguaucaccaagaaaugcaccuggcgaaauauuauggucagcuccacuaggaccugacuuaaacccauauuuaucucacuuagcaagaauguauaacgguuacgcaggaggauucgaaguucaaguaauacuugcagguaaugcauuuacugcuggaaaaaucauuuucgcagcuguucccccuaacuucccaacagaaggucuaucuccaucacaaguuacaauguucccacacauaauugucgauguaagacaacuagaaccagucuuaauuccacucccagauguacgaaacaauuuuuaucauuauaaccaaucaaaugacucaacaauaaaauuaaucgcuaugcuauauacuccacuaagagcaaacaacgcaggagaugauguauucaccguuucaugucgcguucuaacccgaccuagucccgauuuugauuuuaucuuucuaguaccccccacaguagaauccagaacuaaaccauuuacaguaccaaucuuaaccguagaagaaaugacaaacagucgauucccuauaccauuagaaaaacuauuuacaggcccaucaucagcauuuguaguacaaccacaaaaugguagauguacaacagauggaguauuacuaggaacaacacaacuaucaccuguuaacauauguacauuuagaggagacguaacacauauuccaggaaccagaacauacagaaugaaucucgcaucucaaaauuggaacaauuaugauccaacagaagaaauucccgcaccccuaggaacaccagacuuuguaggcaaaauucaaggcaugcuuacucaaacaacaaaaggcgauggcucaacaagaggacacaaagcaaccguaucuaccggauccguagacuuuacaccaaaauuaggaucaguacaauuugcuacagauacagacaacgauuuugaaacuggucaaaauaccagauucacacccguaggaguaauacaagacggaucaucaacucaucgcaacgaaccucaacaauggguccuucccgacuacuccggacgaacuguccacaacguccauuuagccccagccgucgcccccacauuuccaggcgaacaauuacuuuuuuuuagaucuacaaugccaggaugcucaggauauccaaauauggaucuagauugucuccuaccucaagaauggguacaacauuucuaccaagaagcugcaccaucacaaucagaugucgcauuacuacguuucguaaacccagacaccggaagaguauuauuugaauguaaacuucauaaagcaggauaugucacuguagcacauacuggucaacaugaucucguaauacccccuaauggauacuuuagauucgauucuuggguaaaucaauuuuacacauuagcaccaaugggaaacggagcaggaagaagaagagcauuauaa

SEQ ID NO: 31367 - RNA, 1623 nt, Artificial Sequence
  derived and/or modified sequence opt6 from VP1__Norovirus__ADR78950
augaaaauggcuucaaaugaugcuucuccaucagacgguuccgcagcaaaucuaguaccugaagugaauaaugaaguaauggcauuagaaccaguaguuggagcagcuauagcugcuccaguagcuggccaacaaaauguaauagacccuuggauaagaaauaauuuuguacaagcaccaggaggagaauuuacuguaucaccaagaaaugcucccggagaaauauuaugguccgcuccauuaggaccagaucucaauccuuauuuaucacaucuagcaagaauguauaacggauaugccggaggcuuugaaguucaaguuuuauuagcaggaaaugcauuuacugcaggaaaaauaauauuugcagccguaccacccacauucccaacugaaggacuaucaccaagucaaguaacaauguuuccucacauaauaguugacguuagacaauuagaaccaguacuaauaccucuaccugacguaagaaacaauuucuaucauuacaaccaauccaaugacucuaccauaaaauuaguagcaaugcuauauaccccauuaagagcaaauaacgccggagaugacguauucacaguaucauguagaguucuaacaaggccuagcccagauuuugauuucauauuuuuaguaccaccaacaguugaaucaagaaccaaaccauuuacaguaccaauauuaacaguagaagaaaugacaaacucaagauuuccuauaccacuagaacgacuauucaccggaccaagcuccgcauuuguuguucaaccucaaaauggaagauguacuacugaugguguacuacuugguacuacacaacuuuccccaguaaacauaugcaccuuucguggugacguuacuaauauacccggcucucgaacauauagaaugaaccucgccucacaaaauuggaauaauuaugauccaacagaagaaauaccagcaccacucgguacaccugauuuuguaggaaaaauccaaggaguauuaacacaaacaacaaaaggugauggaucaacuagaggacauaaagcaacaguuagaacaggaucugcagauuuuacaccuaaacucggaucuguucaauuugcuacugacacugauaaugauuucguaacaggccaaaacacaagauucacaccaguaggaguaauacaugauggaucuucagcacaucguaacgaaccccaacaauggguauuaccagaauauucaggaagaucuguccacaacguucacuuagcaccagcuguagcuccaacuuucccaggagaacaacuccuauucuuucgauccacaaugccagguuguuccggauauccaaacauggauuuagauuguuuauuaccacaagaauggguacaacauuuuuaccaagaagcugcaccaucacaaucagauguagcacuccuacguuuuguaaauccagauacaggacguguacucuuugaauguaaguuacauaaagcagguuacguaacaguagcacacaccggacaacacgaccuaguaauaccaccaaacggauauuuucgauucgauucauggguaaaucaauuuuacacacuugcaccaaugggaaauggagcuggcagaagaagagcauuauaa

SEQ ID NO: 31368 - RNA, 1623 nt, Artificial Sequence
  derived and/or modified sequence opt6 from VP1__Norovirus__ADR78956
augaaaauggcaucaaacgacgcuaguccaucagacggcucuacugcaaacuuaguuccagaaguaaacaacgaaguuauggcacucgaaccagucguaggcgcagcaauagcagcaccaguagcaggacaacaaaauguuauagacccuuggauuagaaauaacuuuguccaagcgccagguggagaauuuacaguaucaccaagaaacgccccuggagaaaucuuauggucagcaccauuaggaccagauuuaaauccauauuuaucacaccuugcaagaauguauaaugguuacgcugguggcuuugaaguccaaguaauacucgccggaaaugcauucacagcaggcaaaauaauuuuugcagcaguaccccccaacuucccuacagaaggauuaucaccaucacaaguaacaauguucccacacauuauaguugacgucagacaacuagaaccugucuuaaucccauuaccagauguaagaaacaacuucuaccauuauaaccaaucaaaugacucaacaauaaaauuaauagcuauguuauauaccccauuaagagcaaauaaugcuggagacgauguauuuacaguauccugucgaguacuaaccagaccaucaccagacuucgacuuuauauuuuuaguaccaccuaccguagaaucacgaacaaaaccuuuuacuguaccuauacuaacuguagaagaaaugacaaauuccagauucccaauaccauuagaaaaacuauucacaggaccaucaucugcauucguuguacaaccacaaaacggacgauguacaacagacgguguccuucuaggaacaacucaacucucuccaguaaauaucuguacuuuccgaggagacguaacgcauauaccaggaacacgaacuuacagaaugaaucuagccucacaaaacuggaauaauuaugauccaacugaagaaauaccagcaccacuagguacaccugauuuugucggaaaaauacaagguaugcuuacacaaacaaccaaaggagauggauccacuagaggacacaaagcaacuguauccacaggaucaguugacuuuacacccaaacuagguucaguacaauucgcaaccgauacagauaaugauuucgaaacaggucaaaauacacgcuucacucccguaggaguaauacaagacggaucaucagcacauagaaacgaaccacaacaauggguauuaccagacuauucaggaagaacuguacacaacguccaccuagccccagcaguagcacccacauucccaggagaacaacuacuuuuuuuuagaaguaccaugccaggauguagcggguauccaaauauggaucuagacugucuauuaccucaagaauggguacaacacuucuaccaagaagcagcaccagcacagucagacguagccuuacuccgauuugucaauccagacacaggaagaguacucuucgaaugcaaauuacauaaaacagguuauguaacaguagcccacacaggacaacaugauuuaguaauucccccuaacggauauuucagauuugacucuuggguaaaucaauuuuauacauuagcaccaaugggcaauggagcuggacgaagaagagcucuuuaa

SEQ ID NO: 31369 - RNA, 1653 nt, Artificial Sequence
  derived and/or modified sequence opt6 from VP1__Norovirus__AEA02124
augaugauggcaucaaaagaugcaacaucaaauauggauggaaccaguggcgccggccaacucguaccagaaaauaauaauacaucagaaccaauaaauauggaacccguugcuggagcaguaaccgccgccgcuacagcaggucaaguaaacaugauagacccuuggauaaugaauaauuacguacaagcaccucaaggagaauucacaauaucaccaaacaauacaccaggcgauauucuauuugauuuacaauuagguccucauuuaaacccuuuuuuagcacaccuaucacaaauguauaauggauggguagguaauaugaaagugagaguaguauuagcaggaaaugcuuuuucagccggaaaaauaauaguauguuguauaccacccggauuuagugcucccaauauauccauagcccaagcuacaauguucccccacguaauagcagacguuagaguauuagaaccaauagacauaccauuagaugauguacguaauguacuauuccauacaaacgacaauggaaaucaaaccaugagacuacuauguaugcuauauacuccauuaagaucaggaggaaccuccucagguacagacccauuuguaauagcuggaagaguauuaacauguccaacaccagacuucaauuuuuuauucuuaguaccacccacuguagaacaaaaaacaaaacaauucucaguacccaacuuaccacuaaacguaaugucuaacuccagaguaccaucuuuacuuaacgcaaugguaguaucacccgaucaagcacaaguaguucaauuucaaaacggaagauguacccuagacggacaaauguuaggaacaacaacaguaucugcaucaugcguagcacguuucagagguaaaacuuuccaagcaccagacaauagauuaggcauaaauuuagcagaaauaucuggugaacccuaucaugcuuucgaauccccagcaccauuaggcuuuccagauuucggagauggagacuggcacguaacagcaaccaaaguaacuccaagucaauuagaagcaaaugacccugucgucguaggaaauguacaacccuacaauccacaauucgccccacauuuaggaacauuaguaguugaaaauccaacacccgaucagguagcaacaggaacagauuuacuauuuaauauaacaugguuaucaaauagagcuaacaauagauucaaucccuggguaauaccuaauuauggaucaacacuuacagaagcugcacaauuagcaccauccauuuuuccaccaggauuuggagaaacaauuguauauuuuaauuccacauucccagcaguuggcgccacaacacaugccgcaauaccaugcuuauuaccucaagaauuuguagcccauuucguaaaugaacaagccccaauuagaggcgaagcagcuuuacugcauuacauagauccagauacacacagaaauuuaggagaauuuaaaauuuacccagaagguuuugucacauguguaccuaauguagggggaacagguccacaaucuuuaccaacuaaugguguauucgucuucgucucauggguaucucgauauuaucaauuaaaaccaguaggaacagcuggccaagcaagaagauuaggauuucguagaguauaa

SEQ ID NO: 31370 - RNA, 1647 nt, Artificial Sequence
  derived and/or modified sequence opt6 from VP1__Norovirus__AED02033
augaaaauggccuccaacgacgcugcaccaucaaaugacggagccgcaggauuagucccagaaauaaacaaugaagcaauggcacuagaaccaguagcaggagcagcaauagccgcaccucuuacaggacaacaaaauauaauugacccauggauaaugaauaauuuuguccaagcccccggcggagaauuuacaguuucaccuagaaauucuccaggagaaguacuucuaaaccuagaacuaggaccagaaauaaauccauaucucgcacaccuagccagaauguauaacggcuacgcaggaggauuugaaguacaaguuguauuagcagguaaugcuuuuacagcuggaaaaguuauauucgcagcaauuccaccaaacuuuccaauugacaaucuaucugcagcacagauaaccaugugcccacacguaauaguagacguuagacaacuagaaccgauuaaccuaccaaugccagaugucagaaacaacuuuuuucauuacaaccaaggaucagacucaagauuaagacucaucgcuauguuauacacaccacucagagcuaacaauaguggagacgauguauucacaguaucaugucguguuuuaacuagacccucaccugacuuuucauuuaacuuucuaguuccaccuacaguugaaucaaaaacaaaacccuucacucuaccuauauuaacaauuucugaaaugucuaacucucgauuucccguacccauagacucacuacauacauccccaacagaaaauauaguaguucaaugucaaaauggaagaguuacauuagacggcgaauuaaugggaacuacacaacuuuuaccuucucaaauaugugcuuuuagaggcaccuuaauaagaucaacaucaagggccucagaucaagcagauacuucaacuccaagacuauuuaauuauuauuggcacauacaacuagauaaucuaaacggaacuccauaugacccagccgaagauauaccugcaccacuaggaacaccagacuucagagguaaaguauucgguguagcuucucaaagaaacccagacucaaccacuagggcacacgaagcaaaaguugacacaaccuccggucgauucacaccaaaacuagguucacucgaaauaauaacagaaucagacgauuuugaucucaaccaaucaacuaaauucacaccaguaggaauaggaguagauaaugaagcagaauuccaacaauggucccuucccaacuacuccggacaauucacacacaacaugaauuuagcuccagcaguagcaccaaauuuccccggagaacaauuauuauucuuucgcucacaacuaccaaguucuggaggacguucuaauggaguauuagauugcuuaguaccucaagaauggguacaacauuuuuaucaagaaucagcaccagcacaaacacaaguugcacuaguacgauauguaaacccugacaccggaagaguauuauucgaagcaaaacuacacaaacugggauucaugacaauagcuaaaaauggagacucuccaauaacagucccaccaaacggcuauuucagauuugaaagcuggguaaauccauuuuacacauuagcucccaugggaaccggcaauggcagacgacguauacaauaa

SEQ ID NO: 31371 - RNA, 1647 nt, Artificial Sequence
  derived and/or modified sequence opt6 from VP1__Norovirus__AED02034
augaaaauggcaagcaaugacgccgcuccaucaaaugacggagcagcuggauuagugccagaaauaaacaaugaagcaauggcccuagaaccaguagcaggagcagcaauugcagcaccacuuacaggacaacaaaacauaaucgauccauggauaaugaacaacuuuguacaagccccaggcggagaauuuacaguaagcccacgaaacucaccaggcgaaguauuauuaaaucuagaacucggaccagaaauuaacccauaccuagcacacuuagcaagaauguauaacggauaugcagguggcuuugagguacaaguaguuuuagcaggaaacgcuuucacagcaggaaaaguaauauuugcagccauaccaccaaauuuuccaauagacaaucucuccgcagcacaaauaacaauguguccacacguaauaguagauguaagacaacuagaaccaaucaacuuacccaugcccgacguucgaaauaacuucuuccacuauaaucaaggaagugauuccagacuaagacuaauugcaaugcuauauacaccucuaagagccaauaacucaggagacgacguauucacagucucaugcagaguauuaacaagaccaucuccagauuucucauucaauuuccuaguuccuccaacaguugaaucaaaaaccaaaccauuuacccuuccaauauuaacaauauccgaaaugucaaacucacgcuuuccaguucccaucgacuccuuacacacaucauuaacagaaaacauuguaguacaaugucaaaauggaagagucaccuuagauggagaauuaaugggcacaacccaacuacuaccaucccaaauaugugcuuuccgaggcacccuuacaagaucaacauccagagcuucagaccaagccgacacugccacaccaagauuauucaacuacuauuggcacauacaauuaaacaaucuaaacggaacaccauaugauccugcagaagacaucccagcacccuuaggaacaccagacuuuagaggaaaagucuucggaguugccucacaacgaaaucccgacucaaccacaagagcucaugaagccaaagucgauacuacaucaggaagauuugccccaaaauuaggcagccuagaaauaucaacugaaacagaugauuucaaccaaaaucaaccuacaagauuuaccccaguaggaauaggaguagauaaugaagcagauuuucaacaauggucacuacccgacuacucaggacaauuuacccacaauaugaauuuagcaccagcaguagcucccaauuuucccggugaacaauuacuauuuuucagaagccaauuaccaucuucaggaggacgauccagcggaauauuagauugcuuaguaccacaagaauggguucaacacuuuuaccaagaaucagcaccagcacaaacucaaguagcccuaguaagauacgucaauccagauacuggucgaguacuuuuugaagccaaacuccauaaauuagguuuuaugacaauagccaaaaacggcgacagcccaauaacaguaccaccaaacggcuacuucagauucgaaucaugggucaauccuuuuuacacucuagcacccaugggaacaggaaauggaagacgacgaauacaauag

SEQ ID NO: 31372 - RNA, 1647 nt, Artificial Sequence
  derived and/or modified sequence opt6 from VP1__Norovirus__AED02035
augaaaauggccucuaaugaugcagcaccuucaaaugauggagcagcagguuuaguaccagaaauaaauaaugaagcuauggcuuuagaaccaguagcaggcgccgcaauugcagcaccacuaacaggccaacaaaauaucaucgacccuuggauaaugaauaauuuuguccaagcaccaggaggagaauuuacuguaucaccaagaaacucacccggagaaguauuacuuaaucuagaauuaggaccagaaauaaauccauaccuagcacaccuagcuagaauguauaauggcuacgcagguggauuugaaguacaaguaguauuagcagguaacgcuuucacggcaggcaaaguuauauucgcagcaauaccaccaaauuuucccauagauaacuuaagcgcugcacaaauaacuaugugcccacacguuauaguagauguaagacaacuagaaccaauaaacuuaccaaugccagacguaagaaauaacuuuuuucacuacaaccaaggaucagacuccagacuaagauuaauagcuaugcuuuauacacccuuaagagcaaacaauucuggagaugacguauucaccguaucaugcagaguucuaaccagaccuucuccagauuuuucauucaacuuccuuguaccuccaacaguagaaucuaaaacaaaaccauuuaccuuacccauucucaccauaucagaaaugucaaauaguagauuuccaguuccaauugauuccuuacauaccucacccaccgaaaauauagucgugcaaugucaaaacggcagaguaacuuuagacggagaacuaaugggaacaacacaauuguuaccaagucaaauaugugcauuuagaggaacacuaacaagaucaacauccagaacaggagaucaagcugauacagcaucacccagauuauuuaauuauuauuggcacauacaauuagacaauuuaaacggaacaccauaugauccugcugaagauauaccagcuccauuaggaacaccugauuucagaggcaaaguauucggcguagcaucacaacguaacccagacaguacaacaagagcacaugaagcaaaaguugauacuacgucagguagauuugccccaaaauuaggaucauuagaaauaucaaccgaaucagacgacuucgacucuaaucaaccuacaagauuuaccccaguaggcauuggcguagauagagaaacagauuuucaacaauggacacuuccagaauauucuggucaauucacacauaacaugaaccuagcaccagcaguugcaccaaauuuuccuggugaacaauuauuauuuuuccguagccaacuaccaucauccggaggaagauccggaggcauauuagacugucuaguaccucaagaauggguacaacacuuuuaucaagaaucugcaccagcacagacacaagucgcacuaguaagauacgucaauccagauacaggccgaguuuuauuugaagcuaaacuccacaaacuaggcuucaugacaauagcaaaaaacggagauucccccauaacaguaccaccuaacggcuacuucagauucgaaaguuggguaaauccuuuuuauacacuagcccccaugggaacaggcaauggaagaagaagaauucaauaa

SEQ ID NO: 31373 - RNA, 1647 nt, Artificial Sequence
  derived and/or modified sequence opt6 from VP1__Norovirus__AED02037
augaaaauggcaucaaaugacgcagcaccaucaaacgacggagcagcaggccuaguaccugaaauaaacaaugaagcaauggcauuagauccuguagcaggcgcagccaucgcagcaccccuuacaggacaacaaaacauaauagacccauggauaaugaauaacuucguucaagccccaggaggcgaauucacaguaucaccaagaaauucaccaggagaagucuuacuaaaucucgaauuaggccccgaaauuaauccauaucuagcacaccuagcaagaauguacaaugguuaugcaggcggauucgaaguccaaguaguacuagcaggaaacgccuucacagcagguaaaguaauuuuugcagcaaucccaccaaauuuuccaauagauaaccuaucagccgcacaaaucacaauguguccacaugucauaguagauguaagacaacuugaaccaauaaaucuaccaaugccagaugucagaaauaacuuuuuucacuauaaucaagguucagacucacgacuaagacuaauagccaugcuauacacuccauuaagagcuaacaacaguggcgaugacguauucacuguaucaugucgaguacuaaccagaccaucaccagauuucagcuucaacuuccuaguaccacccacuguagaauccaaaacaaaaccauucacacuaccaauacuuacuauaucagaaaugucaaauagucgauuuccaguuccuauagauucacuacacacuucuccaaccgaaucaauaguaguccaaugucaaaauggcagagucacuuuagauggagaacuaaugggaacuacacaauuacuucccaaucaaauuugcgcauucagaggaaccuuaacgagaaguacaaauagagcaucagaccaagcagacaccgcaacacccagacuauucaaccaccacuggcauauacaacuagacaacuuaaauggcacaccauaugacccugcugaagacaucccugcaccacuaggaaccccugacuucagaggaaaaguauuuggaguugcaucgcaaagaaacccggauucaacuacacgagcacaugaagcaaaaguagacacaacaucuggacgauuuacaccuaaauuaggaagcuuagaaauaaccacugaaucagacgacuuugacccuaaucaaucuacgaaauuuacuccaguaggaauagguguagacaaugaagcagauuuucaacaauggucuuuaccugauuacucuggacaauucacacacaacaugaacuuagcaccagcuguagcacccaacuucccaggagaacaauuacuauuuuuccgaucacaauuaccaagcucuggaggccgauccaacggcauauuagauugucuaguaccgcaggaauggguacaacacuucuaucaagaaucagcaccagcacaaacacaagucgcccuaguaagauacguaaacccugauacaggaagaguauuauuugaagccaaacuucacaaauuaggauucaugacaauagcaaaaaauggagacucaccaauaacaguuccaccaaaugguuacuuuagauucgaaucuugggucaauccauuuuacacauuagcuccaaugggaacuggaaauggaagacgaagaauacaauaa

SEQ ID NO: 31374 - RNA, 1647 nt, Artificial Sequence
  derived and/or modified sequence opt6 from VP1__Norovirus__AED02038
augaagauggcuucaaaugaugcagcaccuucaaacgauggugcagccggacuaguaccugaaauaaauaaugaagcaauggcacuagaaccaguagcaggugcugcaauagcugcaccacuaacuggacaacaaaauauuauagacccauggauaaugaacaauuuuguacaagccccuggcggagaauuuacaguaucaccaagaaacucaccaggagaaguauuacuaaauuuagaauuaggaccagaaaucaauccauauuuagcacaccuagcacgaauguacaauggauacgcagguggcuuugaaguacagguaguauuagcaggcaacgccuucacagcaggcaaagucauuuuugcagcaauuccaccuaauuuuccaauagauaaucuaucugccgcacaaauaacaaugugcccucauguaaucguagauguccgacaauuagaaccuauaaacuuaccuaugccugacguacgaaauaauuuuuuucacuauaaccaaggaucagacagucgauuaagauuaaucgcaauguuauacacaccuuuaagagcuaacaauuccggagacgauguauucacuguaucuuguagaguacuaacucgaccuucaccagacuucucauucaauuuccuagucccaccaacaguggaaucaaaaacaaaaccauuuacucuaccaauauuaacaauaucagaaauguccaauucaagauuuccagucccaauugacucuuuacauacaucaccaacagaaaauauaguuguacaaugucaaaacggaagaguuacacucgauggagaacuaaugggaacaacucagcuccuaccuucacaaauaugugcauucagaggaacauuaacaagaucuacaucucgagcaggcgaccaagcagacacugcuacaccacguuuauucaauuauuauuggcacauucaacuugacaacuuaaauggaacaccauaugaucccgcagaagauauaccagcaccuuuaggaacaccagacuuccgaggaaaaguauuuggaguagcaucacaaagaaauccagauuccaccacaagagcacacgaagcuaaagucgauacaacaucaggacgauucgcucccaaacuagguuccuuagaaauaucaacugaaucuuccgauuuugacuccaaucaaccaaccagauuuacuccaguuggaauuggaguagacaacgaagcagauuuucaacaauggucacuaccagacuauucaggucaauuuacucauaacaugaaucucgcaccagcaguagcuccuaacuucccaggagaacaauuacuuuuuuuuagaucacaacuaccauccuccggaggucgcucuaacggaauauuagauugccuaguaccucaagaauggguacaacauuuuuaccaagaaucugccccagcacaaacccagguagcacucguaagauacguuaacccagacacaggaagaguauuauucgaagccaaauuacauaaauuaggauucaugaccauugcaaaaaacggcgauucuccuauuacaguuccaccuaauggauauuuuagauuugaauccuggguuaauccauuuuauacacuagcaccuaugggaacuggaaauggucgaagacgaauacaauaa

SEQ ID NO: 31375 - RNA, 1647 nt, Artificial Sequence
  derived and/or modified sequence opt6 from VP1__Norovirus__AED02039
augaaaauggcaucaaacgacgcagcaccaucaaacgacggugccgcaggauuagucccagaaaucaacaaugaagcuauggcauuagaaccaguugcaggagcagcaauagcugcaccuuuaacaggccaacaaaauauaauagacccauggauaaugaauaacuuuguacaagcuccaggaggugaauucacaguaucaccaagaaauucaccaggagaaguauuauuaaaucucgaacuagguccagaaaucaaucccuaucuagcacaccuagcaagaauguauaauggauacgcaggaggcuucgaaguacaaguuguuuuagcugguaaugcauucaccgcaggaaaaguaauuuuugcugcaaucccaccaaacuucccaauagauaauuuaucagcugcacaaaucacaaugugcccacacguaauaguagauguuagacaacuugagccaauaaaccuuccaaugccugauguaagaaacaauuucuuucauuauaaucaaggaagcgacucaagauuacgacuaauugcaauguuauauacuccauuaagagcuaacaauucaggagaugauguauuuaccguuucguguagaguucuuacuagaccuucgccagauuuuuccuuuaauuuccuagucccaccuacuguugaaucaaaaacuaaaccuuuuacacuaccaauucuaacaauaucagaaaugucaaauucaagauuuccaguaccaauagauucauuacauacaucaccaacugaaaacauuguuguacaaugucaaaacggacgcgucacacuagauggagaauuaaugggaacuacacaacuauuaccgucacaaauaugugcauuucgcggaacauuaacucguucaaccagccgugcaggagaucaagcagauacagcuaccccaagguuauucaauuauuacuggcacauacaauuagauaacuuaaacggaacuccauacgacccagcagaagauauaccagcacccuuaggaaccccagacuuucgcgguaaaguauuuggaguagcuucacaaagaaaucccgauucaacaacaagagcacaugaagcaaaagucgauacuaccucagguagauucgcaccaaaauuagguucccucgaaaucucaacagaauccucagauuuugauucaaaucaaccuacaagauucacaccaguaggcauuggcguugacaaugaagccgacuuucaacaauggucacuuccagauuauucaggacaauuuacacauaacaugaaucucgcaccagcuguugcaccuaacuuccccggagaacaacuauuauucuuuagaucacaauuaccuucuucaggugguagaucacacggaauacucgauugcuuaguaccucaagaauggguacaacacuucuaucaagaaucagccccugcucaaacacaaguugcacuagucagauacguaaauccugacacagguagaguuuuauuugaagccaaacuacauaaauuagguuuuaugacaauagcuaaaaauggagauucaccuauuacuguaccaccaaacggauauuuuagauuugaaucaugggucaauccauuuuacacauuagcuccaaugggcacuggaaauaaacgucgaagaauccaauaa

SEQ ID NO: 31376 - RNA, 1623 nt, Artificial Sequence
  derived and/or modified sequence opt6 from VP1__Norovirus__AEG79290
augaaaauggcaucaaacgacgcaaacccaucugauggcucagccgcaaaucuagucccagaaguaaauaacgaagucauggcacuugaaccagucgcuggagcagcccucgcagccccaguagcaggacaacaaaauguaauugaccccuggauuagaaauaauuucguccaagcaccaggaggagaauucacaguaucaccacgcaaugccccaggagaaauacuaugguccgcccccuuaucacccgaucuaaauccauauuuaucacauuuagcaagaauguauaacaguuacgcagguggcuucgaaguacaaguaauauuagccgguaaugcauucacugcuggaaaaauaauuuuugcugcaguacccccuaacuucccaauagaaggccucucaccaucacaaguaacaauguucccccauauaaucguagacguaagacaauuagaaccaguauuaauaccgcuccccgauguaagaaauaauuucuaucacuacaaccaauccaaugaaccaacaauaaaauuaauagcaaugcuuuacaccccauuaagagcaaauaacgcuggugaagauguauucaccguauccuguagaguccuaacacguccuuccccagauuuugauuucauauuucucguuccacccacaguagaaucaagaacaaaaccauucacaguaccaauauuaacaguugaagaaaugacuaauucaagauuccccauaccauuagaaaaacuauuuacaggaccaucuucauccuucguaguccaaccacaaaauggaagauguaccacugacggaguuuuacuaggaacaacacaacuuagcccaguaaauauauguacauuucgaggugauguaacacauauagcuggaagcagaaauuauacuaugaauuuagcaaguauuaacuggaauaauuacgacccuacagaagaaauacccgcuccacuaggaacuccagauuuuguaggaaaaauacaaggaauguuaacacaaacaacaagaggugacggaucaacaagaggucaccgagcaacaguuuacacaggcucagccccauucacuccaaaacuugguucuguacaauuuaccaccgauacagauaacgacuuugaaacaaaucaaaacaccaaauucacaccagucggaguaguacaagauggagacaccgcccauagaaacgaaccccaacaauggguacuaccaucauauaguggacgcaacguacaaaauguacaccuagcccccgccguagcuccaaccuuuccaggagaacaacuauuauucuuuagaagcacaaugcccgguugcucuggcuaucccaauauggaucuugauugccuauuaccacaagaauggguucaacacuucuaucaagaagcagcuccagcacaaucagacguagcacucuuaagauucguuaacccagauacuggaagaguacuauucgaauguaaacuacauaagucaggauaugucacuguagcacacacuggacaacacgaccuaguaauaccaccaaauggauacuucagauucgauucaugggucaaucaauuuuauacacuagcacccauggguaauggcacaggaagacgaagagcauuauaa

SEQ ID NO: 31377 - RNA, 1608 nt, Artificial Sequence
  derived and/or modified sequence opt6 from VP1__Norovirus__AEI29586
augaaaauggccucaaacgaugcagcuccaucaaaugacggagcugcagguuuagucccagaaguaaacaacgaaacuauggcuuuagaaccaguagcaggugccucaaucgcagcacccuuaacaggacaaaacaaugucauagauccauggauucgccucaacuucguacaagcuccaaauggagaauucacaguaagcccaagaaauucuccaggcgaaguacuauuaaaucuagaacuaggaccagaauuaaauccauaccuagcacaccuaucaagaauguauaauggauacgcaggaggaguugaaguucaaguacuacuagccggaaaugcauucacugcuggaaaacuaguauuugcagcaguaccaccucacuuuccacuagaaaacauuaguccaggacaaauaacaauguuuccccacgucauaauugacguaagaacacuagaaccaguacucuuaccauuacccgacgucagaaauaacuuuuuccacuauaaucaacaaaacgaaccacgaaugagacuaguugcaaugcuuuauacuccccuaagaucaaauggaucuggagaugacguauuuacaguaaguugucguguccuaacacgaccaucaccagacuuugauuucaacuaucuaguaccacccacuguagaaucaaaaacaaaacccuucacacuaccaauacuaacaauaggagaacuuacaaauucaagauuuccaguaccuauagacgaacuuuauacuucaccuaacgaaagccuuguaguacaaccacaaaaugguagaugugcacuugauggagaacuacaaggaacaacacaauuacuaccaacugcaauauguucauucagaggaagaauaaaccaaaaaguaucuggagaaaaccauguauggaauaugcaaguaacaaauauugaugguacaccauuugacccuacagaagauguaccugcaccacuagggacaccagauuuuucaggaaaauuauucgguguauuaucucaacgagaccaugacaacgcaugucgaucucacgaugcaguaaucgcaacaaauucagcgaaauuuacaccaaaauuaggagcuauacaaaucggaacaugggaacaagacgauguacauauaaaucaaccaacaaaauucacaccagucgguuuauuugaaucugaaggcuuuaaccaauggacauuaccaaauuauucaggugcuuuaacacucaacaugggauuagccccacccguagcaccaacauuuccaggagaacaaauauuauuuuucagaucucauauaccauuaaaagguggaguugcugauccaguaauagauugccuacuaccacaagaauggauccaacaccucuaucaagaaucagcuccaucgcaaacugauguagcauuaaucagauucacaaacccagacaccgguagaguacuauucgaagcaaaacuacauagaucaggauauauaacuguagccaacacaggaucaagaccaauagucguacccgcaaauggauauuuuagauucgacucuuggguuaaucaauuuuacucacuagcaccaaugggaacaggaaacggaagacgaagaguacaauaa

SEQ ID NO: 31378 - RNA, 1623 nt, Artificial Sequence
  derived and/or modified sequence opt6 from VP1__Norovirus__AEJ82646
augaaaauggcaucaaaugacgcaacaccaagcgacggcucaacagcuaacuuaguaccugaagucaacaaugaaguaauggcccuagaaccaguaguaggagcagcaauagcugcaccaguagcaggccaacaaaacguaauagauccuuggauaagaaauaacuuuguucaagcaccagguggagaauuuaccguuuccccaagaaacgcaccuggagaaauacucuggucugcaccauuagguccagaccuaaacccauaccucagucaccuugcaagaauguauaauggauaugccggcggauucgaaguacaaguuauauuagcagguaaugucuuuacagcaggaaaaauaauauucgcagcaguuccccccaauuucccaacagaaggacuaucacccucacaaguaacaauguucccucacauaauaguagauguaagacaacuagaaccaguacucaucccacuaccugauguacgaaacaauuucuaucacuauaaucaaucaaacgaucccacaauaaaacuaauagcuauguuauacacaccccuacgagcaaauaaugccggagacgacguauuuacaguaucauguagaguacuaacacgaccaucaccagauuucgauuuuauauuccucgcaccuccaacaguugaaucucguacaaaaccauuuuccguaccaauucuaacuguugaagaaaugacuaauucccgauuuccaaucccacuagaaaaacuauuuacaggaccaucaucagcauucguaguccaaccccaaaacggcagauguacaacagacggaguacuacuagguacaacacaacuuucuccaguuaauauuugcacauuucguggugacguaacucauauagcaggaacccaaaauuacacaaugaauuuagcaucccaaaacuggaauaauuacgaucccacugaagaaauaccugcacccuuaggaacaccagauuuuguuggaaaaauucaaggugucuuaacccaaacaacuagaagagacggauccacuagaggacauaaagcaacuguaucaacagguuccguacauuuuacgccaaaauuaggauccauacaauucucaacagauacuucaaacgacuuugaaacaggacaaaauacaagauucacaccaguaggaguaguacaagacggcaguacuacucaccaaaaugaaccacaacaauggguacuuccugacuauuccggcagagacucacauaaugugcauuuagcaccagcaguagcaccaacauucccaggagaacaacuauuauuuuuuagaucaacuaugccagguuguuccggcuacccaaauaugaaccuugauugcuuauuaccacaagaauggguacaacauuucuaucaagagucagcucccgcucaaagcgauguugcauuauuaagauucgucaauccagacacaggcagaguauuauuugaaugcaaacuccauaaaucagguuaugucacaguagcucauacaggacaacacgaccuaguaauaccaccaaauggauauuucagauuugacucauggguaaaucaauuuuacacacuagcaccuauggggaauggagcaggaagaagaagagcacuauaa

SEQ ID NO: 31379 - RNA, 1623 nt, Artificial Sequence
  derived and/or modified sequence opt6 from VP1__Norovirus__AER11308
augaaaauggcaucuaacgaugcaacuccuuccgauggaucuacagcuaaccuaguuccagaaguaaacaacgaaguuauggcucuagaaccaguaguaggugcagcuauugcagcaccuguagccggucaacaaaauguaauagauccuuggauaagaaacaacuucguccaagcuccuggcggagaauuuaccguaucuccuagaaaugcuccaggagaaaucuuauggucagccccacuaggaccugaucuuaacccauaccuaucgcacuuagcaagaauguacaacggauacgccggaggauucgaaguacaaguuauccuagcagguaaugcuuucacugccggaaaaauaauauucgcugccguucccccaaacuucccaacugaaggucuaucaccaagccaaguaacaauguucccacacauuauaguugauguacgucaacuagaaccaguauuaauuccauuacccgauguccgaaacaauuucuaucacuauaaccaaucuaacgacccaacaauaaaacucauagcaauguuauauacaccauuaagagcaaacaaugccggcgaugauguauuuaccguaaguuguagaguucuaacaagacccucacccgauuucgauuucauauuucuuguacccccaaccguagaaucaagaaccaaaccuuuuucuguaccaauacuuacaguagaagaaaugacuaauucaagauuuccaauaccuuuagaaaaacuauuuacaggcccuucaucagccuuuguaguucaaccacaaaaugguagaugcacuacagauggaguucuacuuggaacuacacaauuaucuccaguaaauauauguacauucagaggugacguuacacauauagcaggaacacaaaauuauacaaugaauuuagcuucucaaaacuggaacaauuacgauccuacagaagaaauaccugcaccauuaggaacuccagacuuuguagguaaaauucaaggaguacuaacccaaacaacuagaagagauggaucuacaagaggacacaaagcaacaguauccaccggaucuguacauuuuacacccaaacuuggauccguccaauuuucaacagauacuucaaaugacuucgaaacaggacaaaacacacgauuuacuccaguaggaguuguucaagacggaucaaccacccaucaaaacgaaccucaacaauggguacuaccuaacuacucaggaagagauucacauaacguacacuuagcaccagcagucgcacccacauuuccuggugaacaacuuuuauucuuuagaucaacaaugccugguugcucaggauacccaaauaugaacuuagacugucuauuaccucaagaauggguacaacauuucuaccaagaaucagccccagcacaaucagauguagcccuacucagauucguuaaccccgacacuggaagaguacuuuucgaaugcaaacuacauaaaucaggauacguaacaguagcacacacaggucaacacgaucuaguaauuccucccaauggauauuuccguuuugauuccugggucaaccaauuuuacacauuagcacccaugggcaauggagcaggcagacgccgugcuuuauaa

SEQ ID NO: 31380 - RNA, 1623 nt, Artificial Sequence
  derived and/or modified sequence opt6 from VP1__Norovirus__AER11310
augaaaauggcaucaaacgaugcaacaccaucagauggaagcacagcaaacuuaguaccugaaguaaacaaugaaguuauggcauuagaaccuguaguaggagcagcaauagcagcaccagucgcaggucaacaaaauguaauugacccauggauaaggaauaauuucguacaagcaccaggaggugaauuuacaguaucuccaagaaaugcuccuggagaaauucuauggucagcaccucucggacccgacuuaaacccauaucuaucucaucuagcacgcauguacaacggauaugcuggaggauuugaaguccaaguuauacuagcaggcaaugcauucacugcuggaaaaaucaucuuugcagccguaccaccuaauuucccaacugaaggauuaucaccaucccaaguaacaauguucccacacauaauaguagauguaagacaauuagaaccaguauuaauaccauuaccagacguacgaaauaauuuuuaccauuauaaucaaucaaaugauccuaccaucaaauuaauugcaauguuauacacaccacuacgagcuaacaaugcaggcgaugauguauucaccguuucuugucgaguuuuaacacgaccaucaccagauuuugacuuuauuuuccuaguaccaccaaccguugaaucacguaccaaacccuucucagucccaauucuaacaguagaagaaaugacaaauucucgauuuccaauaccuuuagaaaaauuauucacagguccaucuagcgcauucguaguacaaccucaaaacgguagaugcaccacagauggaguauuacuuggcacaacacaauuaucaccaguaaauauauguacauuuagaggagauguaacccauauagcuggaacccaaaacuacacaguaaaccucgcaucacaaaacuggaauaacuacgacccaacagaagaaauaccagcaccacuuggaacaccagacuuuguaggaaaaauacaagguguccuuacccaaacaacaagaagagacgguucuacucgaggucacaaagcaacaguaucaacaggaagcguacauuuuaccccaaaacuuggcucaguacaauucucuacggacacaucuaaugacuucgagaccggacaaaacacaagauucacaccaguuggaguugugcaagaugguucaaccacacaucaaaacgaaccacaacaguggguccuaccuaauuauucaggacgugauucacauaauguacaccuagcaccagcaguagcaccuacauuuccaggugaacaacuacuuuucuucagaucaaccaugccuggguguucugguuaucccaauaugaaccuagauugcuuacucccacaagaauggguucaacacuucuaccaagaaucagcccccgcacaauccgauguagcccuacuaagauuuguaaauccagauacgggaagaguccuauucgaauguaaacuccauaaaucagguuauguaacaguagcacacaccggucaacacgacuuaguaauaccuccaaauggauauuucagauucgauuccuggguaaaucaauucuacacucuagcaccaaugggaaauggagcagguagacgaagagcucuauaa

SEQ ID NO: 31381 - RNA, 1623 nt, Artificial Sequence
  derived and/or modified sequence opt6 from VP1__Norovirus__AER11312
augaaaauugccuccucagacgcaaacccaucagacggauccacagcaaaucuaguaccugaagucaauaacgaaguuauggcucuagaaccaguagucggagcugccauagcagcuccaguagcaggacaacaaaauguaauagauccauggauaagaaacaauuuuguccaagccccaggaggagaauuuacaguuucaccaagaaaugccccaggagaaauauuauggucagcaccuuuaggucccgaccuaaauccauaccuaucacacuuagcccgcauguauaacucuuaugccggagguuuugaaguacaaguaauauuagcaggcaacgcauucaccgccggcaaaauaaucuucgcagcaguaccaccaaacuuuccaacagaaggauuaucaccuucucaaguuacuauguuuccucacauuauaguagauguaagacaacuagaaccaguucuaaucccauuaccagauguaagaaauaacuuuuaucacuacaaccaaucaaaugauccaacaauuaaacuuauagcaauguuauacaccccuuuaagagcuaacaaugccggagaugaugucuuuacaguauccuguagaguauuaacuagaccaucaccagacuuugacuuuauauuuuuaguaccaccgacagucgaaucaagaacuaaaccauuuagcguaccuaucuuaacaguagaagaaaugacuaacucuagauucccaauaccacuagaaaaauuauuuacaggcccaucauccgcuuucgugguacaaccacaaaaugguagaugcacuacagacggaguacuacuaggcacaacacaauuaucaccuguaaauauuuguaccuuuagaggugacguaacacauauagcauccacucaagaauacaccaugaaccucgcaucacaaaacuggaacaauuaugauccuacagaagaaaucccagcaccucuaggaacaccagauuuugucgguaaaauacaaggcguacuaacucaaacaacuagacgcgacggaucuacacgaggacauaaagcaacuguaucaacaggcucaguucacuuuacacccaaacuuggacguauccaauucucaacagauacauccaaugauuuugaaacaggccaaaauacucgauucacccccguaggagucguccaagacggaucaacuacccaccaaaaugaaccccaacaaugggucuuaccaaacuauucaggacgugacucucauaauguacauuuagccccagcaguagccccaucuuuucccggagaacaacuacucuucuucagaucaacaaugccaggaugcucuggauauccaaauaugaauuuagauugucuacucccacaagaauggguucaacacuucuaucaagaagcagcuccagcucaauccgauguagcauuauuaagauucguaaacccagacacaggacgaguauuauuugaaugcaaacuccauaaaucaggauauguaacaguugcacacaccggccaacaugaccuaguaauaccuccaaacggauauuuccguuuugacagcuggguaaaccaauucuacacucuugcaccaaugggaaauggaaccggaagaagaagggcauuauaa

SEQ ID NO: 31382 - RNA, 1623 nt, Artificial Sequence
  derived and/or modified sequence opt6 from VP1__Norovirus__AER11314
augaaaauggcaucuaaugacgcgaacccaucagauggaucugcagcaaauuuagucccagaaguaaacaacgaaguaauggccuuagaaccaguaguaggagcagcaauugccgcuccaguagcaggacaacaaaauguaauagacccuuggauaagaaauaauuuuguccaagcaccaggaggagaauucacaguauccccaagaaacgccccaggagaaaucuuauggucagcaccucuagguccagauuuaaaucccuauuuaucgcaccuugcaagaauguauaacgguuacgcuggaggauuugaaguacaaguaauucuagcuggaaacgcauuuaccgccggcaaaauaauauucgcagcaguaccuccaaacuuuccaacugaaggacuaucuccaucccaaguuacaauguuuccacauauaauaguugauguuagacaguuagaaccaguacucauaccauuaccagauguacguaacaauuucuaucauuauaaccaaucaaacgauuccaccauaaaacuuauagcaauguuauauacaccauuaagagcaaauaaugcaggagaagacguuuucaccguaucaugcagaguauuaacacgacccucaccagacuuugacuucauauuucucguaccaccuacuguagaaucccguaccaaaccauuuacagucccaauacuaaccguagaagaaaugacuaacucuagauuuccaauaccauuagaaaaacucuucacagguccauccggagcuuuuguaguacaaccacaaaauggaagaugcaccacagacgguguauuauuagguacaacacaauuaucaccagucaacauauguaccuuucgaggagacguaacacauauagcuggaacaagaaauuacacuaugaauuuagcaucccuaaacuggaauaauuacgauccaacagaagaaauaccagcaccacuaggaacaccagacuucguuggaaaaauacaaggaguacuaacacaaacaacaaaaggagacggaucuacucguggacauaaagcaacaguauacacaggaagcgcaccauuuacaccaaaacuuggaucuguucaauucucuacagauaccgaaaaugacuucgaaacacaucaaaauacuaaauuuacaccaguaggugucauacaagaugguggaacuacccacagaaaugaaccacaacaguggguccuaccauccuacaguggacgaaauguacacaacguacacuuagcuccagcuguagcaccuacauuucccggagaacaacuccuuuucuuuagaucuacuaugccaggaugcucagguuauccaaauauggauuuagauugcuuacucccucaagaauggguacaacauuucuaucaagaagcagcgccagcacaaucagacguugcacuaaugagauuuguaaacccugacacaggaagaguacuauuugaaugcaaacuucauaaaucaggcuauguuacagucgcacacacaggucaacacgaucuaguaauaccacccaauggauacuuucguuuugacucuuggguaaaucaauucuacacauuagcacccauggguaacggaacaggcagaagacgagcuuuauaa

SEQ ID NO: 31383 - RNA, 1623 nt, Artificial Sequence
  derived and/or modified sequence opt6 from VP1__Norovirus__AER11316
augaaaauggcuucuaaugacgcaaaccccuccgaugguucugcagcaaaucuaguaccagaaguaaauaaugaaguaauggcucuagaaccuguaguaggagcagcaauagcagcccccguagcaggccaacaaaauguaauagacccauggauaagaaauaauuuuguacaagcgccaggaggagaauuuaccguaucccccagaaaugcuccaggagaaauauuauggagcgcaccauuagguccagacuuaaacccauaucuaucacacuuagcacgaauguacaacggauacgcaggaggauuugaaguacaaguaauacucgcaggcaaugccuuuaccgcuggaaaaauaauuuuugcagccguacccccaaacuuuccaacagaaggacuaucacccucacaaguaaccauguucccacacaucaucguagacguaagacaacuagaaccuguacuuauucccuuaccugauguaagaaauaacuucuaucacuauaaccaauccaaugacucaacuauaaaacuaauugcaaugcuauauacaccacuacgugcuaauaaugccggugaagauguauucaccguaucaugccgaguauuaacacguccuucaccagacuucgacuucauauuucuaguuccucccacaguugaaucaagaacuaaaccauucaccguaccaauacuaacaguugaagaaaugacgaauucaagauucccaauaccuuuagaaaaauuauucacaggaccaucaggagcuuucgucguccaaccacaaaacggaagauguacaacagacgguguauuacuuggaacuacacaauuauccccaguaaauauauguacauucagaggagacgucacacauauagcaggcucaagaaauuauacaaugaacuuagccucucuaaacuggaauaauuacgaucccacagaagaaauaccagcaccauuaggaacaccugauuuugucggaaaaauacaaggagucuuaacacaaaccacuaaaggugacggaucaacuagaggucacaaagcaaccguauauacaggaucagcaccauuuacaccaaaacuagggucaguacaauucucaacugauacugaaaaugacuuugaaacacaccaaaacacaaaauuuacuccaguaggaguuauacaggauggaaguacaacacauagaaaugaaccacaacaauggguucuuccuucauacuccggaagaaacguacacaauguucaucuagcacccgcaguugccccaacauuucccggcgaacaacuacuuuucuuccgaucaacaaugccaggauguucaggauaucccaauauggaccuagauugucuauuaccucaagaauggguacaacauuucuaucaagaagcagcuccagcacaaucugauguagcacuauuaagauuuguaaacccagacacaggcaggguucucuucgaaugcaaauuacauaaaucaggauauguuacaguugcacauaccggucaacaugauuuaguaauuccaccuaacgguuacuuucguuucgauucauggguaaaucaauuuuacacucuugcaccaaugggaaacggaacuggaagaagaagagcauuauaa

SEQ ID NO: 31384 - RNA, 1623 nt, Artificial Sequence
  derived and/or modified sequence opt6 from VP1__Norovirus__AER11318
augaaaauggcuucaaaugaugcuaaccccucagauggaagugcagcuaauuuaguaccagaaguaaauaacgaaguaauggcucucgaaccaguaguaggugcagcuauagcugcaccuguugcugggcaacaaaauguaauagauccauggauaagaaauaacuuuguacaagcaccagguggagaauuuacaguaucaccaagaaacgcaccaggagaaauacuauggucagcuccacuagguccagaucuaaaucccuaucuaucccaucuagcaagaauguauaacggcuaugcaggagguuuugaaguccaaguaauacuagcaggaaaugcauuuacagcaggcaaaauaauauuugcugcaguacccccuaacuucccaacugaaggucuaucaccaucccaaguaaccauguucccucacauuaucgucgacgucagacaauuagaaccagucuuaauuccacuuccagauguacgaaauaauuuuuaucacuacaaccaauccaacgauucaacuauaaaacuuauugcaauguuauacacaccacuucgagcuaacaacgcaggcgaagauguauuuacaguaagcuguagaguucuuacaagaccuucaccagacuuugacuuuauauuuuuaguacccccuaccgucgaaucacgcacaaaaccauucaccguaccaauauuaacuguugaagaaaugacaaauucccgauuuccaauaccauuagaaaaacuauuuacaggaccaucuggagcauucguaguacaaccccaaaauggaagauguacaacagacggaguauuauuaggaacaacacaauuauccccaguaaauauauguacuuuucgaggagauguaacacauauugcaggaucacgaaacuauacuaugaauuuagccucauuaaauuggaauaauuaugacccuacagaagaaauaccagcaccucucgguacaccugauuuuguagguaaaauacaagguguuuuaacacaaaccacuaaaggugacgguuccacucgaggacauaaagcaacaguauauacaggauccgcaccauuuacaccuaaauuaggcucaguacaauucucaacagacacagaaaacgacuucgaaacacaucaaaacacuaaauucacaccaguuggcguaauacaagauggaucuacaacacauagaaaugaaccccaacaauggguacuaccaucauacucaggaagaaauguacauaauguacaucuagcaccagcgguagcaccaacauuuccuggagaacaauuacuauuuuuucgcucuacaaugccaggaugcagugguuauccaaauauggauuuagauugucuacuaccucaagaauggguacagcacuuuuaucaagaagcagcacccgcacaaucagacguugccuuguuacgauucguaaacccagauacaggaagaguauuauuugaauguaaauuacauaaaucaggauacguaacuguagcacauacuggacaacacgacuuaguaauaccaccaaaugguuacuucagauucgauucuuggguaaaccaauuuuacacauuagcaccuaugggaaauggaacaggacgcagaagagcacuauaa

SEQ ID NO: 31385 - RNA, 1623 nt, Artificial Sequence
  derived and/or modified sequence opt6 from VP1__Norovirus__AER11320
augaaaauggcaucaaaugacgcaaaucccuccgauggaucagcggcaaauuuaguacccgaaguaaauaaugaagucauggcauuagaaccaguaguaggagcagcaauugcagcaccagucgcaggacaacaaaauguaauugacccauggauccgaaauaauuuuguucaagcaccaggaggagaauuuacaguaagucccaggaaugcaccaggagaaauacuuuggagugcaccacuaggaccagauuugaauccauauuuaucacaccucgccagaauguauaauggauaugcaggcggauucgaaguccaagucauauuagcuggaaacgcauuuaccgcugguaaaauaaucuucgcugcagucccaccaaauuuuccaaccgaaggauuaucuccaucacaaguuacaauguuuccacauaucguaguagauguuagacaacuagaaccaguuuuaauaccauuaccagauguuagaaauaauuucuaucacuauaaucaaucaaaugauucaacaauuaaguuaauagcuauguuauacacaccacuaagggcaaauaaugcaggagaagauguuuuuacuguaucaugcagaguauuaacaagaccaucaccagauuuugacuuuauauuucuaguaccacccacaguugaaucacgcacuaaaccauuuacaguaccaauacuuacaguagaagaaaugacaaauucuagauucccaauaccgcuagaaaaauuauuuacagguccaaguggagcuuucguaguacaaccucaaaauggaagaugcacaacagacggaguccuacuaggaacaacucaacuaucuccagucaauauaugcaccuuccgaggagacguuacucauauagcaggauccagaaauuauacuaugaaccuagccucacuaaauuggaacaacuaugauccaacagaagaaauacccgcaccacuuggaacaccagacuuuguaggaaaaauacaaggaguacuaacacaaaccacuaaaggagacggaaguacacgaggacacaaagcuacaguauauacaggaucugcucccuuuacuccaaagcuaggaucaguacaauucucaacagacacugaaaacgacuuugaaacacaucaaaauacuaaauuuacaccuguagguguuauccaagacggcagcacaacacauagaaaugaaccacaacaauggguauuaccaucauauucuggaagaaacguacauaauguccaucuagcacccgcuguugcaccuacauucccuggagaacaacuguuauucuuucgaagcacaaugccaggauguagugguuacccaaacauggaucuagauugcuuacuuccacaagaauggguacaacauuuuuaucaagaagccgcuccagcccaaucagacguugcauuauuaagauucguaaacccagacacagguagagucuuauuugaaugcaaacuacauaaaucaggauaugucacuguugcacacaccggacaacacgacuuaguaauuccaccaaauggauauuuucgguuugacucuuggguuaaucaauucuauacauuagcacccauggguaauggaacaggaagaagaagagcacuauaa

SEQ ID NO: 31386 - RNA, 1623 nt, Artificial Sequence
  derived and/or modified sequence opt6 from VP1__Norovirus__AER11324
augaaaauggcaucaaaugacgcgaacccaucagacggaucagcggcaaacuuaguaccagaaguuaacaaugaaguaauggcccuagaacccguaguaggagccgcuauagcagcccccguagcaggacaacaaaauguuauagacccauggauaagaaauaacuuuguucaagcacccggcggagaauuuacagucucaccaagaaaugcaccaggagaaauacuauggucagccccacuaggaccagaucuuaauccauaccuuucccacuuagcaagaauguauaacggauaugcuggcggauucgaaguacaaguaauacuagcuggaaaugcauuuacugcaggaaaaauuaucuucgcagcagucccuccuaacuuuccuacagaaggcuuaucuccuucacaaguaacaauguuuccucauauuauuguggacguaagacaauuagaaccaguauuaauaccacuaccagacguaagaaacaauuucuaucauuauaaucaaucaaaugacagcacaauuaaacuaauagcaaugcuuuacacacccuuaagagcaaacaaugccggagaagaugucuuuaccguauccuguagaguacuuacacgaccuucaccugacuuugauuuuaucuuccuagucccuccuacgguagaaucaagaacaaaacccuucaccguacccauacuaacaguagaagaaaugacaaacaguagauucccaauaccacuagaaaaacuauuuacuggaccuucgggugcauucgucguacaaccucaaaauggaagaugcacaacugauggaguacuacuaggaacaacacaacuuucuccugucaauauauguacauuuagaggagacguuacccauauagcaggcucaagaaauuauacaaugaaucucgcauccuuaaacuggaacaauuacgacccaaccgaagaaauaccugcaccacuuggcacaccagacuuugucggaaaaauacaaggaguauuaacacaaacuacaaaaggugacggaucaacaagaggucauaaagcaacaguauauacuggaucagcaccuuuuacaccuaaauuaggaucaguccaauucucaacugauacagaaaaugacuuugaaacacaucaaaacacaaaauuuacaccaguaggaguaauccaagacggaaguacaacacauagaaacgaaccacaacaaugggucuuaccaagcuauagcgguagaaauguacacaacguacacuuagcccccgcaguagcaccaacauucccaggagaacaacuacuauucuucagaucaacaaugccaggaugcaguggauaccccaacauggaucuagauuguuuauuaccacaagaauggguacaacauuuuuaucaagaagcagcacccgcacaauccgauguagcacuauuaagauucguuaauccagacacaggacgaguauuauucgaaugcaaauuacauaaaucuggauauguaaccguagcacacaccggccaacaugaucuaguaauuccaccaaacggauauuuuagauucgauucauggguaaaccaauuuuacacacuagcuccaauggguaauggaacaggcagaagaagagcauuauaa

SEQ ID NO: 31387 - RNA, 1623 nt, Artificial Sequence
  derived and/or modified sequence opt6 from VP1__Norovirus__AER11326
augaaaauggcaucaaaugacgcaaauccaucugauggaucagcagcuaaucuaguaccugaagucaauaaugaaguaauggcacuagaaccaguaguuggugcagccauagccgcaccaguagcaggacaacaaaacguuauagauccauggauuagaaauaauuuuguacaagcucccggaggugaauuuaccguuucaccuagaaacgcaccaggagaaaucuuauggucagcuccacuaggacccgaucuuaacccauaccuaucucaccuagcaagaauguauaacggauacgccggugguuuugaaguucaaguaauauuagcaggcaacgcauucacagcuggcaaaauaauauuugcagcaguuccuccaaauuucccaaccgaaggccuaucuccaucacaaguaacaauguucccacauauaaucgucgacguuagacaauuagaaccaguacuaauacccuuacccgaugucagaaauaacuucuaucacuauaaccaaucaaaugacucaacaauaaaauuaaucgcaaugcuauacacaccacuaagagcaaauaaugccggugaagauguuuuuacugucagcugcagaguucuuacccgcccaucacccgacuuugauuuuauuuaucuaguaccaccuacuguagaaucaagaacaaaaccuuucacuguaccaauacuuacaguagaagaaaugacaaacucccgauucccuauaccucuagaaaaacucuuuacaggucccucaggagccuuuguaguacaaccacaaaacggcagaugcacaacagacgguguauuauuagguaccacccaauuaaguccaguaaauauauguacauuuagaggcgacguaacacauauagcugguucaagaaacuacacgaugaauuuagccucacuaaacuggaauaauuaugaucccacagaagaaauaccagcaccauuaggaacaccugacuuuguuggaaaaauacaagguguacucacucaaacaacuaaaggcgacggaucuacacgaggacacaaagcaacagucuauacugguggagcucccuuuacaccaaaauuaggaucuguucaauuuucaacagauacagaaaacgauuuugaaacccaccaaaauacuaaauuuacaccaguaggaguaauacaagacggaagcacuacccauagaaaugaaccacaacaauggguauuaccaucauauucaggacgaaauguucauaauguccaccucgcaccagcaguagcaccaacauuucccggcgaacaacuccucuucuuuagaucaacaaugccaggauguucuggauauccaaauauggauuuagauugucuccuaccacaagaauggguacaacauuucuaucaagaagcagcaccagcucaaucagacguagcacuauuacgcuucguaaaccccgauacuggacgagucuuauuugaaugcaaacuccauaaaucaggauauguaacaguugcacauacuggucaacacgaucuaguaauaccaccaaauggauacuuucgauucgauucauggguuaaccaauuuuauacuuuagcacccaugggaaauggaacuggaagaagaagagcauuauaa

SEQ ID NO: 31388 - RNA, 1623 nt, Artificial Sequence
  derived and/or modified sequence opt6 from VP1__Norovirus__AER11328
augaaaauggcaucaaacgacgcuaauccauccgauggcucagcagcaaacuuagucccagaaguuaacaacgaaguaauggcuuuagaacccguuguaggagcagcaauagcagccccaguagcaggccaacaaaacguaauugauccauggauaagaaauaauuuuguacaagcaccaggcggagaauuuacuguuucaccuagaaaugccccuggcgaaauccuuuggucagcuccacuuggacccgacuuaaauccauaucuaucucaccuagcccguauguauaauggauacgcaggaggauuugaaguacaaguaauacuagcaggaaaugcuuuuacagcagguaaaaucauauucgccgccgucccgccaaacuuuccuacagaaggacuauccccaucacaaguaaccauguucccacauaucauaguugauguacgacaauuagaaccaguuuuaaucccacuacccgauguaagaaacaauuuuuaccacuauaaccaaucaaaugacucaacaauaaaacuaauagccaugcuauacacaccauuacgugcaaacaacgcaggagaagauguauucaccguaucaugcagaguacuaacacgcccaucaccagacuuugauuuuauuuuucucguaccaccaacaguagaaucucgaaccaaaccauucacaguaccaauauuaacagucgaagaaaugacaaacagcagauuuccaauacccuuagaaaaacucuucacuggacccagcuccgcauucguaguacaaccacaaaacggaagauguacaaccgacggaguacuauugggaaccacacaacuuucaccaguaaauauauguacauuccgaggagacguaacacacaucgcaggaucaagaaauuauaccaugaaucucgcaucauuaaacuggaacaauuaugauccaacugaagaaaucccagcuccauuaggcaccccagacuucguaggaaaaauucaaggcguauuaacacaaacaacaaaaggcgauggaucaacucgaggucacaaagccacaguauauacaggaucagcaccauucacacccaaacuaggauccguacaauucaguacagauacagaaaacgauuuugaaacccaccaaaacacaaaauucacaccaguaggagucauacaagacgguuccacaacucacagaaaugaaccacaacaauggguacuuccauccuauucagggcgaaauguacauaauguacauuuagcaccagcaguagcacccacuuuuccaggagaacaauuacuauuuuucagaucuacuaugccagguugcucaggcuauccaaacauggauuuagacugccuacuaccucaagaauggguucaacauuuuuaccaagaagcagcaccagcacaaucugacguagcauuacuaagauucguaaacccagacacagguagaguacucuucgaaugcaaauuacacaaauccggcuacgucacuguagcacauacuggacaacacgaucucguaauaccuccaaacgguuacuuccgauucgacucauggguuaaucaauuuuauacauuagcaccaauggguaaugguacaggacgaagaagagcauuauaa

SEQ ID NO: 31389 - RNA, 1623 nt, Artificial Sequence
  derived and/or modified sequence opt6 from VP1__Norovirus__AER11330
augaaaauggccucaaaugacgcuaauccuagcgacggaucugccgcaaaucuaguccccgaaguaaacaaugaaguuauggcacuagaaccagucguaggcgcagcaaucgcagcccccguugcuggacaacaaaacguaauagacccuuggauaagaaauaauuuuguucaagcaccaggcggagaauuuacuguaucaccaagaaacgccccaggagaaauccuauggagugccccacuaggcccugauuuaaacccauaccuaucacauuuagcaagaauguauaacgguuaugcaggagguuucgaaguacaaguaauacuugcaggaaaugcuuuuacugcaggaaaaauaaucuuugcagcuguaccaccaaacuuucccacugaaggacuaucaccaucacaaguaacaauguuuccucauauaaucguagacguacgacaacuugaaccagucuuaauuccacuaccagauguuagaaacaacuuuuaucauuacaaccaauccaaugauucaacaauaaaauuaauagcaauguuauauacaccauuacgagcaaauaacgcaggagaagaugucuuuaccguaucauguaggguacuaacucgaccaucaccagauuucgacuuuauauuccuugucccacccacuguugaaucaagaacaaaaccauucacaguaccaaucuuaaccguagaagaaaugacaaacucaagauucccaauacccuuagaaaaauuauuuacuggaccuucaggagcauucgucgugcaaccacaaaauggaagaugcacaacagauggaguauuacucgguacaacacaauuaucaccagucaacauauguacuuuuagaggagacguaacacacauagcagguucaagaaauuacacaaugaaucuagcaucacuuaacuggaauaauuacgaucccacugaagaaacaccugcaccacuaggaacaccagauuuuguaggaaaaauucaagguguauuaacgcaaacuaccaaaggagacggaucaacaagaggccacaaagcaacagucuauacuggaucugcuccauuuaccccaaaacuaggaucaguacaauuuagcacagacacugaaaaugauuuugaaacccaucaaaauacaaaauuuacaccaguuggagugauccaagacgguuccacaacacauagaaacgaaccacaacaauggguacuaccaagcuauucaggcagaaauguacauaacguccacuuagcaccagcaguagcaccaacauuuccaggcgaacaacuacuauuuuuuagaucaacaaugccaggauguucaggauauccaaacauggauuuagauugccuacuuccacaagaauggguccaacacuuuuaucaagaagcagcaccagcucaaagcgacguagcauuacuacgcuuuguaaauccagacacaggaagaguauuauucgaaugcaaauuacauaaauccggauauguaaccgucgcucacacaggccaacacgaucuaguaauaccacccaaugguuauuucagauuugauucauggguaaaccaauuuuauacucuagcuccaaugggaaaugguacaggaagaagaagagcauuauaa

SEQ ID NO: 31390 - RNA, 1623 nt, Artificial Sequence
  derived and/or modified sequence opt6 from VP1__Norovirus__AER11332
augaaaauggcuagcaaugacgcaaacccaucagacggaucagcugcaaauuuaguaccagaaguaaacaaugaaguaauggcauuagaaccagucguaggagcugccauagcugcaccuguagcuggacaacaaaauguuauagauccauggauaagaaauaacuuuguacaagcaccaggcggagaauuuaccguaucccccagaaaugcuccaggagaaauacuauggucugccccauuaggacccgaucucaauccauauuuaucgcauuuagcaagaauguacaauggauaugcaggagguuuugaaguccaaguuauauuagcaggcaaugcuuucacagcaggaaaaauaauauucgcugcaguacccccaaacuuuccaacagaaggucuaucgccuucucaaguaacaauguuuccacauaucauaguagacguaagacaacuagaaccaguacuaauuccacuccccgacguuagaaauaauuucuaucauuauaaucaaucaaaugacucuacaauaaaacuaauagcuaugcuuuacacaccacuaagagcuaacaaugcuggagaagauguuuuuaccguaucaugcagagucuuaaccagaccaucacccgacuuugauuuuauauuuuuaguuccaccaacaguagaaucaagaacaaaaccuuuuacaguccccauacuaacagucgaagaaaugacuaacaguagauuccccauaccuuuagaaaagcuauuuacagguccaucuagcgccuucguaguacaaccacaaaacgguagauguacaacagacggaguacuauuaggaaccacacaauuaaguccagucaauauauguacuuuuagaggagacguuacacauauagcuggaucacgaaauuacacaaugaaucuagcuucacuaaauuggaauaauuaugauccaacagaagaaaucccagcucccuuaggaaccccagacuuugucggaaaaauccaaggaguacuaacacaaacaacaaaaggcgacgguucuacaagaggacacaaagccacugucuacacaggaucugcacccuucacaccaaaauuaggaucaguccaauuuagcacagauacagaaaacgauuucgaaacacaccaaaauacuaaauucacaccaguaggcgugauacaagauggaucaacaacucacagaaacgaaccacaacaauggguacuaccaucauauucagguagaaauguacaaaacguacaccuagcaccagccguagccccuacauuuccaggagaacaauuauuauuuuuccgaucaacaaugccuggaugcucaggauauccaaauauggaccuagauugucuacuuccacaagaauggguacaacauuucuaccaagaagcagcacccgcucaaucagacguagcuuuauuaagauucguaaauccagacacaggaagagucuuauucgaauguaaacuacauaaaucaggcuauguaacaguagcacacacuggucaacaugaccuaguaauacccccaaauggauauuucagauucgauaguuggguaaaucaauuuuauacuuuagcuccaauggguaauggaacaggccgaagacgugcauuauaa

SEQ ID NO: 31391 - RNA, 1623 nt, Artificial Sequence
  derived and/or modified sequence opt6 from VP1__Norovirus__AER11334
augaaaauggcaucaaacgaugcaaacccaagugauggaucagcugcaaaccucguaccagaaguaaacaacgaagucauggcacuugaaccaguaguaggcgccgcaauagcugcaccagucgcaggacaacaaaaugucauagacccuuggauaagaaacaacuuuguucaagcaccaggcggagaauuuacaguuucuccaagaaacgcuccuggugaaauauuauggucagcaccauuaggaccagauuuaaauccuuaucucucacauuuagcaagaauguauaacggauacgcuggaggauuugaaguacaagucauacuagcaggcaaugccuuuacugcagguaaaauaaucuucgcagcaguaccuccaaauuuucccaccgaaggauuaucaccaucccaaguaacaauguucccacacauaauaguugauguaagacaauuagaaccaguucuaauaccacucccagauguuagaaauaauuuuuaucacuacaaucaauccaaugacucuaccauaaaacuaauagcaauguuauauacuccucuaagagccaacaaugcaggugaagaugucuuuaccguuuccugccgcguucuaacaagaccaaguccagauuuugauuuuauuuuccucguaccaccaacaguugaaucaagaacaaaaccuuuuacugucccaauacuuaccguagaagaaaugacuaauucccgauuuccaauaccauuagaaaaacuauucaccggaccauccucagccuucguaguacaaccucaaaacggaagauguacaacagauggaguauuacuaggaacaacacaauuauccccaguaaauaucugcaccuuuagaggugacguaacacauaucgcaggaucaagaaauuacacuaugaacuuagcaucauuaaacuggaacaauuacgauccaacagaagaaauuccagcuccacuaggcacaccagauuuugucggaaaaauucaaggugugcucacacaaacaacuaaaggagacggcucaacuagaggacauaaagccacaguauauaccggaucagcucccuuuacacccaaacuaggaucaguucaauuuucaaccgacacagaaaacgauuucgaaacacaccaaaacacuaaauuuacacccguaggcguaauacaagacggaucaaccacacacagaaaugaaccucaacaauggguacuaccuucauauucaggaagaaauguacauaauguucaccuagcuccugcaguagcaccaaccuuuccaggagaacaacuauuauuuuucagaucaacaaugcccggaugcuccggauauccuaauauggauuuagauugccuuuuaccacaagaauggguccagcauuucuaucaagaagcagcaccagcacaauccgauguugcccuuuuaagauucguuaacccagauaccggacguguauuauucgaauguaaacuacauaaauccggauacgucacugucgcucacacuggacaacacgaucucguaauaccaccuaaugguuauuuuagauuugauucauggguaaaucaauucuauacauuagcuccaaugggcaauggcacaggaagacgacgagcccuauaa

SEQ ID NO: 31392 - RNA, 1623 nt, Artificial Sequence
  derived and/or modified sequence opt6 from VP1__Norovirus__AER11336
augaaaauggcuucaaaugacgccuccccuuccgacggaucugcagcaaaccuaguaccagaagucaauaacgaaguuauggcacuagaaccaguagucggagcagccauagccgccccaguugcaggacaacaaaauguuauagacccauggaucagaaacaacuuuguccaggcaccuggaggcgaauuuacaguaucaccaagaaacgcaccaggagaaaucuuauggucagcaccauuaggacccgauuuaaauccauaccucucucauuuagcccgaauguauaacgguuacgcuggagguuucgaaguacaaguaauauuagcaggaaaugccuuuacagcuggcaaaauaauauuugcugcaguacccccaaacuuucccacagaaggacugucaccaucucaaguaacaauguucccucauauaauugucgauguaagacaacuagaaccaguccucauaccauuaccagacguacgaaacaauuucuaccacuacaaccaaucaaaugauucaacaauuaaacucauagcaauguuauacacaccauuaagagcaaacaaugcaggagaagaugucuuuacaguaucaugcagaguuuuaacaagaccaucaccugacuuugacuuuauauuccuaguccccccuacaguugaaagccguacuaaaccauucacaguacccauacuaacaguagaagaaaugacuaauucaagauuucccauaccauuagaaaaacuauuuacuggcccaucaggagcauucguaguacaaccacaaaauggucgauguacuacugacggaguccuuuuaggaacuacacaauuaucaccaguaaauauuugcacuuuucgaggugacguaacacacauagcaggaucaagaaauuacacaaugaaucuagcagcauuaaacuggaauaacuaugauccuacagaagagauccccgcaccacuaggaacaccugacuuuguaggaaaaauacaaggaguauuaacacaaaccacaaaagcagacggaucaacacgaggucacaaagcaacaguauauacaggauccgcagacuucacaccuaaacuaggcucuguacaauuuaauacagauacagaaaacgauuucgaaacacaucaaaauacaaaauucacaccaguuggaguaauucaagacgguucaacaacacacagaaaugaaccacaacaauggguacuuccaucauacucagguagaaacguacacaauguccacuuagcaccugccguagccccaacauucccaggagaacaauuauuauucuuuagaucaaccaugcccgguugcuccggauaucccaacauggacuuagacugcuuacuaccccaagaauggguacaacauuucuaucaagaagcagcaccagcacaaucggacguagcauuacuaagauucguaaacccagacacuggaagaguccuuuuugaaugcaaacuacauaaaagcggauauguaacaguagcucauacaggacaacacgaucuaguaauaccaccaaacgguuacuucagauucgauucauggguaaaucaauuuuacacauuagcaccaaugggaaacggaacaggaagacgcagagcacucuaa

SEQ ID NO: 31393 - RNA, 1623 nt, Artificial Sequence
  derived and/or modified sequence opt6 from VP1__Norovirus__AER11340
augaaaauggcuucaaaugacgcaucaccauccgauggcucagcagcaaauuuaguaccagaaguaaacaaugaaguaauggccuuagaaccaguaguaggugcugcaauugcagcaccaguugcaggacaacaaaauguaauugaccccuggaucagaaacaacuuuguacaagcgccaggaggagaauuuaccguaagcccuaggaaugcaccaggcgaaauucucuggucugcaccacucggaccagacuuaaauccauaccucucacaccuagcuagaauguacaauggcuaugcaggagguuucgaaguucaaguaauauuagcaggcaaugcauuuacagcaggaaaaauaauauucgcagcaguacccccaaacuuuccaacagaaggauuaucuccaucucaaguaacaauguuuccacacauaauuguagauguuagacaacuugaacccguauuaauaccccuacccgauguucgaaacaacuuuuaucauuacaaucaaucaaaugauucaacaauuaaauuaauagcuaugcuauauacuccauuacgagcaaacaacgcaggagaagaugucuuuaccguaucauguagaguuuuaaccagaccaucaccugauuucgacuuuauauucuuaguaccaccuacaguagaaucacgaacaaaacccuucacaguacccauccugacaguugaagaaaugacaaauuccagauuccccauaccacuagaaaaauuauuuaccggucccucuggagcauuuguaguacaaccccaaaauggaagaugcacuacugacggagucuuacuaggaacuacacaacuuucaccagucaauauuuguaccuucagaggagauguaacacauauagccgguucacguaauuacacaaugaauuuagcagcauuaaauuggaauaauuacgauccaacagaagaaauacccgcaccuuuaggaaccccagauuuuguuggaaaaauacaaggaguacuaacacaaaccacaaaagcugauggaucuacacgaggacauaaagcuacuguauacacaggaucagcagauuuuacaccaaaauuaggaaguguacaauucucaacagauacagaaaacgacuucgaaacccaucaaaauaccaaauuuacuccaguagguguaauacaagacgguucaaccacacauagaaaugaaccacaacaauggguacuuccaucauauucaggucgcaacguucauaacguacaucuugcaccagcaguagcaccaacuuuuccuggagaacaauuacuuuuuuuuagaucaacaaugccaggauguucaggcuauccaaauauggacuuagauugucuacuaccacaagaauggguacaacauuucuaucaagaagcagccccagcucaaucugauguagcacuucuaagauucguuaauccugauacaggacgaguacuauucgaauguaaacuacauaaaucaggauauguuaccguagcacacacaggacaacacgaucuaguaauaccacccaauggcuauuucagauuugacucaugggucaaccaauucuacacucucgcuccaaugggaaauggaacaggaagaagaagagcacuauaa

SEQ ID NO: 31394 - RNA, 1623 nt, Artificial Sequence
  derived and/or modified sequence opt6 from VP1__Norovirus__AER11342
augaaaauggcuucaaacgaugcaucaccaucagauggcucagcagcaaauuugguucccgaagucaacaaugaaguuauggcauuagaaccuguaguuggugcagcaauagcagccccaguagcaggucaacaaaauguaauagacccauggauaagaaauaacuuuguacaagcaccaggaggugaauuuacuguaucaccacgaaaugcaccaggagaaauauuaugguccgcaccuuuaggucccgaucucaauccauauuuaucucaccuugcacgcauguacaaugguuacgcaggaggauucgaaguacaaguaauucuagccggaaaugcuuuuacugcagguaaaauaauauucgcugcuguaccaccaaacuuuccgacagaaggucuaucaccaucacaaguaaccauguucccacacaucauaguugacguaagacaacuagaaccaguucucauuccauuaccagauguaagaaacaauuuuuaucacuacaaccaaucgaaugacaguacaauuaaacuaauagcuauguuauauacaccgcuucgagcaaacaaugcaggagaagauguauuuacaguaucuuguagaguuuuaacaagacccucaccugacuucgacuuuauauuuuuaguaccacccaccguagaaucacgaacaaaaccauuuacagugccaaucuuaacaguagaagaaaugacaaacucaagauuucccauuccacuagaaaaacuuuucacaggaccaucgggagccuucguaguacaaccucaaaacgguagauguacuaccgauggaguauuacuaggcacaacacaacuuucuccaguuaacauauguacauuuagaggagacguaacacacauagcagguucaagaaacuauacaaugaacuuagcagcauuaaacuggaacaauuacgaccccacagaagaaaucccagcaccauuaggaacaccagauuucguaggaaaaauacaaggaguacuuacacagacaacaaaagccgacggcucuaccagaggucauaaagcaacgguauauacugguagcgcugacuuuacuccaaaacuagguucaguacaauucuccacggauacagaaaacgacuucgaaacacaucaaaauaccaaauucacaccuguaggagucauacaagauggauccacaacacauagaaacgaaccucaacaauggguacuaccauccuauuccggacgcaauguacacaauguacaucuagcaccagcaguagcacccacuuuuccaggagaacaacuauuauuuuucagaucaacuaugccaggaugcucaggcuauccuaauauggaucuugauuguuuacuaccacaagaauggguucaacauuuuuaucaagaagcugcuccagcccaaucagauguagcacuucuuagauuuguaaacccagacacaggacgaguacuauucgaaugcaaauuacacaaaucaggauacguaacuguagcacacacuggacaacaugauuuagugauaccaccuaacggauauuuccgauuugacucauggguaaaucaauucuacacuuuagcaccaaugggaaauggaacaggaagacgaagagcacuauaa

SEQ ID NO: 31395 - RNA, 1623 nt, Artificial Sequence
  derived and/or modified sequence opt6 from VP1__Norovirus__AER11344
augaaaauggcaucaaaugacgcaaguccauccgauggaucagcagcaaacuuaguuccagaaguaaacaaugaaguaauggcacuugaaccuguuguaggagccgcaaucgcagccccaguugcuggacaaaaaaauguaauagacccauggauacguaauaacuuuguacaagcaccugguggcgaauuuacaguaucaccuaggaaugcaccuggugagauacuuuggucugcuccacuaggaccagaucuaaauccauauuuaucacacuuagcaagaauguauaacggauacgcaggaggauucgaaguacaaguaauuuuagcuggaaaugcauuuacagccggaaaaauaauauucgcagccgucccaccaaacuucccaacagaaggauugucaccuucucaaguaacuauguuuccucacaucauaguagauguuagacaacucgaacccguacuaauaccuuuaccagauguaagaaauaacuuuuaucacuauaaucaauccaaugacucaacaauaaaacuuauagcuaugcuauacacaccuuuaagagcaaauaacgcaggagaagacguauuuacaguaagcuguagaguacuuacuagaccaucaccugacuuugauuucaucuuucuaguaccaccuacaguagaaucaagaacaaaacccuucacaguuccaauucucacuguagaagaaaugaccaacucucguuuuccaauuccccuagaaaaacucuucacaggaccauccggcgcauucguaguucaaccucaaaauggaagaugcacuacagauggaguauuacuaggaacaacacaauuaagucccguaaacaucuguaccuuuagaggagacguaacucauauagcaggcucaagaaacuauacaaugaaucucgccgcauuaaacuggaacaauuaugauccaacagaagaaauaccugcaccacuaggaacuccagauuucguagguaaaauacaaggaguuuuaacucaaacaacaaaagcagauggaucaacaagaggacauaaagcuacugucuauacaggaucugcugacuuuacaccaaaacuaggcucaguccaauuuuccaccgacaccgaaaaugauuucgaaacacaucaaaauacaaaauucacaccaguaggcguuauacaagacggcaguaccacacaccgaaaugaaccacaacaauggguacuaccauccuauucuggucguaauguacauaacguacaccuagcaccagcaguagcaccaacauuuccaggagaacaacuacuauuuuuuagauccacaaugccaggauguuccggauacccaaauauggacuuagauugccuauuaccacaagaauggguacaacauuucuaccaagaagcagcaccagcacaaucagacguagccuuacuuagauucguaaacccugauacaggaagagucuuauucgaauguaaacuucauaaaucaggauauguaacuguugcacacaccggccaacaugauuuaguaauuccccccaauggauacuucagauuugacucauggguaaaucaauucuacacauuagcuccaaugggaaacggaaccggacgacgaagagcauuauaa

SEQ ID NO: 31396 - RNA, 1623 nt, Artificial Sequence
  derived and/or modified sequence opt6 from VP1__Norovirus__AER11346
augaaaauggcaucaaaugacgcaucuccgucagauggaucagccgcuaauuuaguaccugaagucaacaaugaaguaauggcccuagaacccguuguuggagcagcaauagcugcacccguagcaggacaacaaaauguuauagauccauggauaagaaacaacuucguacaagcaccaggaggagaauuuacaguaucuccucgaaacgcaccaggagaaauucucuggucagccccauuaggcccagauuuaaacccauauuuaucucacuuagcaagaauguacaacggauacgcuggaggauucgaaguccaaguaauacuagcuggaaaugcauuuacugcaggaaaaauaauauuugcagcaguaccaccaaacuucccaacagaaggauuaucucccucccaaguaacaauguuuccccauauaauuguagauguccgacaacuagaaccaguauuaaucccacuacccgauguacgcaauaacuucuaucacuacaaccaaucaaaugacucuaccauaaaauuaaucgccauguuauacacuccuuuacgagcaaauaaugcaggagaagauguauuuacagucucaugcagagucuuaacaagaccaucacccgacuuugacuuuauauuuuuaguaccaccaacagucgaaucuagaaccaaacccuuuaccguacccauacuaaccguagaagaaaugacuaacucaagauuuccaauaccauuagaaaaacuauucacagguccaucuggagcauuugucguacaaccacaaaauggaagauguacaacagacggaguccuacuagggacuacacaacuaucgccaguuaauauaugcacuuuccgaggagacguaacacauaucgcaggaucuagaaauuacacaaugaauuuagcagcacuuaacuggaauaacuacgacccaacagaagaaauaccagcaccauuaggaacacccgauuuuguaggcaagauucaagguguauuaacccaaacaacuaaagcagacggaaguacacgaggccacaaagcaacuguauauacaggcucugcagauuuuaccccaaaacuagguucaguucaauucucaacagauacagaaaaugauuuugaaacacaccaaaacacaaaauuuacaccugucggaguaauacaagaugguagcacuacacaucgaaaugaaccacaacaauggguucuacccucuuacaguggacgaaauguacacaacguacaccuugcaccagcaguagcaccuaccuuuccuggcgaacaauuauuauucuuuagauccacaaugccugguugcucaggauaccccaauauggaucucgacuguuuauugccacaagaauggguacaacauuuuuaccaagaagcugcuccagcccaaucugauguagcauuacuuagauucguaaacccugauacaggaagaguauuauucgaaugcaaauuacauaaaucaggcuauguaacaguagcacacacaggacaacacgaucuaguaauaccaccaaacggauauuuuagauucgacucaugggucaaucaauucuacacacuugcaccaaugggaaauggaacaggaagaagaagagcauuauaa

SEQ ID NO: 31397 - RNA, 1623 nt, Artificial Sequence
  derived and/or modified sequence opt6 from VP1__Norovirus__AER11348
augaaaauggcaucaaacgaugcaucaccaucugaugguucagcagccaaucuaguaccugaagucaacaaugaaguaauggcacuagaacccguaguaggagcagccaucgccgccccggucgcaggacaacaaaauguaaucgauccauggauacgaaauaacuuuguacaagccccaggaggagaauuuacagucuccccaagaaaugcaccaggagaaauacuauggucagccccguuaggucccgauuuaaauccuuaccucucacaucuugcaagaauguacaacgguuaugcaggugguuuugaaguacaaguuauucuagcuggcaaugcuuuuacugcagguaaaauaauauucgcugcaguacccccaaauuuuccaacagaagguuuaucuucuucacaaguuacaauguucccacacauaauuguagauguuagacaauuagaaccaguuuuaauuccccuaccagaugucagaaacaacuuuuaucacuacaaucaauccucugacucaaccauaaaacuuauagcaaugcuauauacaccacuaagagcaaacaaugcaggagaagauguauuuacaguaucauguagaguacuuacuagaccaucuccagauuuugauuucaucuuccuagugccaccaacaguagaaucaagaacaaaaccauucacaguaccaauacuaacuguagaagaaaugacaaacucacgauucccaauaccacuagaaaaacuuuuuacagguccaucaggagcauucguaguacaaccacaaaacggaagauguacaacugacggcguuuuauuaggaacaacucaacuaucaccaguaaauauuuguacauuuagaggcgacgucacacauauagcaggcucuagaaauuacacuaugaaucuagcagccuuaaacuggaacaauuacgacccaacagaagaaaucccagcaccccuaggaaccccugauuuuguagguaaaauucaagguguccuaacucaaacaacaaaagcagacgggucaacaagaggacacaaagcaacagucuauacagguucagccgacuuuacucccaaauuaggaucaguacaauucucaaccgauacagaaaaugauuucgaaacacaucaaaauacaaaauucacacccguaggaguaauacaagauggauccaccacccaucgaaaugaaccacaacaauggguacucccaaguuacucaggaagaaauguucacaauguacaccuggcacccgcaguagcaccaacuuuuccaggagaacaauuacucuucuuucgaucaaccaugccaggaugcucaggauacccuaauauggaucuugauugcuuauuaccucaagaauggguacaacacuucuaucaagaagccgcaccagcucaaagugacguagccuuacucagauuuguuaacccagacaccggacgaguauuauuugaauguaaauuacauaaaucuggauauguaacgguagcacauacuggccaacaugaucuuguuauaccucccaaugguuauuucagauuugacaguugggucaaucaauucuacacucuagcaccaaugggcaauggaacagguagaagaagagccuuauaa

SEQ ID NO: 31398 - RNA, 1623 nt, Artificial Sequence
  derived and/or modified sequence opt6 from VP1__Norovirus__AER11350
augaaaauggcuucaucagacgccaaucccucagacgguucaacagcaaaucuaguuccugaaguuaauaaugaaguaauggcacuugaaccuguuguaggcgcagcaauagcagcuccaguugcuggccaacaaaauguuauugacccauggauaagauccaacuuuguacaagccccaggaggagaauuuacaguaucaccucgaaaugcaccaggagaaauauuaugguccgcuccuuuaggcccagacuuaaauccauaccuaucacaucuugcaagaauguauaacggauaugcaggaggauucgaaguccaaguaaucuuagccggaaaugcauuuacagcaggcaaaauaauauuugcagcaguaccaccaaacuuuccuacugaaggauuauccccaucacaaguaacuauguucccacacauuauuguagauguaagacaauuagaaccaguacuaauaccccuacccgacguaagaaauaacuucuaccacuauaaucaaucaaaugacccaacaauaaaauuaaucgcuaugcuauauacaccauuacgagcaaacaaugcuggagacgacguauuuacuguauccugccgaguccuaacuagaccaucaccugauuucgacuuuauauuccuuguuccaccaacaguagaaucaagaacuaaaccauuuuccguuccaauacuaaccguagaagaaaugacaaacucaagauuucccauaccauuagaaaaacuauuuacaggaccuucaucugccuuuguaguacaaccucaaaacggcagaugcacaacagauggcguauuuuuaggaacuacccaauuauccccagucaauauauguacauuccgaggagaugucacacauauaacaggaucacgaaauuacacaaugaauuuagcuacacaaaauuggaacucauaugauccaacagaagaaauaccagcaccacuugguacaccugacuuuguaggcaaaauacaaggaguauuaacacaaacaacaagagcagauggaucaacaagaggacacaaagcaacaguauauacagguagcgcugauuuugcaccuaaauuagguagaguucaauuugccacagacaccgauaaugacuucgacgcaaaccagaauaccaaauucacaccaguuggaguaauacaagauggagauacugcacauaggaaugaaccacaacaauggguauuaccaucauauucaggaagaaauucucauaacguacaccuagcacccgcaguagcaccaacauuuccaggagaacaacuacuauucuucagaucaacaaugccugguuguucuggauaucccaacauggauuuagacugcuuacuaccacaagaauggguacaauauuuuuaccaagaagcagcaccagcacaaagcgauguagcacuacuaagauucguuaauccagacacagguagaguacuauucgaaugcaaacuucauaaaucaggauacguaacaguagcacauacaggacaacacgaucuaguaauacccccaaauggauauuucagauucgauuccuggguaaaccaauuuuacacccucgcacccaugggcaauggaacaggaagacgcagagcacuauaa

SEQ ID NO: 31399 - RNA, 1623 nt, Artificial Sequence
  derived and/or modified sequence opt6 from VP1__Norovirus__AER11352
augaaaauggcaucaagugacgcaaacccaucagacggaagcacagcaaaucuuguaccagagguaaauaaugaagucauggcuuuagaaccagucguuggagcagcaauugcagcaccaguagcaggccaacaaaacguaauagauccuuggaucagaaauaacuuuguucaagcaccuggcggugaauuuacaguaucaccuagaaaugcaccuggagaaauacuauggucugcaccucucgguccagauuuaaauccauaucuaucacacuuagcaagaauguauaauggauacgcaggcggcuucgagguccaaguaauucuagccgguaaugcauuuacagcaggaaaaauuauauucgcagcaguacccccaaacuuuccaacagaaggccuuucaccaucacaagucacaauguucccacauauuauaguagacgucagacaacuagaaccagucuuaauaccacuaccagacguaagaaacaauuuuuaucacuauaaucaaucaaacgauccaacuauuaaauuaauagcaauguuauacaccccacuuagagcaaauaaugcaggagacgauguauucacaguuucaugucgaguauuaacacgaccuucaccugauuucgacuucauauuuuuaguaccacccacuguagaaucaaggacaaaaccauucucagucccaauauuaaccguugaagaaaugacaaacucacgauuuccaaucccauuagaaaaacuauucacaggaccaucuucagcuuuuguaguacaaccacaaaacggacgauguacaacagauggaguauuguuaggaacaacucaacuaagcccaguaaacauuuguacauuuagaggugacgucacacacauaacaggaucucgaaauuacacaaugaaucuagcaacccaaaauuggaauucauaugacccaaccgaagaaaucccugcaccucuaggaacuccagacuucgucggaaaaauucaaggaguauuaacacaaacaacuagagcagacggaucaacuagaggccacaaagcuacaguauauacaggcucagcagauuuugcaccaaaauuaggacgaguccaauucgcaacagauacagauaaugauuucgaugcuaaccaaaauacuaaauucacaccagucggaguaauacaagauggaggcaccgcacauagaaacgaaccacaacaauggguacuacccuccuauaguggaagaaauucacacaacguacaucuugcaccagcaguagcaccuacauuuccaggcgaacaacuacuuuucuucagaucaacaaugccagguugcucaggauacccaaacauggaucucgacugccuacuaccacaagaauggguacaauauuuuuaucaggaagcagccccagcacaaucagacguugcauuacuaagauucguaaaucccgauacaggaagaguccuauucgaauguaaauuacacaaaucagguuaugucacuguagcacacacaggacaacacgauuuagucauaccaccaaauggcuauuuccgauuugauucauggguaaaucaauuuuacacauuagcaccaaugggaaauggcacaggaagaagaagagcacucuag

SEQ ID NO: 31400 - RNA, 1623 nt, Artificial Sequence
  derived and/or modified sequence opt6 from VP1__Norovirus__AER11354
augaaaauggcaucaaaugacgcaaauccuucugacggaucggcggcaaaucuaguaccagaagucaauaaugaaguuauggcauuagagccaguaguuggagcugcuauagcagcuccaguagcaggacaacaaaauguuauagauccauggauaagaaacaauuuuguacaagcaccaggaggagaauuuacaguuagcccaagaaaugcacccggagaaauacuauggucagcaccacucggaccugauuuaaauccuuauuuaucacauuuagcaagaauguauaauggcuacgcaggagguuuugaaguucaaguaauccucgcaggaaaugcuuucacagcaggaaaaauaauauuugccgcaguaccaccuaacuuuccaacagaaggauuaucaccaucacaaguaacuauguuuccacauaucauaguagacguacgucaacuagaaccaguacuaauuccauuacccgauguccgcaauaauuucuaucacuauaaucaaucaaaugacaguacaaucaaacuaauagcaauguuauacacaccacuaagagcaaauaacgcuggagaugauguauuuaccguaucaugucgaguacucacaagaccaucucccgacuuugacuuuauauuucuaguaccaccaacuguugaaucacgaacuaaaccauucacaguaccuauacuuaccguagaagaaaugacuaacucacgauucccaauaccacuagaaaaacuauuuacugguccaaguucugccuucguaguccaaccacaaaacggaagaugcacaacagacggaguacuauuaggaacaacacaacuaucaccaguaaauauaugcacguucagaggagacguaacccauauagcaggaucuagaaauuauaccaugaaucuagccucacuaaacuggaauaauuaugaccccacagaagaaauaccugcaccauuaggcacacccgauuuuguuggaaaaauacaaggaguuuuaacacaaacaacaaaaggagacggaucaacacgaggacacaaagcaacugucuauaccggaucagcagacuuuacaccaaaauuaggaucaguacaauucgcuacagauaccgaaaacgauuucgaaacacaucaaaauacaaaauuuacaccaguuggagucauacaagacgguaguaccacacauagaaaugagccacaacaauggguaccaccuucauacuccggaagaaauguucauaacguacacuuagcccccgccguagcaccaaauuuucccggagaacaauuacuauuuuucagauccacaaugccagguuguucaggauauccaaauauggacuuagauugcuuacuaccucaagaauggguacaacauuuuuaucaagaagcagcuccagcacaaucagacguagcacuacuucguuuuguaaaucccgauacagguagaguauuauuugaaugcaaacuacacaaaucaggauaugucacuguagcucacacaggacaacaugaucuagucaucccaccuaauggauacuuuagauucgauucauggguuaaccaauuuuacacuuuagcaccaaugggaaauggaacugguagacgacgagccuuauaa

SEQ ID NO: 31401 - RNA, 1623 nt, Artificial Sequence
  derived and/or modified sequence opt6 from VP1__Norovirus__AER11356
augaaaauggcuagcaaugaugcaaauccaucugauggaucugccgcuaaccuuguaccugaaguaaauaacgaaguaauggcauuagaaccuguuguaggugcagcaauagcagccccaguugcuggacaacaaaauguaauugauccauggauaagaaauaauuuuguacaagcgccuggaggagaauuuaccguaucaccaagaaacgcacccggcgaaauacuuuggucagcaccccuaggccccgauuuaaacccuuauuuaucacacuuagccagaauguacaacggauacgcaggaggauuugaaguacaagucauucuagcaggaaacgcauucacagcugguaaaauaauauucgcagcagucccaccaaacuuuccuacagaagguuuaucaccaagccaaguaacaauguuuccacacaucauaguagacguaagacaacucgaaccaguuuuaauaccacuacccgauguaagaaauaauuuuuaccacuauaaucaaucaaaugauucaacaauuaaauuaauagcaauguuauacacaccauuaagggcaaacaacgcaggcgacgacguauuuacaguuucauguagaguauuaacuagacccucuccagacuuugacuuuauauuucuaguaccaccaacagucgaaucaagaacuaaaccauucacuguacccauacuaacagucgaagaaaugacaaacucaagauuucccauaccguuagaaaaauuauuuacaggaccaaguucggcuuuuguaguacaaccacaaaauggaagauguacuacagauggaguauuacuagguacuacucaauuaucaccaguaaauauaugcacauuuagaggagacguaacacauauagccgguucuagaaauuacacaaugaaucuagcaaguuuaaacuggaacaacuacgauccaacggaagaaauaccagcaccacuaggaacaccagacuucguaggcaaaauacagggugucuuaacacaaaccacuaaaggagacggaucaacuagaggucacaaagcaacgguuuauacuggaucagccgacuuuaccccaaaauuaggaucagugcaauuugcuacagacacugaaaacgacuucgagacacaucaaaauacaaaauuuacaccaguuggaguaauacaagaugguucaacuacacaucgaaaugaaccacaacaauggguacuaccuuccuacucuggacguaacguacauaacguacaucucgccccugcuguugcacccaauuucccaggagaacaauuacuauucuucagaucaacaaugcccggaugcucaggauauccaaacauggaucuagauugccuauuaccgcaagaauggguacaacauuuuuaccaagaagccgcaccagcacaaucagauguagccuuauuaagauucguuaauccagacacaggacgaguucuauucgaauguaaauuacauaaauccggauacguaacaguagcucauacuggacaacacgaucuaguaauuccuccaaacggauauuuuagauuugauucauggguaaaucaauuuuauacacuagcaccaauggguaauggaacaggacgaagaagagcauuauaa

SEQ ID NO: 31402 - RNA, 1623 nt, Artificial Sequence
  derived and/or modified sequence opt6 from VP1__Norovirus__AER11358
augaaaauggcuucauccgaugcaaacccaucagacggauccacagccaacuuagucccugaaguaaacaaugaagucauggcucuagaaccaguuguaggcgcagcaaucgcagcccccguagcaggacaacaaaauguaauagacccauggauaagaaauaauuuuguacaagcaccaggcggcgaauuuacaguauccccccgaaacgcaccaggagaaauucuuugguccgcaccuuuaggaccagauuuaaauccauauuuaucacacuuagcaagaauguauaacgguuacgcaggaggauucgaaguacaaguaauauuagcuggaaacgccuucacugcaggaaaaauaauauuugcugcaguaccaccaaacuuccccacugaaggacucagcccaucacaaguaaccauguucccacauauaauaguugacguuagacaauuagagccaguauuaauaccacuaccagacguaagaaacaauuuuuaucauuauaaccaaucaaaugauucaacaauaaaacuaaucgcaaugcuauacacacccuuaagagcaaauaacgcaggagaugauguuuucacaguaagcugucgaguacuaacaagaccuucaccagacuuugauuuuauauuucuaguacccccuacaguagaaucaagaacaaaaccauucucaguaccaguauugacaguugaagaaaugacaaacaguagauuuccaauaccauuagaaaaacuauucacaggcccuucaucagcuuucguaguacaaccacaaaauggccgaugcacuacagacggagucuuacuaggaacuacucaacuaucaccaguaaauauauguacguuccgaggugacgucacacacauuccagguuccagaaacuacaccaugaauuuagcuucucaaaacuggaauaguuaugacccaacagaagaaauaccagcaccacucggaacuccagauuuuguuggaaaaauucaaggaguauuaacacaaaccacaagaacaaacggaucaacccguggccacaaggcuacaguauacacaggcucagcugauuuuucaccaaaacugggaagaguacaauuugcaacagauacagauaaugauuucgaaaccaaucaaaauaccaaauucacccccguaggaguaauacaagaugguucaacuacacccagaaacgaaccacaacaauggguccuacccucauacucaggaagaaauauacacaacguacacuuagcaccagcaguugcaccuacauuuccaggugaacaacucuuauucuuuagaucaaccaugccugguugcucaggauaucccaauauggaucucgauugccuacuaccucaagaauggguccaauauuuuuaucaagaagcugcuccagcacaaucagauguagcucuacuacgauucguuaacccagacacuggaagagucuuauucgaauguaaauuacacaaaucaggcuacguaaccguagcucacacuggacaacaugaucucguaauuccaccuaacggauacuuucgauucgacucuuggguaaaucaauuuuacacacucgcuccaaugggaaacggaacaggaagaagacgagcacuauag

SEQ ID NO: 31403 - RNA, 1623 nt, Artificial Sequence
  derived and/or modified sequence opt6 from VP1__Norovirus__AER11360
augaaaauggcaaguucagacgcuaauccuucagauggaucaaccgcaaaccuaguaccagaagucaauaaugaaguaauggcacuagaacccguaguaggcgcagcaauugcagcaccaguagcaggccaacaaaacguaauagauccauggauacgaaauaacuuuguacaagcaccaggaggcgaauucacaguaucaccucgaaacgcaccaggagaaauccuauggucagcaccucucggaccagaucuaaaucccuaccuaucacacuuagcacgaauguauaauggauacgcaggaggauuugaaguacaaguaaucuuagcuggaaacgcauucacagcaggaaaaauaauauucgcagcaguaccuccaaauuuuccaacagaaggccuaucccccucucaaguaacaauguucccacaucuaauaguagauguucgacaacucgagccaguacuuauaccccuaccagauguaagaaacaauuucuaucacuacaaccaaucaaaugauucaaccauaaaauuaaucgcaauguuauauacaccauuaagagcaaacaaugcaggugacgauguauuuacaguaucaugucgaguccuaacaagaccaagcccagacuuugauuucauauuucuaguaccaccaacuguagaaucccgaacaaaaccuuucuccguaccuguauuaacagucgaagaaaugacaaacucaagauuuccaauaccauuagaaaagcuauucacuggaccaucuucugcuuucguaguccaaccucaaaaugguagauguaccacugacggaguccuuuuaggaacaacccaauuaucaccaguaaauauauguacauuuagaggagauguaacacauauuccaggaucacgcaauuacacaaugaauuuagcaucacaaaauuggaauucauacgauccgacagaagaaaucccagcaccacuagguacaccagauuuugucgguaaaauacaaggcguauuaacacaaacaacaagaacuaaugguucuacuagaggacacaaagcaacaguauacacaggauccgcagacuucucaccaaaauuaggacgcguccaauuugcaacagauacagauaacgauuuugaaacaaaucaaaauacuaaauucacaccuguaggaguaauucaagacggaucaaccacaccaagaaaugaaccacaacaauggguauuaccuucauauucagguagaaauauacauaauguacacuuagcaccagcaguagcaccaacauuuccaggcgaacaauuacucuucuuucgaucuacaaugccaggauguucagguuauccaaacauggaccucgauugcuuacugccacaagaauggguacaauacuuuuaucaggaagcagcaccagcacaaucugacguagccuuacuaagauucguuaacccugacacuggaaggguauuauuugaauguaaauuacacaaaucaggcuauguaacaguugcccauacaggccaacaugaucuagucaucccaccaaacgguuauuucagauuugauuccuggguuaaucaauuuuacacuuuagcaccaaugggaaauggcacaggacgcagaagagcauuauaa

SEQ ID NO: 31404 - RNA, 1647 nt, Artificial Sequence
  derived and/or modified sequence opt6 from VP1__Norovirus__AEX10549
augaaaauggcaucaaaugacgccgcaccaucuaaugacggagcagcaggccuaguaccagaaauaaacaaugaagccauggcauuagaaccuguagcaggugcagcaauagcagcaccucuaacaggacaacaaaauauuauagacccauggaucaugaacaauuucguacaagcaccaggcggagaauucaccguuucuccacgaaacucucccggagaaguacuauuaaacuuagaauuaggacccgaaauaaauccauacuuagcccauuuagcaagaauguauaauggauaugcaggagguuuugaaguacaaguaguauuagcaggaaacgcauuuacagcuggaaaagucauauucgcagcaauuccuccaaauuuccccacagauaaccuuucugcagcacaaauaacaaugugcccacauguuauaguugauguccgacaacuagaaccuauaaacuuaccuaugccagauguaagaaauaacuuuuuccacuacaaucaaggaucugacagcagacuccgccuaguagcgauguuauacacgccacuaagagccaacaacucuggagaugacguauucaccguaucaugcagaguacuaacuagaccaagcccagacuucucauuuaauuucuuaguaccuccuacaguagaaucaaaaaccaaaccauuuacauuaccaauauuaacgauaucagaaaugucaaacuccagauucccagucccuauugacucacuacauaccucaccaacagacaacauaguaguccaaugucaaaauggcagaguuacauuagauggagaauuaauggguacuacacaacuacuaccaucacaaauaugugcuuucagaggaguacuaacaagaucaacaucaagagcaagugaucaagcugauacugcaacacccagacucuuuaacuaucacuggcacauucaacuagacaaccuaaacggaacaccuuaugacccagcagaagacauaccagcaccucuaggcacuccagacuuuagaggaaaaguauucgguguagcaucacaaagaaacccugacucaacaacaagagcucacgaagcaaaaguagauacuacaucuggaagauuuacaccaaaauuagguucauuagaaauaucgacagaaucuggcgauuuugaccaaaaucaaccaacacgauuuacacccguaggaauaggaguagacaaugaagccgacuuucaacaauggacacucccagacuacucaggacaauuuacccacaacaugaauuuagcaccagccguagcaccaaauuuuccaggagaacaauuauuauuuuucagaucacaccuuccaucaucaggaggaagaucaaaugguauacuagauugcuuaguaccccaagaauggguacaacauuuuuaccaagaaagugcacccgcacaaacacaaguugcauuaguaagguacguaaauccagacacaggaagaguauuauuugaagccaaacuacauaaauuagguuucaugacuauugccaaaagcggcgacucaccaauaacagugccaccaaauggauauuucagauucgaaucuuggguaaacccauucuacacauuagccccaaugggaacaggaaacggaagaagacgcauacaauaa

SEQ ID NO: 31405 - RNA, 1623 nt, Artificial Sequence
  derived and/or modified sequence opt6 from VP1__Norovirus__AEX91910
augaaaauggcauccucagaugcaaacccaucagauggaucuacagcgaaccucguaccagaagucaauaaugaaguuauggcucuagaaccaguagucggcgcagcuauugcagcucccguagcaggacaacaaaacguuauagacccauggauuagaaauaacuuuguucaagcaccaggaggagaauuuacagucagcccaagaaacgccccuggagaaaucuuauggagcgcaccauuagguccagauuuaaacccuuaucuaucccacuuagcaagaauguauaacggauacgcaggcgguuucgaaguacaaguuauauuagcaggcaaugcuuucacagcuggaaaaauaauauucgcagcuguaccaccaaacuuuccuacagaaggccuaucuccaucucaaguaacaauguuuccacauauaauaguagacguuagacaacuagaaccaguccuaauaccuuuaccugacguacgaaauaacuucuaucacuauaaucaauccaacgacccaacuauaaaauuaaucgcaaugcucuacacuccacuccgagcuaauaacgcaggcgacgacguguuuaccguaucauguagaguacuaacacgaccaucucccgacuuugacuucauauuuuuaguaccaccaacaguagaaucucgaacaaaaccuuuuucuguccccgucuuaacaguagaagaaaugacaaauagucgauucccaauaccauuagaaaaacuauuuacaggaccuucuucagcauuuguuguacaaccccaaaacggaagaugcaccacagacggcguuuuacuagguaccacucaacuaucaccaguaaauauaugcacuuucagaggagauguaacacauauaccaggaucaagaaauuauaccaugaaccuugcuucacaaaacuggaauuccuaugacccaacagaagaaacaccugcucccuuaggaacaccugauuuuguaggaaaaauccaaggaguucuaacacaaaccacaagaacaaacgguucaacaagaggacacaaagcuacaguauauacuggcucagcagacuuuucaccaaaacuaggaagaguacaauuugcuacagauacagauaacgauuuugaaacaaaucaaaacaccaaauucacaccaguaggcguaauacaagacggaucaacaacccccagaaaugaaccacaacaauggguacucccuucauauucuggaagaaauauccauaauguucaccuagccccagccguagcaccaacauucccaggugaacaacucuuauucuuuagaaguacaaugccagguugcucaggauaccccaauauggacuuagauugccuauuaccacaagaauggguacaauauuuuuaucaagaagcugccccagcucaaucagacguagcacucuuaagauucguaaacccagauacuggacgaguacuauucgaauguaaacuacacaaauccggcuauguuacaguagcccacacaggucaacacgaccuagucauaccaccaaauggcuauuuuagauucgauucaugggucaaucaauuuuauacauuagcacccaugggaaauggaacaggccgacgaagagcuuuauaa

SEQ ID NO: 31406 - RNA, 1737 nt, Artificial Sequence
  derived and/or modified sequence opt6 from VP1__Norovirus__AFD30970
augaaaauggcaucuucagaugcaaccccaucaucagauggagcaggcaauuuagugccagaaucucaacaagaaguauuacccuuagcuccaguugcaggcgcugcacuagcagcaccaguaguaggccaacaaaacauaauugauccauggauaaaagaaaauuuuguacaagcaccacaaggagaauuuacaguauccccuaaaaacucaccuggagaaguauuaguaaaucucgaauuaucaccaaggcuuaauccuuaucucgaccacuuaagcaaaauguauaaugcuuaugcaggaggcauggaagucgaaaucauacuugcaggaaaugcauuuacugcaggaaaaguccuaauugcagcaguucccccaaacuuucccauagaaaacauaucagccucacaagcaucacaauucccacaugucauaguagauguacgaacacuagaaccaauacgacucccauuacccgauguucguacuaacuuuuuccacuauacaacacaagaagaaccaagaaugagaauaguagcaugguuauacaccccuuuaagaacaaacgguucaggagacgauucauucaccguaucuggacgcauacucacucgcccuucaccagauuuugaauuuaguuuucuuguuccuccaacaguagaaacaaaaaccguaucauuuuccguaccaggacuagucguagaagauaugucaaacucacgauggccagcucaaauaaauggacuaguaguaagaggcaaugaagcacaaguagugcauuuucaaaacggaagauguacaaccgaaggaacacuauuagggacaacuaccuuaucaauuaauucuauaugcggucuaagaggccuaucaguaucccaagcuucuguaagaggugcacccgcacuaacagaagaaaugccacccuuagaagaugaaguugcagacggagcagcagccacuuauacacuugcacgugcagcagauaccacacuaugguuaagaguagaagaaccugacggaagaccauaugauauauuuggugaccaaccagcaccccuaggaacuccagauuucacugcaguaauaguaggaacagcaauaaggccaagaacagcaucaggagcauaucuccaugaugcauauguagacacaacuccaggagaugcagacuucacaccaagcacugguaauaccaaaauaguauuacgaggaggcgguucaggacauguuggacaaggacauuauuggcaauuccgaccaauagcagucgaaggaggaggcucaagaccccaauaucaagaauauaauuuaccagauuacgcaggaccuacagcuucaaaucaugaucuagcaccuccaguugcaccccgaaugccuggagaauuacuauuauuauucgaaucagauaugccugugugggacaacggagcaggagccgcaccugcucaaaaaauacauugucuauuaccuaaugaauuuauaacacacuuauuugauuuacaagcaccugcauuagcagaggcugccuuacuacgauacguccacccagacucaggaaggacauuauuugaauguaaauuauaucgcgaaggauauaugguuguugcagcuccagcagguagauuaaacuuuccuuuagaugguuauuuuagguuugauucauggguaucagcauucuauauuuuaagcccuguaggaucaggccaaggaagacgaggaaggucaaaagcagcauaa

SEQ ID NO: 31407 - RNA, 1623 nt, Artificial Sequence
  derived and/or modified sequence opt6 from VP1__Norovirus__AFH88383
augaugauggcaucaaaagacgcuccuacuucuccugauggagccucuggugccggacaacucgucccagaagcaaauacagcugaacaaauaucuauggauccaguugccggagcaucaacugcaguagcaacagccggacagguaaauaugauagacccuuggauuuuuaacaauuuuguacaagcaccacaaggagaauucacaauaucucccaauaauacaccuggagauauauuauuugauuuacaauuagguccacaucucaauccauuuuuagcucauuuaucucaaauguauaacgguuggguaggcaauaugagaguacgcauacuucuagcaggaaaugcuuuuacagcagguaaaauaauaauuuguuguguaccaccuggauucgaugcacgaauacuuaccauugcacaagcaacauuauuuccucauuuaauagcagauguaagaacauuagaaccaguugaauuaccccuagaagaugucagaaauguuuuauaucauaacucuucacaaccacaaccaacuaugagauuaguugcaaugcuuuacacacccuuacgaacaggaggugguucaggaggaaccgaugcuuuugucguagcuggaagagucuuaacauguccagcaccagauuuuucuuuucuuuuuuuaguuccaccaucaguggaacaaaaaacaagaguuuucucuguacccaauauaccuuuaaaagaucucucaaauaguagagucccaguccccguacaaggaauguucaugucaccagauguaaaucaauccguccaauuucaaaauggacgaugucaaauagauggucaauuacaaggaaccacuccaguuucgcuaucccaacuaugcaaaauuagaggaaaaacaucuucaaacgcucguguauuaaacuuaucugaaguagauggaaccccauucauuccacucgaaucuccagcaccagucgguuuuccagauuuaggaggaugcgacuggcauguuaauuuuacuuuucaagcacaaaaucaagacccuucacaaucaguuaccuucgcaacuaaugaugcauccuuuguaccauaccucggauccauuucuccccauaauggaggagacuuucaugcuggugauauaauuggaucccuaggauggauaucagcaccuucagauaauucucaacucaauguauggacaauaccuaaauacggaucaucucuucccgauguuacucaucuagccccagcaguauucccaccaggauuuggugaagucauucucuauuuuuauucuacauucccaggaucuggccaaccuucccaacuacaaguaccaugucuacucccacaagaauucauaacucauuucuguaaugaacaagcacccauagccggagaagccgcuuuacuccacuauguugacccugauacuggacguaaccuaggugaauuuaaacucuauccugacggauuuaugacaugugucccuaauagcguuaguucaggaccccaaacauuaccaauuaacggaguauucguauuuguaucauggguaucacgauuuuaccaacuaaaaccaguaggaacagcaucagcagcucgacgacuuggacuaagaagaauauaa

SEQ ID NO: 31408 - RNA, 1671 nt, Artificial Sequence
  derived and/or modified sequence opt6 from VP1__Norovirus__AFJ21376
augaaaauggccucaucagaugcugcaccaucuacugauggugcaggaaaccuuguaccagaaucacaacaagaaguacuaccauuagcuccaguagccggagcagcacuagccgcacccguaguaggucaaacaaauaucauagaucccuggauaaaagaaaauuuuguucaagcuccacaaggcgaauuuacagugucuccaaagaacucgccaggagaaauauuaguuaacuuagaacuuggaccuaaacuaaauccauauuuagaucaucucaguagaauguacaauagcuaugcuggaggaauugacguuaugguaguguuagcaggaaaugcauuuacagcagguaaaguacuaauugccgcaauuccacccaauuuuccaguugaagguguaucagcuagucaagcaacacaauuuccacacguaauaauagauguaagaacauuagauccagucagauuaccuuuaccagauguuagaucaaccuuuuuccauuacacaaaugauacagaaccuaagaugagauuaguaauauggcuauauaccccucuaagaacaaauggaucaggagaugauucauuuacuguaucaggucgaauacuaacaagaccaucccaagauuucgaauuugcuuuuuuaauaccaccaacaguggaaacaaaaacaacaccauucucaguaccaggauucucuguucaagaaaugaguaauucuagauggccugccgcgauaucugcuauggucguaagagguaaugaaccacaaguuguacaauuucaaaauggaagagcucacuuagauggaaugcucuuaggaacaacgccuguuucuccaaacuauauagcuucauauagaggaauuuccacugggaauucaagaucagcaucaagugaagcagacgaaagagcaguuggcaguuuugacguuuggguaagauuacaagaacccgauggucaaccuuacgacauauuuggaaaacaacccgcuccuauaggaacgccagauuuuaaagcaguaauaguaggauuugcagcccgaccauugacaaguggauccuacgcuaaugaagcauacguaaacacaaccgcauccgauuacgcaccagcaacaggaaacaugagauuuacaguuagaaauggugggacaggacacauauccgcaaauaaauauugggaauuuaaaucauucgguguagaaggagaaagacauaccgauauucaauaucaagaauaugaauuaccugauuacucaggucaaguagcaucaaaucacaaucuagcaccaccaguugcaccacgaaugccaggcgaaucccuuuuauuauuccaaucuaacaugccuguaugggaugacggacauggugaaaguaccccaaaaaaaauccacugucucuuaccucaagaauuuauaggacauuuuuucgaucgucaagcaccaucauuaggagaugcugcauuacuacgauauguaaaucaagaaacaaauagaguacuauuugaauguaaauuauauagagacggauacauaacaguagcugcaucaaguggcuuauuagauuuuccacuugauggauucuuucgauuugauucauggguaucaucauucuacauauuaucgccaguaggaucuggacaaggaagacgaggacgaguaagauuucaauaa

SEQ ID NO: 31409 - RNA, 1608 nt, Artificial Sequence
  derived and/or modified sequence opt6 from VP1__Norovirus__AFJ21379
augaaaauggcaucauccgacgcugcuccauccaacgacggagcugcaggacuuguaccugaaguaaauaacgaaacaauggcauuagaaccaguagcaggagcaucaauagcagcaccacuaacaggccaaaacaauguaauugacccauggaucagacuaaauuucguucaagcaccaaauggagaauucacaguauccccccguaacuccccaggcgaaguuuuacucaacuuagaacucgguccagaacuaaaccccuacuuagcacaucuauccagaauguacaacggauaugcagguggaguagaaguacaaguacuacuagccggcaacgcauucaccgcugguaaacuaguuuucgcugcaguaccgccacauuuuccauuagaaaauauauccccuggacaaaucacaauguuuccacacguuauaauagauguacgaacacuagaacccguauuauuaccucuaccugacguaagaaacaauuuuuuccauuauaaucaacaaaaugaaccaagaaugagacuaguagcaaugcuauauacuccucuaagaagcaacggaucuggagacgacguauucacaguaucaugucgaguacuuacaagacccucaccagauuucgauuucaauuaccuaguaccaccaacagucgaaagcaaaacuaaaccauuuacccuaccaauacuaacuaugggagaacuaaccaauaguagauuucccguaccuauagacgaauuauauacaucuccaaacgaauccuuagucguacaaccacaaaauggacguugcgcauuagauggagaauuacaaggcacuacacaauuacucccaaccgcuauaugcucauuucguggaagaauaaaccaaaaaguaucaggagauaaccacguauggaauaugcaaguaacuaauauaaauggaacaccauuugauccaacugaagauguacccgcaccccucggaacucccgauuuuucaggaaaacuuuuuggaguacuaucacaaagagaccaugauaaugcauguagaucacacgaugcaguaauagcuacuaauucagcaaaauucacaccuaaacuaggagcaauucaaauagguacaugggaacaagaugauguacacauaaaccaaccaacuaaauuuacuccaguuggacuauuugaauccgaagguuuuaaccaauggacacuaccaaauuauuccggagcucuaacacucaacaugggcuuagcccccccagucgcaccaaccuuucccggagaacaaauacuuuucuuuagaucucacaucccacuuaaaggaggaguugcagauccaguuauagauuguuuauuaccacaagaauggauacaacauuuauaucaagaaucagcaccuucacaaacugacguagcacucauuagauucacaaacccagacacaggcagaguacuauucgaagcaaaauuacauagaucaggauacauaacaguagcaaauacaggaucaagaccuaucguaguaccugcaaauggauauuucagauuugauucauggguuaaucaauuuuacucccuagcacccaugggaacuggaaauggaagaagacgaguacaauaa

SEQ ID NO: 31410 - RNA, 1608 nt, Artificial Sequence
  derived and/or modified sequence opt6 from VP1__Norovirus__AFJ21382
augaaaauggcuucuaaugaugcagcaccaucaaaugauggagcagccggacuagucccagaaguuaauaacgaaacaauggcauuagaaccaguagcuggagcaagcauagcagcuccccuuacaggacaaaauaaugucauagaccccuggauaagacuuaacuuuguucaagcaccaaauggugaauucacaguaucuccucgaaauuccccuggagaaguccuauuaaauuuagaauuaggaccagaauuaaauccauauuuagcacauuuaucuagaauguauaauggauaugccggcggaguagaaguccaaguacuacuagcaggaaacgcauuuaccgcaggcaaauuaguuuucgcagcaguacccccacacuucccauuagaaaacauuuccccaggccaaauuacuauguuuccccauguaaucauugacgucagaaccuuagaaccaguauuauuaccucuaccagauguccguaauaauuuuuuucacuauaaccaacaaaacgaaccacgaaugagacuuguagcaaugcuauacacaccacuucgcucaaauggaucuggagaugauguauuuaccguaucaugcagaguauuaacaagaccaucaccagauuuugauuucaacuaucuaguaccacccacaguugaauccaaaacaaaaccuuucacauuaccaauuuuaacaauaggagaacuaacaaauucaagauucccgguuccuauagaugaacuauauacaucaccaaacgaaucauuaguaguucaaccacaaaacggcagaugcgcacuagacggugaauuacaagguacuacacaauuacuaccaacugcaauaugcucuuuuagaggcagaauaaaucaaaaaguaucuggagaaaaucacguauggaacaugcaaguaaccaauauuaaugguacaccauuugacccaacagaagauguaccugcaccccuaggaacuccagauuucuccggaaaauuauuuggaguacuaucacaaagagaccaugacaaugcauguagaucucacgacgcaguuauagcaacaaauagcgcaaaauucacaccaaaauuaggagcaauacaaauuggcacaugggaacaagacgauguacauauaaaucaaccuacaaaauucacuccaguaggcuuauuugaaucagaaggauuuaaccaauggacacuacccaacuacucaggagcauuaacacuuaacaugggauuagcuccuccaguagcaccuacuuucccaggagaacaaauacuauucuuucgaucacauauuccgcuaaaaggaggaguagcagaucccguaauagacugcuuacucccucaagaauggauacaacaccuauaucaagaaucagcucccucucaaacagauguagcuuuaauccgauucacuaauccugacacaggaagagucuuauuugaagcuaaacuccauagaucaggauauaucacaguagccaauacuggaucaagaccuauaguaguaccugcuaauggauauuucagauucgacucauggguaaaucaauuuuauucacuagcaccaaugggcaccggaaauggaagaagacgaguacaauaa

SEQ ID NO: 31411 - RNA, 1623 nt, Artificial Sequence
  derived and/or modified sequence opt6 from VP1__Norovirus__AFJ21387
augaaaauggcaagcaaugacgcuaaucccagugauggaucagccgcuaacuuaguacccgaaguuaacaaugaaguaauggcacuagaaccugucguaggagcagcaauugcugccccaguagcuggccaacaaaauguaauagacccuuggauuagaaauaauuuuguacaagccccaggcggagaauucacaguaagccccagaaaugcaccaggugaaauauuauggagugccccacucggacccgauuuaaauccauaucuaucucauuuagcaagaauguauaaugguuacgcaggagguuuugaaguacaaguaauucuagcaggaaaugcauuuacagcaggaaaaauaauauucgcagccguaccaccaaacuuuccaacugaagguuuaucuccaucgcaaguuacaauguucccacacauaauaguugacguacgacaauuagaaccagucuuaauaccauuaccugauguacgaaauaacuucuaucacuacaaccaaucaaacgacuccaccauaaaauuaauagcaauguuauacacaccauuaagagcaaauaacgccggugaagacgucuuuacaguuagcuguagaguacuuacacgcccuucaccagacuucgacuuuaucuuccuaguaccuccuacaguugaauccagaacaaaaccauuuacaguaccuauuuuaacuguagaagaaaugacaaacucccgauucccaauaccacuagaaaaauuauuuacaggacccuccggcgcauucguaguucaaccacaaaauggacgauguaccacagacggcguauuacuugguacaacacaauuaagcccaguaaauauauguacauuuagaggugacguuacacacauagcuggaucaagaaauuacacuaugaacuuagcaagcuuaaacuggaacaauuaugauccuacagaagaaaucccagcaccacuaggcaccccagacuuugucggcaaaauacaaggaguucuaacacaaaccacuaaaggagauggaucuacaagaggacacaaagcaacaauauauacagguuccgcaccauuuacaccaaaauuaggaaguguacaauucucaacugauacagaaaacgacuucgaaacccaucaaaacacaaaauuuacuccaguaggcguaauacaagacggcucaacuacacauagaaaugaaccucaacaaugggucuuaccauccuauucaggaagaaauguacauaacguacauuuagcaccagcuguagcaccaaccuuucccggugaacagcuauuauuuuuuagaucaacaaugcccggaugcucaggcuauccuaauauggaucucgacugcuuacuuccacaagaauggguacaacacuucuaucaagaagccgcaccagcccaaucugacguagcacuucuaagauuuguaaacccagacacaggaagaguauuauuugagugcaaacuacacaaaucaggauauguaacaguugcgcacacaggacaacacgauuuaguuauccccccuaaugguuauuuuagauucgacucauggguaaaucaauucuauacauuagcaccuaugggaaacggcacaggaagaagacgagcucuauaa

SEQ ID NO: 31412 - RNA, 1623 nt, Artificial Sequence
  derived and/or modified sequence opt6 from VP1__Norovirus__AFJ21388
augaaaauggcauccaaugacgcaaauccaucagauggcucugcagcaaacuuaguaccagagguaucaaaugaaguaauggcacucgaaccaguaguaggugcugccauagccgcaccaguagcaggccaacaaaacguaauagauccuuggauucguaacaacuuuguucaagcuccaggaggugaauuuaccguuucuccaagaaaugcaccuggagaaauucuauggucagcaccacuaggaccagaccuaaauccuuacuuaagucaccuagcaagaauguauaacggauaugcuggugguuuugagguccaaguaauucuagcugguaacgcauucacagccggaaaaauaauuuucgcugcaguaccaccaaauuuucccacugaaggacuauccccaucacaaguaacaauguucccacacauaaucgucgacguaagacaacuagaaccaguauuaauaccccuuccugauguacgaaacaauuuuuaccacuauaaucaaucuaaugauucaaccauuaaauuaauugcuauguuauauacaccacuaagagcaaacaaugcaggagaagauguauucaccguuagcuguagaguauuaaccagaccaucaccagacuuugacuucauauuucuaguaccaccuacaguagaaaguagaacuaaaccauucacuguacccauauuaaccguagaagaaaugacaaauucaagauucccaauaccauuagaaaaauuauucacaggucccucaggugcauucguuguacaaccacaaaacggacgauguacaacagacgguguauuauuaggcacaacacaguuaucaccaguaaauauauguacauuucgaggagauguaacccauauagccggaucccgaaauuacacaaugaaucuagcaucauuaaacuggaauaacuaugauccaacugaagaaauaccagcaccauuagguacaccagauuuuguaggaaaaauacaagguguauuaacacaaaccacaaaaggugauggcucaacuagaggacacaaagcaaccguauauacagguucugcuccuuuuacaccuaaauuaggaucaguucaauucucuaccgauacagaaaaugacuucgaaacacaccaaaauacuaaauucacuccagucggaguaauccaagacgguucuacaacacaccgaaaugaaccccaacaauggguauuaccaaguuauaguggaagaaauguccacaauguucacuuagcuccugccguagcaccaacauucccaggagaacaacuacuuuucuucagaucuaccaugccaggaugcaguggauauccaaauauggaccuagauugucuauuaccacaagaauggguacaacauuuuuaucaagaagccgcuccagcucaaucagacguagcauuacuucgauuuguuaacccagauacaggacgaguacuauucgaaugcaagcuacauaaaucaggcuauguuacgguagcacauacuggacagcaugaucuaguaauaccaccaaacggauauuuuagauuugauucauggguuaaucaauucuacacauuagcaccuaugggaaauggaacaggaagaagaagagcccuauaa

SEQ ID NO: 31413 - RNA, 1623 nt, Artificial Sequence
  derived and/or modified sequence opt6 from VP1__Norovirus__AFJ21389
augaaaauggcaaguaacgaugcaaacccaucagauggauccgcugccaaccuugucccagaaguaaacaacgaaguaauggcauuagaacccguaguaggagccgcaauugcagcucccgucgcaggacaacaaaaugucauagacccuuggauaagaaauaacuuuguccaagcaccuggcggagaauuuacaguuucacccagaaacgcaccuggugaaauucuuuggucagcuccacuaggaccagaucuaaauccauaucuuucacacuuagcaagaauguauaaugguuacgcaggcggauuugaaguacaaguaauauuagcaggcaaugcauucacagcuggaaaaauaauauuugcugcaguaccaccaaacuucccaacagaaggucuaucaccaucacaaguuacaauguucccacacauaauaguagauguaaggcaauuagaaccaguucuaauaccauuaccagacguccgcaauaauuucuaucacuauaaucaauccaaugacucuacaauaaaauuaaucgcaaugcuauacacaccauuaagagccaacaaugcaggugaagauguauuuaccgucucuugccgaguauuaacaagacccucaccagauuuugacuucauauuuuuaguaccaccaaccgucgaaucuagaaccaaacccuucacaguuccaauacuuacaguagaagaaaugacuaauucaagauucccaauaccucuagaaaaauuauuuacuggaccaucuggagcauucguaguacaaccacaaaacggaagauguacaacagauggaguccuucuaggaacaacucaauuaucaccaguaaauauuuguaccuuuagaggagaugucacacacaucgcaggaucacgaaauuauacuaugaaucuagcaagccucaauuggaacaacuacgauccaacagaagaaauaccagcaccauuaggcacuccugauuuuguaggaaaaauccaaggaguacuaacucaaacaacgaaaggagacgguucaacacgaggacauaaggcaacuguauauacaggaagcgcucccuuuacaccuaaauuaggaucaguccaauucucuacugauacagaaaacgauuucgaaacucaccaaaauacaaaauucaccccuguagguguaauacaagauggauccaccacacacagaaacgaaccucaacaauggguauuaccaucauauucugguagaaauguucacaacguucauuuagcaccugccguugccccaacuuuuccaggugaacaauuacuuuuuuuuagaucaacaaugcccgguugcuccggauacccuaauauggaccuagacugcuuacuaccacaagaauggguacaacauuucuaucaagaagcagcaccagcacaaucagacguugcccuauuaagauucguaaauccugauacaggaagaguacuauucgaaugcaaacuacacaaauccggauaugucacaguagcacacacaggucaacaugaucuagucauaccaccaaacggauauuucagauuugauuccuggguaaaccaauuuuacacccuagccccuaugggaaacggcacagguagacgaagagcacuuuaa

SEQ ID NO: 31414 - RNA, 1623 nt, Artificial Sequence
  derived and/or modified sequence opt6 from VP1__Norovirus__AFJ21390
augaaaauggcuucaaaugacgcaaaccccagugacggaucugcagcaaaccuaguaccggaaguaaacaaugaaguuauggcacuagaaccaguuguaggagcagcaauagcagcaccuguagcaggccaacaaaauguuauagauccauggauaagaaauaacuucguacaagcacccggaggagaauuuacaguaucacccagaaaugcaccaggugaaauacucuggucagcaccucuagguccagaccuaaacccauauuuaucccacuuagcacgaauguauaacggauacgcaggaggcuuugaaguacaaguaauauuagcuggaaacgcauuuacagccggaaaaauaauauucgcagccguacccccaaauuuuccaacagaaggauuaagucccucccaaguaacuauguucccacauauaauaguugacguuagacaacuagaacccguauuaauaccucuaccagacgucagaaacaauuucuaucauuacaaccaaucaaacgauucuacaauuaaauuaaucgcaauguuauacaccccacucagagcaaacaaugcaggagaagauguauuuacaguuucauguagaguacuaacaagaccaucaccagacuucgacuucauauuuuuaguaccaccuacaguagaauccagaaccaaaccauuuacagucccuauauuaacaguagaagaaaugacuaacucuagauucccaauaccacuagaaaaauuauuuacagguccaucaucagcuuucguaguacaaccacaaaacggaagaugcacaacagauggaguacuauuaggaacuacacaauuaucaccaguaaauauaugcacauuucgaggcgauguaacacauauagcugguucaagaaauuacgcaaugaacuuagcuucccucaacuggaacaauuacgacccaacugaagaaauuccagcgccacuaggaacaccagacuucguaggaaaaauacaaggacuacuaacucaaacuacuaaaggagacgguucaaccagaggucacaaagcaacaguauacaccggaucagcaccauuuacaccuaaauuaggauccguacaauucucaacagacacagaaaacgauuucgaaacccaucaaaauaccaaauucacacccguagguguaauacaagacggaucaacaacacauagaaacgaaccgcaacaauggguacucccaucauauagcggacguaauguacacaauguucaccuagcuccagcaguagcaccaacauucccaggagaacaauuauuauucuuuagauccacaaugccaggaugcucaggauaucccaauauggaccuagacugccuacuaccucaagaauggguacaacauuuuuaucaagaagcagcaccagcucaauccgauguagcauuacuaagauucguaaaccccgauacaggcagaguacuauucgaaugcaaacuacauaaaucugguuauguaacuguagcacacaccggucaacacgacuuaguaauacccccuaauggauacuuccgauucgacucuugggucaaccaauuuuacacacuagcaccaauggguaauggaaccggccgucgaagagcacuauaa

SEQ ID NO: 31415 - RNA, 1623 nt, Artificial Sequence
  derived and/or modified sequence opt6 from VP1__Norovirus__AFJ21391
augaaaauggcaagcucagaugccaacccauccgacggaucaacagccaaucuagucccagaaguaaacaacgaaguaauggcacuagaaccaguugucggagcagcaauagcagcuccaguagcuggucagcaaaacguaauagacccuuggauaagaaauaacuuuguucaagcaccaggaggagaauuuacaguaucaccacgaaacgcuccuggagaaauacuuuggucugcaccccuuggucccgaccuaaacccauaucuaucccaccuagcacgaauguauaauucauacgcaggaggauucgaaguacaaguaauauuagcuggaaacgccuuuacagcugguaaaauuauauucgccgccguuccaccaaacuuccccacugaaggucuaucaccaucacaagugacaauguucccucacauaauaguugacguucgacaauuagaaccuguccucauaccccuaccagacguuagaaacaauuuuuaucauuauaaucaaucaucagacccuacaauuaaacuaauugcaauguuauauaccccauuaagagcuaacaaugccggagaugauguauuuaccguuucaugccgaguucucacuagaccuuccccugacuucgacuuuauauuuuuaguaccacccacaguagaaucuagaacaaaaccauucucaguaccuaucuuaacaguagaagaaaugacaaacucaagauuuccaauucccuuagaaaaauuauuuacaggccccaguucugcauucgucguacaaccacaaaacgguagauguacaacagauggaguauuauuagguacaacacaauuauccccaguaaauauauguacuuuuagaggagacguaacacacauagcaggaacacaagaauacacaaugaaucucgcaucucaaaauuggaauaauuacgauccaacugaagaaauaccagcaccacuaggcacaccagauuucguuggaaaaauacaagguguccucacacaaaccacaagaagagaugguucuacucgcggucacaaagcaacaguaaguacaggauccguacauuuuacuccuaaacuaggaagaauacaauuuuccacagauacaucaaacgauuuugaaacaggacaaaauacacguuucaccccaguaggcguaguccaagauggaucaacaacucaucaaaaugaaccacaacaauggguauuaccuaacuauuccggacgagauucucauaacguacauuuagcaccugcaguagcaccuucauuuccuggagaacaacuauuauuuuuccgaucaacaaugccaggcugcucaggauaccccaauauggauuuagacugccuuuuaccacaggaauggguacaacacuuuuaucaagaagcagccccugcucaaucugauguugcauuacuaagauucguaaacccagacacaggacgaguacuauucgaauguaaauuacauaaaucagguuaugucacuguagcacacacaggacaacaugaccuaguaaucccaccaaauggauauuucagauucgauucaugggucaaucaauucuacacacuagcaccaaugggaaacgguacaggaagaagaagagcauuauaa

SEQ ID NO: 31416 - RNA, 1623 nt, Artificial Sequence
  derived and/or modified sequence opt6 from VP1__Norovirus__AFJ21392
augaaaauggcauccuccgacgcaaacccauccgacggaucuacagcaaaccuaguacccgaaguaaacaaugaaguuauggcuuuagaaccaguaguuggagccgcuauagccgcaccaguagcuggacaacaaaauguaauagauccauggauaagaaauaacuucguacaagcacccggaggagaauuuacugugagcccaagaaacgccccaggagaaauauuaugguccgcaccacuaggaccagaucucaauccauauuuaucacacuuagcaagaauguauaauggcuacgcaggaggauuugaaguccaaguaauauuagcaggaaacgccuuuacagcaggaaaaauaauauucgccgcaguaccaccaaacuuuccaacugaaggacuaucuccuucucaaguuaccauguucccccauauaauaguagacguaagacaacucgaaccuguucuuaucccuuuaccagauguaagaaacaauuuuuaucauuauaaccaaucuaacgacucaacuauuaagcuaauagcaaugcuauauacuccacuacgagcaaacaacgcaggugaagauguauucacaguaucauguagaguacuaacacgacccucaccugauuuugauuuuauauuucuugucccaccaacaguagaaagccguacaaaaccauucacagucccuauauuaacaguagaagaaaugaccaauucuagauuuccaauaccauuagaaaaacuauuuacaggaccaucaggugcauuuguuguacaaccacaaaaugggagaugcacaacagacggaguacuauuaggaacuacucaacucagucccguaaacauauguaccuuucgaggugaugucacucauauagcuggcucaagaaacuauacaaugaaucuagccuccuuaaacuggaauaauuacgacccaacagaagaaaucccagcaccucucggaacuccagacuuuguagguaaaauacaaggcguacucacccaaaccacaaaaggugacgguucaacaagaggacauaaagcaacaguauauacaggcucagcaccauuuaccccaaaacuaggcucaguccaauuuucaacagauacagaaaacgauuuugaaacacaccaaaacacaaaauuuacuccaguuggaguaauacaagacggcucuaccacccacagaaacgaaccacaacaaugggucuuaccauccuacucaggcagaaauguccauaauguacaucucgcaccagcaguugcaccaacauucccaggcgaacaacuacuauucuucagaucuacaaugccaggaugcucaggauauccaaauauggaucuagauugccuacuaccacaagaauggguacaacauuucuaccaagaagcagccccagcacaauccgauguggcccuucugagauuuguaaauccagacacaggcagaguauuauucgaauguaaauuacacaaaucaggauacguaacaguagcucacacaggacaacacgauuuaguuaucccaccaaauggcuauuucagauucgacgccugggucaaucaauucuacaccuuagcaccaaugggcaacggaacaggacgaaaaagagcacuauaa

SEQ ID NO: 31417 - RNA, 1623 nt, Artificial Sequence
  derived and/or modified sequence opt6 from VP1__Norovirus__AFJ21393
augaaaauggcaucaaaugaugcuaacccaucagauggaucugcagcaaauuuaguaccagaaguuaauaaugaaguaauggcacuagaaccuguaguaggagcugcaauagcagcaccuguagcaggacaacaaaaugucauagaccccuggauaagaaacaacuuuguacaagcuccuggcggcgaauuuacaguaucaccaagaaaugcaccaggagaaauacuauggucagccccucuaggaccagacuuaaauccauaucuuucacaucuagcucguauguauaacggauacgcaggugguuucgaaguacaaguaauacuagcaggaaacgcuuuuacagccggaaaaauaauauucgcugcuguuccaccaaacuuuccuacagaaggauuaucucccucacaaguaacaauguuuccacauauaauaguagacguucgacaacuagaaccaguccuuauaccauuaccagacguaagaaacaauuucuaucacuauaaucaaucaaaugacucaacaauaaaacuaauagcaaugcuuuauacuccacuacgugcaaauaaugcuggagaagauguauuuacaguaucauguagaguacuaacaagaccaucuccagacuuugacuuuauauuuuuagucccacccacaguugaaaguagaacgaaaccauucacaguaccaauauuaacaguugaagaaaugacuaauaguagauuucccauuccuuuagaaaaacuauuuaccggaccaucaucugcauuugucguacaaccacaaaacgguagauguacaacagauggaguauuauuaggaacaacacaguuaucaccagucaauaucuguacauucagaggcgacguuacacauauagcaggaagccgcaauuauacuaugaaucuugcaucacuaaauuggaacaauuaugauccuacagaagaaauaccugcaccacuaggaacaccagauuuuguaggaaaaauacaaggaguauuaacacaaaccacaaaaggagaugguucuacccgcggucacaaagcaacaguauacacagguucagcaccuuucacaccuaaauuaggauccguucaauucucaacagacaccgaaaacgacuucgaaacacaucaaaauacaaaauuuacaccaguaggaguuauccaagacggaucaacuacacauagaaaugaaccacaacaauggguauuaccaucauauuccggucgaaauguucauaacguacacuuagcaccagcaguagcaccaacauuuccaggagaacaauuauuauucuuucgauccacaaugccaggaugcucaggauauccaaacauggaucuagauugcuuacuaccacaagaauggguccaacauuuuuaccaagaagcagcuccugcucaauccgauguagcacuauuaagauuuguuaacccugauaccggcagaguauuauuugaauguaaacuucacaaaucaggauaugucacuguagcccacacaggccaacaugacuuaguaauuccacccaauggauauuucagauuugacaguuggguaaaucaauucuauacacuugcaccaaugggaaauggcacaggaagacgaagagcacuauaa

SEQ ID NO: 31418 - RNA, 1623 nt, Artificial Sequence
  derived and/or modified sequence opt6 from VP1__Norovirus__AFJ21394
augaaaauggcauccaaugaugcaaaccccucagauggaucagccgcaaaucuagucccagaaguaaacaacgaaguuauggcauuagaaccaguuguaggugcagcaauagcagccccaguagcaggacaacaaaacguaauugauccauggaucagaaauaauuuuguacaagcaccaggaggagaauuuacaguauccccaagaaaugcuccaggugaaauacuauggucagcaccacuaggaccagacuuaaauccauauuuaucacauuuagcaagaauguauaacggauaugcaggaggcuucgaaguacaaguaauauuagcagguaaugcauucacagcuggaaaaauaauauucgcugcaguaccaccuaacuucccaacagaaggacuaucaccaucccaaguaaccauguucccacacauuauaguagauguacgacaacuagaacccguauuaauuccacuaccagaugucagaaauaacuucuaucauuauaaucaaucaaaugacucuacaauaaaauuaauagcuaugcuauauaccccacuacgagcaaacaaugcuggagaagaugucuuuaccguaucaugcagaguacuaacaagacccucaccagauuucgacuucauauuucuaguaccaccaacaguugaaucaagaacaaaaccauuuacuguacccauacuuacuguagaagaaaugacaaacucacgauuuccuauaccacucgaaaaauuauuuacaggaccaucaggugccuuuguaguacaaccucagaacggaagauguacaaccgaugguguacuauuaggaacuacucaauuaucuccagucaacaucugcaccuuucguggugacguaacucauauagcaggaucuagaaauuacacuaugaaucuagccucacuaaauuggaacaacuacgacccaacagaagaaauaccugcaccacuaggaacaccagauuuuguaggaaaaauacaaggaguacucacacaaacaacaaaaggagauggaucaacuagaggucacaaagcaacaguauauacaggauccgcaccauucacuccuaaauuaggaucaguccaauucaguacagauacagaaaacgacuucgaaacacaucaaaacaccaaauuuacucccguaggugucauacaagauggauccacuacacaucgaaaugaaccacaacaauggguucucccuaguuauucuggucgaaauguacauaacguccaucuagcacccgcuguagcaccaacauuuccaggagaacaauuacuauuuuuuagaucuaccaugccaggaugcuccggauauccaaauauggaucucgacugucuauuaccccaagaauggguacaacauuucuaucaagaagcggcuccugcacaaucugacguugcauuacuccguuuuguaaauccagacacagguagaguacuauuugaaugcaaacuacacaaaucaggauacgucacaguugcucacacaggacaacacgauuuagucauaccaccaaauggauauuuccgauuugauucauggguuaaccaauuuuauacacuagcaccuaugggaaauggaacaggaagaagacgcgcccuuuaa

SEQ ID NO: 31419 - RNA, 1623 nt, Artificial Sequence
  derived and/or modified sequence opt6 from VP1__Norovirus__AFJ21395
augaaaauggccucaaaugacgcaaauccaucagauggaucagcagcaaacuuaguacccgaaguaaacaaugaagucauggcauuagaaccuguaguaggugcagcaauagcagccccaguagcaggacaacaaaacguuauagacccuuggauacgcaauaauuuuguucaagcaccaggaggagaauuuacaguuuccccaagaaaugcaccaggagaaauacuauggucagcaccucucggcccagaucuuaauccauaucuuucacauuuagcaagaauguacaacggauacgcaggcggcuucgaaguccaaguuauauuagccggaaacgcauuuacagcaggaaaaauaauauucgcugcugucccaccaaauuucccuacagaaggauuaucaccuucacaaguaacaauguucccacacauuauaguugaugucagacaacucgaaccaguauuaauaccuuuaccagacguacgaaacaauuucuaccacuacaaccaaucaaacgacucuacaauaaaauuaauagcaaugcuuuacacacccuuaagagcaaauaaugcuggcgaagacgucuuuacaguaucuugcagaguucuuacaagaccaucaccagacuuugacuucauauuucucgucccaccaaccguagaaucacgaacaaagccauucacaguuccaaucuuaaccguagaagaaaugaccaacucuagauuuccaauaccacuugaaaaacucuuuacagguccaaguucagcauucguaguacaaccucaaaauggacgauguacuaccgaugguguauuacucggaacaacacaacuaucacccguuaauauauguacauucagaggagauguaacacauauagcaggaucacgaaacuacacuaugaauuuagcaucuuuaaacuggaauaauuacgauccaacagaagaaauaccagccccauuaggaaccccugacuuuguaggaaaaauacaaggaguauuaacacaaacaacuaaaggugaugguucaacaagaggucauaaagcaacaguuuauacagguucagcuccuuuuacacccaaacuaggaucaguacaauuuucaacagauacugaaaaugauuuugaaacccaucaaaauacaaaauucacaccaguaggaguuauacaagacgguucaacuacacaucgaaaugaaccucaacaauggguauuaccaucauauaguggaagaaauguacacaauguucaccuugcacccgcaguagcaccaacauuuccaggagaacaauuacuuuucuuuagaucaacaaugccaggaugcucaggauacccuaauauggaucuagacuguuuauuaccacaagaauggguacaacacuucuaccaagaagcagcccccgcacaaucugacguagcacuuuuaagauucguuaacccagauacaggaagaguucuuuucgaauguaaacuacauaaaucaggauauguaaccguagcacacacaggacaacaugaucuaguaauaccuccaaauggauacuuccgauucgauucauggguaaaucaauucuacacauuagcaccuaugggaaaugguacaggcagaagacgugcacuauaa

SEQ ID NO: 31420 - RNA, 1623 nt, Artificial Sequence
  derived and/or modified sequence opt6 from VP1__Norovirus__AFJ21396
augaaaauggcaucaaaugacgcuaacccuucagauggauccgcugcuaacuuagucccagaaguaaacaaugaaguaauggcccuagaaccaguaguuggcgccgcaauagcagcucccguagcaggacaacaaaacguaauagauccauggauaagaaacaacuucguacaagcaccugggggagaauuuacaguaucaccacgaaacgcaccaggagaaauacugugguccgcaccauuaggacccgauuuaaacccauaucucucucaccuagcacgaauguacaaugguuacgcaggaggauucgaaguacagguuauacuagcaggaaaugcauuuacagcaggcaaaauaauuuuugcagcaguaccuccaaacuuuccaacugaaggauuaucaccaucacaagucacaauguucccccacauaauagucgauguucgacaacuagaaccagucuuaauaccauuacccgacguaagaaacaauuucuaccacuauaaccaaucaaacgauuccacuauaaaauuaauagcaauguuauacacaccucucagagcuaacaaugcaggagaagaugucuuuacaguuuccugccgaguacuaacaagaccaucacccgauuuugacuuuaucuuucuaguacccccaacaguagaauccagaaccaaaccuuuuacaguaccaauuuuaacaguagaagaaaugacuaacucacgauuucccauaccacucgaaaaacuuuuuacaggccccucuggcgcauucguaguacaaccacaaaacggaagauguacaacagacggugucuuauuaggaacuacacaauuauccccugucaauauuugcacauucagaggagacgucacacacauagcaggauccagaaauuauacaaugaacuuagccucacuaaauuggaacaacuaugauccaacugaagaaaucccagcuccacuaggaacaccagacuuuguagguaaaauacaaggaguucuuacacaaacaaccaaaggagacggcucaacgagaggacacaaagccacaguauacacaggcuccgcuccauuuacaccaaaauuaggaucaguacaauuuucaacagauacugaaaacgacuuugaaacacaucagaauacaaaauuuacaccaguuggaguuauccaagacggaucaacaacacauagaaacgaaccacaacaauggguauuacccucauauuccgguagaaacguacauaauguacaccuagccccagccgucgcaccuacauuuccaggagaacaacuccuauucuuucgaucuacaaugccaggaugcucaggauauccaaauauggacuuagauugccuucucccccaagaauggguacaacauuuuuaucaagaagcugcaccugcacaaucagacguagccuuauuaagauuuguaaacccagacaccggcagaguacuauuugaaugcaaacuacauaaaagcggauacguaacaguagcucacacaggacaacacgauuuaguaauaccuccaaaugguuauuucagauuugauuccuggguaaaccaauuuuacacauuagcaccaaugggaaaugguacaggaagaagaagggcauuauaa

SEQ ID NO: 31421 - RNA, 1623 nt, Artificial Sequence
  derived and/or modified sequence opt6 from VP1__Norovirus__AFJ21397
augaaaauggcuucaucagaugcuaaucccucagacggaaguaccgcuaacuuaguuccugaaguaaauaacgaaguaauggcacuagaaccaguaguaggugccgcaauugcagcaccuguagccggacaacaaaauguaauagauccauggauaagaaauaacuuuguacaagcaccaggaggugaauuuacaguaucaccacguaacgccccaggagaaauacuauggucagcuccauuaggaccagaucucaauccauauuuaucacaccuagcaagaauguauaauucauaugcuggaggauuugaaguccaagucauacuagcagguaaugcuuuuacagcaggaaaaauuauauucgcagccguaccaccaaauuucccuacagaaggcuuaucuccaucacaaguaacaauguucccacacauaauaguugacguaagacaauuagacccaguauuaauuccucuaccagauguacgcaacaauuucuaucacuauaaucaaucuaaugacccaacaauaaaauuaaucgcuauguuauauacaccauuaagagcuaauaaugcuggagacgauguauuuacaguaucauguaggguauuaacuagaccuucaccagacuucgacuuuauauuucuagucccaccaacaguagagaguagaacaaaaccauucucaguaccuauacuaacaguagaagaaaugacuaacucacguuuuccaauaccauuagaaaaauuauucaccggaccaucuucugcauuuguaguacaaccacaaaauggacgcugcaccacagacggaguacuacuaggcaccacacaauuaucuccaguaaauauaugcacauuuagaggugacgucacacacauagcuggaacacaagaauacaccaugaacuuagcaucucaaaacuggaacaauuaugauccaacagaagaaauaccagcaccauuaggaacuccagacuuuguagguaaaauacaaggcguacuaacucaaacaacuagaggagacggauccacacgaggacauaaagccacaguaucuacaggaucaguacauuuuacaccuaaauuaggaaggauccaauucucuacagacaccucuaacgauuucgaaacaggacaaaacacaagauucacaccaguaggaguuguucaagacgguucaacaacacaucaaaaugaaccacaacaauggguacuaccaaauuacucuggcagagauucccauaacguacacuuagcaccagcagucgcacccucauuccccggagaacaacuacucuuuuuucguucuacaaugcccggaugcucagguuacccaaauaugaaccuugauugucugcucccacaagaauggguacaacacuucuaucaagaagcagcacccgcacaaucagauguagcacuuuuaagauucguuaauccagauacuggaagagucuuauucgaaugcaaacuucauaaaucaggauaugucacuguagcacacacaggccaacacgaucucguuauaccgccaaacggauacuuucgauuugauuccuggguaaaucaguuuuacacacuagcaccuaugggaaauggaacagguagaagacgagcauuauaa

SEQ ID NO: 31422 - RNA, 1623 nt, Artificial Sequence
  derived and/or modified sequence opt6 from VP1__Norovirus__AFJ21398
augaaaauggcuagcaaugacgccaauccaucugauggauccgcugcuaaccuagucccagaaguaaacaaugaaguaauggcacuugaaccuguaguaggagcagccauagccgccccaguagccggacaacaaaauguaauagauccauggaucagaaauaauuuuguacaagcaccuggaggagaauuuaccguuagcccucguaacgcaccaggagaaauacucuggucagcuccauuaggaccagacuuaaauccauaccuaucucauuuagcaagaauguacaauggauacgcagguggauuugaaguccaaguaauuuuagcaggaaacgcuuucacagcaggaaaaauaauauucgcugcaguaccaccaaacuucccaacagaaggacuauccccaucucaaguaacuauguuuccucauauaauaguugacguacggcaacuggaacccguacucauaccauuaccagauguaagaaauaauuucuaucacuacaaccaaucuaaugacucaacuauaaaacuuauagccauguuauacacuccauuaagagcaaauaaugcaggcgaagacguuuuuacagucucaugucgcguacuuacacgaccaucuccagauuuugacuucauauuucuaguuccaccuacuguagaaucacgcacuaaaccauuuacaguaccaauccuaacugucgaagaaaugaccaacucaagauuucccauaccauuagaaaaauuauucacaggacccucaucagcauucguuguacaaccacaaaauggaagauguacaacagacggaguauuacuagggaccacucaauuaucuccagucaauauauguaccuuuagaggagacguaacacauauagcaggaucccgaaacuacacuaugaauuuagcuucauuaaauuggaacaacuacgauccaacagaagaaauaccagcaccauuaggaacaccagacuuuguagguaaaauucaaggaguacuaacccaaacuacuaaaggagauggaucaacaagaggucauaaagcaacaguauauaccggaucagccccauucacaccaaaauuagguucaguacaauucucuacagauacagaaaacgauuucgaaacucaucaaaacacaaaauucacuccaguaggcguaauucaagauggagguacaacacauagaaaugaaccucagcaauggguacuaccaucauauuccggaagaaauguucccaacguacacuuagcuccagcaguugccccaacauuuccaggggaacaacuauuauucuuucgaucgacaaugccaggauguuccgguuauccaaauauggauuuagacugucuacuuccacaagaauggguacaacacuuuuaucaagaggcagcaccugcacaaucagacguagcacuauuaagauuuguuaauccagacacaggacgaguauuauuugaaugcaaacuacauaaauccggcuauguaacaguugcacacacaggacaacaugaucuugucauacccucaaaugguuacuuucgauuugauucaugggucaaccaauuuuacacucuagcaccuaugggaaauggaacuggacgacguagggcauuauaa

SEQ ID NO: 31423 - RNA, 1623 nt, Artificial Sequence
  derived and/or modified sequence opt6 from VP1__Norovirus__AFJ21399
augaaaauggcaucaaaugaugcaucaccgucagauggaucagcugcaaaucuuguacccgaaguuaauaacgaaguaauggcacuugaaccaguaguuggagcagccauugcagccccaguagcaggacaacaaaacguaaucgacccauggauuagaaauaauuucguacaagcaccuggaggugaauuuacaguaucuccgcguaaugcuccaggagaaauacuauggagugccccacuaggaccagaccuaaauccauacuuaucacaucuagcaaggauguacaauggauacgccggcggauuugaaguacaaguaauauuagcaggaaaugcguucacugcaggaaaaauuauauuugcugcagucccaccuaacuuucccacagaaggucuaucacccucucaaguaacuauguuuccacacauaaucguugacguaagacaacuagaaccaguacucauaccauuaccagacguaagaaauaauuucuaccacuauaaucaaucuaaugacucaacaauaaaacuaauugcaaugcuauauacaccauuacgugcaaacaaugcaggagaagacguauucacaguauccugcagaguauuaaccagacccucaccugacuuugacuuuauuuuuuuaguaccacccaccguagaaucucgaacaaaaccauucacaguuccuauacuaacuguagaagaaaugacaaacucuagauuuccaauuccacuagaaaaacuauucaccggaccaucaggagcauucguuguacaaccucaaaacgguagaugcaccacagauggaguacuguuaggaaccacacaauuauccccaguaaauauauguacauuuagaggagacguaacacacauugcaggauccagaaacuacacaaugaauuuagcagcucuaaacuggaacaacuacgaccccaccgaagaaauaccagcaccacuaggaacaccagacuucguaggaaaaauucaaggcguuuuaacacaaacaaccaaagccgauggaucaacaagaggucauaaagcaacuguauauaccggcucagcagacuuuacuccaaaauuaggcucaguacaauucucaaccgauaccgaaaaugauuucgaaacucaccaaaacacaaaauucacacccgucggaguaauacaagacggaaacacuacacacagaaacgaaccgcaacaauggguauuaccaucauauucuggacgaaauguacacaauguacaucucgcaccagcagucgcaccaacuuuuccaggagaacaacuacuuuucuuuagaucuacaaugccaggaugcucuggauauccaaauauggaccucgacugcuuauuaccacaagaauggguacaacauuuuuaccaagaagcugcaccagcacagucagacguagcauuauuaagauuuguuaaucccgauacagguagaguauuauuugaaugcaaacuacauaaaucaggcuauguuaccguagcacauacaggacaacacgauuuaguuaucccacccaacgguuacuucagauucgauucauggguuaaucaauuuuauacacuagcaccaaugggcaauggaacuggaagaagaagggcgcuauaa

SEQ ID NO: 31424 - RNA, 1623 nt, Artificial Sequence
  derived and/or modified sequence opt6 from VP1__Norovirus__AFJ21400
augaaaauggcaucaaacgaugcuaauccaucagauggaucugccgcaaaccuuguaccagaaguaaacaacgaaguaauggcauuagaaccaguuguaggugcagccauagcugcuccaguagcaggccaacaaaauguaauugauccauggauuagaaauaauuucguacaagcgccuggaggagaauuuacaguaucaccccguaaugcaccuggagaaauacuauggucagcaccacuaggaccagaccuuaauccauauuuaucccauuuagcaagaauguacaaugguuacgcuggaggauucgaaguacaaguaauuuuagccgguaaugcauuuacagcaggaaaaauaauauucgccgcuguaccaccaaacuuuccaacagaaggacucucaccuucacaaguaacuauguucccacauauaauaguagacguuagacaauuagaacccgugcuaauaccccuaccagacguacgaaacaauuucuaucacuauaaucaaucuaaugacucaacaauaaaauuaauagcaauguuauauacaccauuaagagcuaacaaugcaggagaagauguauuuacaguuucauguagaguauuaacuagacccagcccagauuuugacuuuauauucuuaguuccaccaacaguagaaucgcgaacuaaaccauucacaguaccaaucuuaacuguagaagaaaugaccaauucaagauuuccuauuccacuugaaaaacuuuucacaggaccaucaucagcauucguaguccaaccacaaaacggcagauguacuacagacggaguuuuauuaggcacaacacaacuuucaccaguuaauauaugcacauuucgcggagauguaacucauauagcaggaucaagaaauuacacaaugaauuuagcaucacuaaacuggaauaauuaugauccgacagaagagauaccagcaccacuaggaacacccgauuucguagguaaaauacaaggaguccuuacacaaaccacaaaaggugauggcucaacaagaggacauaaagccacaguuuacacaggaucagcacccuuuacaccuaaacuaggaagcguacaauucucaacagauacggaaaaugacuuugaaacucaucaaaacacaaaauuuacaccugucggaguaauccaagacggaggaacaacacaucguaaugagccucaacaauggguccuaccaucuuauucuggaagaaacguaccuaauguccaccuagcaccagcuguagcaccaacauuuccaggcgaacaacucuuauuuuucagaucaacaaugccaggcuguucuggauacccuaacauggauuuagauuguuuacuaccacaagaauggguacaacacuucuaccaagaagcugcaccugcacaaucagauguugcacuauuaagauucguaaaccccgauaccggaagaguauuauucgaauguaaacuacauaaaucaggauacguuacaguagcucauaccggucaacaugacuuaguaauaccuucaaacggauauuuuagauucgauuccuggguaaaccaauucuauacauuagcaccaaugggcaacggaacuggaagaagacgagcauuauaa

SEQ ID NO: 31425 - RNA, 1623 nt, Artificial Sequence
  derived and/or modified sequence opt6 from VP1__Norovirus__AFJ21401
augaaaauggccagcaaugaugcaaacccaucagauggcucagcagcaaauuuaguaccagaaguaagcaaugaaguuauggcccucgaaccaguaguaggugcagcaauagcugcaccagucgcaggacaacaaaauguuaucgacccauggauucgcaauaacuuuguacaagcaccaggaggagaauuuacaguauccccacgaaaugcaccuggggaaauauuauggucugcaccucuaggaccagacuuaaacccuuauuuaucacaccuugcaagaauguauaauggauaugcaggcggauucgaaguacaaguuauauuagcaggaaacgcuuuuacagcaggaaaaauuauauuugcugcaguuccucccaauuuuccaacugaaggauuaucuccaucacaaguuacaauguuuccacacaucauaguagaugucagacaauuagaaccaguucucauaccacuacccgauguaaggaacaauuucuaucacuauaaccaaucuaaugacagcacaauuaaauuaauagcaauguuauauacaccacucagagcuaauaaugcaggagaagacguauucacagucaguugucgaguauuaacaagaccuuccccagauuucgauuuuauauuuuuaguccccccaaccguagaaaguagaacuaaaccuuuuacgguaccaauacuaacaguagaagaaaugacaaacucgcgauuuccaauaccauuagaaaaauuauucacaggaccaucaggagcauucguaguacaaccacaaaauggaagauguacgacugacgguguccuacuagguacaacacaacuaucuccaguaaauauaugcacauuuagaggagacguaacccauaucgcaggauccagagauuacacaaugaauuuagcaucuuuaaauuggaacaauuaugacccaacugaagaaacaccagcaccuuuaggaacaccagacuuuguaggaaagauacaaggaaugcuaacacaaacaaccaaaggagauggaucaacaagaggacacaaagcuacaguauauacaggaucagcaccauuuacuccaaaauuaggauccgucagauucuccaccgacaccgaaaacgauuucgaaacacaucaaaauaccaaauuuacaccaguuggaguaauacaagacggaaguacaacacauagaaaugaaccacaacaauggguucucccaucguauucagguagagauguacauaauguacauuuagcaccagccguugcaccuacauucccaggagaacaacuccuauuuuuucgaucaacaaugccaggauguucuggauauccaaauauggauuuagauugucuacuaccucaagaauggguacaacacuucuaucaagaagcagccccagcacaaucugacgucgcauuacuacgauucguaaauccugacacaggacgcguacuauuugaauguaaacuccacaaaucaggauauguaacaguagcacacacaggacaacaugaucuaguuauaccacccaacggcuauuuucgauucgauucuuggguaaaccaauuuuacacacuagcuccaauggguaauggcacaggccguagaagagcauuauaa

SEQ ID NO: 31426 - RNA, 1623 nt, Artificial Sequence
  derived and/or modified sequence opt6 from VP1__Norovirus__AFJ21402
augaaaauggcaucaaaugaugcaaacccuucagacggaucagccgcuaaccuaguaccugaaguuucuaacgaaguaauggcauuagaaccaguaguuggugcagcuaucgccgccccagucgcuggacaacaaaacguaauagauccauggauaagaaacaacuuuguacaagcuccaggaggagaauuuaccguaucaccuagaaacgcccccggagaaauauuauggucugcaccccuaggcccugaccuaaauccauaucuaucccacuuagcccgaauguacaacggcuacgcaggaggcuucgaaguccaaguaauucuagcaggaaaugccuuuacagcaggaaaaaucauauuugcagcaguacccccaaauuuuccaacugaaggacuaucuccaucccaaguuacuauguuuccucauauaauagucgacguaagacaauuagaaccaguuuuaauuccauuaccagaugucagaaacaacuucuaucacuacaaccaauccaaugauucuacaauaaaacuuauagcaauguuauacacuccauuaagagcaaacaaugcaggagaagacguauucacaguaucaugccgcguuuuaacaagaccaucaccagauuuugacuucauauuucuaguuccaccaacaguagaaucaagaacaaaaccauucacaguuccaauauuaacaguugaagaaaugaccaacucacgauucccaauaccuuuagaaaaacuauuuacagguccuucaggagcauucgucguacaaccacaaaauggaagauguacaacugaugggguauuacuuggaacuacacaacucucaccaguaaauauauguacauuuagaggagacguaacacauaucgcuggaucuagagacuauacaaugaaucuagcaucuuuaaacuggaacaauuacgauccaaccgaagaaauaccggccccucuagguacaccagacuuuguaggaaaaauucaaggaaugcuaacacaaacaacaaaaggagauggaucuacccgaggacauaaagcaacaguauauacagguucugcaccauuuaccccaaaacuaggcucaguaagauuuucaacagauacagaaaaugacuucgaaacacaucaaaacacaaaauuuacaccaguaggaguaauacaagauggaucaaccacucacagaaaugagccacaacaauggguacucccuucauauuccgguagagauguacauaacguacaucuugcaccagccguagccccaacauuuccaggagaacagcucuuauucuucagaucaacaaugccagguugcaguggcuacccaaauauggaucuagacuguuuauuaccacaagaauggguacaacauuucuaucaagaagcagcucccgcacaaucagauguugcauuacucagauuuguaaauccagauacaggaagaguacucuuugaauguaaacuacauaaaucaggauaugucacagucgcacacacuggacaacaugaccuuguaauaccaccaaauggauauuuuagauucgauucuuggguaaaucaauucuacacacuagcuccaaugggaaaugguacuggaagacgaagagcauuauaa

SEQ ID NO: 31427 - RNA, 1623 nt, Artificial Sequence
  derived and/or modified sequence opt6 from VP1__Norovirus__AFJ21403
augaaaauggcaucaaaugaugcuaacccauccgauggaucagccgccaacuuagucccagaaguaucaaacgaaguaauggcuuuagaaccagucguaggggcagcaauagcagcaccuguagcaggacaacaaaauguaaucgacccauggauaagaaacaauuuuguacaagcaccaggaggagaauucacaguaucaccuagaaaugcuccaggagaaauauuauggucagccccacucgguccagauuuaaauccauauuuaucucacuuagcaagaauguauaacggauacgcuggaggauuugaaguccaaguaauacuagcaggcaaugccuuuacagcaggaaaaauaaucuuugcagcaguaccaccaaacuuuccgacagaaggacuuucaccuucacaaguaacgauguucccacauauuauaguugauguaagacaacuagaaccaguacuaauaccccuacccgauguaagaaacaacuucuaucacuauaaccaaucaaaugacucaacuauaaaacuaauagcaauguuauacacaccuuuaagagcaaacaaugcaggagaagauguauuuacuguaucauguagaguacuaacacgcccuucaccugauuuugauuucauuuuccuaguacccccuacaguagaaaguagaacaaaacccuuuacaguaccaauauuaacaguagaagaaaugacuaacucacgauuuccaauaccacuagaaaaacuauucacaggcccuucaggugcauuuguuguacaaccacaaaacggaagaugcaccacugacgguguacuucuagguacaacacaauuaucaccaguaaacauauguacauuccgcggagacguaacccacauugcuggauccagagauuauacuaugaaucuagccucacuuaauuggaauaauuaugauccaacagaagagauaccagcaccuuuagggacacccgauuuuguaggcaaaauacaaggaaugcucacacaaacaaccaaaggugacgguucuacacgaggccauaaagcuacuguuuauacaggaucagcaccauuuacaccuaaauuaggcucugucagauucucaacagauacagaaaacgauuucgaaacacaucaaaauaccaaauuuacacccgucggaguaauacaagacggaucaacaacacacagaaaugaaccacaacaauggguacuaccauccuacagcggacgcgauguccauaacguccacuuagcuccagcuguugcaccaacauuuccaggagaacaauuauuauuuuuucgaucaaccaugccagguugcagcggauacccuaacauggaucuagauugccuauuaccucaagaauggguacaacacuuuuaccaagaagccgcaccagcucaaucagauguagcauuacuaagguucguuaaccccgauacaggaagaguauuauuugaaugcaaacuacauaaauccggauaugucaccgucgcccacacuggacaacacgaucuuguaauaccucccaacggauacuuuagauuugauucauggguaaaucaauuuuacacuuuagcuccaaugggaaauggcacugguagaagaagagcacuauaa

SEQ ID NO: 31428 - RNA, 1623 nt, Artificial Sequence
  derived and/or modified sequence opt6 from VP1__Norovirus__AFJ21404
augaaaauggcaucuaaugacgcaaaucccuccgacggaucagccgcaaacuuagucccugaaguuucuaaugaaguaauggcacuugaaccaguaguaggagcagcaauagcagcacccguagccggacaacaaaacguuauagacccuuggauaagaaauaacuuuguacaagcaccuggcggagaauuuaccguaucucccagaaaugcaccaggcgaaauauuauggucagcaccccucggaccagauuuaaauccauaucuaucacauuuagcaagaauguauaacggcuaugcaggaggauucgaaguccaaguaauuuuagcaggaaaugcauucacagcagguaaaauaauauucgcugcaguaccaccaaauuuuccuacagaaggucuaucucccucccaaguaacaauguuuccacauauuauuguagacguaagacaacuagaacccguacuaaucccauuaccagauguaagaaacaauuucuaccacuacaaucaaucaaaugauucaacaauaaaacuuauagcaaugcucuacacuccuuuaagagcuaacaacgcaggagaagauguauuuacaguuucauguagaguacuaacacgaccgucaccagacuucgauuuuauauuuuuaguaccaccaacaguagaaucacgaaccaaacccuucacagucccaauccuaacaguagaagaaaugaccaacucuagauuccccauaccauuagaaaaauuauuuacaggcccaucaggcgcauuugucguacaaccacaaaacggaagauguacaacugauggcguacuccuaggaacaacucaauuaagcccagucaauauauguaccuuucgaggugacguuacacacauugcuggaucaagagacuauacuaugaauuuagcaucuuuaaauuggaacaacuaugaccccacugaagaaauucccgcaccacuaggaacuccagacuucguaggaaaaauacaagguauguuaacacaaacaacaaaaggcgacgguuccacuagaggccacaaagcaacaguauauacaggcuccgcccccuuuacaccaaaauuagguucaguaagauuuuccaccgacaccgaaaaugauuuugaaacucaucaaaauacuaaauuuacuccagucggaguaauacaagacgguucaacuacacauagaaaugaaccacaacaaugggucuuaccaucuuauucaggcagagauguccacaauguacaccuagcaccagcuguagcaccuacauucccaggagaacaacuauuauucuucagaucaacaaugccuggaugcucaggauauccaaauauggacuuagauugcuuauuaccacaagaauggguccaacauuucuaucaagaagcugcuccagcacaauccgauguagcacuacuaagauucguuaacccugacacuggaagaguauuauucgaaugcaaacuccauaaaucaggauaugucacaguugcacauaccggacaacaugaucuagucauaccucccaacgguuacuuuagauuugauucaugggucaaccaauucuacacauuagcccccaugggcaaugguacagguagaagaagagcauuauaa

SEQ ID NO: 31429 - RNA, 1623 nt, Artificial Sequence
  derived and/or modified sequence opt6 from VP1__Norovirus__AFJ21405
augaaaauggcaucaaacgacgcaaaucccuccgacggaucagcagcaaaccuuguaccugaagucaauaacgaaguuauggcccucgaaccagucguaggugcagccaucgcagcaccgguugcaggucagcaaaaugucauagacccuuggauacgaaauaauuuuguacaagcaccaggcggagaauuuacagucuccccuagaaaugcaccaggagaaauccuauggagcgcaccucuaggaccugaccuaaacccauacuuaucucauuuagcccgaauguauaaugguuacgcaggaggcuucgaaguacaaguaauacuagcuggaaacgcuuuuaccgcaggcaaaauaaucuuugcagcaguaccaccaaacuuuccaacagaaggccucucaccaucacaaguaacaauguucccacacauuauaguagaugucagacaacuggaaccaguacuaauuccauuaccagacguaagaaacaauuucuaucauuauaaccaaagcaaugacucuacaauaaaauuaauagcuaugcuauacacuccccuaagagcuaacaaugcaggugacgacgucuucacaguaucauguagaguacuaacacgacccucaccagacuucgauuuuauauuucuaguaccacccaccguagaaucaagaacuaaaccuuuuacuguucccauauuaacaguagaagaaaugacuaauuccagauuuccaauuccauuagaaaaacucuuuacagguccauccucagcauuuguaguccaaccacaaaacggccgaugcacaacugauggaguacuacuagguaccacacaacuauccccaguaaacauauguacauuucgaggagacguaacacacauagcaggcuccagaaacuacacaaugaaucuagcaucccuaaacuggaacaacuaugacccaacugaagaaauaccagcaccauuagguaccccggacuucguagguaaaauacaaggaguacuuacccaaacaacaaaaggagacggaucaacaagaggucauaaagcaacaguauacacaggcuccgcagauuuuacacccaaauuaggaucuguacaauucuccacagauacagaaaacgacuuugaaacccaucaaaauacaaaauucacaccagucggaguuauccaagacggaucaacaacacaccgaaaugaaccacaacaauggguacuuccaucauacaguggaagaaauguucauaauguucaccuagcaccagcaguugcaccaaauuucccaggagaacaauuauuauucuucagaucaacaaugccagguugcucuggcuaucccaauauggaucucgauugccuuuuaccacaagaauggguacaacauuuuuaucaagaagcagcucccgcacaaucugauguagcauuacucagauucguaaacccagacaccggcaggguauuauucgaaugcaaacuacauaaaccaggcuacguaacaguugcccacacuggacaacaugaccuaguuauaccucccaauggauauuuucgauuugauucauggguaaaucaauuuuacacacuagcuccaaugggaaauggagcuggaagaagaagagcucuauaa

SEQ ID NO: 31430 - RNA, 1623 nt, Artificial Sequence
  derived and/or modified sequence opt6 from VP1__Norovirus__AFJ21406
augaaaauggcaucaucugacgcuaauccaucagaugguucaacagccaaccuaguacccgaaguaaauaaugaaguaauggcccuagaaccaguaguaggagcagcuauagccgcaccagucgcaggacaacaaaauguaaucgacccauggaucagaaacaauuuuguacaagcaccuggcggagaauuuacagucuccccaagaaaugcuccuggagaaaucuuauggucugcuccacucggaccagacuuaaauccauaccuaucacacuuagcacgaauguacaacgguuaugcagguggauucgaaguccaaguaauacucgccggaaaugcauucacugcaggaaaaauaauuuucgcugcaguaccccccaauuuuccaacagaaggauuaucaccaucucaaguaacaauguucccacacauuauaguagauguuagacaacuagaaccaguauuaauaccacucccagacguaagaaauaauuucuaucauuauaaucaaucaaacgacccaacuauaaaacuaauugcaauguuauacacaccacuacgugcuaauaacgcaggagacgacguauuuacagucucuugucgaguacucacaagaccaucaccagacuuugacuuuaucuuuuuaguacccccaacagucgaaucuagaacuaaaccauucuccguaccaguacuaacaguagaagaaaugacaaauucuagauuuccaauacccuuagaaaaauuauucacaggaccaucaucugcauuuguuguccaaccccaaaacggcagauguacuaccgauggcguacuucuaggaacaacacaacuauccccaguaaauaucugcacauucagaggugacguaacacauauaccaggcucaagaaauuacacaaugaaccuugcaucacaaaacuggaacuccuaugauccaacagaagaaaucccagcaccauuaggcacacccgauuucguaggaaaaauccaaggaguauuaacacaaacaacaagaacuaacggaucaacuagaggacauaaagcaacaguauauacaggaucagcagacuuuucuccaaaauuagguagaguucaauuugcaacagauacugauaacgauuucgaaacuaaccaaaacaccaaauuuacaccaguaggagucauacaagauggaaguaccacuccacgaaaugaaccacaacaauggguccuaccaucauacucaggucgaaacauacacaauguccaccuugcaccagcugucgcaccaacauuuccaggagaacaauuauuauuuuuucgaucaacuaugcccggcuguuccggcuaucccaauauggauuuagauugcuuauuaccucaagaauggguacaauauuucuaccaagaagccgcuccagcucaaucagaugucgcauuacuacgauucguaaacccagauaccggccgcguucuauucgaauguaaauuacauaaaucaggauacguuacugucgcacacacaggacaacacgauuuaguaauaccaccuaaugguuauuucagauucgauucuuggguuaaucaauucuacacccuugcuccaaugggaaaugguaccggaagaagaagagcauuauaa

SEQ ID NO: 31431 - RNA, 1623 nt, Artificial Sequence
  derived and/or modified sequence opt6 from VP1__Norovirus__AFJ21407
augaaaauggcuuccuccgacgcaaacccaucagacggaucaaccgccaaccuaguaccagaaguuaauaacgaaguuauggcacuagaaccaguaguaggagcagccauagcagcucccgucgcuggacaacaaaauguuauagacccauggguaagaaacaauuuuguccaagcaccaggcggagaauucacaguaucaccaagaaaugcucccggagagauauuauggucagcaccucuuggaccagaccuuaauccauauuuaucucaucuagcaagaauguauaacggauacgcuggaggauucgaaguacaaguaauacuagcaggaaaugcuuuuaccgcugguaaaauaauauucgcagcuguaccaccaaauuuucccacagaaggauuaucaccuucacaaguaacuauguuuccacauauaauaguugaugucagacaacuagaaccagucuuaauuccauuaccugacguaagaaacaacuuuuaccauuacaaucaaucaaaugacccaacaauaaaauuaauugccaugcuauauacaccucuacgcgcaaauaacgcaggugaugacguauucaccgucucaugcagaguacuaacacgaccauccccagacuucgauuuuauauuuuuaguaccuccaacaguagaaagucgaacaaaaccauuuucaguaccaauauuaacuguugaagaaaugacuaauucacguuuccccauaccauuagaaaaauuauuuacaggaccaaguagugcauucguaguacaaccucaaaacggaagauguacaacagauggaguauugcuagguacaacccaacuaaguccaguaaacauauguacauuuagaggugacguaacacauauagcaggaagccacaacuacacuaugaacuuagcuucucaaaauuggaacucuuacgauccaacagaagaaauucccgcaccauuaggaacucccgacuuuguaggaaagauucaagguguuuuaacucagacaacuagaacugauggcaguacuagaggacacaaagcaacaguuuauaccggcucaacagaauucuccccuaaauuagguagaguccaauuugcaaccgacacaaauaaugacuuugaugccaaucaaaauacaaaauucacgccaguaggugucauacaagauggcggaacaacucacagaaaugaaccccaacaauggguacuucccuccuauucaggaagaaacacacauaauguacauuuagcaccagcagucgcaccuacauuuccaggcgaacaauuauuauucuuucgaucuacaaugccaggauguucaggcuauccaaauauggauuuagauugucuucucccacaggaauggguacaauauuucuaucaagaagcugcaccagcacaaucagauguagcacuacuuagauucgucaauccagauacaggaagaguacuauuugaauguaaauuacauaaaucaggauacguaacuguagcacauaccggacaacacgacuuaguaauuccaccaaacggauauuuccguuuugauucuuggguaaaccaauuuuacacacucgcaccuaugggaaauggcacaggacgaagaagagcacuauaa

SEQ ID NO: 31432 - RNA, 1623 nt, Artificial Sequence
  derived and/or modified sequence opt6 from VP1__Norovirus__AFJ21409
augaaaauggcaucauccgaugcaaacccaucagauggauccacagccaaccuuguaccugaaguuaauaacgaaguaauggcccuugaaccaguuguaggagcagccauagcagcuccagucgcaggacaacaaaauguaauagacccauggauucgaaacaacuuuguucaagccccaggaggagaauuuacaguaucuccacgcaaugccccuggugaaauacuuuggucagcaccacuaggcccagaccuaaauccauauuuaucacauuuagcaagaauguauaacgguuacgcaggaggauucgaaguacaaguaauacuagcaggaaacgccuuuacagcaggaaaaaucauauucgcagcaguucccccaaacuuuccaaccgaaggacuaucaccaucucaaguuacaauguuuccucacaucauugucgauguaagacaacuugaaccaguuuuaauaccauuaccagauguccgcaacaauuucuaccauuauaaccaaucaaacgacccgacaauuaaauuaaucgcaaugcuauacacaccacuccgagcuaauaaugcuggugaugaugucuuuacagucuccugcagagucuugacacgaccauccccagauuuugauuucauauuucuagugccaccaacuguagaaucaagaaccaaaccauucucaguaccaauccuuacaguagaagaaaugacaaauucaagauuuccaauaccacuagaaaaacuauucaccggaccaaguagugcauucguaguacaaccacaaaacggaagaugcacaacagacggaguauuacuaggaacuacacaauuaucucccguaaauauauguacauuucgaggagacgucacacauauaacagguucaagaaauuauacaaugaaccuugcaacacagaacuggaacucauaugauccaacugaagaaaucccugcaccgcuaggaacaccagacuuuguagguaaaauacaaggaguacuaacucaaacaacaagagcagaugguucaacucgaggucacaaagcaacaguauauaccgguucugccgacuucgcaccaaaauuaggcagaguacaauucgcuaccgacacagauaacgauuucgacgcaaaucaaaacacaaaauuuacucccguaggaguaauacaagauggagacacugcacacagaaaugaaccucagcaauggguauuaccuuccuacucaggucgaaacucacauaauguacaucuagcuccagcaguagcaccaacauuuccaggcgaacaacuauuauucuuuagaucaacaaugccugguugcuccggauaccccaauauggacuuagauugccuccuaccacaggaauggguacaauacuucuaucaagaagcagcucccgcucaaucugauguagcacuacuacgauucguaaacccagacacaggacgcguauuauucgaauguaaacuucauaaaucuggauacguaacugucgcucacacuggacaacacgauuuaguuauaccuccaaacggauauuuuagauucgacucaugggucaaucaauuuuauacccuagccccaaugggaaauggcacagguaggagaagagcacuauga

SEQ ID NO: 31433 - RNA, 1623 nt, Artificial Sequence
  derived and/or modified sequence opt6 from VP1__Norovirus__AFJ21410
augaaaauggcauccagugacgcaaacccaucagauggaucaacagcaaacuugguaccagaagucaauaacgaaguaauggcacuagaacccguuguaggagcagcuauagcugccccaguagccggccaacaaaacguaauagacccauggauaagaaacaacuuuguacaagcaccagguggagaauuuacaguauccccuagaaaugccccuggagaaauacucuggagugcaccacuaggucccgaccuaaauccauaucuaucucauuuagcuagaauguauaacggauaugcaggagguuucgaaguacaaguaaucuuagcaggaaacgcauuuaccgcaggaaaaaucguuuucgcagccguucccccuaauuucccuacagaaggacucaguccaucccaaguaacaauguucccacacauaauaguagauguucgacaauuagaaccaguacuaauucccuuaccagauguaagaaacaacuuuuaccauuauaaccaaucaaaugauccuacaauaaaacuaauagcaaugcuauacacuccacuaagagccaauaacgcaggagaugauguauuuacaguauccuguagaguccucacaagaccaucucccgauuucgacuuuauauuuuuaguuccaccaacaguagaauccagaacuaaaccauucucaguaccuauacucaccguugaagaaaugacaaacuccagauuuccaauuccacuugaaaaacuauuuacaggaccaucaucagcauucguuguccaaccacaaaacggaagauguacaacagauggaguuuuacuuggcacaacccaacugucaccuguaaauaucugcacauuucgaggagauguuacacauauagcaggaucacacaauuauacuaugaauuuagcaucacaaaacuggaacucauaugaucccacugaagaaauaccugccccucuaggaacacccgacuucguagguaaaauacaaggaguacuaacccaaacaacaagaacugaugguucaacccgaggccacaaagcaacaguauauaccggcucugcagaauuuuccccaaaauugggaagaguacaauucgcuaccgauacaaauaacgacuuugaugcuaaucaaaauacaaaauuuacuccuguaggaguuauacaagacggaggaacaacucauagaaaugaaccacaacaauggguucuaccaaguuauucaggucgaaauacacauaacguacaccuagcaccugcaguugcccccacauuuccaggagaacaauuacuauucuuuagaucuacaaugccaggcugcucaggauacccaaauauggaccuagacugccuauuaccccaagaauggguacaauauuucuaucaagaagcagcaccagcacaauccgacguagcucuacuacgauucguuaacccagacacaggcagaguacuauucgaaugcaaacuacauaaaucaggauacguaacaguagcacacacaggacaacacgaucuaguaauaccaccaaauggauauuuucgauucgauaguuggguaaaucaauuuuacacacuagccccaaugggaaauggaacuggaagaagaagagcacuauaa

SEQ ID NO: 31434 - RNA, 1623 nt, Artificial Sequence
  derived and/or modified sequence opt6 from VP1__Norovirus__AFJ21411
augaaaauggcaucaucagaugccaacccaagcgacgguucaacagcaaacuuaguaccugaaguuaacaaugaaguaauggcacucgaaccaguuguaggagcagccauagcagcaccagucgccggccaacaaaauguaauugacccuuggauaagaaauaauuucguacaagcaccaggcggagaauuuacaguaucaccucguaacgcccccggagaaauacuauggucagccccacuuggucccgauuuaaauccauauuuaucucaucuugcaagaauguacaacgguuaugcaggcggauucgaaguacaagucauacuagccggaaaugcauuuacagcagguaaaauaguuuucgccgccguucccccaaacuuuccaacagaaggauuaucaccaucacaaguuacuauguuuccacacauaauagucgacguaagacaacuagaacccguacuuauaccauuaccugacguaagaaauaauuuuuaucacuacaaucaaucuaaugaccccacaaucaaacuuauagcaaugcucuacacaccuuuaagagcaaacaaugcaggugacgauguauuuacaguaucauguagaguccuuacuagacccucuccugacuuugacuucauauuucucguaccaccuacaguugaaucacgcacuaaaccauucuccguacccauucuuacaguagaagaaaugaccaauucaagauuuccaauaccccuugaaaaauuauuuacaggaccaucaucagccuucguaguacaaccccaaaacggcagauguaccacagacggaguauuacuaggaacaacacaacuuucaccagucaacaucuguaccuuuagaggagacguaacacauauagcuggcucucacaauuacacaaugaaucuagcaucacaaaauuggaacucauacgauccaaccgaagaaauaccagcaccucuaggaacuccugacuuuguaggaaaaauccaaggaguguuaacacaaacuacaagaacagacggcuccacaagaggacacaaagcaacuguauauacaggaucugcagaauuuaguccaaaacuaggaagaguccaauucgcaaccgacacaaacaacgauuuugacgcaaaucaaaauacaaaauucacaccaguuggaguaauacaagacggaggcacuacacaccgaaacgaaccacaacaauggguacuuccaucauauucaggccgcaauacccauaacguacacuuagcaccugcaguagcaccuacauuucccggagaacaacuccuauucuuccgaucaacaaugccuggauguuccggcuaucccaauauggauuuagauugccuacuaccacaagaauggguacaauauuucuaccaagaagcagcaccagcacaaucagaugucgcacuauuaagauuugucaauccugauacaggcagaguauuauuugaaugcaaacuucacaaaucaggauauguaacaguagcccacacaggacaacaugaucuagugauaccacccaauggauacuuccguuucgacucuugggucaaccaauuuuacacauuagcccccaugggcaacggcacuggaagaagaagagcacuauaa

SEQ ID NO: 31435 - RNA, 1623 nt, Artificial Sequence
  derived and/or modified sequence opt6 from VP1__Norovirus__AFJ21413
augaaaauggcaucaucugacgcaaacccuucagacggcucaacagcuaauuuaguacccgaaguaaacaaugaagucauggcacuagaaccaguuguaggagcugcaauagcagcuccuguagcaggacaacaaaauguaauagacccauggauucgcaacaacuuuguacaagcaccuggaggagaauucacaguaucacccagaaaugcaccaggcgaaauauuauggucagcaccuuuagguccagaucuuaacccauauuuaucgcacuuagcaagaauguacaacggauacgcuggaggauuugaaguacaaguaauuuuagcaggaaaugcauucacagcaggaaaaauaguauuugcagcuguaccaccaaauuuuccaaccgaaggucuaucaccaucacaaguaacuauguucccacauauaauaguagauguacgucaauuagaaccaguccucauacccuuacccgauguaagaaauaacuucuaccauuauaaccaaucaaacgacccaacuaucaaauuaaucgcaaugcuauauaccccauuaagagcaaacaaugcuggcgacgauguauuuacaguaucuuguagaguccuaacacgaccuucuccagacuuugauuucauauuucuuguuccuccaacaguagaaucaagaacuaaaccauuuucagucccaauauuaacaguagaagaaaugacuaacaguagauuuccaauaccuuuagaaaaauuauuuaccggacccuccagcgcauucguaguucaaccacaaaacggaagaugcacaacagauggagucuuacuagguaccacacaacuuucuccaguaaauauaugcacauuuagaggagacguaacacauauagcugguucgcauaauuacacuaugaaucucgccucucaaaacuggaacucauacgacccaacagaagaaaucccagcaccacuagguacacccgacuuuguugguaaaauacaaggaguucuaacacaaacuacaagaacagacgguucaacaagaggacacaaagcaacaguauauacagguucagcagaauuuucaccaaaacuaggccgaguacaauucgccacagacacaaacaacgauuuugaugcaaaucaaaacaccaaauucacuccaguaggaguaauacaagaugguggcacaacgcacagaaaugaaccacaacaauggguucuaccaaguuacuccggaagaaacacacauaauguacaucuugcaccugcaguagcaccuacauuuccaggagaacaacuucucuucuuuagaucaaccaugccaggaugcagcgguuauccaaacauggauuuagauugcuuacuaccccaagaauggguucaauauuucuaucaagaagccgcaccagcacaaucagauguugcauuauuaagauuuguuaauccugauacuggaagaguacuauucgaauguaaacuacauaaaucaggauacguaacaguugcacacacaggucaacacgauuuaguaaucccuccaaauggauauuucagguucgauuccuggguaaaucaauucuauacacuagccccaaugggaaauggaacaggaagaagaagagcacuauaa

SEQ ID NO: 31436 - RNA, 1623 nt, Artificial Sequence
  derived and/or modified sequence opt6 from VP1__Norovirus__AFJ21414
augaaaauggcauccucagaugcaaacccuagugauggaucaacugccaauuuaguaccagaaguaaacaaugaaguaauggcacuagaacccguagucggagccgccauagcagcgccaguugcuggacagcaaaauguaauagauccauggauuagaaauaacuuuguacaagcacccggaggagaauucaccguuucuccacgaaacgcuccuggcgaaauauuaugguccgccccauuaggaccagacuuaaauccauacuuaucccaccucgcaagaauguacaauggauaugccggagguuucgaaguucaaguaauauuagcuggaaacgcuuucacugcaggaaaaauaauauucgcugccguaccaccaaacuuuccaacagaaggacuaucacccucucaaguuaccauguucccacacauaauaguagauguacgacaacuagaacccguacuaauaccucuaccagauguacguaacaauuuuuaccacuauaaccaaaguaaugacccaaccauuaaauuaauagcaauguuauacacuccucucagagcuaacaaugcaggcgaugauguauuuacuguaucuugucgaguacucacuagaccaagucccgacuucgauuuuauauuuuuaguuccaccaacuguagaaucuagaacaaaaccuuucucuguacccguacuaacugucgaagaaaugacaaacaguagauucccaauacccuuagaaaaacuauucacaggaccuucaucagcuuucguaguccaaccucaaaacgguagaugcacuacagacggaguauuacucggcacaacacaauuaaguccaguaaauauauguacauuuagaggugauguuacacauauaccaggaucacgaaauuauacaaugaaccuagcaucucaaaacuggaacucauaugauccaacagaagaaauaccagcaccauuaggaaccccagacuucguaggaaaaauacaagguguauuaacacaaacuacacgaacaaauggaucaacacgaggacacaaagcaacuguauauacaggaucagcagauuuuucaccaaaacuaggacgcguacaauucgcaaccgauacagacaaugauuuugaaacaaaucaaaacacaaaauucacaccagucggaguaauacaagacggaucaacuacaccaaggaaugaaccccaacaauggguuuuaccaucauacucagguagaaauauucauaauguacaccuagcaccagccguagccccaaccuuuccaggagaacaauuauuauucuuuagaucaaccaugccaggaugcucuggcuacccaaacauggaucuagauuguuuacuuccgcaagaguggguacaauacuuuuaucaagaagcagcuccagcacaaucagacguugcacuacuacgauucguuaauccagauacuggucgcguauuauuugaaugcaaacuacauaaaucuggauacguaacaguagcccacacuggucaacaugaucuaguaauuccucccaauggauauuuuagauucgauucauggguaaaucaauuuuacacacuagcuccaauggguaauggaacaggacgaagacgagcucucuaa

SEQ ID NO: 31437 - RNA, 1623 nt, Artificial Sequence
  derived and/or modified sequence opt6 from VP1__Norovirus__AFJ21415
augaaaauggcaucaucugaugcaaacccaagugacggaucaacagcaaacuuaguaccagaaguuaacaaugaaguaauggcacuagaaccaguuguaggagccgcaauagcugccccaguagcuggucaacaaaauguuaucgacccauggauacgaaauaacuuuguucaagcaccaggaggagaauuuacaguaucacccagaaacgcuccaggagaaauauuaugguccgcaccauuaggaccagaucuaaacccauaucuaucacacuuagcccguauguauaacgguuacgcaggaggcuucgaaguacaagucauauuagcagguaacgcauuuacagcaggcaaaauuguauucgcugcaguaccaccaaauuuucccacagaaggacuaucuccaucacaaguuacaauguuuccacauauaauuguugacguaagacaacuugaaccuguucucauacccuuaccugauguacguaauaacuucuaucacuauaaccaaucaaaugacccaacuauaaaauuaauagcuaugcucuauacaccgcuacgagcaaacaacgcaggagacgacguauucacugucucaugcagaguauuaacacgaccuucuccagacuuugacuuuaucuuucucguaccacccacaguagaaucacgcacaaaaccauucucaguaccuauauuaaccguugaagaaaugacuaauucaagauuucccauaccauuagaaaaacuauuuacaggaccaucuucagccuucguuguacaaccccaaaacgguagauguacaaccgacggaguacuacuagguacaacccaauuaucaccaguuaacauauguacauuuagaggagacguaacacauauagcugguucacacaauuauacaaugaaccuugcaucacaaaauuggaacucuuacgauccaacagaagaaaucccagccccucuaggaacaccagacuuugucggcaaaauucaagguguauuaacccaaacuacaagaaccgacggauccacuagaggacacaaagcaacuguauauacagguucagcagaauucucaccaaaacucggccgcguacaauuugcuaccgacaccaauaacgauuuugaugccaaucaaaacacaaaauucaccccagucggagucauucaagacggugguacaacacacagaaaugaaccacaacaauggguucuaccuucauacucuggaagaaauacacauaauguacaccuugcuccagcaguagcaccaacuuuccccggagaacaauuacuuuuuuuuaggucuaccaugccaggaugcucuggauacccaaauauggauuuagauugccuuuuaccccaagaauggguacaauauuucuaccaagaagccgcaccugcucaaucagacguagccuuauuaagauucgucaacccagacacuggaagaguauuauucgaaugcaaacuucacaaaucaggauacguaacugucgcacauacaggacaacaugaccucgucauaccacccaacggauauuucagauucgacucaugggucaaucaauuuuacacuuuagcuccaaugggcaauggaacaggacgucgaagagccuuauaa

SEQ ID NO: 31438 - RNA, 1623 nt, Artificial Sequence
  derived and/or modified sequence opt6 from VP1__Norovirus__AFJ21416
augaaaauggcauccucugacgcuaauccuuccgacggcuccacugcaaacuuaguaccugaaguaaacaaugaaguuauggcccuugaaccaguaguaggagccgcuauugcugcaccaguagcaggacaacaaaauguaauagacccauggauaagaaauaacuuuguacaagccccaggaggagaauuuacaguaucaccaagaaaugccccaggugaaauauuauggucagcaccauuagguccagaucucaauccauaccuaucacacuuagcacgaauguauaacggauacgcagguggauucgaaguacaaguaauacuugcaggaaaugcauuuacagcaggaaaaauaauauucgcugccguaccaccaaacuuuccuacugaagguuuauccccaagccaaguuacaauguucccacacauaauaguagacgucagacaacucgaacccguauuaauuccauuaccagacguaagaaauaauuuuuaccacuauaaccaaagcaacgacccaacuaucaaacuaaucgcuauguuauacaccccauuacgagcaaauaaugcaggagacgauguauucacaguaucaugccgaguucuaacacgucccucuccagauuucgacuucauauuuuuaguaccaccaaccguugaaucaagaacaaaaccauucucaguaccuguccucaccguagaagaaaugacaaacucaagauuucccauuccacuagaaaaacuauucaccggaccuucaucggcauuuguuguacaaccacaaaacggacgauguacaacugauggaguucuacuugguacaacucaacuaucaccaguuaauauauguacauuuagaggagacguaacucauauaccaggaucuagaaacuacacaaugaauuuagcuagccaaaacuggaacucuuaugacccuacugaagaaaucccagcuccauuagguaccccagacuuuguagguaaaauacaaggaguacucacacaaaccacuagaacaaacgguuccacaagaggacauaaagcuacuguauauaccggaucagccgacuuuuccccaaaacuaggaagaguacaauucgcaacagacacagauaaugauuucgaaacaaaucaaaauacuaaauucacuccagucggggucauacaagaugguucuacuacaccgaggaaugaaccacaacaauggguguuaccaucauauucuggacgaaauauacauaacguucaucuugcuccggcaguagcacccacauucccaggagaacaacuacuauuuuuucgaucaaccaugccaggaugcucaggcuauccuaauauggaccuugauugucuacuaccacaagaauggguacaauauuucuaucaagaagcagcacccgcacaaucagauguagcacuauuacgauucguaaaccccgauacuggaagaguacuauuugaaugcaaauuacauaaaucaggauauguaacaguagcacacacaggacaacaugauuuaguaauuccgccuaacggauacuuuagauucgauucauggguaaaucaauuuuauacucuugcacccaugggaaaugggacaggacgucgacgugcauuauaa

SEQ ID NO: 31439 - RNA, 1623 nt, Artificial Sequence
  derived and/or modified sequence opt6 from VP1__Norovirus__AFJ21417
augaaaauggcuucauccgacgcuaacccaucagauggaucaacagcaaaccuuguacccgaaguaaauaaugaagucauggcauuagaaccaguaguaggugcagcaaucgcagcuccaguagcaggacaacaaaauguaaucgacccuuggauacgaaauaauuucguacaagcccccggaggagaauuuacaguuucaccaaggaaugcaccaggcgagauauuauggucagcaccauuagguccagaucuuaauccuuaccuaucacacuuagcacgaauguauaacggauacgccggagguuucgaaguacaagucauacuagccggaaaugcauuuacugcagguaaaauagucuucgcagcuguaccaccuaacuuccccacugaagguuuaucuccaucacaaguaacaauguuuccccauauuauuguagacgucagacaacuugaaccaguacuaauaccauuacccgacguaagaaacaauuuuuaccacuauaaccaauccaaugauccaacaauaaaacuaaucgcuauguuauacacuccuuuaagagccaacaaugcaggagacgacgucuucacaguuaguuguagaguacuaacaagacccuccccagacuuugacuuuaucuuuuuaguaccaccaacaguagaaucacgaaccaaacccuucucagucccaauccuaaccguugaagaaaugacaaacucaagauuuccaauacccuuagaaaaauuauucacaggaccaaguagcgcauuugucguacaaccacaaaauggaagauguacaacagacggaguacuacuagguacaacacaacuauccccaguuaauauaugcacauuuagaggagauguaacccacauagcaggaucacacaauuacaccaugaauuuagcaucacaaaauuggaauucuuaugauccaacugaagaaauacccgccccacuaggaacaccagacuucguaggaaaaauacaaggagucuuaacacaaaccacaagaacagacggcaguacaagaggacacaaagcaacaguauacacaggcucagcagaauuuucaccaaaauuaggccgaguacaauucgcaaccgacacaaauaaugauuuugaugcaaaccaaaacacaaaauuuacaccaguaggaguuauacaagacggaggaacaacacaccgaaaugaaccacaacaauggguacuaccauccuauucgggaagaaauacacauaauguacaccuagcaccagccguugcaccaacauucccaggagaacaauuacuuuuuuuuagaucuaccaugccaggauguucagguuaucccaauauggacuuagauugccuacuaccacaagaauggguucaauauuuuuaccaagaagcagcaccagcucaaucagauguagcgcuccuaagauuugucaauccugauacuggaagaguacucuuugaaugcaaauuacauaaauccggauauguuaccguggcucacacaggacaacacgauuuaguuauaccaccaaauggauauuuuagauucgauuccuggguaaaucaauucuauacacuagcaccaaugggcaauggaacuggaagaagacgugcauuauaa

SEQ ID NO: 31440 - RNA, 1623 nt, Artificial Sequence
  derived and/or modified sequence opt6 from VP1__Norovirus__AFJ21418
augaaaauggcuucaucagacgcaaauccaagcgauggcucuacagcaaaccuaguccccgaaguaaacaaugaaguuauggcacuagagccaguaguaggcgccgcuauagcagcaccaguagcuggucaacaaaacauaauagaucccuggauaagaaauaacuuuguucaagcaccaggaggagaauuuacaguaucaccaagaaacgcaccaggagaaauauuaugguccgcaccauuaggcccagaucuaaauccauauuugucacaucuugcacgaauguauaacggauaugcaggaggauuugaaguacaaguuauccuagcaggaaaugcauuuacagcuggaaaaauaguuuucgcagcuguaccuccaaacuucccaacagaaggucuaucaccaucacaaguaacaauguucccacacauaauaguagacguacgacaacuagaacccguacuuauaccucuaccagauguaagaaacaacuucuaucacuacaaccaaucaaaugacccuacuauaaaauuaauagcaaugcuuuacacaccauuaagagcaaacaaugccggagaugauguuuuuaccgucuccugccgcguauuaacaagaccaucacccgauuucgacuuuauauuucucgucccuccuaccguugaaagcagaacaaaaccauuuuccguacccauacuaacaguagaggaaaugacaaauucucgcuuuccaaucccuuuagaaaaacuuuuuacaggaccauccucugccuuuguuguacaaccacaaaauggucgcugcaccacugauggaguacuacuaggcacuacacaauuaucaccuguaaacauauguaccuucagaggagauguaacacauauagcaggaucccacaauuacaccaugaauuuagcaucccaaaauuggaacucauacgacccaacagaagaaauaccugcaccacuaggaacaccagauuuuguuggaaaaauacaagguguucuuacacaaaccacucgaacagacgguucaacacgcggacauaaagccacuguauauacaggaucagcagaauuuuccccuaaacuaggcagaauacaauucgcaacagauacaaauaaugacuuugacgcuaaccaaaauacgaaauucacaccagucggaguaauacaagacggaggaacaacacauagaaaugaaccacaacaauggguauuaccaucauacucugguagaaauacucauaacguacaccuagcuccagcaguugcaccuacauucccaggagaacaauuauuauucuuucgcucaacacuaccaggaugcucaggauaccccaacauggaccuagauugucuccucccacaagaauggguacaauauuucuaucaagaagcagcaccagcucaaucugacguagccuuacuaagauucguaaacccugacacuggaagaguauuauuugaaugcaaauuacacaaaucuggauauguaacaguugcacacacaggacaacacgaccuaguaauacccccaaauggauauuuucgauuugacucauggguuaaccaauuuuacacacucgcuccuaugggaaauggcacaggacguagacgagcauuauaa

SEQ ID NO: 31441 - RNA, 1623 nt, Artificial Sequence
  derived and/or modified sequence opt6 from VP1__Norovirus__AFJ21419
augaaaauggcuucaucugacgcaaauccaucagauggaagcacugcaaauuuaguacccgaaguaaacaaugaaguaauggcucucgaaccgguaguuggugcugcaauagccgcacccguagcaggacagcaaaauguaaucgacccauggauaagaaauaauuuuguccaagcacccggaggagaauuuacaguaucaccacgcaaugccccaggagaaauauuauggucagcaccacuaggaccagacuuaaacccauaucuaagucaccuagcaagaauguacaacggauacgcaggaggauuugaaguccaaguaauauuagcaggaaacgcauuuacagcaggaaaaauaauauuugccgcaguuccaccaaacuuuccaacagaaggacuaucaccaagccaaguaaccauguucccucacauaauuguagauguacgacaauuagaacccguauuaauaccacuacccgacguaagaaauaauuucuaccacuacaaucaaucaaacgaccccaccaucaaacuuauagcaauguuauauacaccccuaagagccaauaaugcuggagacgauguauuuacaguaucauguagaguacuaacccguccaucaccugauuuugacuucauuuuucuuguaccaccaacagucgaaucaagaacuaaaccauucucaguaccaauccucacagucgaagaaaugacuaauucaagauuuccaauucccuuagaaaaacuuuuuacagguccaucauccacauuugucguacaaccucaaaacggaagauguacaacagauggaguccuuuuagguacaacacaauuaucaccaguuaauauauguacauuucgaggugacguaacacacauagcaggaucacacaauuauacaaugaaucuagcaucacaaaacuggaacucauacgacccaacagaagaaauaccagcuccccuuggaacccccgacuucguaggaaaaauccaaggcguacuuacucaaacaacaagaacugacgguucaaccagaggucauaaagcuacaguauauacagguuccgcagaauuuucaccaaaacuuggaagaguacaauucgcaaccgauacuaauaacgauuuugaugcaaaucaaaacacaaaauucacaccaguaggaguaauacaagauggggguacaacucaucgaaacgaaccucaacaaugggucuuaccauccuauuccggaagaaauacacauaauguccauuuagcuccagcaguagccccuacauuucccggugaacaauuauuauuuuuucgaagcacaaugccaggauguucaggcuauccaaauauggaucuagacugcuuaauaccccaagaauggguccaauauuucuaucaagaagcugcaccagcacaaucagacguagcauuauuacgauucguaaacccagacacaggacgaguauuauuugaaugcaaacuccauaaaucagguuacguaacuguagcccauacaggacaacaugauuuaguaauaccaccaaauggauacuucagauuugacaguuggguaaaucaauuuuauacauuagcacccaugggaaauggaacaggaagaagacgagcauuauaa

SEQ ID NO: 31442 - RNA, 1623 nt, Artificial Sequence
  derived and/or modified sequence opt6 from VP1__Norovirus__AFJ21420
augaaaauggcaaguucagaugcaaacccaucagacggaucaacagcaaauuuaguaccugaaguaaacaacgaagucauggcacuagaaccuguuguaggagcagcaauagcagcaccaguugcuggccaacaaaauguaauagaccccuggauacgaaauaauuuuguacaagccccaggaggugaauuuacaguuucaccaagaaaugcaccaggugaaaucuuauggagugcaccccuuggaccagaccuaaacccauauuuaucucacuuagccagaauguauaauggauacgccggaggauuugaaguacaaguaaucuuagcuggaaacgcauuuacugcaggaaaaauaguauuugcagcaguuccaccaaacuuuccuacagaaggucuauccccaucacaaguaacaauguuuccacacaucauaguagacguaagacaacuugaacccguacuuauaccucuuccagacguaagaaauaauuuuuaucauuauaaucaaucaaaugacccaacaauaaaacuaauugcaaugcuuuauacuccacucagagcaaauaacgcuggcgaugauguauuuacaguuaguuguagaguauuaacuagaccauccccugacuuugacuuuauauuucuaguaccaccuacaguugaaucaagaacuaaaccuuuuaguguaccaauacuaacaguagaagaaaugacaaacucaagauuuccaaucccauuagaaaaacuauuuacagguccaagcucagcuuuuguaguucaaccacaaaauggaagaugcacuacagacgguguccuauuaggaacuacacaacuaucaccaguuaauauauguaccuuuagaggagauguaacacauauagcagguucacacaauuacacuaugaauuuagcuucacaaaauuggaacucuuacgacccaacagaagaaaucccagcaccacuaggaacuccagacuuugucggaaaaauucaagguguucuaacccaaacuacuagaacagauggaucaacacguggacacaaagcaacagucuauaccggcucagcugaauuuucuccaaaauuaggaagaguacaauucgcaacagauacaaacaacgauuuugaugccaaucaaaauacaaaauucacaccaguaggaguaauccaagauggaggaaccacucacagaaaugaaccacaacaauggguccuaccaucauacucaggaagaaauacacacaacguacacuuagcaccagccguagcaccaacauuuccaggcgaacaacuccuauucuucagaucaacuaugcccggaugcaguggauaccccaauauggacuuagauugucuucuaccacaagaauggguacaauauuucuaucaagaggccgcaccagcacaaagcgacgucgccuuauuaagauucguuaaccccgauacaggcagaguauuauucgaauguaaacuccauaaaucaggauaugucacaguagcucacacuggacaacacgaucuagucauaccaccaaauggauacuuuagauuugacucuuggguaaaucaauucuacacauuagcacccaugggaaauggaacaggaagaagaagagcuuuauaa

SEQ ID NO: 31443 - RNA, 1623 nt, Artificial Sequence
  derived and/or modified sequence opt6 from VP1__Norovirus__AFJ21421
augaaaauggcuuccucagacgccaacccaucagacggcucuacugcuaacuuaguaccagaaguaaacaacgaaguaauggcauuagaaccaguaguaggugcagcaauagcugcucccguagcaggucaacaaaaugucauagauccuuggaucagaaauaacuuuguacaagcaccuggaggagaauuuacuguaaguccacgaaaugccccuggcgaaaucuuauggucagcuccccuagguccagauuuaaauccauaucuaucucaccuugcaagaauguauaacggauacgcaggagguuuugaaguacaaguaaucuuagcuggaaaugcuuuuacagcuggaaaaauaguuuuugcaguuguaccacccaacuucccaacagaaggccuaucucccucucaaguaacgauguucccucauauaauugucgacguuagacaauuagaaccaguuuuaauaccacucccagacguacguaacaauuucuaucauuauaaucaaucaaacgacccaacaauuaaauuaauagcaaugcuauauacuccacuaagagccaacaaugcaggagacgacguauuuaccguaucauguagaguacuaacacgaccaucaccagacuuugauuuuauauuccuaguaccaccaacaguagaaucaagaaccaaacccuuuucuguuccaauacuaaccguagaagaaaugaccaacucaagauuccccauaccauuagaaaaacucuucacaggcccaucaucagcauucguaguacaaccccaaaaugguagauguacaacagacggcguauuacucgguacaacacaacuaucaccagucaauauauguacguucagaggagacguaacacauauugccggaucacacaacuauacaaugaaucuagcaucucaaaauuggaauucauacgaccccacugaagaaauaccagccccccuaggaacaccagacuuuguuggaaaaauacaaggaguauuaacacaaacaacacgcacugauggaucaacaagaggacacaaagccaccguauauaccggaagugcagaauuuucacccaaauuaggacguguucaauucgcaacagauacaaauaaugauuucgaugcaaaucaaaauacaaaauuuacaccaguaggaguaauccaagauggaggaacaacccauagaaaugaaccacaacaauggguucucccaucuuauucaggacguaauacacauaacguucauuuagcaccagcaguagcaccaaccuuuccaggagaacaacuauuauucuuuagaucuacuaugccaggaugcucuggauauccaaauauggauuuagauugucuucugccacaagaauggguucaauauuuuuaucaagaagccgcaccagcacaaucugacguugcccuauuacgauucguaaauccagacacuggaagaguauuauuugaaugcaaacuacacaaauccggauauguaaccgucgcacacauuggacaacacgaucuaguaaucccuccaaauggauacuuuagauucgacucauggguaaaccaauuuuacacucuagcaccaaugggaaauggaaccgguagacgaagagcauuauaa

SEQ ID NO: 31444 - RNA, 1623 nt, Artificial Sequence
  derived and/or modified sequence opt6 from VP1__Norovirus__AFJ21422
augaaaauggcaaguuccgacgcaaacccaucagauggauccacagcaaacuuaguaccugaaguuaauaaugaagucauggcuuuagaaccaguaguaggagcugcaauagcagcaccaguagcuggucaacaaaauguaauagacccauggauaaggaauaauuuuguacaagccccuggaggugaauuuacaguaucuccaagaaaugcaccaggagaaauacuuugguccgccccauuaggccccgaucuaaacccauauuuaucacaccuugcaagaauguauaaugguuacgcaggaggauucgaaguacaaguuauucuagcaggaaaugcauuuacagcugguaaaaucguuuucgcggcaguucccccaaacuuuccaacagaaggcuuaucaccaucacaaguaacaauguucccacauauuauaguugauguaagacaacuagaaccuguacuaauaccuuuaccagaugucagaaauaauuucuaccacuauaaucaaucaaaugacccuacaauaaaacuaauagcaaugcuauacacaccacuacgagcaaacaacgccggagacgacguauuuaccgucuccuguagaguauuaacacgcccaucuccagauuuugauuucauauuuuuaguaccuccaacaguagaaucaagaacaaaaccuuuuucaguucccauauuaacugucgaagaaaugacuaacucaagauuuccaauaccauuagaaaaacuauucacuggacccucuagcgcauuugucguacaaccucaaaacgguagauguacuacagacgguguucuucuuggaaccacacaauuaaguccaguaaauauauguaccuuuagaggugaugucacacauauagccggaucucauaauuauacgaugaaucuugcuucacaaaacuggaauucauacgauccaacagaagaaauaccagcacccuuaggaacuccugauuucguaggaaaaauacaagguguacuaacacaaacuacacguaccgauggaagcacaagaggucauaaagcaacaguauacacagguucagcagaauucucuccaaaacuaggacgcguccaauucgcaacagauacuaauaaugacuucgaugcaaaccaaaauaccaaauucaccccagucgguguaauacaagacggaggaacuacacauagaaaugaaccacaacaauggguacuaccaucauauucugguagaaauacccauaacguccacuuagccccagcaguugcaccuacuuucccaggagaacaacucuuauucuuucgaucaaccaugccaggaugcucaggauacccaaauauggauuuagauugccucuuaccacaagaauggguacaauacuucuaccaagaagcugcucccgcacaaucugauguagcacuuuuaagauuugucaauccugauacuggaagaguauuauucgaauguaaacuacauaaaucagguuaugucacaguagcacauacuggccaacaugaccugguaauaccuccaaacgguuauuuuagauucgauucauggguuaaucaauuuuacacacuagcuccaauggguaauggcacuggcagaagaagagcauuauaa

SEQ ID NO: 31445 - RNA, 1623 nt, Artificial Sequence
  derived and/or modified sequence opt6 from VP1__Norovirus__AFJ21423
augaaaauggccuccucagacgccaauccaucagacgguucaacagcuaauuuaguaccagaagucaauaaugaaguuauggcacuagaaccaguaguaggagcagcaauagcugcacccguagcaggacaacaaaauguaaucgauccuuggauaagaaacaacuuuguacaagcuccagguggagaauuuacuguuucaccccgaaaugccccuggugaaauacuuuggucugccccauuagguccagauuuaaauccauaccucucucaucuagcaagaauguauaacggauacgcaggagguuuugaaguacaaguuauacuagcaggaaaugcauuuaccgcaggaaaaaucauauuugcagcaguacccccaaauuuuccaacagaaggauuaucuccaucacaagucacaauguucccccacauuauuguagauguacgacaacuugaaccaguacuaaucccucuaccagauguccgcaacaauuucuaucauuauaaccaaucaaacgacccuacuaucaaauuaauagcaaugcuuuacacaccacuuagagcaaauaacgccggagacgauguauuuacuguaucaugucgaguucuaaccagaccaucaccagacuuugacuucauauuucuagucccgccuacagucgaauccaggacaaaaccauucucaguuccaguauuaacaguggaagaaaugaccaacucaagauuucccauaccccuugaaaaacuuuuuaccggaccaucuucagcauuuguuguacaaccacaaaacgguagauguacuacugacggaguucuacuaggaacaacacaauuaucaccaguaaauauaugcaccuuccgaggagauguaacacacaucuccggauccagaaauuacaccaugaaucuagcaagccaaaauuggaacucuuaugauccaacagaagaaauaccugcuccucuaggaacuccugacuuuguaggcaaaauacaaggagucuuaacucaaacuacuagaacaaauggaucaacaagaggacacaaagcaaccguuuacacaggcuccgcagacuuuucaccaaaacuagguagaguacaauucgcaacagacacagacaacgacuucgaaaccaaucaaaauacaaaauucaccccaguaggaguaauccaagacggcucaacaacaccaagaaaugaaccacaacaauggguacuaccaucauauucaggacgaaauauucauaauguacauuuagcaccagcaguagccccaacauuuccaggugaacaacuauuauucuuuagaucgacaaugccaggauguaguggcuauccuaacauggacuuagauugcuuauuaccacaagaauggguucaauauuuuuaccaagaagcagcaccagcucaaucagauguugcacuucuaagauucguaaacccagacacaggacgaguauuauucgaaugcaaacuacauaaauccggauacguuacaguagcccauacaggacaacaugauuuaguuaucccaccaaacggauacuuuagauucgauucaugggucaaucaauuuuauacucuagcuccaauggguaacgguacuggacgaagaagagcauuauaa

SEQ ID NO: 31446 - RNA, 1623 nt, Artificial Sequence
  derived and/or modified sequence opt6 from VP1__Norovirus__AFJ21424
augaaaauggcaucaucagaugccaaucccucagauggcucaacagcaaaccuuguaccugaaguuaacaaugaaguaauggcauuagaaccaguaguaggagcagcaauagcagcaccaguagcaggacaacaaaacguaauagacccuuggauuagaaauaacuuuguacaagcuccaggaggagaauuuaccgucaguccacgaaaugcuccaggcgaaauauuauggucugcaccccuaggaccugauuuaaacccauauuuaucacaccuagcaagaauguauaacggcuacgcuggaggauucgaaguucaagucauuuuagccggaaaugcauuuacagcaggcaaaauaauauucgcugccguaccaccuaacuuuccaacagaaggauuaucuccaucacaaguaaccauguucccacacauaauagucgacguaagacaauuagaaccaguucuaaucccacuuccagauguuagaaauaauuucuaucauuauaaucaauccaaugacccaacaauaaaauuaauagcuaugcuuuacacaccccuacgcgcaaauaaugcaggugaugauguauuuacaguuucauguagaguauuaacuagaccuucaccugacuuugacuuuauauuucuuguaccuccaacugucgaaagccgaacaaaacccuuuucagucccaguacuuacaguagaagagaugacaaacucacgauuuccaauaccacuagaaaaacuauuuacaggaccauccagugcauucguuguccaaccacaaaauggaagauguacaacagacgguguacuauuagguacaacacaacuaucacccguaaauaucuguacauuuagaggugauguuacacauauaccagguagcagaaacuacacaaugaaccuagcaagccaaaacuggaacuccuaugacccaacagaagaaauaccagcaccacucggaacaccugauuuuguaggaaaaauacaaggcgucuugacccaaacaacacgcacuaaugguuccacacguggacacaaagcaacaguauauacagguagcgcagacuuuucuccaaaguuaggaagaguacaauucgcaacagauaccgacaacgacuucgaaaccaaucaaaacaccaaauuuaccccaguaggaguuauacaagacggaucaaccacaccaagaaaugaaccucaacaauggguuuuaccauccuacucuggaagaaauauacauaacguucaccuagccccagccguagcuccaaccuuuccaggagaacaauuauuauucuucagaucaacaaugcccggcugcucaggauaucccaauauggaucuugacuguuuacuaccacaagaauggguacaauacuucuaccaagaagcagcuccagcacaauccgacguugcucucuuaagauucguaaacccugacacuggccgaguauuauucgaaugcaaacuacauaaaucaggcuaugucacagucgcacacacuggacaacacgacuuaguuauaccaccaaauggauauuuccgauucgauucuuggguaaaucaauucuacacauuagcaccaaugggaaacggaacaggaagacgaagagcacucuaa

SEQ ID NO: 31447 - RNA, 1623 nt, Artificial Sequence
  derived and/or modified sequence opt6 from VP1__Norovirus__AFJ21425
augaaaauggcuuccucagaugcaaacccuuccgacggaucaacagcaaaucuuguaccagaagucaacaaugaaguaauggccuuagaaccaguaguaggcgcagcuauagcugcaccuguagcuggacaacaaaauguaauagacccauggauacguaacaacuucguacaagcaccugguggugaauuuacaguuucaccaagaaaugcaccaggagaaauauuauggucagcaccucuagguccagaucuaaaccccuaucuaagucauuuagcccgaauguacaaugguuacgcuggcgguuucgaaguucaaguaauacuagcaggaaaugcauucacagcagguaaaauaauauucgcagcagucccaccaaacuuuccaaccgaaggacuauccccaucucaaguaacuauguuuccccauauuauaguagauguaagacaauuagaaccaguacucauacccuuaccugacguaagaaauaacuucuaccauuauaaccaaucaaaugauccaacaauaaaauuaauugcuaugcuauacacuccacuuagagccaauaaugcaggcgaugauguauucacuguuucauguagaguauuaacaagaccauccccugacuuugacuuuauauuuuuaguaccaccaacaguagaaucaagaacaaaaccuuuuucaguuccuguauuaacagucgaagaaaugacaaauucaagauuuccaauaccauuagaaaaacucuucacaggacccaguucagcuuucguuguacaaccacaaaacggaagauguaccacagauggaguuuuacuagguacaacacaauuauccccaguuaauauaugcacguuuagaggagacguaacucauauaccaggaucaagaaauuacacaaugaaccuagcaucucaaaacuggaacaacuacgauccaacagaagaaauaccagcaccauuagguacaccagacuuuguaggaaaaauacaaggaguauuaacacaaacaacuagaacaaaugguucaacacguggacauaaagcaacaguauauacaggcucugccgacuuuucaccaaaauuaggucguguacaauuugccacagauacagauaaugacuucgaaacuaaucaaaauacaaaauuuacaccaguaggcguaauccaagauggaaguaccacaccaagaaaugaaccucaacaauggguauuaccaucauauucuggaagaaauauacauaacguucaccucgccccugcaguagccccaacauucccaggagaacaacuauuauucuuuagaucaacaaugccaggaugcucaggauauccaaauauggauuuagauugccuauuaccucaagaauggguccaauauuucuaccaagaagcagcuccagcacaauccgacguagccuuacuccgauucguaaaccccgauacagguagaguauuauucgaauguaaauuacacaaaucuggcuauguaaccguagcacacacuggacaacacgacuuaguaauaccgcccaauggcuacuuucgauucgacucauggguaaaucaauucuauacacuagcaccaaugggaaauggaacaggacgacgacgugcacuauaa

SEQ ID NO: 31448 - RNA, 1623 nt, Artificial Sequence
  derived and/or modified sequence opt6 from VP1__Norovirus__AFJ21426
augaaaauggcaaguagcgaugcaaauccaucagauggaucaacagcuaacuuagucccagaaguaaacaacgaaguaauggcacuugaaccaguuguaggagcagcuauagcugcacccguggcaggccaacaaaauguaauagacccauggauaagaaauaauuuuguacaagcaccagguggagaauucacaguauccccaagaaacgccccaggugaaauauuauggucagcaccuuuaggaccagacuuaaauccauaucuuucccaucucgccagaauguacaacggauaugcaggcggauuugaaguacaaguaauuuuagcaggaaacgcauucacagccggaaaaauaauauucgcagcuguaccaccaaacuuuccuacagaaggacuaucuccuucacaaguaacaauguucccacacauaauaguagauguccgacaacuagaaccugucuuaauaccuuuaccagacguccguaauaauuucuaucacuacaaucaauccaacgauccuacaauaaaauuaauagcaauguuauacaccccauuaagagccaauaaugcaggagaugauguuuuuacgguaucuuguagaguauuaacaagaccaucaccagacuuugauuuuaucuuuuuaguaccacccacaguagaaucacgaacaaaaccauuuucaguaccaguauuaacaguagaagaaaugacaaauucaagauuucccauaccccuugaaaaauuauuuacuggaccaaguucugcauucguaguacaaccacaaaauggaagaugcacaacugacggaguacuacucggaacaacacaacuuucuccaguaaacauuuguacauuucgaggcgacguaacucauauaccaggaucaagaaacuauaccaugaaccuagcaucccaaaacuggaacucauacgauccuacagaggaaauaccggcaccacuaggcacaccagauuuuguuggaaaaauacaagguguauuaacacaaacaacccgaacaaauggcucaacaagaggacacaaagcgacaguauauaccggaucagcagauuuuuccccaaaacuuggccguguccaauuugcaacagauacagauaacgacuuugaaaccaaucaaaauaccaaguucacaccaguaggaguuauacaagauggaagcacaacuccaagaaaugaaccucaacaauggguacuuccaagcuauuccggaagaaauauacauaacguacacuuagcaccagccguagcaccaacuuuuccaggagaacaauuacuauucuucagaucaacaaugccuggaugcucaggcuauccaaauauggaucuagauuguuuauuaccacaggaauggguacaauauuucuaucaagaagcagcaccagcccaaucagacguagccuuauuaagauuuguaaauccagauacaggacgcgucuuauucgaaugcaaauuacacaaauccggcuauguaacuguagcacauacaggucaacacgauuuaguuauuccaccaaacggauauuuccgauucgauuccuggguaaaucaauucuauacacuagcacccaugggcaauggcacaggaagaagacgagcauuauaa

SEQ ID NO: 31449 - RNA, 1623 nt, Artificial Sequence
  derived and/or modified sequence opt6 from VP1__Norovirus__AFJ21428
augaaaauggcaucuucugacgcgaauccaucagacggaucaacagcuaacuuaguaccagaaguaaacaaugaaguaauggcacuagagcccguaguaggagcagcaauagccgccccaguagcaggccaacaaaauguaaucgacccauggauaagaaacaauuuuguacaagcacccggcggagaauuuaccguauccccgagaaacgcuccaggagaaauauuauggucagcaccucuaggaccagaucuaaauccauauuuaucucaccucgccagaauguacaacggauacgcaggcggauucgaaguacaaguaauacuagccggaaacgcuuuuacagcaggaaaaauuauauucgcggcaguaccaccaaacuuucccacugaaggucucucaccaucacaaguuacuauguucccacauauaauaguugacguaagacaacucgaaccuguucuaauaccacuaccugauguuagaaauaauuucuaucauuauaaucaaucaaaugacucaacaauuaaacucauagcaaugcuauacacaccauuaagagcaaauaaugcuggcgacgacgucuucacuguaucaugucgaguucuaacaagaccaucucccgacuucgauuuuauauucuuaguuccaccaaccguagaaucaagaacaaaaccuuuuucuguaccaguacuuacuguagaagaaaugacaaauucuagauuuccaauaccacuugaaaaacuauuuacaggaccaucaucagcauuuguaguccaaccccaaaacggcaggugcacuacagacggaguacuacuaggaacgacacaacuaucaccaguuaauauuuguacauuuagaggagacguuacucauauuuccggcuccagaaauuacacuaugaaccuagccucacaaaacuggaauucuuacgacccagcagaagaaauaccagcaccgcucggaacacccgacuuuguugguaaaauacaaggaguacuaacccaaacgacaagaacaaauggaucaaccagaggccauaaagcuacagucuauacaggaagcgcugacuuuucaccaaaauuaggcagaguacaauucgcuacagacacagacaacgauuuugaaaccaaccaaaacacaaaauuuacaccaguuggcguuauacaagauggaucuacuaccccacgaaaugaaccucaacaaugggucuuaccaucauacucuggacgcaauauccauaauguacaucuagcaccugcuguugcaccuacauuuccuggcgaacaacuacuauucuuucgaucaacaaugccugguugcucaggauaucccaauauggaucuugacugccuauuaccacaagaauggguacaauacuuuuaucaagaagccgcuccagcucaaagugacgucgcauuacuaagauucguaaauccagacacuggccguguucuauuugaaugcaaacuacauaaaaguggauauguaacuguagcacauacaggacaacaugacuuaguaauacccccaaauggauauuuucgauucgauucauggguuaaucaauuuuacacucuagcacccaugggaaauggaacuggaagaagaagagcccuuuaa

SEQ ID NO: 31450 - RNA, 1623 nt, Artificial Sequence
  derived and/or modified sequence opt6 from VP1__Norovirus__AFJ21429
augaaaauggcaucaucagacgcuaacccuuccgauggauccacugcaaacuuaguaccagaaguaaauaacgaaguuauggcauuagaaccaguagucggagcagcuauagcagccccuguagcaggacaacaaaauguaauagacccauggauaagaaauaacuucguucaagcaccuggaggagaauucaccguaucacccagaaacgccccaggagaaauacucuggucagcaccucuaggaccagaccuaaacccuuauuuaucccacuuagcucgaauguauaacggauaugcaggaggauuugaaguacaaguaauauuagccggaaacgccuuuacagcuggcaaaaucaucuucgcagcaguaccaccaaauuuccccacagaaggauuaucuccaucccaaguuacuauguucccacauauuauaguagauguaagacaacuugaaccaguccuaauaccauuaccagaugucagaaauaauuuuuaccacuacaaccaaucaaacgacccaacuauuaaauuaaucgcaaugcuauacacaccauuacgagcaaacaaugcaggagaugacguauuuacaguaucaugcagaguacuaacuagaccuucgccagacuuugacuucauuuuuuuaguaccaccaaccgucgaaucacgaaccaaaccuuucucgguacccguacuaacaguagaagaaaugaccaacucaagauuuccaaucccccuagaaaaacuauucacaggcccaucaucugcauuuguaguacagccucagaauggaagauguacuacagacggaguacuauuaggaacaacccaacuauccccaguaaauaucuguacauuuagaggagacguaacacacauuccaggaucaagaaauuacacuaugaaucuagcaucacaaaauuggaauucauaugaucccacagaagaaauaccagcaccacucggaacaccagacuuuguuggaaaaauacaaggcguacuaacgcaaaccacucgaacuaacgguucaacacgaggacauaaagcaacugucuauacuggaucagcugacuucucuccgaaauuaggaagaguacaauucgccacagacaccgacaacgacuucgaaacaaaucaaaauacaaaauucacuccaguuggugucauucaagauggcucuacuacuccaagaaacgaaccucaacaauggguacuaccuucauauucaggaagaaauauccacaacguacaccuagcucccgcaguagcuccaacauuccccggagaacaacuauuauuuuuuagaucgacaaugccaggaugcucaggauauccaaauauggauuuagauugccuacuaccucaagaauggguacaauauuucuaucaagaagcagcacccgcacaaucagacguagcauuauuacgauuuguaaacccagacacaggaagaguuuuauucgaaugcaaauuacauaaaucuggauauguaacaguagcacauacaggacaacacgaucuaguuauaccaccaaauggauauuuucgauuugacuccuggguuaaucaauuuuauacuuuagcuccaaugggaaauggaacagguagaagacgagcauuauaa

SEQ ID NO: 31451 - RNA, 1623 nt, Artificial Sequence
  derived and/or modified sequence opt6 from VP1__Norovirus__AFJ21430
augaaaauggcaucaucugacgcaaacccaagugauggaucaacagcuaacuuaguaccagaaguaaacaaugaaguaauggcauuagaaccaguaguuggggccgcuauagcugcaccaguagccggacaacaaaacguaauagauccauggauacguaacaacuucguccaagcuccaggaggcgaauuuacaguuucaccaagaaaugcaccuggcgaaaucuuauggagcgcaccauuaggaccugaucucaauccauaccucucacaucuagcaagaauguacaacgguuacgcaggaggauucgaaguacaaguaauauuagcaggaaacgcuuuuacagcaggaaaaauaauuuucgcagcaguaccaccgaacuucccaacugaaggauuaucaccaucucaaguuacaauguuuccccacaucauaguagauguacgccaacuagagccaguuuuaauaccuuuaccugacguaagaaauaacuuuuaccacuacaaucaaucaaaugacccaacgauaaaauuaauagcuauguuauauacaccauuacgagcaaacaaugcaggagaugauguauuuaccgucaguuguagaguacuaacuagaccaucaccagauuuugauuuuauauucuuaguaccaccaacaguagaaucaagaacaaaaccauucucaguaccaguauuaacaguugaagaaaugacaaacucacgauucccgaucccacuugaaaaauuauuuacagguccaucaucagcauucguaguacaaccucaaaacggacgcuguaccacugacgguguacuacuaggaaccacacaacuaucuccuguaaacauauguacauuuagaggagacguuacucauauacccggaucaagaaauuacacuaugaauuuagcaucucaaaacuggaacuccuaugauccaacagaagaaauaccugcaccuuuaggaacaccagauuuuguaggaaaaauacaaggcgucuuaacacaaacuacaagaacaaacggaucaacuagaggacacaaagcaacaguauauacuggauccgccgauuucuccccaaaauuaggcagaguccaauucgccacugauacugauaaugauuucgaaaccaaccaaaacacaaaauuuacuccugucggaguaauacaagauggauccaccacaccaagaaaugaaccacaacaauggguucuuccuucuuacagcgguagaaauauacauaauguacaucuagcccccgccguugcuccaacauuuccaggagaacaacuacuguucuuuagaucaaccaugccagggugcucaggauacccaaauauggauuuagauugccuauuaccacaagaauggguacaauacuuuuaucaagaagcagcaccagcacaaucagacguagcauuauuaagauuuguaaauccagacacaggacgugucuuauuugaauguaaacuacacaaaucaggauauguaacggucgcacauacaggacaacacgaucucguaauaccgccaaaugguuauuucagauucgauaguuggguaaaucaauuuuauacccuagcuccuauggguaacggcaccggaagacgaagagcauuauaa

SEQ ID NO: 31452 - RNA, 1623 nt, Artificial Sequence
  derived and/or modified sequence opt6 from VP1__Norovirus__AFJ21431
augaaaauggcaagcucagacgcuaauccuucugauggaucaacagccaaccuaguaccagaaguaaacaacgaaguaauggcauuagaaccaguaguaggagccgcaaucgccgcaccaguagcuggacaacaaaauguaauagauccauggaucagaaacaacuuuguacaggccccaggcggagaauucacuguuucacccagaaacgcuccuggcgaaauauuaugguccgcuccacuugguccagaucucaauccauaucuaucacaucuagcacgaauguauaacggauaugccggcggcuuugaaguacaaguaauauuagcaggaaacgcauuuacagcagguaaaauaauauucgcugcaguuccaccgaauuuuccuaccgaaggacuaucaccaucacaaguaaccauguucccucauauaauaguagacguacgacaauuagaacccguucuaauaccccuacccgauguaagaaauaauuucuaucacuauaaucaaucaaaugacccuacaaucaaacucauagcaaugcuauacacaccacuacgagcaaauaacgcgggugacgauguauuuaccguuuccugcagaguacuaacacgcccuagcccagacuuugacuuuauauuucuaguaccaccuaccguagaaucuagaacuaaaccuuucucaguaccuguacuaacuguugaagaaaugacaaacucuagauuccccauaccucuugaaaaauuauuuacaggaccuuccucagccuucguuguucaaccacaaaauggccgaugcacaaccgauggagucuuacuaggcacaacacaauuaagccccguaaauauaugcacauucagaggagacguaacacauauaccaggaucaagaaacuauaccaugaauuuagcaucccaaaauuggaacucauacgauccuacagaagaaauaccugccccacuaggcacacccgauuucguaggcaaaauacaaggaguacuaacucaaacaacacgaacaaacggauccacacgcggacacaaagcaacagucuauaccggaucagcugauuuuuccccaaaacuaggaagagugcaauuugcuacagauacugauaaugauuucgaaacuaaucaaaacacaaaauuuacaccaguuggaguuauacaagacgguuccacuacaccuagaaaugaaccccaacaauggguccuaccaucauauuccggaagaaacauacacaauguacaccucgcgccugcaguagccccaacauuuccaggcgaacaauuauuauucuuuagauccacaaugccaggcugcucuggauaucccaacauggauuuagacugucuacuaccucaagaauggguucaauauuucuaucaagaggccgccccagcucaauccgacguagcucuacuaagauuuguaaauccugacaccggacguguauuauucgaauguaaauuacauaaaucaggcuacguaaccgucgcacauacaggacaacacgaccuaguaauaccacccaauggcuacuuuagauucgauuccuggguaaaucaauuuuauacacuagcaccuaugggaaauggaacaggacgaagacgagcauuauaa

SEQ ID NO: 31453 - RNA, 1623 nt, Artificial Sequence
  derived and/or modified sequence opt6 from VP1__Norovirus__AFJ21432
augaaaauggcaaguucagacgcaaacccauccgauggaucaacugcaaacuuaguacccgaaguaaauaacgaaguaauggcuuuagaaccaguugucggagcagcaauagcugccccaguagcaggacaacaaaauguuauagauccauggauacgaaauaacuuuguacaagcacccggaggugaauucaccguaucaccacgaaaugccccaggagaaauauuauggucagcaccucuaggaccugaccuaaauccauauuuaucccauuuagcuagaauguacaauggauaugcuggcgguuucgaaguacagguuaucuuagcaggaaacgcauuuacagcaggcaaaauuauuuucgcagcuguaccaccaaacuuuccuacugaaggauuaucaccaucacaaguaacaauguucccacauauaauuguagacguuagacaacuagaaccaguucucauaccacuaccagauguaagaaacaauuucuaucacuauaaccaaucaaacgacccaacaauuaaauuaauagccaugcuuuauacaccacuacgagcaaacaacgcaggagaugauguuuucacaguuucuuguagaguacuaacaagaccuuccccugacuucgacuuuauauuucuaguaccaccaaccguagaaucuagaaccaaaccuuucuccguaccaguauuaacaguugaagaaaugacuaacucaagauucccaauaccucuagaaaaauuauuuacaggcccaucaucugcauuuguaguccaaccccaaaaugguagaugcaccacggaugguguacuucuaggcacaacacaauuaucaccugucaauauauguacauucagaggagacguaacucauacccccgguucacacaauuacacaaugaaucuagcuucucaaaauuggaauucauacgauccaacugaagaaauaccagcaccauuaggaacacccgauuuugucggcaaaauacaaggaguauuaacccaaacaacaagaacuaacggaucuacaagaggacauaaagcaacaguauauacuggauccgccgauuuuuccccaaaauuaggaagaguucaauucgcaaccgacacagacaaugauuuugaaacuaaccaaaauacaaaauucaccccuguuggaguaauucaagauggaucaacaacaccaagaaacgaaccucaacaauggguacuaccaucuuauucaggacgaaauauacauaauguucaccuagcucccgcugucgcacccacauuccccggagaacaacuccuauuuuucagauccacaaugcccggauguucaggauauccaaauauggauuuagauugcuuacuaccacaagaaugggugcaauauuuuuaccaagaagcagccccagcacaauccgauguagcccuauuacgauuuguaaacccagauaccggaagaguauuauucgaaugcaaauuacauaaaucagguuauguaacaguagcccacacaggucaacacgauuuagucauuccuccuaacggauauuucagauuugauucuuggguaaaucaauucuauacacuagcuccaauggguaauggaacaggacguagacgagcauuauaa

SEQ ID NO: 31454 - RNA, 1623 nt, Artificial Sequence
  derived and/or modified sequence opt6 from VP1__Norovirus__AFJ21433
augaaaauggccucaucagacgcaaaccccucagauggaucuacagcuaacuuaguucccgaaguuaacaaugaaguuauggcacuugaaccaguagucggagcagccauagccgcaccaguagccggacaacaaaauguaauugacccuuggaucagaaauaacuuuguacaagccccaggaggcgaauucacaguaucaccccgaaaugcaccuggagaaauccuauggucagcaccccucggaccagaucuaaacccauauuuaucacacuuagcaagaauguacaacgguuacgcaggaggauuugaaguacaaguaauauuagcaggaaacgcauuuacagcuggaaaaauaauauucgcagcagucccaccaaacuucccaacagaaggacuauccccaucucaaguuacaauguucccccacauaauugucgacguccgccaauuagaaccuguacuuaucccacucccagauguaagaaauaauuuuuaucauuauaaccaaucuaacgauccuaccauaaaacucauagcaaugcuuuacacaccacuuagagcaaacaaugcaggagaugauguauuuacaguaucauguagaguauuaacacgcccaucaccagacuucgauuuuauauuucuaguaccaccuacaguugagucacgaaccaaaccuuucucaguaccaguuuuaaccguacaagaaaugacaaauuccagauuucccauaccucuagaaaaauuauuuacaggaccuucaucugcuuuuguuguucaaccacaaaacggucgaugcaccacagacggagucuuacucggaacaacccaacuuuccccaguaaauauauguacauuccgcggagauguaacacauauaccaggcucuagaaauuacacaaugaaucucgcuucccaaaacuggaacucauaugaucccacagaagaaauaccagcaccacuaggaaccccagacuuuguuggcaaaauacaaggaguauuaacacaaaccacaagaacaaauggcucaacacgcggucacaaagcuacaguauauacagggucagcagauuucucacccaaauuagguaggguacaauucgcaacagauacagauaacgauuucgaaaccaaccaaaauacaaaauuuacaccaguaggaguaauacaagacgguucaacuacaccaagaaaugaaccucaacaaugggugcucccaucauauaguggaagaaauauacauaacguacaccuagcaccagcaguagcuccuacauucccuggagaacaauuauuauuuuucagaucaacuaugccaggaugcuccggauauccaaacauggaccuagacugcuuacuaccucaagaauggguacaauauuucuaucaagaagcagcaccugcacaaucugacguagcauuauuaagauucgucaacccagacacaggacgaguacuauucgaaugcaaauuacacaaaucgggauauguaacaguagcgcacacuggacaacacgaucuaguaauacccccuaacggauacuucagauuugauucauggguaaaucaauuuuacacacuagcuccaaugggaaaugguacagggagacgacgagccuuauag

SEQ ID NO: 31455 - RNA, 1623 nt, Artificial Sequence
  derived and/or modified sequence opt6 from VP1__Norovirus__AFJ21434
augaaaauggcauccucagacgcaaaucccuccgauggaagcacagcuaauuuaguacccgaaguaaauaacgaaguaauggcacuagaaccaguaguaggagcagccauagcagcaccaguugcaggacaacaaaauguaauagauccauggauaagaaacaauuucguacaagcaccaggaggagaauucacaguaucaccacguaaugcacccggagaaauacuauggucagccccacuaggaccagacuuaaauccauaccuaucacacuuagcaagaauguauaacgguuacgcaggagguuucgaaguccaaguuauccuugcaggaaacgcuuuuacagcagguaaaauaauuuucgcagcagucccaccuaauuuuccuaccgaaggucuaucaccaucucaaguaacaauguucccacauauaauagucgauguaagacaauuagaaccaguacuuauaccucuaccagauguuagaaacaacuucuaucacuauaaccaaucaaacgacucuaccauaaaauuaauagcuaugcuuuacacuccccuaagagcaaacaacgcaggugaugauguauuuacaguaucaugccgaguucuuacacgaccaucuccagacuuugacuuuauauuucuaguaccccccacagucgaaucuagaacuaaaccauuuucaguuccuguacuaacaguagaagaaaugacuaacucucgcuuuccaauuccauuagaaaaacuuuuuacaggaccaucaagugcauuuguaguacaaccacaaaacggacgauguaccacagacggaguauuauuaggaacuacucaauuaagcccaguuaacauaugcacauuuagaggugacguuacacauauaucaggauccagaaacuacaccaugaaucuugcaagccaaaacuggaacucauacgaucccacugaagaaauaccagcaccauuagguacacccgauuuuguaggaaaaauccaagggguauuaacacaaacaacaagaacuaacgguucaacaagaggacauaaagcaacugucuacaccggaucagcagacuuuucaccaaaauuaggaagaguacaauucgcuacagauacugacaaugauuuugaaaccaaccaaaacaccaaauucacuccuguaggaguaauccaagauggcucaacuacaccaaggaaugaaccacaacaauggguacuaccuucauauuccggaagaaauauacauaauguacaucuagcaccugcaguagcaccaaccuuuccaggcgagcaauuacuauuuuuuagaaguacuaugccaggcuguucuggauaccccaauauggauuuagauugucuauuaccccaagaauggguacaauacuucuaucaagaagcagcgccagcacaauccgauguagcauuauuaagauucguaaacccagacacuggaagaguauuauucgaaugcaaauuacacaaaucaggauaugucacaguagcacauacaggccaacacgauuuaguaauaccaccaaauggauauuucagauucgacuccuggguaaaccaauuuuacacauuagccccaaugggaaauggcacaggacgucgaagagcauuguaa

SEQ ID NO: 31456 - RNA, 1623 nt, Artificial Sequence
  derived and/or modified sequence opt6 from VP1__Norovirus__AFJ21436
augaaaauggcuucaucugacgccaauccaucagauggauccacagcaaaucuuguaccagaaguaaacaaugaaguaauggcucucgaaccaguaguaggagcagcaauagcugcaccaguagcaggacaacagaauguaauagauccauggauaagaaauaacuucguacaagcuccaggaggugaauuuacuguuucuccaagaaaugcaccaggugaaauuuuauggagcgcaccauuagguccugaccuaaauccuuauuuaucccaucuagcuagaauguauaaugguuacgcaggaggauucgaaguacaagucauacuagcagguaaugcauucacagcugggaaaauaauauuugcagcaguaccaccuaacuuuccaacugaaggucucucaccuucacaaguaacaauguuuccacauauaauaguugauguaagacaacucgaaccaguauuaauaccucuaccagauguuagaaauaauuuuuaccauuacaaucaaagcaaugauccaacaauaaaauuaauagcaaugcuuuacacacccuuacgagccaacaaugcaggugacgacguuuucaccguaucuuguagaguauuaacaagacccucaccagacuuugacuuuauauuuuuaguaccuccaacaguagaaucaagaaccaaaccauuuucaguaccuguauuaacaguagaagaaaugacaaauuccagauuuccaauaccacuagaaaaauuauuuacaggucccucauccgcuuucguuguacaaccucaaaauggcagauguacuaccgacggcguacuauuaggaaccacacaacuaucaccagucaauauuuguaccuuucgcggagacguaacacauauccccggcucucgaaacuacacaaugaacuuagccucacaaaacuggaauucauaugauccgacagaagaaauaccugcaccacuaggaacaccagauuuugucggaaaaauacaagguguccuuacacaaacaacacgcacaaacggcucaacucguggccacaaagcaacaguauauacaggauccgcugacuuuucaccuaaauuaggaagaguacaauuugcaacagauacagauaaugacuucgaaacaaaucaaaacacaaaauucacaccaguuggaguaauccaagauggcucaacaacuccaaggaaugaaccacaacaauggguacuaccaucauauucaggucgaaauauacacaacguccaucucgcucccgcaguagcuccaacauuuccaggugaacaauuauuauucuuuagaucaacaaugccaggauguucagguuauccaaacauggacuuagauugccuacuaccccaagaauggguacaguauuuuuaucaagaagcagccccagcccaaucugacgucgcauuacuucgauucguuaacccagauaccggucgaguauuauucgaauguaaacuacauaaaucaggauauguuacaguagcucacacaggacaacaugaucuaguuauuccucccaauggauacuucagauucgauucauggguaaaucaauuuuacacauuagcaccaauggguaauggcaccggaagaaggcgagcauuauaa

SEQ ID NO: 31457 - RNA, 1623 nt, Artificial Sequence
  derived and/or modified sequence opt6 from VP1__Norovirus__AFJ21437
augaaaauggcaucaucagacgccaauccuucugaugguucaacagcaaaucuaguaccagaagucaacaacgaagucauggcacuagaaccuguaguaggcgcagcuauagcugcaccaguagcuggacaacaaaauguaauugacccauggauucguaacaacuuuguccaagcaccaggaggagaauuuacaguuucaccacgaaaugcuccaggagaaauauuauggucagccccauuaggaccagaucucaacccauaccuuucccacuuagcacgaauguauaacgguuaugcuggaggauucgaaguccaagucauacuagcuggaaacgcauuuacagcugguaaaaucauauuugcagccguaccaccaaauuucccaaccgaaggauuaucaccaucccaaguaacaauguuuccacacauaauaguugacguuagacaauuagaaccaguacuaauaccccuuccagauguaagaaacaauuucuaucacuauaaccaauccaaugacucaacaauuaaauuaauagcaauguuauauacccccuuacgagcaaauaacgccggagacgacguuuuuaccguaucauguagaguacuuacuagaccaucuccugacuuugacuuuauauuucuagucccaccaacaguagaaucacgaacaaaaccuuucucaguaccuguauuaacaguagaagaaaugacaaacucucgauuuccuauaccauuagaaaaacuauucacaggaccuaguucagcauucguaguacaaccccaaaacgguagauguacaacugaugguguacuacuagguacaacacaacuuucuccaguaaauauuuguaccuuuagaggagacguaacacacaucucagguucaagaaauuacacaaugaauuuagccagccaaaauuggaacucuuaugauccuacugaagaaauuccagcuccuuuaggaaccccugacuuuguaggaaaaauacaaggaguuuuaacacaaacaacacgaacaaacggauccacaagaggccauaaagcaacaguauacacagguagcgcagacuucuccccgaaauuaggcagaguacaauucgcaacagacacagauaacgauuucgaaacaaaucaaaauacaaaauucacaccaguuggaguuauacaagacggaucaacaacacccagaaaugaaccucaacaauggguccucccuuccuauucaggaagaaauauacauaauguacacuuagcacccgcagucgcaccaacauuuccaggcgaacaacuauuguucuucagaucaacaaugccaggaugcucuggauacccaaacauggaucuagacuguuuauuaccacaagaauggguucaauauuucuaucaagaagcagcaccagcucaaucagauguagcacuacuacgcuucguaaaucccgacacuggacguguauuauucgaauguaaauuacauaaaucaggauauguaacaguagcccacacaggacaacaugaucuuguuauaccaccaaaugguuacuucagauucgacucauggguaaaucaauuuuauaccuuagcaccaaugggaaaugguacaggccgucgaagagcacuauaa

SEQ ID NO: 31458 - RNA, 1623 nt, Artificial Sequence
  derived and/or modified sequence opt6 from VP1__Norovirus__AFJ21438
augaaaauggcuucauccgaugcuaacccuagugauggaucaacagcaaauuuaguaccagaagucaauaaugaaguaauggcauuagaaccaguaguaggugccgcaauagcagcaccaguugcaggacaacaaaacguaauagaccccuggauaagaaauaacuucguacaagccccaggcggugaauucacaguaucaccacgaaacgcaccaggagaaaucuuauggucagcaccucucggaccagaucuuaacccauaucuaucacaccuagcuagaauguauaacggauaugcuggaggcuuugaaguucaaguaauuuuagcagguaaugcauuuacugcaggaaaaauuauuuuugcagcaguuccaccaaauuucccaacagaaggauuaucaccuucucaaguaacaauguucccacacauuaucguagacguaagacaacuagaaccagucuuaauuccccuaccagacguaagaaauaacuucuaccacuacaaccaaucaaaugacccuaccauuaaacuaauugccauguuauacacaccauuaagagcaaacaaugcaggagacgaugucuuuacuguauccugcagaguccuaacucgaccaagcccagacuucgacuuuauauuucuaguaccucccacaguugagucaagaacaaaaccauucagcguacccguacuaacaguagaagaaaugacaaauucacgcuuuccaauaccacuugaaaaauuauucacaggacccucaucagcauucguaguccaaccccaaaauggccguugcaccacagaugguguauuauuaggaacaacacaacuuucaccaguuaacauuuguacuuuuagaggagacguaacacauauaccaggauccagaaauuacacaaugaacuuagccucucaaaacuggaacucuuaugacccaacagaagaaauaccagcaccacuaggcaccccagauuuuguaggaaaaauucaaggaguacuaacacaaaccacucguacaaauggcucuacaagaggacacaaagcuacugucuauacugguucagcagauuucucaccaaaacuuggccgaguacaauucgcuacagauacagauaacgauuucgaaacuaaccaaaauacuaaauuuacaccuguaggaguaauacaagauggaucaacaacaccuagaaacgaaccacaacaauggguauuaccaucauauaguggaagaaacauccacaacguacaccuugcaccagcaguagcacccacauuuccuggagaacaauuauuauucuuuagaucaacuaugccagggugcucuggcuaccccaauauggaucuugacugccuacuaccacaagaauggguacaauauuuuuaucaagaagccgcaccagcacaaucagacguugcacuauuaagauucguaaacccagauacaggcagaguacuuuuugaaugcaaacuacauaaaucuggauauguaacagucgcccacauaggacaauaugaucuaguuauaccaccaaauggcuauuucagauucgauagcuggguaaaccaauuuuauacauuagcaccuaugggcaaugguaccggcagaagaagagcacuauaa

SEQ ID NO: 31459 - RNA, 1623 nt, Artificial Sequence
  derived and/or modified sequence opt6 from VP1__Norovirus__AFJ21439
augaaaauggcauccagugaugcaaaucccucagaugguucaacagcaaaucuuguacccgaaguaaauaaugaaguuauggcucuugaaccaguuguuggagccgcuauugcagcaccugucgccggucaacaaaauguaauugacccauggauacgaaacaacuuuguccaagccccuggaggagaauucacaguaucaccaagaaacgcacccggagaaauuuuauggucagcccccuuaggaccagaccuaaaucccuauuuaucacauuuagccagaauguauaacgguuaugcaggagguuucgaaguccaaguaauucuagcaggaaacgcuuucacagcaggcaaaauaauauuugcugcuguacccccuaacuuuccaacagaagguuuaucaccaucucaaguuacaauguuuccacacauuauaguagacguaagacaacuagaaccaguauuaauaccucuacccgacguaagaaacaauuuuuaccauuacaaucaaucaaaugauccaaccauuaaauuaauugcuauguuauauacaccauuacgcgcuaauaaugcaggagacgauguuuuuacaguuuccuguagaguacuaacucgaccaaguccagacuuugauuuuauuuuuuuaguacccccuacuguugaaaguagaacuaaaccuuuuucaguucccguauuaacuguugaagaaaugaccaauucacgauucccaauuccauuagaaaaacucuucacaggaccaagcucugcauucguaguucaaccacaaaacgguagaugcacuacagauggaguauuacuaggaacuacucaauuaucaccugucaauauauguacauuccgaggagacguaacccacauaagugguucacgcaacuauacaaugaaccuagcaucacaaaacuggaacucauacgauccaaccgaagaaauaccagcuccuuuagguacaccagauuuuguagguaaaauacaaggagucuuaacccaaaccacuagaacaaaugguucaacaagaggacauaaagcaacaguuuauacuggcucagcagacuuuucuccaaaauuaggaagaguacaauucgcaacagacacagacaaugauuucgaaacaaaccaaaauacaaaauuuacuccuguaggcguaauacaagacggaucaacaacaccaagaaacgaaccucaacaauggguucuaccaucauacucaggacgaaauauucauaauguacacuuagcuccugcaguagcaccaacauuuccuggagaacaauuacuguucuucagaucaaccaugccaggaugcucaggauauccaaacauggaucuagauugcuuacuaccucaggaauggguacaauacuucuaucaagaagcugcaccagcucaaucagauguagcacuuuuaagauucguaaacccugauacaggacgaguauuauuugaaugcaaauuacauaaaucaggauaugucaccgucgcccacacaggacaacaugauuuaguaauaccaccaaacggauacuuuagauuugauucuuggguuaaucaauucuacacacuagcaccuaugggaaacggaacaggacguagacgcgcuuuauaa

SEQ ID NO: 31460 - RNA, 1623 nt, Artificial Sequence
  derived and/or modified sequence opt6 from VP1__Norovirus__AFJ21440
augaaaauggcaucaucugacgcaaacccuucagauggaucaacagcaaaccuaguaccugaaguaaauaaugaaguuauggcauuagaaccagucguuggagcagcaauagcagccccaguagcaggacaacaaaauguaauagauccguggauaagaaacaauuuuguacaagcaccaggaggagaauuuacaguuucaccuagaaaugcaccaggagaaauucuuuggucagcaccgcuaggaccagacuuaaauccauaccuaucucaccuugcaagaauguacaacggauacgcaggaggauucgaaguacaagucauacuugccggcaaugcauuuacagcaggaaaaauaauauuugcagcaguaccaccaaauuuuccaaccgaaggucucucaccaucacaaguaacaauguuuccacacaucaucguagauguaagacaacuagaaccaguacuaauaccccuaccagauguaagaaacaauuuuuaucacuauaaccaaucuaaugacccaacaauaaaauuaauagcaaugcuauauacuccccuaagagcuaacaaugcaggagacgaugucuuuacagucagcugcagaguucuaaccagaccaucuccugacuuugacuuuauauuucuaguaccuccaaccguugaaucuagaacuaaaccauuuuccguaccuguauuaaccgucgaagaaaugacaaacucaagauuuccaauaccacuagaaaaauuauuuacaggcccaaguucagcauucguaguacaaccacaaaacggaagauguacaacagacgguguacuccucggcacaacucaacuuucaccaguaaauauauguacauuuagaggggacgugacucacauuccaggcucaagaaauuauacaaugaaucucgcuagccaaaauuggaauucauacgaccccacugaagaaauacccgcaccacuaggaacaccagacuuuguaggaaaaauacaaggcguauuaacacaaacaacacgagcaaauggaaguacuagaggacauaaagcaacaguauacaccgguucagcagacuuuucacccaaauuaggacguguacaauuugcaacagauacagacaacgauuucgaaacaaaucaaaauacaaaauucacaccaguaggaguaauacaagacggaucaacaacaccucgaaaugaaccacaacaauggguauuaccaaguuauagcggaagaaauauacauaacguacacuuagcaccagcaguagcaccaacauucccaggugaacaacuucuauucuuuagaagcacaaugcccggaugcucuggauaucccaacauggaucuagauugcuuacucccacaagaauggguccaauauuuuuaucaagaagcagcacccgcacaaucugacguagcacuauuaagauucguuaauccagauacaggaagaguccuauuugaaugcaaacuacauaaaucugguuauguaacuguagcacauaccggacaacacgaccuagucauaccuccaaauggcuauuuucgauucgauucuuggguaaaucaauuuuauacuuuagcaccaaugggaaacggaacuggacgaagaagagcacuauga

SEQ ID NO: 31461 - RNA, 1623 nt, Artificial Sequence
  derived and/or modified sequence opt6 from VP1__Norovirus__AFJ21441
augaaaauggcaucaucugaugcaaaccccuccgauggcucuacagccaaccuaguaccagaagucaauaccgaaguaauggcauuagaaccaguugucggagcagcaauugcagcucccguugcaggucaacaaaauguuauugacccuuggauuagaaauaacuuuguacaagcacccggaggcgaauuuacugugaguccucguaacgcacccggagaaauacuuuggagcgcaccauuaggaccagaucuaaauccauauuuaucacacuuagcuagaauguacaaugguuacgcaggagguuucgaaguacaaguuauacuagcaggaaacgcauucacagcaggaaaaauaauuuucgcagcaguaccaccaaacuuuccaaccgaaggucuaucaccaucucaagucacaauguuuccacauauaauaguugacguaagacaacuugaaccaguauuaauuccauuaccugaugucagaaacaacuuuuaccacuauaaucaaaguaaugaccccacaauuaaauuaauagcaauguuauacacuccucuaagggcaaacaaugcuggagaugauguauuuacaguuucauguagaguacuuacuagaccaucaccagacuuugauuucauauuuuuaguaccuccuacagucgaaucaagaacaaaaccauucucaguaccaguacuuacaguugaagaaaugacaaacucuagauuucccauaccccuagaaaaacuauuuacaggaccaucuucagcauucguaguacaaccacaaaaugguagauguacaacagacggaguacuauuaggaacaacacaauuauccccagucaauaucuguacauuuagaggugacguaacacauauaccugguuccagaaauuacacaaugaaucuugcuucccaaaacuggaacuccuacgacccaaccgaagaaauaccagcaccauuaggaacaccagauuucguagguaaaauccaaggaguuuuaacccaaaccacuagaacaaacggaucuacuagaggacauaaagcaacaguauauacuggaucagcagacuuuuccccaaaauuaggacguguucaauuugcaacagacacagacaacgauuuugaaaccaaucaaaauacuaaauuuacacccguuggagucauacaagacggaucaacaacaccaagaaaugaaccccaacaauggguacucccaucuuauucaggacgaaauauacacaauguucacuuagccccugccguugcacccacuuuuccuggagaacaacuauuauuuuucagaucuacaaugccaggauguucuggcuacccaaauauggaucucgauugcuuauuaccucaagaauggguucaauauuucuaccaagaagcagcuccagcucaaucagaugcagcacuauuacgauucgucaauccagacacaggaagagucuuauuugaaugcaaacuacauaaaucaggcuauguaacuguagcacacacaggccagcacgaucuuguaaucccaccaaauggauauuuuagauucgauucaugggucaaucaauuuuacacauuagcaccaaugggaaauggaacaggccgaagaagagcacuauaa

SEQ ID NO: 31462 - RNA, 1623 nt, Artificial Sequence
  derived and/or modified sequence opt6 from VP1__Norovirus__AFJ21442
augaaaauggcaucuaaugacgccaacccaucagacgguucagcagcaaaccuuguaccagaaguaaauaaugaagucauggcccuagaaccaguaguuggagcagcaauagcugcaccaguagcaggacaacaaaauguuauugacccuuggauaaggaacaauuucguacaagcaccaggaggugaauucaccgucucaccaagaaacgcaccaggagaaauuuuauggucagcaccacuugguccagaccuaaauccauaucuaucccauuuagccagaauguauaacggauacgcaggaggcuucgaagugcaaguaauacuagcuggaaaugcuuuuacugcuggaaaaauaauauucgcagcugucccacccaauuucccaacagaaggauuaucaccaucacaagugacaauguuuccucauauaauaguagacguaagacaauuagaaccaguacuaauaccauuaccagacguucgaaacaauuuuuaucacuauaaucaaucuaaugacucaacaaucaaacuaauagcaaugcuauauacuccacuaagagccaauaaugcaggugaugacguauucacaguaucauguagaguuuuaacacgucccucacccgacuuugacuucauauuccuuguaccuccuaccguugaaucacgaacaaaaucauucacaguacccauucucacaguagaagaaaugacuaauucaagauuuccaaucccauuagaaaaauuauuuacagguccuucaucugcauucguaguacaaccacaaaacggcagaugcacuacagauggaguacuacuaggaaccacacaacuaagcccagucaacauauguacauuuagaggcgauguaacacacauagcagguucucguaauuacacaaugaaucuagcuucacuuaauuggaacaacuacgauccaaccgaagaaaucccagcaccauuaggaacaccagacuuuguaggaaaaauucaagguguacuaacacagacaacaaaaggagacggaucaacaagaggacacaaagcaacaguauauacagguucagcugauuuuacaccaaaacuuggaucaguacaauuuggaacagauaccgauaaugauuucgaaacacaucaaaauacaaaauuuacccccgucgguguaauacaagacggaucaacaacccacagaaacgaaccacaacaauggguacuaccaucauacucaggacgaaauguacacaauguacauuuagcuccagcaguagcuccaaauuuccccggagaacaacuccuauuuuuuagaucaacaaugccuggauguucaggauauccaaacauggaucuugacugcuuauuaccacaagaauggguacaacauuucuaucaagaagcagcaccagcacaaucagacguagcauuacucagauucguuaacccugacacaggaagagucuuauucgaaugcaaacuacauaaaucuggcuauguaacaguagcacauacuggacaacacgauuuaguaauuccaccaaauggguauuucagauucgauucauggguuaaucaauuuuacacacuagcgccaaugggaaacggagccggaagaaaacgagcccuauaa

SEQ ID NO: 31463 - RNA, 1623 nt, Artificial Sequence
  derived and/or modified sequence opt6 from VP1__Norovirus__AFJ21443
augaaaauggcgucaucagaugcuaacccgagcgauggauccacagccaacuuagucccagaagucaacaacgaaguaauggcauuagaaccaguaguaggcgccgcuauagccgcaccaguagcaggacaacaaaauguuauugacccauggauaagaaauaauuuuguacaagcuccaggaggugaauuuaccguuucuccaagaaacgcaccaggagaaauauuauggucagcaccauuaggaccagaucuaaacccuuauuuaucacaucucgcaagaauguauaacgguuaugcaggaggauucgaaguacaaguaauauuagcaggaaaugcuuucacagcagguaaaauaauauuugcagcagucccacccaacuuucccacagaaggauuauccccaucacaaguuaccauguucccacauaugauagucgacguccgccaacuagaaccuguccuaauaccauuacccgaugucagaaacaacuuuuaccacuauaaccaaucaaaugacccaacaauuaaauuaauagcuaugcucuacacaccacuucgagcuaacaaugcaggagacgauguauucacaguuucuugucgaguauuaacaagaccuucaccagacuucgauuucauauuucuuguuccaccaacaguagaaaguagaacaaaaccauucucaguaccuguauuaacuguugaagaaaugacaaauucaagauucccaauacccuuagaaaaacuauucacaggaccaucuagcgcuuucguaguacaaccacaaaacggaagaugcacuacugacggaguccuauuaggaacaacacaacuaucaccuguaaauauaugcaccuuucgcggcgacguaacacacaccccaggaucucacaauuauacaaugaauuuagcaucacaaaauuggaacucuuaugauccaacagaagaaaucccagcaccucuaggaacaccagacuucguagguaaaauucaagguguauuaacacaaacuacacguaccaacgguucaacacguggccacaaagccacaguauauacaggaucagcagauuuuagcccuaaauuaggcagaguucaauucgcaacagauacagauaaugauuucgaaaccaaccaaaauaccaaauucaccccaguaggaguaauacaagacgguagcacaacaccacgaaacgaaccucaacaguggguauuaccaagcuauucaggaagaaauauacauaauguacauuuagcaccagcaguagcaccaacuuuuccaggcgaacaauuauuauuuuuucgaucaacuaugccaggaugcucaggcuaucccaauauggauuuagauugcuuauuaccucaagaauggguucaauauuucuaccaagaagcagcacccgcacaaucugauguagcacuacuaagauucguaaacccagacacaggaagaguacuuuuugaaugcaaacuacauaaaucagguuacgucacaguagcacacacaggacaacacgauuuaguuauacccccaaauggauacuuccgauucgauagcuggguaaaucaauuuuacacacucgcaccaaugggaaauggaacuggaagacgaagagcacuuuaa

SEQ ID NO: 31464 - RNA, 1623 nt, Artificial Sequence
  derived and/or modified sequence opt6 from VP1__Norovirus__AFJ21444
augaaaauggcaucuucagacgcaaauccuucagaugguucuacagcuaaccucgucccugaaguaaacaaugaaguuauggcacuagaacccguaguaggagcagcaauagcugcaccaguagcaggacaacaaaauguaauagacccauggauacgaaauaacuuuguacaagccccaggaggugaauucacaguaucaccuagaaacgcaccaggagaaauacuuuggagcgcaccacuaggaccagauuuaaacccauauuuaucacaucuugcaagaauguacaacggauaugcaggugguuuugaaguacaaguaauacucgccggcaacgcauucaccgccggaaaaaucauauuugcagcaguaccaccaaacuucccaacagaaggauuaucaccaucacaaguaacuauguuuccacacaucauuguagacguaagacaauuggaaccuguucuaauaccauuacccgacgucagaaauaauuucuaccacuauaaccaaagcaaugauccaacaauaaaacuuauagcaauguuauacacaccacuacgagcaaauaacgcaggcgacgauguauuuacaguauccuguagaguacuaacaagaccauccccagauuuugacuuuauauuucucguaccuccaacaguagaaucacgaaccaaaccauucucaguacccauccuaacagucgaagaaaugacaaacucacgauuucccauaccacuugaaaaauuauucacaggaccaucaucagccuucguaguacagccacaaaacggaagauguacaacagauggaguacuucuagguacaacccaacuauccccaguaaauauuuguaccuuuagaggagauguaacacacacagcaggaucacacaauuacacuaugaauuuagccucacaaaacuggaacucauacgauccaacagaagaaauaccagccccacucggaacaccagauuuuguagguaaaauucaaggaguucuaacacaaaccacacgagcagacggaaguacaagaggccacaaagcaacagucuauacaggaagcgcagaauuuucaccaaaacugggucgaguacaauucgccacagauacagauaaugauuucgaugccaaccaaaauacaaaauuuacuccaguaggaguaauacaagacggaggaaccacucaucgcaacgaaccacaacaauggguacuuccaucuuauucaggaagaaauacacauaacguacacuuagcaccagcuguagcaccaacauuuccuggugaacaacuccuauuuuuuagaucuacuaugccaggauguucuggauauccaaauauggaucuagauugccuauuaccacaagaauggguacaauauuucuaccaagaagcagcuccagcacaaucagaugucgcacuacucagauucguaaacccagacaccggaagaguuuuauucgaauguaaauuacauaaaucaggauacguaacagucgcgcauacaggacaacacgacuuaguaauaccaccaaauggauauuuuagauuugauucauggguaaaucaauuuuacacccuagcacccaugggcaauggaacaggaagaagaagagccuuauaa

SEQ ID NO: 31465 - RNA, 1623 nt, Artificial Sequence
  derived and/or modified sequence opt6 from VP1__Norovirus__AFJ21445
augaaaauggcaucaucagacgccaacccauccgauggaucaaccgccaacuuggucccagaaguaaacaaugaaguaauggcucuagaaccaguaguaggcgcagcaauagcagcuccuguugcaggacaacaaaauguaaucgacccauggauaagaaauaauuucguacaggcacccggaggugaauuuacagucucucccagaaacgccccaggagaaauauuauggucagcaccacuaggaccugauuuaaauccauauuuaucacaccuagcucguauguauaaugguuaugcagguggauuugaaguucaagucauacuagcuggcaaugcauuuaccgcaggaaaaauuauauuugcagcaguaccuccuaauuuucccacagaaggauuaucaccaucacaaguuacgauguucccacacauaaucguagacguacgccaauuagaaccuguacuaauaccauuaccagacguacguaacaauuucuaccacuauaaccaaucaaaugauccaacaauaaaauuaaucgcuauguuauauacuccucuuagagccaauaacgccggugacgacguauucacagucucaugccgaguauuaacaagaccaaguccagacuucgacuuuauauucuuaguaccacccacaguugaaucaagaacuaaacccuuuucuguaccaguauuaaccguagaagaaaugacaaauucuagauucccaauaccauuagaaaaauuauuuacuggaccuaguucagcuuucguuguacaaccccaaaauggaagauguacaacugacggaguccuuuuagguaccacucaauuaucuccuguaaauauauguacauucagaggagacguaacacauauaccagguucgcgaaauuauacaaugaauuuagccucacaaaauuggaauucauaugacccuacagaagaaauuccagccccacuuggaacaccugauuucgucggcaaaauucaaggaguauuaacacaaaccacccguacaaacggaucuacaagaggacacaaagcaacaguauauacagguucagcagacuuuucuccuaaauuaggaagaguccaauucgcuacagauacagacaacgacuucgaaacaaaccaaaacacaaaauuuacaccuguaggcguaauucaagacggaagcaccacaccaagaaaugaaccacaacaauggguauuaccaucuuauucaggaagaaauauacauaacguucaccuugcaccagcaguugcccccacauuuccuggagaacaacuauuauuuuuucgaucaacaaugccaggaugcucugguuauccaaauauggaucuagauugccuacuaccucaagaauggguacaauauuucuaucaagaagcagcuccugcacaaucagacgucgcauuacuaagauucguaaauccugauacaggacgaguauuauuugaaugcaaacuacauaaaucuggauauguuaccguagcacauacaggacaacacgaccucguaauacccccaaauggauacuuucgauuugauucaugggucaaucaauucuauacacuagcaccuaugggaaauggaacuggacguagaagagcauuauga

SEQ ID NO: 31466 - RNA, 1623 nt, Artificial Sequence
  derived and/or modified sequence opt6 from VP1__Norovirus__AFJ21446
augaaaauggcaucaucagacgcaaaccccucagauggaucaacagcaaaucuagucccagaagucaacaaugaaguaauggcacuggaacccguaguaggagcagcaauugcagcaccaguugccggacagcaaaauguaauagauccauggauacgaaauaacuucguccaagcuccugguggagaauuuacaguaucaccuagaaacgcaccaggagaaauauuauggucagccccccuaggaccagauuuaaauccuuaucuuucucaccuugcucgaauguacaacggauacgccggcggauucgaaguacaaguaauucuagcaggaaaugcuuuuacagcaggaaaaauaauauucgcagcaguaccaccaaacuuuccaaccgaaggucucucaccuucacaaguaacaauguucccacauauaaucguagauguaagacaauuagaaccaguuuuaauaccauuacccgacguuagaaauaauuuuuaucacuauaaccaaucaaaugacccaacaauaaaacuuauagccaugcuuuacacaccauuaagggcuaacaaugcaggugacgauguauuuacaguaucauguagagucuuaacaagaccaucacccgauuuugauuucauauucuuaguaccuccuacagucgaaucaagaacaaaaccauuuucaguaccuguauuaacaguugaagaaaugacaaauucaagauuuccaguuccauuagaaaaacucuucacuggaccaucaucagcauucguuguacaaccccaaaauggaagaugcacuacagauggugucuuacuaggaacuacacaauuaucaccugucaacauauguacauucagaggagacgucacccauauaccaggaagcagaaauuacaccaugaauuuagcuucucaaaauuggaauucauacgaccccacugaagaaaucccugccccacuagguacaccggacuuuguugguaaaauacaaggcguuuuaacacaaaccacaagaaccaacggauccacaagaggacauaaagcaacaguauacacaggaagugcugacuuuucaccaaaauuaggcagaguccaauuugcaacugacacagauaacgauuucgaaacaaaucaaaacacaaaauucacuccagucggaguaauacaagacggcucaacaacaccccguaaugaaccacaacaauggguacuaccuucauauucaggaagaaauauacauaacguacaccucgccccagcaguagccccaacauuuccaggagaacaacuauuauuuuuucgaucaacaaugccaggaugcucaggauacccaaauauggacuuagauuguuuacuaccucaagaauggguacaauacuucuaccaagaagcagccccagcucaaucagacguugcacuacuccgauucguuaacccagacacaggucguguauuauuugaaugcaaacuacauaaaucaggauacguaacaguagcacacacaggacaacacgauuuaguaaucccccccaaugguuauuuccguuucgacucauggguaaaccaauuuuacacucuagcaccuaugggaaacggcacuggaagaagacgagcacuuuaa

SEQ ID NO: 31467 - RNA, 1623 nt, Artificial Sequence
  derived and/or modified sequence opt6 from VP1__Norovirus__AFJ21448
augaaaauggcaucaucagaugcaaauccaucagauggcucaaccgcuaaucuagucccagaaguaaacaacgaaguaauggcacuugaacccguuguuggagccgcaauagcagcaccaguagcaggccaacaaaauguuauagacccuuggauacgaaauaauuuuguacaagcucccggaggagaauuuacagucucaccucgaaaugcacccggagaaauauuauggucagcuccauuaggcccagaccuuaacccauaccuaucacacuuagcaagaauguacaacggauacgcuggaggauucgaaguacaaguuauacuagccggcaacgcauucacagcaggaaaaauuauauuugcagcaguaccaccuaauuucccaacagaaggauuaucaccaucacaaguaacuauguucccacacauaauaguugacguaagacaauuagaaccaguacuaauuccacuaccagacguacguaauaauuucuaucacuacaaucaaagcaaugacccaacaauuaaauuaauagcaauguuauauacuccacuacgagcuaacaaugccggugaugauguauuuacaguaucaugucgagucuuaacucgaccaucaccagacuuugacuuuauauucuuaguaccccccaccguugaaucuagaacaaaaccauucucgguaccuguacuaacagucgaagaaaugacuaacucccgcuuuccaauaccuuuagaaaaacuauuuacaggaccaucuucugcauucguuguccaaccccaaaacggaagaugcacaaccgacggaguacuauuaggaaccacacaauuaucuccuguaaauauauguacuuuuagaggcgacguaacacauauaccaggaucaagaaauuauacuaugaaucuagcaucacaaaacuggaacucauacgacccuaccgaagaaauaccagcaccauuagguacaccugacuucguaggaaaaauacaaggaguauuaacccaaaccacacguacaaacgguucuacuagaggacauaaagccacuguuuauacaggcucagcagacuucucaccaaaacuuggacgaguccaauuugcaacugacacagauaaugauuucgaaacuaaucaaaacacuaaauucaccccuguaggaguuauacaagacggaagcacuacaccaagaaaugaaccacaacaauggguacuaccuucauauuccggcagaaauauccauaacguacaucuagcaccugcuguagcaccaacauucccaggagaacaacuacuuuucuucagaucaacuaugccaggaugcucaggauauccaaauauggaucuagauugucuacuaccacaagaauggguacaauauuuuuaucaagaagccgcaccagcucaaucagacguagccuuauuaagauuugucaauccagacacaggaagaguacucuucgaauguaaauuacacaaaucuggauauguuacaguagcacauacaggacaacaugauuuaguuauacccccaaauggcuacuuuagauuugacucuuggguaaaccaauucuauacauuagcaccaaugggaaacggaacaggacgacgaagagcuuuauaa

SEQ ID NO: 31468 - RNA, 1623 nt, Artificial Sequence
  derived and/or modified sequence opt6 from VP1__Norovirus__AFJ21451
augaaaauggcaucaaaugacgcaaacccaucugaugguucagcugcaaaucuaguaccugaaguaaacaaugaaguaauggcauuagaaccaguuguaggcgcagcaaucgcagcaccugucgcaggacaacaaaauguaauagacccuuggauaaggaauaacuuuguacaagcuccaggcggagaauuuacaguaucaccacgaaaugcaccaggagaaacacuuugguccgccccacuaggaccagaccuuaauccauaccuuucacaccucgcuagaauguauaacgguuacgcaggaggguuugaaguucaaguaauccuagcuggaaaugcauuuacagcuggaaaaauuauuuuugcugcaguucccccaaauuuucccacugaaggccuaucaccaucucaaguaacaauguucccucacauaauaguagacguaagacaacuagaaccaguauuaauuccauuaccagauguacgaaacaacuuuuaccauuauaaucaaucaaacgacucaacaauaaaacuaauagcuauguuauacaccccacuacgugccaacaaugccggagacgaugucuucaccguuagcugucgaguauuaacccgaccuucuccagauuuugacuuuauauuucuaguaccaccaaccguagaaucucgaacaaaacccuucacaguaccaauauuaaccguagaagaaaugacaaauucucgauucccaaucccauuagaaaaacuauuuaccggccccuccucagcuuucguaguacaaccacaaaacggcagaugcaccacagacggaguccuauuaggaacaacacaacuaucaccaguaaauaucuguacauuucgaggugacguuacucauauagccggaucaagaaacuacacaaugaaucuagcaucauuaaacuggaauaauuaugauccaacugaagagauccccgcuccacuaggaacaccagacuuuguaggaaaaauacaagguauguuaacacaaaccacacaaggagacggaucaacccgcggacacaaagcaacagucuauacuggauccgcagacuucaccccaaaacuugguucaguacaauucgccacagauacugaaaacgauuucgaaacccaucaaaauacaaaauucacaccaguagguguaauacaagacggaagcacaacacauagaaaugaaccacaacaaugggcacuuccuucuuacucuggaagaucugcccauaauguucaccuagccccagcuguagcaccaaauuucccaggugaacaauuauuauuuuuuagaucaacuaugccagguugcucagguuaucccaacauggacuuagacugccuacuaccucaagaauggguucaacauuucuaucaagaagcagcuccagcucaaucagauguagcacuucuaagauucguaaacccugauaccggacgaguuuuauuugaauguaaauuacauaaaucaggauacguaacaguagcacauacaggacaacacgauuuaguaauaccaccaaauggcuauuuucgauuugauuccuggguaaaucaauuuuacacacuugcaccaaugggaaauggaacagguagaagaagagcacuuuaa

SEQ ID NO: 31469 - RNA, 1623 nt, Artificial Sequence
  derived and/or modified sequence opt6 from VP1__Norovirus__AFJ21454
augaaaauggcaagcucagaugcaaacccaucagauggaucaacagcaaauuuaguaccagaaguuaacaaugaaguaauggcacucgaaccaguuguaggugcagcaauagcagcaccuguagcuggucaacaaaauguuauagauccauggauuagaaauaacuucguucaagcaccuggaggagaauuuacaguuucaccaagaaaugcuccaggagaaauauuauggucagcaccauuaggacccgaucuaaauccauaccuaucacacuuagcuagaauguauaacgguuaugcuggaggauuugaaguccaaguaauucuugcaggaaacgcauucacagcaggaaaaaucauuuuugcugcagucccaccuaauuucccuacagaaggcuuaucuccaucacaaguaacaauguucccacacauaauaguagacguacgacaauuagaacccguacuaaucccacucccagauguaagaaauaauuucuaucacuauaaucaaucaaaugacccaacaauaaaauuaauagcaaugcuuuauacuccacuaagagcaaauaaugcuggagaugauguauucacaguuagcugucgcguauuaacucgaccuucaccugacuuugacuuuauauuucuuguaccaccaacuguagaaucccgaacaaaaccauucucaguaccuguccuaacaguagaagaaaugacaaauucaagauuuccuauaccacuugaaaaauuauuuaccggaccaucauccgcguucguuguacaaccacaaaauggacguugcacaacagauggaguauuauuagguacaacacaauuauccccaguaaauauaugcacauuuagaggggacguaacccauaucccaagcucacgcaauuacacaaugaaucuagcuucccaaaacuggaauucauacgauccaaccgaagaaaucccagcaccucuugguacaccagauuuuguuggaaaaauacaaggaguacuuacccaaacaacaagaacugacggaucaacaagaggccacaaagcaacaguauacacaggcucagcugacuuuucccccaaauuaggaagaguacaauucgcaaccgauacagauaacgacuucgaaacaaaucaaaauaccaaauuuacuccaguuggaguaauucaagacggaucaacaacacauagaaaugaaccacaacaauggguacuacccucauauuccgguagaaauauacauaauguacauuuagccccagcaguagcaccaacauuuccaggagaacaacuauuauucuuucguucuaccaugccaggaugcucuggauauccaaauauggacuuagauugcuuauuaccacaagaauggguacaauacuuuuaucaagaagcagcccccgcacaauccgauguagccuuacuaagauucguuaauccagauacuggaagaguccuauuugaaugcaaauuacacaaaucugguuauguaacaguagcacauacuggucaacacgacuuagugauaccccccaauggauacuuccgauuugauucauggguaaaucaauuuuauacauuagcuccaaugggcaauggaacaggaagaagaagagcacucuaa

SEQ ID NO: 31470 - RNA, 1623 nt, Artificial Sequence
  derived and/or modified sequence opt6 from VP1__Norovirus__AFL70023
augaaaauggcauccaacgaugcaaauccauccgauggaucgacugcuaacuuaguaccagaaguaaacaacgaaguuauggcacuagaaccaguaguaggagcagcuauagcagcaccaguagcaggacaacaaaauguaaucgacccauggauaagaaauaacuuuguacaagcacccggaggagaauuuacaguuucaccaagaaaugcuccaggcgaaauuuuauggagcgcaccuuuaggaccugauuuaaacccuuaucucgcucaccuagcaagaauguacaacggcuacgccggaggauucgaaguacaaguaauauuagcgggaaaugcauuuacagcugguaaaauuauauuugcagcuguuccaccaaacuuuccaacagaaggucucucaccaucucaagucacaauguucccacauauaguagucgauguuagacaauuagaaccaguccuaauaccacuuccagauguaggaaacaacuucuaccacuacaaucaaucaaacgacccaacaauuaaauuaauagcuauguuauauacuccacuuagagcaaauaaugcaggugaagauguauucacaguuagcugcagaguacuaacaaggccuucaccagacuuugauuuuauauuucuaguaccgccuacugucgaaucccgaacaaaaccauucacuguaccaauacuaacagucgaagaaaugaccaacagcagauuuccaauuccacuugaaaaacuauuuacaggaccauccggagcuuucguaguacaaccccaaaauggcagauguacaacugacggcguacuacuaggaacaacucaacuaucacccguuaauaucuguacauuuagaggagacguaacacacauagcaggaacacacaauuauacuaugaauuuagccucacaaaauuggaacaauuaugauccaacagaagaaauaccagccccccuaggaacaccagacuucguugguagaauacaaggaaugcuaacucaaacaacacgaggagacgguucaacaagaggacacaaagcaacaguguccacaggagacguucacuucacaccaaaauuaggaucaauacaauucaauacagauacuaacaacgauuucgaaacuggacaaaauacaaaauucacuccaguuggagucguccaagauggcaacggagcacaccaaaaugaaccacaacaauggguuuuaccaucauauuccgggagaacaggacacaacguacauuuagcaccagcagucgcaccaacauuuccaggcgaacaacuacuauucuuucgaucaacaaugccaggauguuccggauauccaaauaugaaccucgauugccuauuaccucaagaauggguacaacacuuuuaucaagaagccgcaccagcucaaucugacguagcauuacuaagauuuguuaacccagauacaggaagaguauuauucgaaugcaaacuacauaaaaguggauauguuacaguugcacacacaggccaacacgacuuaguaaucccacccaaugguuacuuuagauucgauuccuggguuaaucaauuuuauacauuagcaccaaugggaaacgguacaggaagaagacgugcucuauaa

SEQ ID NO: 31471 - RNA, 1653 nt, Artificial Sequence
  derived and/or modified sequence opt6 from VP1__Norovirus__AFN06724
augaaaauggccucaaaugaugcugcaccuucaaacgacggagcagcaaacuuagucccagaagcaaacaaugaaguaauggcacuagaaccaguaguaggagcuucaauagcugcacccguaguaggacaacaaaauaucauagacccauggauuagagaaaauuuuguccaagcaccgcaaggagaauuuacaguaucacccagaaauagcccaggagaaaugcuauuaaaucuagaauuaggaccugaauuaaauccauaucuaagucaucuuucaagaauguauaacggguaugcagguggcaugcaaguacaaguaguccuagcaggaaaugcauuuacugcuggcaaaauaauauuugcagcaguaccaccgcacuuuccaguugaaaauauaucagcagcacaaauaacaaugugcccacacguaaucguagacguaagacaacuagaacccguuuuacuaccacuuccugauauaagaaaucgauuuuuucacuauaaccaagaaucaacaccuagaaugcgauuaauugcaaugcucuacacaccucuaagagcaaacucaggagaagauguauucacaguaucaugcagaguacuuacaagaccagcaccagauuuugaauucacauucuuaguaccccccacuguagaaucaaaaacaaaacccuuuacauuaccaauacucacauuaggugaauuaucaaauaguagauucccagccgcaauagauauguuauacacagauccuaacgaauccauuguaguccaaccacaaaacggaagaugcacucucgauggcacucuacaaggcacaacacaacuaguaccaacucaaauaugcgcauuuagagguacauuaauaagccaaacagcacgugcagcugacagcacagauucaccacaacgagcucgagaccacccacuccacguacaaguaaaaaauuuagauggcacacaauaugacccuacagacgauauaccugcaguauuaggugcaauagacuucaaaggaacaguauuuggaguagcaagucagagagauguaucuggacaacaagaacaaggacacuacgccacacgagcacaugaagcucauauagauacaacagacccaaaauaugcuccaaaauuaggaacaauauuaauaaaaucagaaagcaaugacuuuacuacaaaccaaccaauaagauucacaccaguaggaaugggugacaauaacuggagacaaugggaauuaccagacuauuccggacgacuaacguuaaauaugaacuuagcaccugcaguaucaccauccuuuccaggugaacguauccuauucuuucgaucaauuguuccaagcgccggaggguuuggcucaggauauauagacugcuuaauaccccaagaauggguacaacacuuuuaucaagaggcagcaccaucacaaucagcuguagcauuaguaagauacguaaacccagauacaggaagaaacauauuugaagcuaaauuacauagagaaggauuucuuacuguagccaauagugguaauaauccaauagucguaccacccaauggauauuuccguuucgaagccuggguaaaucaauucuauacacuagcaccaaugggaaguggacaaggucgcagaagagcacaauaa

SEQ ID NO: 31472 - RNA, 1653 nt, Artificial Sequence
  derived and/or modified sequence opt6 from VP1__Norovirus__AFN06725
augaaaauggcaucaaaugaugcagcuccuucaaaugacggagccgcaaacuuaguuccagaagcaaacaaugagguaauggcauuagaaccaguaguaggagcaagcauugcagccccaguuguaggacaacaaaauauaauagauccauggauacgagaaaacuucguacaagcaccacaaggagaauuuacuguaucuccaagaaacucaccaggagaaaugcuauuaaaucuagaacuuggaccagaacuuaacccauaucucucucaucuuagucgaauguauaacggauacgcaggcggaaugcaaguacaaguaguauuagccgguaaugcauuuacagccggcaaaauaauauuugcagcaguuccaccacauuuuccaguagaaaauauaucagcagcucaaauaacaauguguccacauguuauaguugauguacgccaauuagaaccaguacuauuaccacuccccgauauacgaaacagauucuuucacuauaaccaagaaaauacaccaagaaugcgauuaauagcaaugcuuuauaccccacuacgagcuaauucaggugaagacguauucacaguaagcuguagagucuuaacaagacccgcuccagauuucgaauucacauuuuuaguaccaccuacaguagaaucaaaaacuaaacccuucaccuuaccaauucuaacacuuggagaauuaaguaacuccagauuucccgcagcuauagauaugcuuuauacagauccaaaugaaucuauaguaguacaaccacaaaauggaagaugcacauuagacgguacauuacaaggaacaacacaacuagucccaacucaaauaugcgcauuuagaggaaccuuaauaagucaaacugcaagagcugcagauaguacagauucuccucaaagagcaagagaccauccacuacauguucaaguuaaaaauuuagaugguacccaauacgauccaacagaugauauaccagcaguuuuaggagcuaucgacuuuaaagguacaguuuuuggcguagcgucucaaagagauguuucaggacaacaagaacaaggacacuaugcaacaagagcacacgaagcacacauagauacgacagauccaaaauaugcaccaaaauuagguacuauauuaauaaaaucagaaaguaaugacuuuacaacaaaccaacccauuagauucacaccaguaggcaugggugauaauaacuggagacaaugggaacuuccagacuauucaggaagacuaacuuuaaacaugaaucuagcaccagcaguaagcccuucuuuucccggagaacgaauacuauucuuucgaucuauaguaccuucagcagguggcuuugguagugguuauauagacugcuuaaucccucaagaauggguucaacauuuuuaucaagaagcagcuccaucacaaucugcaguagccuuagucagguauguaaauccagacacagguagaaacauuuuugaagcaaaauuacaccgcgaaggauuuuuaacaguugcaaauaguggaaauaauccaauaguaguaccuccaaauggauauuuuagauuugaagcaugggucaaucaauuuuauacacuagcacccaugggcuccggccaaggacgaagacgagcccaauaa

SEQ ID NO: 31473 - RNA, 1629 nt, Artificial Sequence
  derived and/or modified sequence opt6 from VP1__Norovirus__AFN06726
augaaaauggccucaaaugacgcagcacccuccacagacggagcagcaggacuaguuccagaaucaaacucugaagucauggcccucgaaccaguagcuggugcagcucuagcagcaccaguaacaggacaaacuaacauaauagauccuuggauaagagcuaacuucguacaagcaccaaauggagaauucacagucucacccaggaacgcaccuggagaaguuuuacuaaaucuagaauuagguccagaacuaaauccuuauuuagcacaucuagcacgaauguacaauggcuacgcaggcggaauggaaguacaaguuauguuggcagguaacgcauuuacagcaggaaaacuaguauucgcagccguaccaccacauuucccaguugaaaaucuuucaccccaacaaauaacaauguucccacacguaauaauagauguaagaacacuagaaccaguuuuacuaccccuccccgacguaagaaauaacuucuuccauuauaaucaaaaagacgacccaaaaaugcggauaguggcaaugcuauacacaccauuaagaucaaauggaucaggagaugauguuuuuacaguauccuguagaguccugacaagaccaucuccagauuucgacuuuacauacuuaguaccaccaaccguagaaucaaaaacaaaaccauucacauuaccaauuuuaacacuuggagaacuaucaaacucacgauuuccaguauccauugaucaaauguauacuuccccaaacgaaguaauaucaguucaaugccaaaacggaagaugcacacuagauggagaacuacaaggaacaacacaacuacaaguaucaggaauaugugcauuuaaaggcgaaguaacagcucaccuacaagacaaugaucaucuauacaauauaacaauaacaaaucuaaacgguucaccuuuugacccaucugaagauauaccugcaccucucggaguaccagacuuucaaggaagaguuuucgguguaauaacccaaagagacaaacaaaaugccgcaggacaaucucaaccugcaaauagaggacaugacgcuguaguaccaacauauacggcucaauauacaccaaaauuaggccaaguacaaauaggcacauggcaaacagaugaucuaaaaguaaaucaaccaguaaaauuuacaccagucggauuaaacgauacagaacauuucaaccaauggguaguaccuagauaugcaggugcacuaaacuuaaauacuaacuuagcaccuucugucgcacccguauuucccggagaacgauuacuuuuuuuuagaucuuacuuaccacuuaaaggagguuacggaaauccggcaauagauugucuauuaccacaggaauggguccaacauuucuaccaagaagccgcuccaucaaugucugaaguagcacuaguaagauacauaaacccugauacaggaagagcacuuuucgaagcaaaacuacauagagcaggcuucaugacaguauccucaaauacaagcgcacccguaguuguacccgcaaauggauauuuuagguuugacucauggguaaaccaauuuuacucucuagcaccaaugggaacaggcaauggacgaagaagaauacaauga

SEQ ID NO: 31474 - RNA, 1617 nt, Artificial Sequence
  derived and/or modified sequence opt6 from VP1__Norovirus__AFN06727
augaaaauggcuucaaacgacgcuacaccaucugaugauggagcugcaggacucguuccugaaauaaacaaugaaguaauggcauuagaaccaguagcuggugcaucaauagccgcacccgucguaggacaacaaaauauaauagaccccuggauccgaaauaacuucguacaagcaccagcaggagaauuuacuguaucuccaagaaacucuccaggugaacucuuauuagauuuagaauuagguccagaacuaaacccuuaucuagcacaucuugcaagaauguauaacggccaugccggagggauggaaguacaaauaguacuagcaggaaaugcauuuaccgcaggaaaaauauuauucgcugcaauuccaccuaguuucccuuaugaaaaccuuuccccugcucaacuaacaaugugcccgcacgucauaguagauguccgucaacuagaaccaguacuauuaccaaugccagauauacgcaauguuuuuuaucauuacaaccaaaacaauucaccaaaauuacgacuuguagcaauguuauauaccccuuuacgagcaaacaauucuggagacgacguauuuaccgucucuugcagaguacuaacuagaccuucaccagacuuucaauuuacauuucucguaccaccaacaguagaaucaaaaacuaaaaauuucacacuuccaguccuuagaguauccgaaaugaccaauagcagauuucccguaguacuagaucaaauguauacaucaagaaaugaaaauauaauaguacaaccacaaaauggaagauguaccacagacggagaauuacuagguacaaccauauuacaaucaguaucaauaugcaauuuuaaaggaacaaugcaagcugaauuauccgaucaaccaagauaucaauaccaacuucaauuaaccaauuuagauggaucaccaauagacccgacugacgaugucccagcaccauuaggcacaccagauuuccaagcaaugcuauacggcguugcuucucaacgaucaucaagagauaaugcaacacgagcucaugaugcacaaaucgacacagcaggagauacauuugcaccaaaaauaggacaaguaagauuuaaaucuagcucaaaugacuuugauuuacaugacccuaccaaauucacaccaauuggaguaaacguagaugaccaacauccauuuagacaauggucauuaccaaacuauggaggacacuuagcccuaaauaaucaccuagccccagccguaacaccuuuguuuccaggugaacaaauauuauucuuccgaucauacauaccaucagccggaggacauaccgacggagcuauggauugccuauuaccacaagaauggauagaacauuucuaucaagaaucagcaccaucacaaucagauauagcacuaguucgauucauaaacccagacacaggccgaguauuauucgaagcaaaacuacauaaacaaggauuucuaacuauagcugccuccggugaucaccccauaguaaugccaacaaaugguuauuucagauucgaagcuuggguaaaccccuuuuauacacucgcacccguaggaacuggcucuggaagaagaagaauacaauaa

SEQ ID NO: 31475 - RNA, 1647 nt, Artificial Sequence
  derived and/or modified sequence opt6 from VP1__Norovirus__AFN06728
augaaaauggcaucaaacgaugcagcacccucaaacgacggagcagcaggcuuaguacccgaaauaaauaaugaagcaauggcuuuagaaccaguagcuggagcagcaaucgcagcaccccuuacaggucaacaaaacaucauagaucccuggauaaugaacaauuucguacaagcaccagguggagaauuuacaguaucaccaagaaacuccccuggagaaguauuauuaaauuuagaauuaggaccagaaauuaauccauaucucgcacaucuagccagaauguauaacggauaugcaggcggauuugaaguacaaguaguccucgcaggaaacgcauucacggcagguaaaguaaucuucgcagcaauaccacccaauuucccaauagacaaccuaucagcugcacaaaucacaaugugcccacauguaaucguagauguaaggcaauuagagcccaucaauuuacccaugccagauguaagaaacaacuuuuuccauuauaaucaaggaucagauucaagacuacgauuaauagcaauguuauacacaccacuuagagcaaauaacucaggagacgauguauucacuguaaguugccgaguauuaacaagaccaucaccagacuuuucauucaacuuccuaguaccuccaacaguagaauccaaaacaaaaccauucacacuaccaauauuaacaaucuccgaaauguccaauucacgauucccaguccccauagacucauuacacaccucgccaacugaaaacauagucguacaaugccagaacggucgugucacuuuagacggugaauuaauggguaccacacaacuacuaccaagucaaaucugugcuuucagaggcacauuaacacgaucaacauccagagcaucagaucaagcagauacagcaacaccaagacuauuuaacuauuauuggcauauacaauuagauaauuuaaacggaacacccuaugaccccgcugaagacauaccagcaccccucggaacucccgacuucagagguaaaguuuuuggagucgcaucacaaagaaacccagauaguacaacuagagcacaugaagcaaaaguagauacaaccucaggaagauuuacaccuaaauuaggaucacuagaaauaucaacagaaucagacgacuuugaucccaaccaaccaaccagauucacaccagucgguauagguguagacaacgaagcagacuuucaacaauggucauuaccagacuauucuggacaauuuacccacaauaugaauuuagcuccagcaguugcaccuaacuuuccaggagaacaacuacuauuuuuuagaucucaacuacccucuucaggaggaagaucuaauggaauauuagacugccuaguaccacaagaauggguacaacauuuuuaccaagaauccgcaccagcucaaacacaaguagcacuaguaagguacguuaauccagauaccggcagagucuuauuugaagcaaaacuacacaaauuaggauuuaugacaaucgcuaaaaauggagauucaccaauaacaguaccaccaaauggauacuuuagauuugaaagcuggguaaauccauuuuauacacuagccccaaugggcacugguaauggucgaagaagaauacaauaa

SEQ ID NO: 31476 - RNA, 1647 nt, Artificial Sequence
  derived and/or modified sequence opt6 from VP1__Norovirus__AFN06729
augaaaauggcaucuaacgacgcagcuccuucuaacgauggagcagcuggauuaguaccagaaauuaauaaugaagcuauggccuuagaaccaguaguaggagcagcuauugcugcaccuuuaacaggacaacaaaacauaauagacccauggauaaugaauaacuucguacaagcaccaggaggagaauuuacuguauccccacguaacuccccaggugaagucuuacugaaccuagaacucggaccagaaauaaauccuuacuuagcacaccuagcacguauguauaacggauacgcagguggcuuugaaguucaaguaguauuagcaggcaaugcuuucacugccggaaaaguaauauuugcggccauuccuccuaauuuuccaauagacaaccuaucagcagcacaaaucacaaugugcccucacgucauaguugaugucagacaguuagaaccaauaaauuuaccuaugcccgacguuagaaauaauuuuuuccacuacaaucaaggcagugacucucgacucagacuaauugcaaugcuauacacuccccuucgagcaaacaauucaggagacgacguuuuuacuguuucuugcagaguauuaacuagaccaucuccugauuuuucauuuaauuuccuaguaccaccuaccguagaaucaaaaauaaaaccauuuacacuaccaauauuaacaauaucagaaaugucuaauucucguuuuccugucccaauagacucauuacauaccagcccuacagaaaacaucguaguacaaugucaaaauggacgaguaacauuagauggagaauuaaugggaacaacacaacuacuaccuucacaaauaugcgcauucagaggaacauuaacaagaucaacaucaagagcaagcgaccaagcugauacugccacaccccgacuauuuaauuauuauuggcacauccaacuugauaaucuaaauggaacaccuuaugauccagcagaagauauaccagcaccauuaggaacaccagacuuucgaggaaaagucuuuggaguugcaucacaaagaaauccagacucaaccacacgagcccacgaagcaaaaguagacacaacaucaggucguuuuacuccuaaacuaggaucauuagaaauaucaacagaaucaggcgauuuugacccaaaccaaccaacaagauucacuccaguaggcauaggcguagauaaugaagcagacuuccaacaauggucucuaccugauuacucaggccaauuuacacauaacaugcaccuugcaccugcagucgcaccaaauuuuccaggagaacaacuacuauucuuccgaucacaauuaccaucuucaggaggaagaucaaauggcauacucgauugccuagucccacaagaauggguacaacauuucuaccaagaaucagcaccagcucaaacacaagucgcccuaguaagauauguaaaucccgacacuggcagaguacuuuucgaagcaaaacuccacaaauuaggauucaugaccaucgcaaaaaauggcgacaguccaauaacaguaccaccaaacgguuacuucagauuugaauccuggguuaacccauucuauacacuagcaccaaugggaaccggaaacgguagaagaagaauacaauaa

SEQ ID NO: 31477 - RNA, 1644 nt, Artificial Sequence
  derived and/or modified sequence opt6 from VP1__Norovirus__AFN06730
augaaaauggcaucuaaugaugcggcuccuucaaacgauggagcagcuaaucuaguaccagaagcaaacaaugaaguaauggcacucgaaccaguaguaggcgccucaauagcagcaccuguagucggacaacaaaauaucauugauccauggauacgagaaaauuucguucaagcaccacaaggagaauucacaguaucuccucgcaacuccccaggugaaaugcuucuaaacuuagaacuuggaccugaauuaaacccuuaccuuucacaucuaucuaggauguauaauggauaugcuggcgguaugcaaguucaaguuguacuagcuggaaaugcauucacagccggaaaaauuauauuugcagcuguaccaccacauuucccuguugaaaauauaucugcagcacaaauaacaaugugcccacauguaauaguagauguuagacaauuagaacccguauuauuacccuuaccugacauucgaaaucgcuucuuucauuauaaucaagaaaauacaccaagaaugagauuagucgcaauguuauacacuccucuucgagcaaauucuggugaagauguauuuacaguaucuuguagaguucuaacacguccagcacccgacuuugaauucacguuucuaguacccccaacaguugaaucuaaaacaaaaccauuuacauuacccauacuuacauuaggcgaacuuucaaauucaagauuuccggcaccaaucgacaugcuauacacagauccaaaugaaaccauagucguacaaccucaaaaugguagauguacacuagauggaacacuacaaggaacaacacaacuugugccaacacaaauauguucauuuagaggaacacuaaucagccaaacaucucguucagcugaaucaacugauucagccccucgaguccgaaaucauccauuacacguacaacuaaaaaauuuagauggaacaccauaugauccaacagacgaaguaccagcaguacuaggagcuauagacuucaaaggaacuguuuuugguguagcaagucaacgaaauacuacagguucaucagcaggagcaacaagagcacacgaaguccauauagauacaacaaauccacgauauacaccuaaacuaggaucuguuuuaauguauucagaaucuacagauuucgaugauggacaaccaaccagauucacaccaauaggaaugggagcugacgauuggagacaaugggaauuacccgaauauucaggacaccuuaccuuaaacaugaaucuagcaccagcaguugcaccagcuuuuccuggagaacguauucuauuuuuuagauccguaguaccaucugcaggaggauaugguucaggucaaaucgacugucuuauuccucaagaauggguacaacauuuuuaccaagaagcagcaccaucacaaucugcagucgcauuaauacgauauguaaauccagauacaggaagaaacauauuugaagcuaaauuacauagagaaggauuuauaaccguagcuaauaguggaaauaauccaauaguaguaccacccaaugguuauuucagguuugaagcauggguaaaucaauuuuauacacuuacaccuaugggaacaggacaaggacgaagacgaguucaauaa

SEQ ID NO: 31478 - RNA, 1623 nt, Artificial Sequence
  derived and/or modified sequence opt6 from VP1__Norovirus__AFN06731
augaaaauggcauccaacgacgcagcaccaucuagcgauggagcagcaggcuuaguaccagaaauaaacaacgaaguaaugccucuagaaccaguagcuggagcaaguuuagcaacuccuguaguaggacaacaaaauauaauagacccuuggauaagaaauaauuuuguacaagcacccgcaggagaauuuaccguaucaccaagaaacuccccaggagaaauccuacuagacuuagaacucggucccgaacuaaauccauaucuagcacauuuagcacgaauguacaauggacacgccggcggaauggaaguucaaauaguccuagcaggaaaugcauuuacugccggaaaaaucauauuugcagcaauaccuccuggauuuccauaugaaaaucuuucaccaucacaaauaacaaugugcccacacgucauaauugacguacgacaacuagaaccaguacuacugcccaugccugauauacgaaacaacuucuuucacuauaaccaagguaaugacccaaaacuaagacuaguagcaauguuauacacaccacuacgagcaaauaacucaggugacgacguuuuuaccgucucuugcagaguucuaaccaaaccuucaccagacuucgaauuuacauuucuagucccaccaacaguagaauccaaaacaaaacaauucacauuaccaauucuaaaaauaucagaaaugacaaacaguagauuuccaguacccgucgacguaauguacacagcaagaaaugaaaaucaaguaguccaaccccaaaacggacgaguaacacuagacggugaacuucuaggcaccacaccccuacuagccguaaauauaugcaaauucaaaggcgaaguaauugcuaaaaauggcgacguuagauccuauagaauggacauggaaaucacaaacaccgacggaacacccauagauccuacagaagacacccccggacccauaggcucuccagacuuccaaggaauacuauuuggaguagcaucucaaagaaauaaaaacgaacaaaacccagcaacaagagcacacgaagcaaauauaaacacuggaggagaucaauacgcaccaaagcuugcacaaguuaaauuuuuuucagaaucacaagacuuugaaguacaucaaccaacaaucuucacaccagucggaguagcaggugauaccucacacccauucaggcaauggaccuuaccaagauacggcggacaccuaacuaacaacacacacuuagcaccugccguagcaccauuauuccccggagaacaacucuuauuuuuucguucacaaauacccucaucaggaggacaugaacaaggauauauggacugccuagucccacaggaauggguacaacauuucuaucaagaagcagcaacugcucaaucagaaguugcauuaauaagauucauaaacccugacaccggaagagucuuauuugaagcaaaacuacauaaacaaggauucauaacaguagcacacacaggagacaacccaauaguaaugcccccaaacggcuacuuucgcuucgaagcauggguaaaccaauuuuacucauuagcaccagucggaacagguaacggcagacgacgcguacaauaa

SEQ ID NO: 31479 - RNA, 1623 nt, Artificial Sequence
  derived and/or modified sequence opt6 from VP1__Norovirus__AFN06732
augaaaauggcuuccaacgaugccgcaccaucaaaugauggagccacaggauuaguuccagaaauuaaucaugaaacauuaccauuagaaccaguagcaggcgcagcaaucgccgcaccugucacuggacaaaacaauauaaucgauccuuggauacgaacaaauuuuguucaagcaccaaacggagaauucacuguaagucccagaaauucaccaggagaaauccuacuuaauuuagaacuaggaccagauuuaaauccauauuuagcacaccuaucuaggauguacaauggauacgcuggaggaguagaaguccaaguccuacuagcuggaaaugccuuuacagcaggaaaaauauuauuugcugccguuccaccuaacuuuccaguugaauuuuuauccccagcacaaauaaccaugcuaccucaccuuauugucgacguacgaacuuuagaaccuauaaugauaccccuaccagauguaagaaauacauucuuccacuauaauaaucaaccagcuaaucgaaugagacucguagcuaugcuuuauacuccacuaagaucaaacggauccggagaugacguauuuacaguaucaugccgaguuuuaacuagaccuacaccggauuuugaauuuacauaccuaguaccaccaucaguugaaucaaaaaccaaacccuucucauuaccaauacuuaccauaucugaacuaacuaacucacgauuccccgcaccuauagauucacuauauacagcccaaaacaauaaccucaauguacaaugucaaaacggaagauguacauuagacggagaacuacaaggcacaacacaacuacuaccuucaggaaucugcgcauucagaggaaaauuaacagcagacguccaccaaucacaugaugacagauggcacaugcaauuaacaaauuuaaacggcacacccuuugacccaacagaagauguaccagcaccuuuaggcacaccugauuuuacaggacuuuuauucggaguagcaucacaacgaaacguagucucaaaccccaauacaacccgugcacacgaagccguaauaucaacaacauccucccaauuugucccaaaacuaggaucaaucaacuucgguucaacuucagacgacuuccaacuacaacaacccacaaaauucacaccagucggaauaaaagucgaaucuggacacgauuuugaucaaugggcacuacccagauauaguggucacuuaacauuaaauaugaacuuagccccaccaguugcaccaaauuuuccaggagaacaacuauuauucuucagaucaaacguacccugcgcaggaggcguaucagauggaguaauagacugucuauuaccacaagaauggauacaacacuucuaucaagagucugcacccucacaaucagauguagccuuaauaagauacguaaacccugacacaggcagaacacuuuuugaagcaaaacuacaucgcacaggauauauuaccguagcacacucaggagauuacccacuagucguacccucaaauggcuacuuuagauuugauaguugggucaaucaauucuauucacuagcaccaaugggaacaggcaauggacgaagaagaguacaauaa

SEQ ID NO: 31480 - RNA, 1623 nt, Artificial Sequence
  derived and/or modified sequence opt6 from VP1__Norovirus__AFN06733
augaaaauggcaucuaaugaugcagcaccaucuaaugacggagcagccggauuaguucccgaaucuucuaacgaagcuauggcuuuagaaccaguagucggugcaucacuagcagcaccuguuacaggccaaacaaauauaauagauccauggauuagaaccaauuuuguacaagcuccaaacggugaauuuaccguuuccccccguaauucaccuggagaaguacuaguaaacuuagaacuuggaccagaacuaaacccauacuuagcucaucuugcaaugauguauaaugguuaugcuggaggaauggaaguacaaguucuucuagccgguaaugcauuuacagcaggaaaaauaauauucgcagcuguccccccauauuucccagucgaaaauuuaucaccuagccaaauuacaauguuuccacacguuauuauugauguaagaacacuagaaccaguauuacuuccaaugccagauguacgauccacauuauuucacuuuaaucaaaaagaugaaccaaaaaugcgacuagucgcuaugcuuuauacaccauuacgaucaaacggaucuggagaugauguauuuacaguaucauguagaauacuaacuagaccuucaccagaauucgauuucacuuauuuaguuccaccaacuguagaauccaaaacuaaaccuuuuacacugccaguccuuacacuaggagaacucucaaauucacgauuuccauuaucuauagaugaaaugguuacaucaccaaaugaaagcauaguuguacaaccacaaaacggaagaguaaccuuagacggagaacuacuagguacaacacaauuacaagcuuguaacauuuguuccauaagagguaaaguaacuggucaaguuccaaacgaacaacacauguggaaucuagaaauuacaaaucuaaaugguacacaauuugacccaacagaugauguaccagcaccauuaggaguaccugauuucgccggagaaguauuugguguacucucacaaagaaaucgaggagaaucuaauccugcaaauagagcacacgaugcaguaguagcaacuuacuccgauaaauauacaccuaagcuaggauuaguacaaauaggaacuuggaacaccaaugaugucgaaaaccaaccaacaaaauucacuccaauaggacucaacgaaguugcaaauggacauagauucgaacaauggacauuaccuagauauucuggugcauuaacauuaaacaugaaccuagccccagccguagcaccacuauucccaggugaacgacuauuauuuuuuagaucauauguaccacucaaaggcggauuugguaacccugcaauagacugucuaguuccacaagaauggguacaacauuucuaccaagaaucagccccaucccuuggagacgucgcacuaguaagauacguaaauccagauacuggaagaguauuauucgaagcaaaacuacacaaaggaggauuucuaacaguaucuucuacaucaacaggaccaguaguaguaccagcaaauggcuauuuuagauucgauucauggguaaaucaauucuauucuuuagcaccuaugggcacagguaacggccgaaggagauuccaauaa

SEQ ID NO: 31481 - RNA, 1623 nt, Artificial Sequence
  derived and/or modified sequence opt6 from VP1__Norovirus__AFN06734
augaugauggcaucaaaagaugcaccgacaucaccugacggugcuucgggagccggacaacuuguaccagaagcaaacacagcagaacaaauaagcauggauccaguugcuggagcaucaacagccguugcaacagcaggacaaguaaauaugaucgauccuuggauauucaauaauuuuguacaagcuccacaaggagaauuuaccauaucaccaaacaauacaccaggagacauuuuauucgacuuacaacuaggaccucaucuaaaucccuuuuuagcucacuuaagucaaauguacaacgguuggguaggaaauaugagaguacgaauacuauuagcaggaaaugcauuuacagccggaaaaaucauaauauguugcguaccgccuggauuugacgcaagaauauuaacaauagcacaagcaaccuuauucccacaucuuauagcugacguaagaacauuagaaccaguagaauuaccucuugaagauguacgcaauguuuuauuucauaauucaucacaaccacaaccaacaaugagacuaguagcaauguuauauaccccauuacgaacagguggugguucaggaggaacagaugcuuucguaguagcaggacgaguucuaacaugccccgccccagauuucucauuucucuuucuaguaccaccaucaguagaacaaaaaacaagaguauucucaguaccaaacguaccuuuaaaagaucucucuaauucuagaguacccguaccaauacaaggaauguucaugucaccagauguaaaucaaucuguacaauuccaaaauggucguugucaaauagauggacaacuacaaggaacaacaccagucucccuuucacaacuaugcaaaauacgagguaaaacuucaucaaaugcaagaguacuaaacuuaucagaaguugacggaacuccuuucauccccuuagaaucacccgcaccagucgguuucccugacuuaggagguugugacuggcaugucaacuuuacauuccaagcacaaaaucaagaucccucucaauccguaacauuugcaacaaaugaugcaucauuuguaccuuacuuagguucaauuucaccacacaauggaggagacuuucauucaggagauauuauagguuccuuaggcuggauuuccgcaccaucugacucaucacaauuaaauguauggacaauaccgaaauauggcucaucauuaccagauguaacacaucucgcaccagcaguauucccaccaggauuuggugaaguaauacuauacuuccauucaacuuuuccaggcucaggacaaccaggacaauuacaaguuccaugccuacucccucaagaauuuauaacccauuuuuguaacgagcaagcacccauagcaggagaagcagcacuccuucauuacguugaucccgauacaggcagaaaucuaggagaauuuaaacucuauccagacggauuuaugaccuguguuccaaacucagucucuucugguccucaaacacuaccaaucaauggcguauuuguauuuguaaguuggguaucucguuucuaucaauuaaaacccguaggaacugcaucugcagcaagacgucucgguuuacgaagaauauaa

SEQ ID NO: 31482 - RNA, 1632 nt, Artificial Sequence
  derived and/or modified sequence opt6 from VP1__Norovirus__AFN06735
augaugauggcuagcaaagaugcaucaccaucugcagacggugccaacggagcaggucaauuagucccagaagucaacaacgcagaaccacuuccauuagaccccgucgcuggagcuagcacagccuuagcaacagcaggacaaguaaacaugauagauccuuggaucuuuaacaauuuuguacaagcaccacaaggagaauucaccauuucuccuaauaacacaccaggagauauauuauuugaccuacaauuaggaccacaccucaauccauucuuagcucaucuaucucaaauguauaacggaugggucggaaauaugagaguaagaguaauauuagccggaaaugcauucacugcuggaaaaguaauaauauguugcguaccaccaggauuucaaucaagaacacuauccauugcacaagccacauuauuuccacacauaauugcagauguaagaacauuagaaccaaucgaaaucccuuuagaagauguaagaaacacauuauaucauacaaacgacaaucaaccaacuaugagacuucuauguauguuauacacaccacuaagaacaggagguggaucaggaggaacagacgcauuuguuguagcagguagaguuuuaacaugcccaucaucugauuucaauuuuuuauuuuuaguuccaccuacuguagaacaaaaaacaagaccauucucaguaccaaauauacccuuacaacuccucagcaacucccgcguaccaaaucuaauacaaucuaugguauuaucaccugaucaagcacaaaacguucaauuucaaaacgguagauguacaacagauggacaauuacuugguacuacaccgguuucaguuagucaaaucuuaaaauuucgagguaaaguaucagcagguucacgaguaauaaaucuaacugaauuagauggaucaccauuccuagcauuugaagcacccgcaccuacaggauuuccagaccucgguacaucugacuggcacguugaaaugucauuaaauucuaauucacaaucauccggaaacccaauacuauuaagagauauucaacccaauucaucagacuucgucccacacuuaggaucaguuuccgucacaaccgcuauagacguagcuggagacuauacuggaacaauacaauggacuucacaaccaucaaacguuacccccguccccgauguuaacuuuuggacaauaccacaauauggaucuaaucuagccgaagcaagccaacuugcaccaguugucuauccaccuggauuuggagaagcaauaguauauuucaugucaccaaucccagguccuaauacagcacacaaaccaaauuuaguaccaugucuuuuaccucaagaauucgugacucauuuugucagugagcaagcuccaucaaugggugaagcagcauuaguucauuacguagacccugauacaaauagaaaucuaggcgaauucaaauuauaucccgaaggauuuaucacaugcguaccaaacgguacuggcccccaacaauuaccucuaaauggcguauucguauuugcaucauggguaucucguuuuuaccaacuaaaaccagucgguacugcaucaucugcgcgaggaagacuaggaguccgcagauaa

SEQ ID NO: 31483 - RNA, 1635 nt, Artificial Sequence
  derived and/or modified sequence opt6 from VP1__Norovirus__AFN06736
augaugauggcaucaaaagacgcaccaacaaacauggacggaacuucaggagcaggacaauuaguaccagaagcaaacaccgccgaaccaauuucaauggauccaguugccggugcagcuacagcaguugcgacagcaggucaaauaaauaugauagauccauggauaaugucuaauuuuguucaagccccacaaggugaauuuacaguaucaccaaauaacacaccaggagacguacuuuuugacuuacaacucggaccacaauuaaauccauuucuagcacaccuagcacaaauguauaacggauggguaggcaacaugagaguaaaaguauuauuagcagguaaugcauucaccgcaggaaaaaucauaauaucauguauacccccaggauucacuucacaaaauauuuccauagcacaaaugacuauguuuccucauguaauugccgauguaagaguauuagaaccaauagaaauaccacucgaagacguaagaaauguacuguuccacacaaaugacaauagaccaaccaugagauuaguuugcauguuauacacaccacuaagagcaaauggaucaucuucagguacagauccauucguaauagcaggcagaguauuaacuuguccagacucaaacuuuagcuuuuuauucuuaguuccuccuaauguagaacaaaaaacacgaccauuuucuguuccaaacauacccuuaaacacucucucaaauucacgaguaccuucacuaauaaaaucaaugacuauaucuagagaccaaaaucaaauaauucaauuccaaaauggaagagucaccuuagauggucaacuacaaggaacuacacccacuucaguuucccaacuauguaaaauuagaggcacaacauaccacgcaacaggaggaaacgguaucaaucuuacagaacuaaacggugaaccauaucaugcauuugaauccccagcaccaaucggauuuccagacuuagguggaugcgacuggcauuuaacagcaaccccaacacaagccuuuaaugacggagccaaagucguacguuuaucaguaacucaaggagcagcauucgcuccucaccuaggaaccauucauuauacaacaacagaccaugauuacgauccaaacacaucaaucaucugcacccuagacuggcuaucacaaaccacuggucaaaauaauguagaucccuggcaaauuccaacauacggaucaacauuaacagaggccgcacaacucgcaccaccaaucuuccccccuggauuuggagaaacauuaguuuuuuucuuaucagauuucccuauuucuaaugguaaaaacggccucucaguuccauguacacuuccacaagaauucgucacucacuuuguaaacgaacaagcaccaauucgaggagaagcagcauuacuccacuacguagaucccgauacacaccguaauuuaggugaauuuaaauuauacccagaaggauuuaugaccuguguaccuaauacaucagguggugguccacaaacacuuccaauaaacgguguauuuguauuuguauccuggguaucacgauucuaucaacuaaaaccaguagguacagcuggugcugcaagacgauuagguauucgaagaucuuaa

SEQ ID NO: 31484 - RNA, 1635 nt, Artificial Sequence
  derived and/or modified sequence opt6 from VP1__Norovirus__AFN06738
augaugauggccucaaaagaugcgccaacaaauauggauggaacuucaggagcaggccaauuaguucccgaagcaaacacagcagaaccuauaucaauggaaccagucgcuggugccgcuacugcagcagcuacagcaggacaaguaaauaugauagauccauggauuaugaauaauuacguucaagccccacaaggagaauucacaauuaguccuaauaacacaccaggugauauucuauucgaucuacaacuaggaccacaccucaauccauuucuaucacauuuagcccaaauguauaacggauggguaggaaauaugaaaguaaaggucuuacuagcaggaaaugcauuuacagcagguaaaauuauaauaucaugcaucccaccuggauuugcaucacaaaauaucucaauagcucaagcaacuauguuuccacauguaauagcagacguaagaguacuagaaccuauagaaguccccuuagaagaugucagaaauguacuuuuucauaauaacgauaauacacccacaaugagacuaguuuguauguuauacacuccauuaagagccucuggaucuuccucgggaacugacccuuuugugauagccggacgaguauuaacauguccaucaccagauuuuuccuuuuuauuucuaguaccuccaaacguagaacaaaaaacaaaaccauuuagcgucccaaauuuaccacuaaaugucuuaaguaauucaagaguaccaagcuuaauaaaauuuaugaugguaucacaagaccauggacaaaugguacaauuucaaaauggcagaguaacuuuagauggucaauuacaaggaacaaccccaacaucagccucccaauuauguaaaaugagaggaacagucuaccacgccucagguggacaaggauuaaauuuaacugaaaucgacggaacaccauaccaugcauuugaaucuccagcaccaauaggauuuccagaucuaggcgacucugauuggcauauuaaugcaucuccugcaacaacauuuaauacaggagaaucagucaagagacuagauauggaacaagguucaucauuugccccacaucuaggaacaguacauuacacaaacgcagacuaugacgccaauacugaucuaauauguucacuagaauggcuaagcccaccuucuggaggaacacccaacaaaguuaauccaugggcaauaccacgauauggaucaacucuuacugaagcagcacaacucgcaccaccaaucuauccuccagguuuuggagaagcuaucgucuuuuucaugucugauuuuccaauugcuaauggacaagauggacuuaaaguucccugcacaaucccacaagaauuuguuacacacuucgucaacgaacaagcuccaacaagaggagaagcagcccuacuccauuauguagacccagacacacaucgaaacuuaggagaauucaaacuauauccagaaggauuuaugacaugcguaccaaacaguuccggauccgguccacaaacauuaccaaucaauggcguuuucacauucguaucauggguaucucgauucuaucaacuaaaaccaguuggaacuaccggcccaguacggagacuaggcauacgucgaucauaa

SEQ ID NO: 31485 - RNA, 1635 nt, Artificial Sequence
  derived and/or modified sequence opt6 from VP1__Norovirus__AFN06739
augaugauggcauccaaagaugcaccaacaaacauggacggaacaucaggugcaggacaauuaguaccagaagcaaauacagcagaaccuauaucaauggaaccaguagcaggagcugcaacugcagcagcaacagcaggccaaguaaacaugauagaucccuggauaaugaauaacuauguucaagccccacaaggugaauuuacuauaagcccaaauaacacacccggcgauauauuauucgaucuacaauuaggaccacaucuaaauccauuccuaucacaccucgcacaaauguauaacggauggguaggaaacaugaaaguaaaaguccucuuagcaggaaacgcauucacugcaggaaaaauaauaauaucuugcauacccccuggcuuugcaucacaaaacauaucaauagcacaagcaacaauguucccucacguuaucgccgacguaagaguauuagaacccauagaaguuccucuagaagauguaagaaacguuuuauuccauaacaaugauaauacaccaacaaugagauuaguauguaugcuauauacuccucuaagagcaucugguaguucaucaggaacagaucccuuuguuaucgcaggaagaguucuaacuuguccaucaccugauuucucauuuuuauucuuaguaccuccaaauguagaacaaaaaacaaaacccuuuuccguaccaaaucuaccauuaaauguauuaagcaauuccagaguaccaucauuaaucaaauccaugaugguaagucaagaucauggacaaaugguacaauuccaaaacggaaggguaacacuugauggacaacuccaaggaacaacaccaacuucugcaagucaacuaugcaaaaugagaggaacuguauaucacgcaucuggaggacaaggacuaaauuuaacagaaauagauggaacucccuaucaugcuuuugaaucaccagcaccaauaggcuucccagauauaggugauucagauuggcauauaaaugccuccccagcaacaacauucgauagcggagaaucuaucaaaagauuagacauggaacaaggaucaaguuuugcuccucacuuaggcacaguucauuacacaaacgcagacuaucccgcaaacacagauuuaauaugcuccuuagaauggcuuuccccaccaagcggaggaacgccaaacaaaguaaacccauggacaauaccuagauauggaucaacuuuaaccgaagcagcacaacuagccccaccaauauacccaccaggauucggagaagccauaguuuuuuucauguccgauuuuccaauagcaaauggucaagaugguuuaaaaguucccugcacaauaccucaagaauucguaacacauuucgucaaugaacaagcuccgacacgcggcgaagcggcauuacuacacuacgucgauccagacacacauagaaacuuaggagaguuuaaacuauaccccgaaggauuuaugaccugcguaccaaauucaucuggaucaggaccacaaacauuacccauuaauggaguuuuuacuuucguaagcuggguaucaagauuuuaucaauuaaaaccagucggcacaacagguccuguaagaagacuaggaauaagaagaucauaa

SEQ ID NO: 31486 - RNA, 1623 nt, Artificial Sequence
  derived and/or modified sequence opt6 from VP1__Norovirus__AFV08771
augaaaauggcauccaaugaugcaaacccaucagacggaucagccgcaaacuuaguuccagaaguuaauaaugaaguuauggcacuagaaccaguagucggagcagcaauagcugcaccuguagcuggacaacaaaacgucauugauccauggauacgaaauaauuuuguacaagccccaggaggugaauuuacaguuucaccucgaaaugcacccggagaaauauuauggucagcaccacuagguccagaccuaaauccauaucucagccauuuagcccgcauguauaauggauacgcaggcggauuugaaguacaaguaauacucgcaggcaaugcauucacagcaggaaaaauaauuuuugccgcaguaccaccaaauuuuccaacagaaggacuuucaccaucacaaguuaccauguuuccacacauaauaguagauguaagacaacuagaaccaguacucaucccauuaccagauguccgaaauaauuuuuaucacuauaaucaaucaaaugauucaacaauuaaacuaauagcaauguuauauacuccauuacgagccaacaaugcaggagacgauguauuuacaguaucauguagaguuuuaacacgaccaagcccagauuuugacuucauuuuccuaguaccccccacaguagaaucacgaacaaaaccauuuucaguaccaauauuaacuguugaagaaaugacuaacucacgauuuccaauuccucuugaaaaacuauucaccggaccaucuucaacauuugucguacaaccacaaaauggaagaugcaccacagacggcguucuucuaggaacuacccaacuaucaccaguaaauauaugcacauuuagaggagacgucacacauauagcagguucacgcaacuacacuaugaauuuagcaucacaaaauuggaacucauacgauccaacagaagaaauccccgcuccacuagguacuccagacuuuguaggaaaaauacaagguguuuuaacacaaacaaccagaacagauggaucuacccgaggacacaaagcaacaguauauacaggaucagcagacuuuucuccuaaauuaggacgcguacaauuugcaacagauaccgauaaugauuucgaugcaaaucaaaauacaaaauucacucccguaggaguaauacaagacggcaacacagcacaucguaacgaaccucaacaaugggugcugccauccuauuccggacgaaauacacauaacguccauuuagcaccagcuguagcaccaacauucccaggagaacaauuacuuuucuuuagaucuacaaugccaggaugcagugguuaccccaacauggaucuagacugucuauuaccacaagaauggguccaauacuuuuaucaagaagcagccccagcccaaucagauguagcucuauuacgcuucguuaacccagacacugguagaguccuuuuugaaugcaaacuccauaaaucaggcuauguaacaguagcacauaccggacaacacgaucuaguaauacccccaaauggauauuuuagauucgauucuuggguaaaccaauuuuauacauuagcaccaauggguaauggaacuggaagaagacgagcacuauaa

SEQ ID NO: 31487 - RNA, 1623 nt, Artificial Sequence
  derived and/or modified sequence opt6 from VP1__Norovirus__AFV08774
augaaaauggcaucuucugacgccaacccaagcgacgguuccacagcuaauuuaguaccugaaguaaauaacgaaguaauggcacuagaaccaguaguuggugccgcaauagcagcuccaguugcuggccaacaaaaugucauagauccuuggauaagaaacaauuuuguacaagcacccggaggcgaauuuacaguaucaccaagaaaugcaccaggagaaauacuauggucagcaccauuaggaccagaucuaaauccauauuuaucacauuuagccagaauguauaacggauacgcuggaggauucgaaguccaaguaauauuagcuggaaaugcauucacagcuggaaaaauaaucuucgcagcaguaccacccaacuuuccuacugaaggacuaucucccucucaaguaacaauguucccucauauaauaguagauguccgacaacuugaaccaguauuaauaccauuaccagaugucagaaauaauuucuaucauuauaaccaaucuaaugacccaacaauuaaauuaauagcaaugcuauauaccccauuaagagcaaacaaugcaggagacgaugucuucacaguaucauguagaguacuaacaagaccaucacccgacuuugauuucauauucuuagucccaccaacaguagaaucacgaacaaaaccauucucaguuccaguauuaacaguagaagaaaugacaaacaguagauuuccuaucccauuagaaaaauuauucacugguccaaguuccgcuuuuguaguacaaccccaaaauggucgaugcacaacagacggagucuuacuagguaccacucaauuaagccccgucaauauauguacauuucgaggugacguaacgcacauaucaggaucuagaaauuacacaaugaaccucgcaucucaaaacuggaacucuuaugacccaacagaagaaauaccagcaccacuaggaacccccgacuuuguaggaaaaauccaaggcguauuaacacaaaccacuagaacugacgguucaacaagaggacacaaagccacaguauauacaggaucugcugauuucagcccaaaacuaggacgcguacaauucgcaacugacacagauaaugauuucguaacuaaucaaaacaccaaauucaccccuguaggaguaauacaagacggaagcacaacaccacgaaaugaaccacaacaauggguacuaccuucauacucaggacgaaauacucauaauguacacuuagcuccagccguagcaccaacauucccaggagaacaacuucuauuuuucaggucaacaaugccuggaugcuccggauauccuaacauggaucuagacuguuuauuaccacaagaauggguacaauacuuuuaucaagaagccgcaccagcacaaucagauguugcauuacucagauuuguaaacccagauacaggaaggguauuauucgaauguaagcuccacaaaucugguuauguaacaguagcacacaccggacaacacgaucuaguuauaccaccaaauggauauuuucgcuucgauuccuggguuaaucaauuuuauaccuuagcaccaaugggaaauggaaccggaagacgaagagcauuauaa

SEQ ID NO: 31488 - RNA, 1623 nt, Artificial Sequence
  derived and/or modified sequence opt6 from VP1__Norovirus__AFV08777
augaaaauggccucuuccgacgcuaacccaucugauggaucaacagccaauuuaguuccagaagucaacaaugaaguaauggcuuuagaaccaguagucggugcagcuauagccgcaccaguagcaggucaacaaaacguuauugacccauggauaagaucuaacuuuguacaagcacccggaggagaauuuaccguuagucccagaaaugcaccuggagaaauccuauggucagcccccuuaggaccagacuuaaauccauauuuaucccauuuagccaggauguauaacggauaugcuggagguuucgaaguccaaguaauacuagcagguaacgccuuuacagcaggaaaaauaauauucgcagcuguaccaccaucauuuccuauagaaggucuaucuccaucacaaguaacaauguuuccccauauaauaguugacguucgccaacucgaaccaguuuuaaucccacuaccagauguaagaaauaacuucuaccauuauaaucaaucaaaugauccaacaauaaaauuaauagcaauguuauacacaccucuuagagcaaauaacgcaggagaugacguauuuacaguauccugcagaguacuaacaagaccuuccccugacuuugauuuuauauuccuaguuccacccaccguagaaucuagaaccaagccuuucucuguaccagucuuaacaguugaagaaaugacaaacucuagauucccuauaccacuagaaaaauuauuuacagguccaucaucugcuuucguuguucaaccacaaaacggucgauguacaacagacggaguacuacucggaaccacccaacuaucaccuguaaauauauguaccuuucgaggaaauguaacacacauaucuggaucccgaaauuauacgaugaacuuagccagccaaaauuggaauuccuacgauccaaccgaagaaauaccagcaccacuaggaacaccagacuuuguagguaaaauacaagguguccuaacucaaaccacaaaaacaaacgguucaacaagaggacacaaagccacuguauauacagguucagcagacuuuucacccaaauuaggaagaguacaauucgcaacagacacugauaaugauuucgaaacaaaucaaaauacaaaauuuacaccuguaggaguuauacaagauggaucaacuacaccaagaaaugaaccacaacaauggguacuaccauccuacuccggcagaaauacacacaacguacaccuagccccagcaguugcaccaacauuucccggugaacaauuauuauucuuucguucaacaaugcccggaugcagcggcuacccaaauauggaccucgacugccuauuaccacaagaauggguucaauauuucuaucaagaagcugcaccagcacaaucagauguugcacuauuaagauuuguaaacccugauacaggaagaguacuauuugaaugcaaacuacauaaaucaggauauguaacagucgcccacacaggacaacacgaucuagucaucccacccaaugguuacuuuagauuugauucauggguaaaccaauuuuauacauuagcaccuaugggaaaugguacuggaagaagacgagcccuauaa

SEQ ID NO: 31489 - RNA, 1623 nt, Artificial Sequence
  derived and/or modified sequence opt6 from VP1__Norovirus__AFV08780
augaaaauggcaucuucugaugcaaauccauccgauggaucuacagcuaaucucguaccagaaguaaacaaugaaguaauggcauuagaaccuguagucggagccgcaauagcugcuccuguagcuggacaacaaaacguuaucgacccguggauaagaaacaacuuuguacaagcaccuggaggagaauuuaccguaucaccaagaaacgcucccggcgaaauccucuggucagcaccccuagguccagaccuaaacccauaucuaucccaccuagcaagaauguauaacgguuacgcaggcggauuugaaguacaaguaauacuagcaggaaaugccuuuacagcaggaaaaauaaucuuugcagcgguuccuccaaauuuuccaacagaaggucuaucacccucucaagugacaauguuuccccacauuauaguagauguaagacaacuagaaccaguccuaauuccccuacccgauguaagaaacaauuuuuaucacuauaaccaaucaaaugacccuacaauaaaauuaauagcaauguuauacacuccacuuagagcaaacaacgcaggagaugauguauucacaguuuccugcagaguacucacaagacccuccccugacuuugacuuuauauuccuaguaccccccacagucgaaucucgaacaaaaccauuuuccguaccaaucuuaaccguagaagaaaugacuaauucccgauuuccaauaccacuugaaaaauuauuuacaggaccaucaucagcuuucguaguacaaccacaaaacggaagauguacaacagacggaguauuacuaggaacaacacaauuaagcccaguaaauauuuguacuuuuagaggagauguaacccauauaacaggaucuagaaacuacacaaugaacuuagccacccaaaacuggaacucuuacgauccaacagaagaaauaccagcaccauuaggaacuccagauuuuguaggcaaaauacaaggcguucuaacccaaacaacgcgugcagaugguucuacaagaggacauaaagcaacugucuacaccggaucagcagacuuugcacccaaacuaggaagaguacaauuugcaacagacacagaucaugauuucgacgcaaaucaaaauacaaaauuuacaccagucggaguuauacaagacggagauacagcucaucgaaaugaaccucaacaauggguauuaccaucauauucagguagaaacucccauaacguucaucucgcuccuacaguagcaccaaccuucccuggagaacaauuauuauucuuccgaaguacuaugccaggaugcucaggcuacccaaacauggaucuagauugucuucuaccacaagaauggguacaauauuucuaucaagaagcagcuccagcucaaucagacguugcacuacuuagauucgucaaccccgauacagguagaguccuauuugaaugcaaacuccauaaaucugguuauguaacaguagcacacaccggacaacacgaccuaguuauaccaccuaacggauauuucagauucgauuccugggucaaucaauuuuacacauuagcaccaaugggaaauggaacaggaagaagaagagcacuauaa

SEQ ID NO: 31490 - RNA, 1623 nt, Artificial Sequence
  derived and/or modified sequence opt6 from VP1__Norovirus__AFV08783
augaaaauggcaucaucagacgcaaacccuucagauggaucaacagcaaacuuaguaccagaaguaaacaacgaaguaauggcucucgaaccaguggucggugccgcuauagccgcacccguagcaggacagcaaaauguaauagacccauggauaagaaauaacuuuguacaagcaccaggcggagaauuuacaguaucuccucgaaaugcuccuggagaaauccuauggucugcaccauuaggcccagacuuaaaucccuacuuaucucaucuagccagaauguauaacggauaugcugguggcuucgaaguacaaguuauacuagcaggaaaugcauuuacagcagguaaaauaauuuucgccgccguaccacccaacuuucccacagaaggacuaucuccaucacaaguaaccauguuuccacauauaauagucgauguacgacaacuagaaccaguauuaauuccauuaccagaugugcgaaacaacuuuuaccauuacaaccaaucaaaugauccaacuauaaaauuaauagcuaugcuauauacaccccuacgugcaaacaaugcaggagacgauguauuuacaguuucaugccgaguacuuacaagaccauccccugacuuugauuuuauuuuucuuguaccacccacagucgaaucacgaaccaaaccauuuucaguuccaguacuuaccguagaagaaaugacaaacucacgauucccaaucccccuagaaaaacuauucaccgguccauccuccgcuuucguaguucaaccucaaaacggaagauguacaacugacgggguacuacuaggaacaacacaacucaguccuguaaacauauguacauuuagaggagacguaacacauauaucuggcucaagaaauuauacuaugaaucuugcaucacaaaacuggaauaguuacgacccaacugaagaaauuccagccccauuaggaacaccagauuuuguaggcaaaauacaaggaaugcuuacacaaacaacaagaacugacggaaguacaagaggacauaaagcaaccguauauacagguucagcagauuucuccccaaaauuaggacgaguacaauucgccacagauacagauaacgauuuuguaacaaaucaaaacacaaaauucacaccgguaggagucauacaagacggaagcacuacaccacgaaaugaaccccaacaauggguauuaccaucauacucuggaaggaauacacauaauguacacuuagccccagccgucgcaccuacauuuccaggagaacaacuuuuauuuuuucgaucuacaaugccaggaugcucaggauauccaaacauggacuuagauuguuuacuuccacaagaauggguccaauacuucuaucaagaagcagcaccugcacaaagugacgucgcacuacuacgauucguaaauccagacacaggaagaguacuauuugaauguaaauuacacaaaacaggauauguaacaguggcacacaccggacaacaugaucuugucauaccacccaacggauauuuuagauuugauucauggguuaaccaauucuacacauuagcaccaaugggaaauggaacaggcagaagaagagcauuauaa

SEQ ID NO: 31491 - RNA, 1623 nt, Artificial Sequence
  derived and/or modified sequence opt6 from VP1__Norovirus__AFV08786
augaaaauggcaucaaaugacgcaaaccccucagauggaucugcagcaaauuuaguuccagaaguaaacaacgaaguaauggcucuagaaccuguaguaggagcagcaaucgcagcaccgguugcaggacaacaaaacguaauagacccuuggaucagaaacaacuuuguacaagcaccaggcggagaauucacaguaucuccuagaaaugcaccaggagaaauucuauggagugcaccauuaggaccagaucuaaauccauacuuaucucauuuggcacgcauguauaacggauacgcaggcggauuugaaguacaaguaauauuagcugguaaugcuuucacagcugguaaaaucauauucgcagcuguuccucccaacuuuccaacagaaggcuuaucaccuucacaaguaacaauguucccacacauuaucgucgacguacgacaacuagaaccugucuuaauaccauuaccugaugucagaaauaacuucuaucacuauaaccaauccaaugacucaacuauaaaacuaaucgcuaugcuauacaccccacuacgagccaacaaugcaggagaagacguuuuuacaguauccuguaggguacuaacaagaccuucacccgacuucgauuuuauauuucuaguaccaccaacagucgaaagcagaacaaaacccuucacuguuccaaucuuaacaguugaagaaaugacaaacucacgauucccaauaccucuagaaaaacuauuuacuggaccuucaucagcauucguaguccaaccacaaaauggacgauguacaacagauggaguauuauuaggaacaacacagcuaucaccaguaaauauauguacauucagaggugaugucacacacauagcaggaucuagaaauuauacuaugaaucuagcaucuuuaaacuggaacaauuaugauccaacagaagaaauaccagccccauuaggaacaccagacuuuguaggaaagauacaagguguuuuaacacaaacuacaaaaggcgacggaucaacucgaggacauaaagcgacaguauauacuggcucagcaccuuuuacuccaaaacuuggaucaguacaauucucuacagauacagaaaaugauuucgaaacacaucaaaauacaaaauucacuccuguuggaguuauucaagauggaggcaccacacacagaaaugaaccucaacaauggguauuaccaucauauucaggaaggaacguaccaaacguucaccuagcaccagcgguagcaccaacauuuccaggcgaacaguuauuauuuuuucgaucaacuaugccuggcugcucaggcuauccaaauauggaucuagauugccuucuaccacaagaauggguacaacacuucuaucaagaagcugcaccagcucaaucagacguagcacuuuuacguuuuguaaauccugacacaggacgcguccuauuugaaugcaaacuucacaaaucaggauauguuacaguagcacacacaggacaacacgacuuaguuaucccaccuaacggauauuucagauucgacucauggguaaaucaauuuuauacacuagcuccaauggguaacggaacaggaagacgaagagcauuauaa

SEQ ID NO: 31492 - RNA, 1623 nt, Artificial Sequence
  derived and/or modified sequence opt6 from VP1__Norovirus__AFV08789
augaaaauggcaucaaacgacgcuaauccaucagauggaucugccgcaaauuuaguaccugaaguuaauaaugaaguaauggcccuagaaccaguaguuggagcugcaauugcugcaccaguagcuggucaacaaaaugucauagacccauggauaagaaauaauuuuguacaagcaccuggaggugaauuuaccguaucucccagaaaugcaccaggagaaauacuaugguccgcaccccuaggaccugaucucaaccccuaccuaucucaccuagcaagaauguacaaugguuaugcuggaggauuugaaguacaagucauacuagcaggaaaugcuuuuacugcagguaaaauaauauucgcagccgucccuccaaauuuuccaacagaaggucuaucaccaucccaaguuacaauguucccucacauaauaguagacguuagacaauuagaaccaguuuuaauaccauuaccagauguacgcaacaauuuuuaucacuauaaccaaucaaaugacagcacaauaaaacuuauagcaauguuauauacacccuuaagagcaaacaaugcaggagaagauguauuuacagucuccuguagaguacuaacacgaccgucuccagacuuugauuuuaucuuucuaguaccuccaaccguugaaucaagaacaaaaccauucacagucccaauacuaacaguagaagaaaugacaaacucacgcuuuccaauaccacuagaaaaauuauuuacagguccaucauccgcauucguaguacaaccacaaaauggaagauguacaacagauggugucuuacuagguacuacacaacuauccccaguaaauauauguacauuuagaggcgacgucacgcauauagcaggaaguagaaauuacaccaugaaccuagcauccuuaaauuggaauaacuacgauccaacagaagaaauuccugcaccauuaggaacaccagauuucguaggaaaaauucaaggugucuuaacacaaacaacaaaaggagacggauccacaagaggacauaaagcaacaguauauaccggcagcgcaccauuuacaccuaaauuaggauccguacaauucggaacagauacugaaaaugauuuugaaacgcaccaaaauacaaaauucacuccaguuggaguaauacaagacggaggaacuacacacagaaacgaaccacaacaauggguacuaccaucauacucaggaagagacguacccaauguacauuuagcaccugccguagcuccuaccuuucccggcgaacaacuacucuucuuucgaaguacaaugccagguugcuccggauacccaaauauggaccucgauugucuacucccacaagaauggguacaacauuucuaucaagaagcagcaccugcucaaucagacguugcauuacuaagauuuguuaaucccgacacaggacgaguccuuuuugaauguaaacuacauaaaucuggauacguaacaguagcacauacaggucaacaugacuuaguuauaccaccuaauggauauuuccgauuugauucaugggucaaccaauuuuauacauuagccccaaugggcaacggaacaggaagaagaagagcucuauaa

SEQ ID NO: 31493 - RNA, 1623 nt, Artificial Sequence
  derived and/or modified sequence opt6 from VP1__Norovirus__AFV08792
augaaaauggcaaguucagacgcaaaucccucagacgguucagcagcaaaccuaguuccagaaguuaauaacgaaguaauggcauuagaaccugucguaggcgcagcuauagcagcaccaguugcaggacaacaaaauguaauagauccauggauuagaaauaauuuuguacaagcacccgggggcgaauucacagucagcccaagaaaugcaccaggagaaauacuauggucagcaccacuagguccugaccuaaacccauaucuaucucaucuagcaagaauguauaauggcuaugcaggaggcuuugaaguccagguuauauuagcaggcaaugccuuuacagcaggaaaagugauauucgcagcaguaccaccaaauuuucccaccgaaggacucucaccaucacaaguaacaauguucccacauauaguaguugacguaagacaacuugaaccaguauuaauuccucuaccagauguucggaacaauuuuuaccauuauaaucaaucuaaugacucaacuauuaaacugauagcuauguuauacacaccacuaagagcaaauaaugcuggagaugacguauucacaguuucaugcagaguauuaacgagaccuucaccugacuuugacuuuaucuuucuagucccuccuacaguugaaucuagaacuaaaccauuuucagucccaguacuaacuguagaagaaaugaccaacucaagauucccaauuccauuagaaaaacuauucaccggucccucaucagcauuuguaguacaaccacaaaaugguagauguacaacagacggaguacuauuagguacaacacaauuaucaccagucaauauauguacuuuuagaggagacguaacccacauaacuggaucaagaaauuauacaaugaauuuagcaagccaaaauuggaauaauuaugauccaaccgacgaaauaccagcaccccuaggaacaccagauuuuguuggaaaaauacaaggaauguuaacacaaacaaccaggacagacgguucaacaagaggacacaaagcaacaguuuauacagguucagcugauuuugcucccaaacuaggacgaguacaauucgaaacagauacagaucacgauuuugaagcuaaucaaaauacaaaauuuacaccagucggcguuauacaagauggaaguacaacacauagaaaugaaccucaacaauggguacuuccaucauauucagguagaaauacccauaauguucacuuagcaccagcaguagcuccaacauuuccaggagaacaauuauuauuuuuucgaaguacaaugccaggaugcucaggauauccaaauauggaucuugauugucuauuaccacaagaauggguacaauauuuuuaucaagaagcagcaccagcacaaucagauguagcauuauugagauucguaaacccugauaccggacgaguauuauucgaauguaaacuacauaaaaguggauacguaacaguugcacauacuggacaacacgacuuaguaauacccccaaacggauauuuuagauuugauucauggguaaaucaauucuauacacucgcaccuauggguaacggaacgggcagacgaagaguaguauaa

SEQ ID NO: 31494 - RNA, 1623 nt, Artificial Sequence
  derived and/or modified sequence opt6 from VP1__Norovirus__AFV08795
augaaaauggccucaucagacgcaaauccuucugauggaucugcagcaaaucuagucccugaaguuaauaaugaaguuauggcacuagaaccaguaguaggagcagcuauagcagcaccaguagcuggacaacaaaacguuauagacccuuggauucgaaacaacuuuguacaagcaccuggaggugaauuuacaguaagcccacguaaugcaccaggagaaauccuuuggucagcaccacuagguccagaucuaaauccauaccugucgcauuuagcacgaauguacaaugguuacgcuggagguuuugaaguccaaguaauacuagcaggaaaugcauuuacugcaggaaaaguaaucuucgcagcagucccaccaaauuuuccuacagaaggacuaagucccagccaaguaacuauguucccacacauagucguugacguaagacaacuagaaccaguucucauuccacuuccagacguaagaaauaauuuuuaucauuauaaucaaucuaaugauccaacaauaaaauuaaucgcaauguuauauaccccacuaagagcaaacaacgcaggagaugauguauucacaguaucauguagaguauuaacuagaccuucucccgauuuugacuuuauauuucucguaccaccaacaguagaaucacguacaaaaccauuuucaguaccagucuuaaccguagaagaaaugacaaacucacgcuuuccaauuccucuagaaaaauuauuuacaggaccaucaucagcauucguuguucaaccacaaaacggaagaugcacaaccgacgguguauuacuuggaacaacccaacuaucaccaguaaauauauguacuuuuagaggagauguaacacauauaacaggaaguagaaauuacacaaugaaucucgcaucccaaaauuggaacgauuacgauccaacagaagaaauaccagcaccacuaggaacacccgacuucguuggaaaaauacaagguguuuuaacacaaaccacaagaaccgaugguucuacaagaggacauaaagcuacuguauacacugguucagcagauuucgcaccaaaauuaggacgaguacaauucgaaacagauaccgaccgagacuuugaagcuaaucaaaauacuaaauuuacaccaguuggaguaauacaagauggaggaacaacacauagaaaugaaccucaacaauggguacuaccaaguuauucugguagaaauacacauaauguacaccuugcaccagcuguagcccccacuuuuccaggagaacaacuauuauucuucagauccacaaugccuggaugcuccggauauccaaauauggauuuagacuguuuauuaccucaagaauggguucaauauuuuuaucaagaagcagcaccggcacaaucagauguugcauuguuaagauuuguaaaucccgauacaggaagaguccucuucgaaugcaaauuacauaaaucaggauauguaacaguugcacauacuggacaacacgaucuuguaauaccaccaaacggauacuucagauucgacucuuggguuaaccaauucuauacauuagcacccauggguaacggaacaggacgucgacgagcaguauaa

SEQ ID NO: 31495 - RNA, 1623 nt, Artificial Sequence
  derived and/or modified sequence opt6 from VP1__Norovirus__AFX95940
augaaaauggcauccucagaugcaaauccaucugacggcuccgcagcaaauuuaguaccugaaguuaauaaugaaguaauggccuuagaaccaguagucggagcagccaucgcagcuccaguagccggacaacagaauguaauagacccauggauacgaaauaacuuuguacaagccccuggaggugaauucacagucucaccacgaaaugccccuggagaaauauuaugguccgcaccacuagguccagaccuuaauccuuauuuaucccacuuagcacguauguauaaugguuacgccggaggauuugaaguacaaguuauuuuagccggaaaugcuuuuacagcaggaaaaguaauauuugcugcaguuccaccaaauuuuccuaccgaagguuuaucgccaucucaaguaacaauguuuccacacauugucguagauguacgacaacuugaaccaguucuaauuccauuaccagauguaagaaauaauuuuuaucauuacaaccaauccaacgauccaacuauuaaauuaauagcaauguuauauacaccauuaagagcaaacaaugcaggagacgauguauuuacaguaucaugccguguucuaacuagaccuucaccagauuuugacuuuauuuuuuuagucccaccuacaguagaaucaagaacaaaaccuuuuuccguaccaguacuaacaguagaagaaaugacaaacucaagauucccaauaccacucgaaaaauuauucaccggaccauccucagcuuucguaguccaaccucaaaauggcagauguacaacugacggagucuuauuagguacuacacaauuaucccccguaaauauauguacauuucgcggagauguaacucauauaacaggaucucgaaauuacacaaugaauuuagcaucacaaaauuggucaaauuaugauccaacagaagaaauaccugcaccacuaggaaccccagacuuuguaggaaaaauacaaggcguacucacacaaacaacacgaacagacggaucaacaagaggacacaaagcaacagucuauaccggaagcgccgauuucgcaccaaaauuaggcagaguacaauucgaaacugacaccgauagagacuuugaagccaaucaaaacaccaaauuuacacccgugggaguuauacaagauggaaguacaacacacagaaacgaaccucaacaauggguauuaccauccuacuccggucguaacacuccaaauguucaucuugcaccagcaguagcuccaacauuuccaggugaacaacuccuauucuuuagaucaacaaugccugguugcucuggauauccaaauauggauuuagacugucuacuuccucaagaauggguacaauauuuuuaucaagaagcagcaccagcacaaucagacguagccuuauuaagauucguaaacccugauacagguagaguuuuauucgaaugcaaacuccauaaauccggcuacguaaccguugcucacaccggacaacacgaucuaguaaucccaccaaacgguuauuuuagauucgauucauggguuaaucaauuuuacacuuuagcaccaaugggcaauggcacuggucgaagaagagcacuuuaa

SEQ ID NO: 31496 - RNA, 1620 nt, Artificial Sequence
  derived and/or modified sequence opt6 from VP1__Norovirus__AFZ84663
augaaaauggccucaaaugacgccucaccaucagauggcucaacagcuaauuuaguaccagaaguuaacaaugaaguaauggcacuugaaccuguuguaggugcagcaauagccgcacccguagcaggccaacaaaauguaaucgacccauggauuagaaauaauuuuguacaagcuccuggaggagaauucacaguaucaccacgaaacgcaccaggagaaauauuauggucugccccacuaggaccagaccuaaacccauaccuuucccaucuagcaagaauguauaacggcuacgcaggaggauucgaaguccaaguuauauuagcaggaaaugcuuuuacagcagggaaaauaauauucgcugccguaccaccaaauuuuccaacagaaggacuaucaccaucucaaguuacaauguucccacacauaauagucgauguaagacaauuagaaccaguacuaauaccacuaccagacgucagaaauaauuucuaucacuauaaucaaucaaacgacucuaccaucaaauuaaucgcaaugcuauauacaccauuaagagcaaauaaugcuggugaugacguauuuacaguaucuuguagaguauuaacuagaccuucaccagauuucgacuucauauuucuaguaccaccaacagucgaaucaaggacaaaacccuuuacugucccaauccuaacuguagaagaaaugucaaacucacgauucccaauuccacuagaaaaauuauauacagguccuucaucagccuucguuguacaaccacaaaacggaagaugcacaacagauggcguacuauuaggaacaacccaacuaucagcugucaauauauguacguuuagaggggaugucacacauaucgcaggcucccacgauuauacaaugaaucuugccucacaaaauuggaauaauuacgauccaacugaagaaaucccugcacccuuaggaacuccagacuuugucgguaaaauacaaggaauguuaacacaaacuacuagggaagacggauccacaagagcacauaaagcgaccguuuccacaggcucuguucauuuuacaccuaaauuaggcuccguucaauacacuacagauacuaauaacgauuuccaaacaggacaaaauacaaaauucacaccaguuggagucauacaagacggaaacaaucaccaaaacgaaccacaacaauggguauuaccaaauuauucugguagaacaggacauaauguacaucuagcucccgcaguagcaccaacauuccccggagaacaacuccucuucuuuagauccacuaugccaggcugcucaggcuauccaaacaugaaccuugacugccuauuaccacaagaauggguucaacauuuuuaccaagaagcagcaccagcucaaucagauguagcacuacuaagauuugucaauccagauaccggaagaguacuauucgaauguaaauuacacaaaucaggauacguuacuguagcucauaccggcccacaugaccuaguaauacccccuaacggauauuuuagauucgauucuuggguaaaucaauucuacacacuagcaccaaugggaaacggagcugguagaagaagaguccuauaa

SEQ ID NO: 31497 - RNA, 1623 nt, Artificial Sequence
  derived and/or modified sequence opt6 from VP1__Norovirus__AGG37871
augaaaauggccaguagugaugcuaaccccucagacggaucagcagcuaaccuuguaccagaaguaaacaaugaaguaauggcucuagaaccagucguaggagcagcaauagcagccccaguagcaggacagcaaaauguaauagacccuuggauaagaaauaacuuuguacaagcaccuggaggcgaauucacaguaucaccacgaaacgcaccaggagaaaucuuauggucagcaccacuaggacccgauuuaaaucccuaucuaucacauuuagccagaauguauaacggauaugccggaggauuugaaguacaaguaauacuagcaggcaaugcauucacugcuggaaaaguaauauuugcugcaguaccaccaaauuuuccaaccgaaggacuaucaccaucacaaguaacuauguucccacauaucgucguagauguaagacaacuagagccaguacuaauuccacuuccagacgugcguaacaauuucuaucauuauaaccaaucaaaugacccaacaauaaaacuaauugcuauguuauauacaccccuaagagcuaacaacgcaggcgacgaugucuuuacaguaucaugucgaguauuaacaagaccaucaccagacuuugacuuuaucuuuuuaguaccucccacaguagaaaguagaaccaaaccauuuucaguaccaguccuaacuguugaagaaaugacaaauuccagauuucccaucccacuagaaaaauuauucacaggaccaucaagcgcauuugucguacaaccacaaaauggccgauguacaacagauggcguauuauuaggaacuacucaauuaucaccaguaaauauuugcacauuuagaggcgaugucacucacauaacaggcucaagaaacuacacaaugaacuuagcaucacaaaauuggaacaacuacgacccaacugaagaaauacccgcaccacuaggcacaccagauuucgucgguaaaauacaaggaguucucacacaaacaacaagaacugacgguuccacaagaggacauaaagccacuguauauaccggcucugcagacuucgcuccuaaauuaggaagaguacaauuugaaacagauacugaccaugacuuugaagcgaaucaaaauacuaaauuuacaccaguaggggucauccaagauggaggcacaacucauagaaacgaaccacaacaauggguucuuccgucauauagcggacgaaauacacacaacguucaccuagcccccgcaguagcacccacuuuuccuggcgaacaauuacuauuuuuccgauccacuaugcccggauguuccggauauccaaacauggacuuagauugucuuuuaccucaagaauggguacaauauuucuaucaagaagcagcaccugcccaauccgaaguagcgcuauuaagauuuguaaauccugacaccggaagaguuuuauucgaaugcaaauuacauaaaaguggauauguaacagucgcacacacaggacaauacgaucuaguuauaccaccaaauggauauuucagauucgauuccuggguaaaucaauucuauacacuugcaccaauggguaauggcacaggaagaagaagagcuguauaa

SEQ ID NO: 31498 - RNA, 1623 nt, Artificial Sequence
  derived and/or modified sequence opt6 from VP1__Norovirus__AGI96383
augaaaauggcuucaucagaugcaaacccaucugauggaucaaccgccaaccuugucccagaaguaaauaaugaagucauggcccuagaacccgucguaggagcagccauagcugcccccgucgcaggccaacagaauguaauagauccuuggauuagaaauaacuuuguacaagcaccugguggugaauucaccguaucaccucgaaaugcaccaggagaaauccuauggucugccccccucggaccagaucuaaauccuuaucuaucucaccuagcuagaauguauaacggauaugcaggaggcuucgaaguacaaguaauacuagcaggaaaugccuuuacagcugguaaaauaauauuugcagcaguucccccaaacuuuccaacagaaggacuuucaccaucccaaguuacaauguuuccccacauaauuguagacguaagacaacuagaaccaguacuuaucccauuacccgacguacgcaacaauuuuuaccacuacaaucaaucaaacgauucaacaauuaaacuaauagcaaugcuuuauacuccacuaagagccaacaaugcaggcgacgaugucuuuaccguauccugucgaguacuaaccagacccucaccagacuucgauuuuauauucuuaguaccaccaaccguugaaucccgaaccaaacccuuuucugucccaauauuaacaguugaagaaaugacaaacucaagauucccaauaccacuagaaaaauuauuuacaggaccaaguucagcauucguaguucaaccucaaaacggaagaugcacaacagaugguguauuacucgguacaacucaacuaagccccguaaacauauguacauuuagaggugacguaacacacauaccaggaucccauaacuauaccaugaaucucgcuucacaaaacuggaacucauacgacccuacagaagaaauaccugcaccacuaggaacacccgauuucguaggcaaaauacaaggaguacuaacacaaacaacauccacuaacgguucaacaagaggacacaaagcaacaguauauacuggaucagccgacuuuucuccuaaauuaggcagaguacaauucuccacugauacaaauaacgauuucgaaacuaaucagaauacaaaauuuacaccaguagguguaauacaagacgguuccacaacacccagaaacgaaccacaacaauggguauuaccaucauacucuggaagaaacauucauaauguacaccuugcucccgcaguagccccuacauuuccaggugaacaacuacuuuuuuuuagaucaacaaugccaggaugcucaggauacccaaauauggaucuagauugccugcuaccucaagaauggguacaauauuucuaucaagaagcugcaccugcacaaagcgauguagcacuuuuaagauucguaaauccagacacuggaagaguacuauuugaaugcaaauuacauaaauccggauaugucacuguagcacacacaggacaacacgauuuaguuauaccaccaaaugguuauuucagauuugauucuuggguaaaccaauuuuauacucuagcaccaauggguaacggaacaggacgucgaagagcucuuuaa

SEQ ID NO: 31499 - RNA, 1623 nt, Artificial Sequence
  derived and/or modified sequence opt6 from VP1__Norovirus__AGI99552
augaagauggcaucaucagacgcaaacccaagugaugguucagcagcaaauuuaguaccaaaaguuaacaacgaaguuauggcacuagaaccuguaguaggcgcagccauagcagcaccuguagcuggacaacaaaaugucauugacccuuggauuaaaaacaacuucguucaagccccaggaggugaauucacagugucaccuaaaaaugcaccuggugaaauucuuuggucagcacccuuaggccccgaucuaaaucccuaucuaucccacuuagccaaaauguacaacggcuacgcaggaggauuugaaguacaaguaauacuagcaggaaaugcauucacagcaggaaaaguaauauuugcagcuguaccaccaaauuuuccuacagaaggauuaucuccaucacaaguaacaauguucccucacauaguaguagauguacgacaauuagaaccaguucuaauaccacucccagauguuagaaauaacuuuuaccacuauaaucaauccaacgacccaaccauuaaacuaauagcaaugcuauacaccccucuaagagcuaacaaugcuggcgacgauguauuuaccguaucuugucgaguacuaacacgaccaucaccugauuuugacuucauuuuucuaguaccuccaacaguugaaucaagaacuaaacccuucucaguacccguucuaacaguugaagaaaugacaaauucuagauuuccaauacccuuagaaaaacuauuuacaggaccaucaucagcuuucguaguccaaccacaaaacggacguuguacuacagauggugucuuacuaggaacaacacaauuaucuccaguuaauauaugcacauuuagaggagacguaacacauacaauaggaucaagaaacuacacaaugaaucuagcuucccaaaacuggaacaacuaugacccaacagaagaaauaccagcuccucucggaacacccgauuucguagguaaaauacaaggaguucuaacccaaacaacuagaacugacggaucuacacggggucacaaagcaacaguauacacuggauccgcagauuucgccccaaaacuaggaagaguacaauuugaaacagacacugaccacgacuucgaagcaaaucaaaauacaaaauucacaccagucggaguuauacaagacggaucaacaacacaucgaaaugaaccccaacaauggguuuuaccaucauauuccggacgaaacacacauaacguacauuuagcaccagcaguugcaccaacauuucccggagaacaauuacuauuuuuuagaucuacaaugccgggauguucuggguacccaaauauggauuuagauugucuacucccccaagaauggguucaauacuucuaccaagaagcagcaccugcacaaucagauguagcacuauuaagauuuguaaacccagacacagguagaguacuauucgaauguaaauuacacaaaucuggauauguuaccguagcucauacaggacaacacgaucuaguuauaccuccuaacggauauuuccgauuugauucauggguaaaucaauuuuauacacuagcuccgaugggaaauggaacaggacgacgaagaccauuauag

SEQ ID NO: 31500 - RNA, 1623 nt, Artificial Sequence
  derived and/or modified sequence opt6 from VP1__Norovirus__AGI99553
augaaaauggcaucaucagacgcaaauccaccagauggauccgccgcaaauuuaguaccaaaagucaauaaugaaguaauggcucuagaaccaguaguaggagcagccaucgcugccccaguagccggacaacaaaauguaauagauccauggauuaaaaauaauuuuguacaagcuccaggaggugaauuuacaguuucccccaaaaacgcaccuggagaaauauuauggucugcuccacucggaccagaucugaacccauacuuaucacaccuagcaagaauguacaacggauacgccggaggauuugaaguacaaguuauacuagcaggaaacgcauuuacagcaggcaaaguaauuuucgcagccgucccuccaaacuuuccaacagaaggcuuaucaccaucccaaguuacaauguucccacauaucguaguugacguucgucaauuagaacccguacuaauuccucuuccagauguaagaaacaacuuuuaucauuauaaucaaucaaaugauccaacaauaaaauuaaucgcaaugcuuuacacaccacuaagagcaaacaaugcaggugacgacguauuuacaguaucaugcagaguacuaacacgcccuucaccagauuuugacuucauauuuuuaguaccaccaacagucgaaucaagaacaaaaccauucucagucccaguacuuacaguugaagaaaugacaaauucaagauuuccaauuccauuagaaaaacuauucacaggaccaucaucagcuuuuguaguacaaccacaaaacggucgauguacaacagauggaguacuacucgguaccacccaauuauccccaguaaacaucuguacuuuuagaggugacguaacccauauaacugguucaagaaauuauacaaugaaccuugccucacaaaacuggaacaacuacgauccaaccgaagaaauaccagcaccucuaggaacaccugacuuuguaggaaaaauacaagguguauuaacacaaacaacucgaacagauggauccacuagaggacauaaagcaacaguauauacagguucugcagauuucgcccccaaacuaggucgaguacaauucgaaacagauaccgaucaugacuuugaagcaaaucaaaauacaaaauucacaccaguaggaguaauacaagauggaagcaccacacauagaaacgaaccacaacaauggguauuaccauccuauucaggaagagauacccacaacguacacuuagcaccagcuguagccccaacauuucccggagaacaacuauuauuuuucagaucaaccaugccaggaugcucgggauacccaaauauggaucuagauugucuucuaccacaagaauggguacaauauuuuuaucaagaagcugcacccgcacaaucugacguagcuuuacuuagauucguaaacccagacacaggacgcguguuauucgaauguaaacuacacaaaucuggauacguaacaguagcucauacaggacaacaugaucuuguaaucccaccaaauggauauuuuagauuugacuccuggguaaaccaauuuuacacacuagcaccaaugggaaauggaaccggcagaagaagaccccuauaa

SEQ ID NO: 31501 - RNA, 1623 nt, Artificial Sequence
  derived and/or modified sequence opt6 from VP1__Norovirus__AGI99554
augaaaauggcuaguuccgaugcaaacccaucagauggcucagcagcaaaccuuguaccaaaaguaaacaacgaaguuauggcucuagaacccguaguaggcgcagccauagcugcacccguagcuggacaacaaaaugucauugacccuuggauaaaaaauaauuuuguacaagccccaggaggugaauuuaccguaucaccaaaaaaugcaccaggcgaaauuuuauggucugcaccauuaggaccagacuuaaauccauaccucagucaccuagcaagaauguacaacggauacgccggagguuucgaaguacaaguaauacuagcaggaaaugcauuuacagccggaaaaguaauauuugcugcuguaccaccaaauuucccaacugaaggacuuucaccaucacaaguuacaauguucccucacauagucguagauguaagacaacuagaaccaguuuuaauaccauuaccugacguaagaaacaauuucuaucacuacaaucaaagcaaugacccaacaaucaaacucauagccauguuauauacuccucuacgggcuaacaaugcgggagaugauguauuuaccguaucaugucgagucuuaacuagaccaucaccugacuuugacuuuauauuuuuaguaccaccaacaguugaaucacgcacaaaaccauucucaguaccaguuuuaacuguagaagaaaugacaaauucacguuuuccaauacccuuagaaaaacuauuuacugguccaucaagugcauuuguaguacaaccacaaaacggaagauguaccacagacgguguauuacuaggaacaacucaauuaucaccagucaauauauguacauuuagaggagauguaacccacauuacuggaucucgaaauuauacaaugaauuuagcaucucaaaauugguccaauuaugaucccaccgaagaaauaccugccccacuugguacaccugacuuugucgguaaaauacagggaguuuuaacacaaacaaccagaacugacggaucaacacgaggacauaaagcaacaguuuauacagguucagcugacuucgcacccaagcuaggaagaguacaguuugaaacagacaccgacagagauuucgaagcaaaccaaaauacuaaauucacuccaguaggaguaauccaagauggaucaacuacacaccgcaaugaaccacaacaauggguacuaccuucauacucaggaagaaacacaccaaacguacaccuagcaccagcaguagcaccaacauuucccggagaacaauuacucuucuuuagaucuacuaugccaggaugcucuggauaccccaacauggaucuagauugcuuauuaccucaagaauggguacaauacuuuuaccaagaagccgcaccagcccaauccgacguugcacuucuacguuucguaaaucccgacacuggaagaguauuauucgaauguaaauuacauaaaucagguuauguaacagucgcacauacuggucaacacgaucucguaauuccacccaauggauauuucagauuugauucauggguaaaucaauucuauaccuuagccccaaugggaaauggcacaggaagaagaagaccacuuuaa

SEQ ID NO: 31502 - RNA, 1623 nt, Artificial Sequence
  derived and/or modified sequence opt6 from VP1__Norovirus__AGI99555
augaaaauggcaucaucagacgcaaauccaucugacggaagugcugcaaaucuaguaccaaaaguaaauaacgaaguaauggcauuagaaccaguaguuggagcugcuauagcagcaccagucgcaggacaacaaaaugucauugacccuuggauaaaaaauaacuuuguacaagcaccuggaggagaauuuacaguaucaccaaaaaacgcaccaggagaaauacuauggucggccccuuuaggaccagaccuuaauccauauuuaucacauuuagccagaauguacaacggcuacgcaggcggauucgaaguacaaguaauauuagcagguaaugcauuuaccgcaggaaaaguaauuuucgcagccguaccacccaacuucccaacagaagguuuaucacccucccaaguuacaauguucccgcauauuguaguagacguaagacaacuagaaccaguauuaauaccauuaccagaugucagaaacaauuucuaccauuauaaccaauccaacgauccaaccauuaaacuaaucgcaaugcuauacacaccucuaagagcaaacaaugcuggagacgauguauuuacaguuucauguagaguacuaacacguccaucaccagacuuugauuuuauauuccuagugccaccaacaguggaaucacgaacaaaaccauuuucaguuccagucuuaacaguagaagaaaugacaaauucucgcuuuccaauaccacuagaaaaacuauuuaccgguccaucuuccgcauuuguaguacaaccacaaaauggacguugcacuaccgauggaguauuacuagguacaacacaauuaucacccguaaauauauguacuuuuagaggugacguuacacauauaacagguucaagaaauuacacaaugaaucuagcaucucaaaacuggaacaauuacgacccaacagaagaaauaccugcaccccucggcaccccugacuuuguuggaaaaauucaaggcgucuuaacacaaacaacuagaacagacgguucuacacgaggucacaaagcaacaguauacaccggcagugcagauuucgccccaaaauuaggaagaguccaauucgaaaccgauacagaucacgauuuugaagcaaaucaaaacacaaaauuuaccccagucggcguaauucaagauggugguacaacacauagaaacgaaccacaacaauggguacuuccaucuuauuccgguagaaacacccauaacguacauuuagccccagccgucgcacccacauuuccaggagaacaacuccuuuucuuuagaucuacuaugccugguuguucuggauauccaaauauggauuuagauuguuuacuaccacaagaauggguucaauauuuuuaucaagaagcugcaccagcacaaucugacguagcacuauuacguuuuguaaauccagacacuggaagaguccuguucgaaugcaaacuucauaaaucuggauauguaacugucgcccauacuggucaacacgaucuuguaauaccaccaaauggauacuucagguucgauucauggguaaaucaauucuauacacuagcuccaaugggaaacgguacaggccgaagacgucccuuauaa

SEQ ID NO: 31503 - RNA, 1623 nt, Artificial Sequence
  derived and/or modified sequence opt6 from VP1__Norovirus__AGK25882
augaaaauggcaucaaaugaugccucucccuccgauggcucugcagccaauuuaguuccagaaguuaacaacgaaguaauggcacuagaaccagucguuggcgcagcaauagcagccccaguagcaggacaacaaaaugucauagacccauggauaagaaauaacuuuguacaagcacccggaggagaauuuacaguaaguccacgaaaugcaccaggagaaauauuaugguccgcaccacuagguccagacuuaaacccauaccucucucauuuagccagaauguauaacggauacgcaggaggauucgaaguacaaguaauauuagcuggaaaugcuuuuacagcaggaaaaaucauuuucgccgcagucccaccaaauuucccaacugaaggccuaucaccaucacaaguaacaauguucccacauauaauaguugacguucgacgauuagaaccuguuuuaauccccuuaccagauguacgaaauaacuuuuaccacuacaaucaaucaaaugacucaacaauaaaacuaauagcaaugcucuacacacccuuaagagcaaauaaugccggagaagacguauucacagucucauguaggguuuuaaccagaccaucccccgacuucgauuucauauuccuaguaccaccaacaguagaaucaagaacaaaaccauuuacaguaccuauacuuacuguagaagaaaugaccuauaguagauuuccaauaccuuuagaaaaacucuucacaggaccuucaagcgcauuuguaguacaaccccaaaacggacgauguacaacagacggaguauuacuagguaccacacaacuaucaccaguaaauauaugcacauucagaggagacgucacacauauugcuggaucaagaaauuauacuaugaauuuagcaucuuuaaacuggaacaacuacgacccaacagaagaaauuccagcaccacuaggaacaccagacuucguaggaaaaauacaagguauguuaacacaaacgacaaaaggagacggaucaacaagaggacauaaagcaacaguauauacaggcuccgcuccauuuacaccaaaacuuggaaguguacaauucgaaacugauacagaaaaugauuucgaaacacaucaaaauaucaaauucacaccagucggaguaauucaagacgguggcacaacacaccgaaaugaaccacaacaauggguacuuccaucauauucagguagaaacguaccaaauguucaucuugcaccagcaguugcaccaacauuuccaggagaacaacuccuauuuuucagaucaacaaugccaggauguagcgguuacccaaauauggauuuagauugccuacuaccacaagaauggguacaacauuuuuaucaagaagccgcuccagcacaauccgauguugcacuccucagauucgucaaucccgacacaggaagaguauuguucgaaugcaaacuacacaaaucaggauaugucacaguagcacacacaggucaacaugauuuaauaauaccuccaaauggcuacuuucguuucgauucaugggucaaucaauucuacacacuagcaccaaugggaaauggaacaggcagacgacgagcauuauaa

SEQ ID NO: 31504 - RNA, 1623 nt, Artificial Sequence
  derived and/or modified sequence opt6 from VP1__Norovirus__AGK25884
augaaaauggcaucaaaugaugcaaguccauccgauggcucagcugccaacuuaguacccgaaguaaacaaugaaguaauggcacuagaaccaguaguaggagcagcaauagcugcaccaguugcuggucaacaaaauguaauagaccccuggauacgaaauaacuucguacaagcacccgguggagaauuuacugugucaccaagaaaugcuccuggcgaaauauuauggucagcaccuuuagguccagaucuaaauccuuaccuaucacacuuagcaagaauguauaacggauaugcuggaggauucgaaguacaaguaauacuagcaggaaaugcauucacagccgguaaaauaauauucgcugcuguaccucccaacuucccaacagaaggauuaucaccuucacaaguaacaauguucccacauauaauaguagacguaagacaauuagaaccuguauuaauaccccuucccgauguaagaaacaauuuuuaucacuauaaucaaagcaaugacucuaccauuaaauuaauagcaaugcuauauacuccacuacgagcaaauaaugcuggagaagaugucuucaccguaucauguagaguacuaacaagaccaucccccgauuucgacuuuauauuuuuaguacccccuacaguagaaucacgaacaaaaccuuucacaguaccaauacuuacaguugaagaaaugacgaacaguagauuucccauaccauuagaaaaacuuuuuaccggaccaucaucagcauucguaguacaaccacaaaacggcagauguacaacagacgguguauuacuagguacaacacaacugucaccaguaaacauauguacauuucgcggagacguaacccauaucgcaggaucacgaaauuauacaaugaaucuagcuucauuaaacuggaacaacuacgauccaacugaagaaauaccagcaccacuaggaacaccagacuucguagguaaaauacaaggaaugcuaacacaaacagcaaaaggcgauggaucaacaagaggucacaaagcaacaguauauacagguucagcacccuuuacaccuaaacuaggaucuguacaauucgaaacagauacagaaaacgacuucgaaacacaucaaaauaccaaauuuacuccaguuggagucauacaagauggaggaacaacccauagaaaugaaccccagcaauggguacucccuucauauucuggaagaaacguacccaacguacacuuagcaccagcgguagccccuacuuuuccaggggaacaacuccuauucuuccgguccacaaugccaggaugcucuggcugcccagauauggaucuagacugccuacuaccccaagaauggguacaacacuucuaucaagaagcugcucccgcacaaucagauguagcacuacuaagauuugugaacccagauacuggccgaguacuauucgaaugcaaacuacauaaaucaggauaugucacaguugcucacacaggacaacacgacuuaauaaucccaccaaauggauauuuccgauucgauucauggguuaaucaauucuacacacuugcuccaaugggaaacggaacuggaagaagacgugccuuauaa

SEQ ID NO: 31505 - RNA, 1623 nt, Artificial Sequence
  derived and/or modified sequence opt6 from VP1__Norovirus__AGK25887
augaaaauggcaucaucagaugcaaaucccucugacggaucagcagcaaaucuuguuccagaaguuaauaaugaagucauggcuuuagaaccagucguuggugcagcuaucgcagcaccuguagcaggacaacaaaacguaauagauccauggauacguaauaacuucguacaagcaccagguggagaauuuacaguaucaccaagaaaugcccccggagaaauauuauggucugcaccucuagggccagauuuaaaccccuaucucucccaccuugccagaauguacaauggauacgcuggugguuuugaaguacaaguaauauuagcagguaaugcauuuaccgcaggcaaaguuauuuucgcagcaguaccccccaacuuuccaacagaagguuuaucaccaucacaaguaaccauguucccacauauaguaguugacguaaggcaacuagaaccaguccucaucccacuaccagauguaagaaacaauuucuaccacuacaaccaaucuaaugauccaacaauaaaacuaauagcaauguuauauacaccacuacgugcaaacaaugcaggagaugacguauuuacaguaucuugucgaguacuaacaagaccuucaccagauuuugauuucauauuucuaguucccccuaccguagaaucaagaaccaaaccauuuuccgucccugucuuaacaguagaagaaaugacaaacucacgauuuccaauuccauuagaaaaauuauuuaccggacccagcucagccuucguaguucaaccacaaaauggaagauguacaacagauggaguccuacuagguacuacacaacuauccccaguuaauauauguacauuucgaggcgacauaacccauaucacaggcuccagaaauuacacuaugaaucucgcuucacaaaauuggaauaauuacgacccaacagaagaaauaccagcaccacuuggaacaccagacuuuguaggaaaaauacaaggagucuuaacacaaacaacaagaacugauggaucuacuagaggacacaaagcaacaguacauacaggaucagcagacuucgcaccaaaacuuggaagaguucaauuugaaacugauacagaccacgacuucgaagccaaccaaaauaccaaauuuacaccugugggaguuauacaagacggaggaacuacacacagaaacgaaccccaacaauggguucucccuaguuacucuggaagaaauacacauaauguucaucuugcaccagcagucgcuccaacauuuccaggagaacaguuauuauucuuuagaucaacaaugccaggauguucaggauauccaaacauggauuuagauugucuacuaccccaagaauggguccaauauuucuaccaagaagcagcuccagcacaaucagacguagcacuacuaagauucguaaacccugauacaggaagaguauuauucgaaugcaaacuacacaaaucagguuauguaacaguagcacauaccggacaacaugaucuaguaauaccuccaaauggauauuucagauuugacuccuggguaaaucaauuuuacacucuagcaccaaugggaaauggaacaggaagacgucgagcgguuuga

SEQ ID NO: 31506 - RNA, 1623 nt, Artificial Sequence
  derived and/or modified sequence opt6 from VP1__Norovirus__AGK25890
augaaaauggcaucaucagaugcaaauccaucagauggaucugcagcaaaccucguaccagaaguuaauaacgaaguuauagccuuagaaccagucgucggcgcugcaauagcugcaccuguagcaggacaacaaaauguuauagaccccuggauuagaaauaacuuuguacaagcaccuggaggugaauuuacaguaucuccucgaaacgcaccaggagaaauauuauggucugcaccauuagguccagaccuaaauccuuaucucucucacuuggcacguauguauaacggauaugcuggaggauucgaaguacaaguaauauuagcuggaaaugcuuucaccgcuggaaaagucauauuugcagcaguuccaccaaauuucccaacagaaggccuaucuccuucucaaguaacuauguucccacacaucguaguagacgucagacaacuagaaccaguauuaaucccacuaccagauguacgaaacaauuucuaucauuauaaccaaucuaaugacccaacaauaaaacucauugcaaugcucuauacaccucuaagagcaaacaaugcaggagacgauguauuuaccguauccugucgaguuuuaacaagaccuucuccagacuuugauuuuauauuucuaguaccaccuaccguugaaucaagaacaaaaccauuuucuguaccaguucuaacagucgaagaaaugacaaauucuagauuucccauaccccuagaaaaacuuuuuaccggaccauccucagcuuuuguaguacaaccucaaaacggaagauguaccacagacggaguucuccuuggcacuacucaauuaucaccaguuaauauauguacuuuuagaggagacauagcacauauaacaggaucacguaauuauacuaugaaucucgcaucucaaaacuggaauaauuacgauccaacagaagaaauaccugccccacuuggaacaccagacuucguuggaaaaauacaaggaguacucacacaaacuacaagaacugauggaucaacaagaggucauaaagcaacuguauacaccggaucagcagauuuugcacccaaacuuggaagaguucaauuugaaacagauacagaucaugauuucgaagcaaaccaaaacacuaaauucacaccaguagguguuauacaagauggugggacuacacauagaaacgaaccccaacaauggguacuaccaucuuauucuggaagaaauacccauaacguucacuuagcaccagcaguagcaccaacauuuccaggagaacaacuucuuuuuuuuagaucaacaaugcccggaugcuccggauaccccaacauggaucuagauugccuauuaccacaagaauggguucaauauuucuaucaagaagcugcaccagcacaaucagacguagcauuauuaagauuuguaaauccugacacaggaagaguacuauuugaaugcaaucuacacaaaucuggauauguuacaguagcacauaccggacaacacgacuuaguuauuccuccuaauggauacuuccguuuugacucauggguaaaucaauucuauacacuagcuccuauggguaacggaacaggaagaagaagagccguauaa

SEQ ID NO: 31507 - RNA, 1623 nt, Artificial Sequence
  derived and/or modified sequence opt6 from VP1__Norovirus__AGK25892
augaaaauggcaagcucugaugcaaacccaucagauggaucuacagcaaacuuaguaccagaaguaaauaaugaaguaauggcccucgaacccguaguuggagccgcuauugcugcacccguagcaggacaacaaaacguaauagauccauggauaagaaauaauuucguacaagcuccaggcggagaauuuacaguaucaccccgaaaugccccaggagaaauauuauggucugccccccuaggaccugaccuaaauccauauuuaucacaccuugccagaauguacaacgguuacgcaggaggauucgaaguacaaguaauauuagcaggcaaugcauucaccgcaggaaaaauuauuuucgcugcaguuccaccuaauuuuccaacagaaggccuaucucccucacaaguuacaauguucccacacauuauagucgacguacgacaauuagaaccaguacuaauaccacuaccugauguuagaaacaacuuuuaucauuacaaucaauccaaugacucaaccauuaaauuaaucgcaauguuauacacaccuuuaagggcaaauaaugcaggugacgacguauuuacaguuucaugcagaguacuaacucgaccgucccccgacuucgacuuuauauuucuaguacccccuacaguugaaucaagaacaaaaccauucucaguaccaguacuaacaguagaagaaaugacaaauucaagauuccccauaccucuugaaaaacuauuuacaggccccucauccgcauucguuguacaaccacaaaacggaagaugcacaacagauggagucuuauuagguacaacccaacuaucaccaguaaacauauguacuuuuagaggagacguuacacauauaccaggaucacgaaauuauacaaugaaccuugcaucccaaaacuggaacuccuaugacccaacagaagaaauaccugcaccccucggaacaccagauuucguuggaaaaauccagggaguacucacccaaacaacaagaacaaauggauccacuagaggacacaaagccacuguauacacaggaucagcggacuucucaccaaaauuagguagaguccaauucgcaacagauacagauaacgauuuugaaacaaaucaaaauacaaaauucacaccaguaggagucauccaagacggaagcacaacacccagaaaugaaccccaacaauggguacuaccaucuuacuccggacgcaauauacauaacguucauuuagcaccagcaguagcaccaacuuuucccggagaacaauuauuauuuuuuagauccaccaugccaggauguucaggauacccaaauauggacuuagauugucucuuaccacaagaauggguacaauauuucuaucaagaagcagccccagcacaaucagacguagcacuacucagauuuguaaauccugacacaggccgaguauuauuugaauguaaauuacauaaaucaggauacguaacaguugcacauacaggucaacacgauuuaguaauaccaccaaacggcuauuuucgauuugacucuuggguaaaucaauuuuacacccuagccccaaugggcaauggcacaggaagacgacgcgcauuauaa

SEQ ID NO: 31508 - RNA, 1623 nt, Artificial Sequence
  derived and/or modified sequence opt6 from VP1__Norovirus__AGK25898
augaaaauggcaucaaacgaugccaacccuucagauggaucagcagccaaucuaguaccagaagucaauaacgaaguaauggcauuagaaccaguaguuggugcagccauagcugcuccuguagcuggacaacaaaacguaauagacccauggauacgaaacaauuucguccaagccccaggaggugaauuuacaguaagcccaagaaaugcaccaggagaaauauuauggucagcaccacuaggaccagauuuaaacccauaucuaucucauuuagcaagaauguauaacggcuacgcuggaggauucgaaguacaagucauacuagcaggaaaugcuuuuacagcaggcaaaauaauauucgcugcaguaccaccaaacuuucccacagaaggucuaucucccucacaaguaacaauguucccucauauaauaguagacguuagacaauuagaaccuguacuaauuccauuaccagaugucagaaauaauuucuaccauuauaaccaaaguaaugacuccaccauaaaacuaauagcuaugcuuuauacaccauuacgagcuaacaaugccggagaagauguauucacaguaucaugccgcgucuuaacacgaccaucucccgacuuugacuuuauauuucuaguaccaccaacuguagaaucaagaacaaaaccauucacaguaccaauacuaacuguagaagaaaugacaaauucuagauuuccaauuccauuagaaaaacuuuuuaccgguccuuccucagcauucguaguucaaccccaaaaugguagauguacuacagacggcguauuacuagauacaacucaauuaucuccggucaacauuuguaccuuccguggagacguaacacacauagcaggaucaagaaauuacacaaugaacuuagcaucacuaaauuggaauaauuacgaucccacagaagaaauaccugccccauuaggaacaccagauuuuguuggaaaaauacaaggaauguuaacacaaacaacaaaaggagacggauccacacgaggucacaaagcuacagucuacacaggaucagcaccauuuaccccuaaacuuggaucaguucaauucgaaacagauacugaaaaugauuuugaaacacaucaaaauacaaaauucacaccgguaggagucauacaagacggaggcacuacccauagaaaugaaccucaacaauggguacucccuucauauuccgguagaaacguaccaaaugcgcauuuagcaccagccguugcaccaacauuuccaggagaacaacuauuauucuuuagaucuacaaugccaggcuguucaggauauccaaauauggauuuagauugucuacuaccucaagaauggguacaacauuuuuaucaagaagcugcuccugcgcaaucugacguagcucuauuaagauuugucaacccagauacaggaagaguucuauucgaauguaaguuacacaaaucaggauacguuacugcugcacacacuggucaacaugauuugguaaucccaccaaaugguuauuucagauucgacagcuggguaaaucaauucuacacuuuagcaccaaugggaaauggaacuggaagacgucgugcacuauaa

SEQ ID NO: 31509 - RNA, 1623 nt, Artificial Sequence
  derived and/or modified sequence opt6 from VP1__Norovirus__AGK25900
augaaaauggcaucuaacgacgcaaacccauccgauggcuccgccgcuaaccuaguaccugaaguaaacaaugaaguuauggcauuagaaccaguuguaggagcagcaauagcagcacccguagccggacaacaaaauguuauagauccauggauuagaaauaacuucguacaagccccaggaggagaauuuacuguaucacccagaaacgcaccaggagaaauacuaugguccgcaccauuaggacccgaucucaauccuuaccuaucacaccuagcaagaauguauaacggauacgcugguggauuugaaguucaaguaauauuagcaggaaaugccuuuacagcaggaaaaauaauuuuugcagcaguaccaccaaacuuuccaacagaaggacucucaccaucacaaguuacaauguucccccacauaauuguagauguucgacaacuagaacccgucuuaauaccauuaccagauguuaggaacaacuucuaccacuauaaccaauccaaugauucaacaauaaaauuaauagccaugcuauacacuccacuacgagcaaacaaugcuggagaagauguauuuacaguaucuuguagaguuuuaacuagaccaucuccagacuuugacuuuauauuccuaguaccaccaacaguagagucacgcaccaaaccauucacagucccuauauuaacaguagaagaaaugaccaacucaagauuuccaauaccacucgaaaaauuauuuacaggacccucaucagcauucgugguacaaccucaaaauggaagauguacaacagauggaguacuucucggaacaacccaacuaucaccaguaaauauaugcaccuuuagaggcgacguaacucacaucgcaggcaguagaaauuacacaaugaacuccgcaucucuaaauuggaauaauuaugauccaacugaagaaauaccagcacccuuaggaaccccagacuuuguaggcaaaauacaaggaaugcuaacccaaacaacaaaaggagauggaucaacacguggacauaaagccacugucuacacaggaucagcaccauuuacaccaaaacuagguuccguccaauuugaaaccgauacagaaaacgacuucgaaacucaucaaaauacaaaauucacacccguaggaguaauccaagacggaggaacaacccacagaaacgaaccacaacaauggguacucccaucuuauucuggacgcaacguaccaaacguacaccuagccccagcuguugcaccaacauucccaggugaacaacuccuauuuuuucguucaacaaugcccggaugcucaggauauccaaauauggauuuagauugucuauuaccucaagaauggguacaacacuuuuaucaagaagcagccccugcacaaucagacguagccuugcuaagauucguaaauccagacacuggcagaguuuuauucgaauguaaacuacauaaaucaggauacguaacagucgcacauacugggcaacacgaucuaguaaucccaccaaaugguuauuuuagauucgauucaugggucaaccaauucuacacacuagcaccuaugggaaaugguacuggccgaagaagagcauuauaa

SEQ ID NO: 31510 - RNA, 1623 nt, Artificial Sequence
  derived and/or modified sequence opt6 from VP1__Norovirus__AGK25902
augaaaauggcuucaaacgacgcaaauccaucugauggaucagcugcaaaucuuguaccagaaguaaauaaugaaguaauggcacuagaacccguaguaggagcugcuauagcugcaccaguagcaggacaacaaaacguaaucgacccauggauaagaaauaauuuuguacaagcaccaggaggagaauuuacaguaucaccacguaaugcuccuggagaaauacucuggucagcaccacuagguccagaucucaauccauacuuaucacaucuugcuagaauguauaacggcuacgcaggaggauuugaaguucaaguuauacuagcaggaaacgcauuuacagcuggaaaaauaauauucgcagccguaccuccaaacuuuccaacugaagguuuaucaccaucacaaguaacuauguucccucauauaauuguagauguccgucaauuagaacccguauuaauaccuuuacccgauguacguaacaacuucuaucacuacaaccaaucaaacgauucaacaauaaaauuaauugcuauguuauauacaccauugcgagcuaauaacgcaggagaagauguauucacagcuucaugucgcguacuuacuagaccaucaccagauuuugauuuuauauuucuaguaccacccacuguagaaucuagaacuaaaccauucacuguaccaaucuuaaccguagaagaaaugacaaauagcagauuuccaaucccacucgaaaaacuauuuacaggaccaucaucggcauucguaguccaaccacaaaauggacgauguacaacagaugguguacuauuaggcacaacacaacuuucaccaguaaauauauguaccuucagaggagacguaacucauauagcaggaucccgcaacuauacaaugaaucuagcauccuuaaacuggaacaacuacgauccuaccgaagaaauacccgcaccacuuggaacaccagauuuuguaggcaaaauucaaggaaugcuuacccaaacuacaaaaggagacggaagcacaagaggacauaaagcaacagucuauaccggaucugcacccuuuacacccaaacucggaucaguacaauucgaaacagacacagaaaacgauuuugaaacccaucaaaauacaaaauucacuccuguagguguaauacaagacggcggaacagcacaucgaaacgaaccacaacaauggguacuaccaucauauucaggacgaaauguaccuaacguucaccuagcaccagcagucgcaccaacauuuccuggagaacaauuacucuuuuuuagaucuaccaugcccggauguuccgguuauccaaacauggacuuagauugcuuauuaccacaagaauggguacaacauuucuaucaagaagcagcccccgcacaaucugacgucgcacuacuccguuucguaaauccagacacugguagaguauuauuugaauguaaauuacacaaauccggauauguaacaguagcacauacaggacaacaugauuuaguaauaccaccaaaugguuacuuccguuucgauucauggguaaaucaauuuuacacucuagcaccaaugggcaacggcacuggacgaagacgugcccuauaa

SEQ ID NO: 31511 - RNA, 1623 nt, Artificial Sequence
  derived and/or modified sequence opt6 from VP1__Norovirus__AGK25905
augaaaauggcuucaaaugaugcaaacccaagcgauggaucugcagcaaauuuaguaccagaaguaaauaaugaaguaauggcauuagaaccaguaguuggagcagcaauugcugcacccguagcaggacaacaaaauguaauugacccuuggauaagaaacaauuuugcacaagccccagguggagaauuuaccguaucuccuagaaaugcaccaggagaaaucuuauggucagccccacuaggaccagaucuuaauccauaucucucucauuuagcacgaauguauaacgguuacgcgggaggauucgaaguacaaguaauacuagcagaaaaugcauuuacagcaggaaaaauaauuuucgcagcaguuccacccaauuuccccacagaaggacuuucaccaucaagaguuacaauguucccacauauuauuguagacguacgacaacuagaaccugucuuaauuccacuuccagacguacguaacaauuucuaccauuacaaccaaucuaaugacucaaccauaaaacuaauagcaauguuauauacuccauuaagagcuaauaaugcaggagaagacgucuuuacugucucaugcagaguucucacaagaccaucaccagacuuugauuuuauauuucuaguacccccaaccguagaaucaagaacaaaaccauucacaguaccaauuuuaacaguagaagaaacaacaaacucaagauuucccauaccauuagaaaaacuauuuacaggaccaucuucagcauuuguaguccaaccccaaaauggaagauguacaacagacgguguauuauuagguacaacacaacuuucaccaguaaauauauguaccuuucgaggcgacguaacucauauugcaggcucaagaaacuauacaaugaaucucgcaucacuaaacuggaacaauuacguaccaacagaagaaauaccagcaccauuaggcacaccugacuuuguaggaaaaguacaaggaaugcuaacacaaacuacaaaaggagauggaucaaccagaggacacaaagcaacaguuuacacuggcucugcuccauuuacaccuaaacuagguucaguacaauuugaaacagauacagaaaaugauuucgaaacacaccaaaauacaaaauucacaccaguaggagucauacaagacggagguacaacacaucgaaaugaaccucaacaaugggucuuaccaucauacagugguaggaaugucccaaauguccacuuagcaccagcaguagcaccaaccuuuccaggagaacaauuauuauucuuccgcucaaccaugcccggguguucuggcuauccaaacauggauuuagauugccuuuuaccucaagaauggguccaacauuucuaucaagaagcagcaccagcucaaucugacgucgcacuguuaagauucguuaacccagauacuggacgaguucuauucgaaugcaaacuacauaaaucaggcuauguuacuguagcacacacaggacaacaugaccucguaauaccaccaaauggauacuuccguuucgauucauggguaaaccaauucuacaccuuagcaccaaugggaaaugguaccggaagacgaagagccuuauaa

SEQ ID NO: 31512 - RNA, 1623 nt, Artificial Sequence
  derived and/or modified sequence opt6 from VP1__Norovirus__AGK25908
augaaaauggcuucaaaugacgcaaacccuucugauggaucagcugcaaaccuaguaccugaagucaacaacgaaguuauggcccuagaaccuguaguuggcgccgcuaucgcagcaccuguagcaggacaacaaaacguaauagacccauggauaaggaacaauuuuguacaagccccuggcggagaauuuacaguaucacccagaaaugcaccaggagaaauacuauggucagccccauuagggccagaccucaacccauauuuaucacacuuagcaagaauguauaauggauacgcaggaggauucgaaguacaaguaauccuugccggaaacgcauucacagccggaaaaaucauauucgcaacagucccccccaauuuucccacagaaggauuauccccaucucaaguaacaauguucccgcauauaauaguagauguaagacaauuagaaccuguucuaauaccacuaccugauguaagaaacaauuucuaucacuauaaucaaagcaacgacagcacuauaaaauuaauagcaauguuauauacuccauuaagagcaaauaaugccggagaagacguauucacaguaucaugcagaguacuaacacgacccucgccagacuuugacuuuauauucuuaguacccccaacaguagaaucacgcacaaaaccauucacugucccaaucuuaacagucgaagaaaugacaaacuccagauuuccaauaccauuggaaaaacuauuuacaggaccaucaucagcuuucguuguucaaccacaaaaugguagauguacaacagaugguguacuacuuggaaccacccaauuauccccaguaaacauauguacauuuagaggagacguaacacauaucgcuggcucacgaaauuacacaaugaauuuagcaucucuaaauuggaauaauuaugaucccacugaagaaaucccagcaccuuuaggaacaccugacuucgucggaaaaauucagggaguacuuacucaaacaacaaaaggagaugguucaacacgaggacacaaagcaacuguuuauaccggaagugcaccauuuacaccuaaauuaggcucuguucaauucgaaacagauacagaaaaugacuucgaaacacaccaaaauacuaaauuuacacccguuggagucauacaagauggaggaacaacccauagaaaugaaccacaacaauggguacuaccaucauauucuggaagaaacgucccaaacguccaucuagcaccagcaguugcaccuacauuucccggagaacaacuacuauuuuuuagaucuacuaugccaggaugcucaggauacccaaacauggaccuugacugccuauuaccacaagaauggguacaacauuucuaucaagaagcagccccagcacaaucugauguagcacuucuuagauucguaaacccagauacaggacgaguuuuauuugaauguaaauuacauaaaucaggauauguaacuguagcccacacaggacaacacgaucuagucauaccacccaaugguuauuuccgauucgauucauggguuaaucaauuuuacacauuagcaccaaugggaaauggaacaggcagaagaagagcauuauaa

SEQ ID NO: 31513 - RNA, 1623 nt, Artificial Sequence
  derived and/or modified sequence opt6 from VP1__Norovirus__AGK25910
augaaaauggccucaucugaugccaauccaagcgauggcucagcagcaaaccuaguuccagaaguaaacaacgaaguaauggcacuagaacccguuguaggugcugcaaucgcagcuccuguagcuggacaacaaaacguaaucgacccauggauaagaaauaauuucguccaagcacccggaggagaauuuacaguuagcccaagaaaugcuccaggagaaauucuuuggucagcaccucuaggaccugauuuaaacccuuaucuaucacaccuugcaagaauguacaauggauaugcaggaggcuucgaaguacaaguaauacucgcaggcaaugcauucacagcugguaaaguaauauucgcagcuguaccaucaaacuuccccacagaaggauuaucuccuucacaaguaacgauguucccacauaucauagucgauguaagacaauuagaaccaguccuaauaccauuaccagauguuagaaacaacuuuuaucauuacaaucaaucaaaugauucaacaaucaaauuaauagcaauguuauacaccuuauuaagagcaaauaaugccggugacgacgucuucacaguaucaugucgaguauuaacucgcccaucuccugacuuugacuuuauauuucuuguuccaccuacuguagaaucaagaacaaaaccuuuuucaguaccaguauuaacaguagaagaaaugaccaacucccgcuuuccaauaccacuagaaaaauuauuuacaggaccuucuucagcuuucguaguacaaccacaaaacggucgaugcaccacagacggagucuuauuaggaacaacucaacuaucaccaguaaauauauguacuuuucgaggagacguaacacacauaaccgguucaagaaauuacacuaugaauuuagcuucucaaaacuggaacaacuacgauccaacagaagaaauaccagcaccauuagguaccccagauuuugucggaaaaauacaagguaugcuaacacaaaccacacgaacagauggaucaacacgaggacacaaagcuacaauguauaccggaagcgcagauuuugccccuaaacuuggacguguccaauuugaaacugauacagaccacgauuuugaagcuaaccaaaacacgaaauucacuccaguagguguaauacaagacggcgguaccacccauagaaaugaaccccaacaauggguacuaccuaguuacucaggaagaaauacucauaauguacaccuagcuccagccguagcaccuacauucccaggagaacaacuauuauucuuucgaccuacuaugccaggcuguucuggauauccaaauauggauuuagauagauuacuuccucaagaauggguacaauauuucuaucaagaagccgcaccagcacaaucagauguagcauuauuacgauucguuaacccagacacaggaagaguauuauucgaauguaaacuacacaaaucagguuauguaaccguagcacauacaggacaacaugaccuaguaauaccaccaaacggauauuucagauuugauuccuggguaaaccaauuuuacacucuagcaccaaugggaaauggaaccggaagacgaagaguagucuaa

SEQ ID NO: 31514 - RNA, 1623 nt, Artificial Sequence
  derived and/or modified sequence opt6 from VP1__Norovirus__AGK25912
augaaaauggcaucaaaugaugcaaacccaucagauggaucagcggcuaaccuaguaccagaaguagauaaugaaguuauggcauuagaaccaguggucggcgcagcaauagcagccccagucgcaggccaacaaaauguaauagacccauggauaagaaauaacuuuguucaagcaccuggcggagaauuuacaguaucccccagaaacgccccaggagaaauacuauggucagcaccauuaggaccagauuuaaauccauauuuaucccaccuagccagaauguauaauggauacgccggagguuuugaaguacaagucauauuagccggcaaugcauuuacugcaggaaaaauaaucuuugcagcaguuccaccaaacuuuccaacagaaggucuauccccaucacaaguaaccauguuuccacauauaauaguagacguucgacaacuagaaccaguacucauaccauuacccgacguaagaaauaauuucuaccacuacaaccaaagcaacgacucuaccaucaaacuaauagccaugcuauacacaccauuaagagcaaauaaugcuggcgaagacguauucacaguaucuugucguguauuaacaagaccuucucccgauuuugauuuuauauuccuagcacccccuacaguugaaucaagaacaaaacccuuuacuguuccaauacuaacaguagaagaaaugacaaauucuagauuucccaucccacuugaaaaacuauuuacagggccaucaagcgcauuuguaguccaaccacaaaacggacgcuguacaacagacggaguauuacuuggaacaacucaacucucaccaguaaacauaugcaccuuuagaggagacguuacacacauagcaggaucuagaaacuacacaaugaacuuagcuucccuuaacuggaacaauuaugauccaacagaagaaauaccagcaccauuagguacacccgauuuugucggaaaaauacaagguauguuaacucaaacaacaaaaggugacggaucaacaagaggacacaaagcuacaguauauaccggaucugcaccauucacaccaaaacuaggaucaguacaauucgaaaccgauacagaaaacgacuuugaaacacaucaaaauacuaaauucacaccaguaggagucauacaagaugguggaacuacucauagaaaugaaccucaacaauggguacuuccaagcuacuccggcagaaauguaccaaauguacacuuagcuccugcaguagcaccaacauuucccggugaacaacuccuauucuuucguucaacaaugccugggugcaguggcuacccuaauauggaucucgauugccuauuaccacaagaauggguacaacauuucuaucaagaagcagcaccagcacaaucagauguagcacuucuacgauucguuaauccagacacaggcagaguacuauucgaauguaaacuacauaaaucaggauauguaacaguagcacauacaggccaacacgauuuaguaauaccaccaaacggauauuucagauucgauucauggguaaaucaauucuauacauuagcaccaaugggaaaugggacaggaaggaggagagcucuauaa

SEQ ID NO: 31515 - RNA, 1623 nt, Artificial Sequence
  derived and/or modified sequence opt6 from VP1__Norovirus__AGK25915
augaaaauggccucaaaugacgcaaauccaucagacgguucugcagucaaccuagucccagaaguaaacaaugaaguaauggcacuagaaccaguuguaggagcugcaauagcagcaccaguugcaggacaacaaaauguaauagauccauggauaagaaauaacuucguacaagcucccggaggugaauuuacaguaucaccaagaaaugcaccaggagaaauacuauggucagcaccacuaggaccagauuuaaauccuuaucuaucucacuuagcaagaauguacaauggauacgcaggaggauucgaaguacaaguuauauuagcaggaaaugcauucacagcugggaaaauaauauucgcugcuguuccaccaaacuuuccuacagaaggauuauccccuucacaaguaacaauguucccccauauaauagucgacgccagacaauuagaaccuguucuaauaccauuaccagauguucgaaacaacuuuuaucauuauaaccaaucuaaugauucaacaauaaaacucauagcuaugcuauauacuccauuaagagccaacaaugcuggagaagauguauuuacaguaucaugucgaguuuuaacuagacccucaccagacuuugacuucaucuuuuuaguuccaccaaccguagaaucaagaacaaaaccauuuacugucccaauuuuaacaguagaagaaaugaccaacaguagauuuccaauaccacuagaaaaacuuuuuacaggacccuccucagcuuucgucguccaaccacaaaacggaagaugcacaacagacggcguacuacuaggaacaacacaauuaucaccuguaaauauauguaccuuucgaggagacguagcacacauugcuggaucaagaaauuacacaaugaaccucgcaucauuaaauuggaacaauuacgauccaacugaagaaauaccagccccacuagguacaccagacuucguaggaaaaauacaaggaaugcuaacucaaacaacaaaaggugacgguucaacaagaggccauaaagccacaguauauacaggaucagcaccauucacaccuaaacuaggaucuguacaauucgaaacagauacagaaaaugauuuugaaacccaccaaaauacaaaauucacaccaguaggaguuauacaagacggaggcacaacacaccgcaaugaaccacaacaauggguacuaccuucauauucaggaagaaauguuccaaacguacaccuugcaccugcaguagccccaacauucccaggcgaacaacuacuacuauuccgaucuaccaugccagguugcucaggauacccaaauauggaucuugacuguuuacuaccacaagaauggguacaacacuuuuaucaagaagcagcaccagcacaaucagauguagcacuacuaagguucguaaacccagacacaggaagaguauuauuugaauguaaacuccauaaauccgguuaugucaccguagcacacaccggacaacacgaccuuguaauuccuccaucagguuauuucagauucgauucauggguuaaucaauuuuacacacuagcaccaauggguaauggaacaggcagaagacgagcauuauaa

SEQ ID NO: 31516 - RNA, 1623 nt, Artificial Sequence
  derived and/or modified sequence opt6 from VP1__Norovirus__AGK25917
augaagauggcaucaaacgaugccaacccaagugacggaucugcagcaaacuuagucccagaaguaaauaaugaaguaauggcauuagaacccguaguaggugcugccauagccgccccaguagcuggacaacaaaacgugauagacccauggaucagaaacaacuuuguacaagcaccagguggagaauucacaguaucuccucgaaacgcaccaggagaaauauuauggucagccccacuagguccagaucuaaaucccuaucuuucacacuuagcacgaauguauaacgguuaugcuggaggauucgaaguacaaguaauauuagcaggaaacgcauuuacagccggaaaaauaauuuucgcagcaguaccuccaaauuuuccaacagaaggacuaaguccaucacaaguaaccauguucccccacauaauaguugacguaagacaauuagaaccugucuuaauaccccuaccagacguuagaaauaauuucuaucacuacaaccaaucaaaugacucuacaauaaaauuaaucgcaaugcuauauacaccacuaagagcaaauaaugcuggagaagacguauuuacaguauccugccgaguuuuaacuagaccaucuccagacuuugacuuuauauuucuaguucccccaacaguugaaucgagaacuaaaccauuuacagucccuauacuaacagucgaagaaaugacaaauagcggcuucccaaucccauuagaaaaacuauucacagggcccucaucagcauucguaguccaaccacaaaauggaagaugcacuacagacggaguacuucuaggaacaacacaacuaucaccaguuaacauauguaccuuuagaggcgacguaacucauauagcuggcucucgcaauuauaccaugaaucuagcaucacuaaacuggaacaauuacgauccaacagaagaaauaccugcaccacuaggaacuccagacuucguuggaaaaguccaaggaguacuaacucaaacuacuaaaggagacggaucaacuagaggacacaaagcaaccguauacacuggaagugcacccuuuacacccaaauuaggaucuguacaauucgaaacagauacagaaaaugauuucgaaacacaucaaaacaccaaauucacaccaguaggaguaauacaagacggugguacagcacauagaaacgaaccacaacaauggguauuaccaucauauucaggcagaaauguaccaaauguucacuuagcaccagccguagcuccaacauuuccaggugaacaacuacuuuuuuuccgcucuacaaugccaggauguucaggauauccaaauauggacuuagacugcuuacuaccacaagaauggguacaacauuuuuaucaagaagcagcuccagcccaaagugauguagcacuacucagauuuguuaauccagacacaggaagaguacuuuucgaaugcaaauuacauaaaucaggcuaugucacaguagcacacacaggacaaagagauuuaguaauaccuccaaacgguuacuucagauucgacagcuggguaaaucaauuuuacacucuagcaccaauggguaauggaacaggucguagaagagcacucuaa

SEQ ID NO: 31517 - RNA, 1623 nt, Artificial Sequence
  derived and/or modified sequence opt6 from VP1__Norovirus__AGK25919
augaaaauggcaucuagugaugcaaacccauccgaugguucagcugcuaaucucguaccugaagucaauaaugaaguaauggcccuagaaccaguaguaggagcugccauugcugccccaguagcaggucaacaaaauguuaucgaucccuggauaagaaauaauuuuguacaagccccaggaggagaauuuacaguaucacccagaaaugcaccaggcgaaaucuuauggucagccccacuaggaccugaccuaaauccauaucucucacacuuagcaagaauguacaauggauaugccggaggauucgaaguacaaguaauauuagccggaaaugcauucacagcaggcaaaguaauauucgcugcaguacccccaaauuuuccuacagaaggauuauccccaucacaaguaacaauguuuccacauauuguaguagauguaagacaacuugaaccaguucugauaccacuaccagauguaagaaauaauuuuuaccauuauaaucaaucaaaugacccuacuauaaaauuaauagcaaugcuauacacaccacuaagagcaaauaaugcaggagaugauguauuuacaguaucaugucgaguauuaacaagaccaucaccagauuuugacuuuaucuuucuaguaccaccuaccguugaaucuagaaccaaaccuuucucuguaccagucuuaacuguugaagaaaugacuaacucucgcuuuccaauaccccuugaaaaacuauuuacaggaccaucgucugcuuucguuguccaaccucaaaauggaagaugcaccacagauggcguauuauuaggaacaacacaacuuagcccaguaaacauauguacuuuuagaggugauguaacacacauuacaggcuccagaaacuacacaaugaauuuagcuucacaaaauuggaauaacuaugauccaaccgaagaaacaccagcuccacuaggaacaccagauuuugucggaaaaauacaaggaguucuuacccaaacaacacgaacagacgguucaacaagaggacauaaagcuacaguauauacaggauccgcagacuucgcaccaaaacuagggagaguacaauuugaaacagacacagaucaugauuucgaagcaaaccaaaacacaaaguuuacaccuguaggagugauccaagaugguggaaccacacauagaaaugaaccacaacaauggguacuaccaucauacucaggaagaaauacacauaacguacauuuagcacccgcaguugcaccuaccuuuccaggagaacaacuauuauuuuuuagauccacaaugccuggauguucugguuauccaaauauggauuuagauugucuccuaccacaagaauggguucaauauuuuuaccaagaggccgcaccugcacacucugauguugcacuauuaagauuuguuaaccccgacacuggucgaguacuauuugaguguaaacuucauaaauccggauauguaacagucgcacauacaggccaacaugauuuaguaauaccacccaacgguuauuuuagauuugauucauggguaaaucaauuuuauacauuagcaccaaugggcucaggaaccggccgaagaagagcagucuaa

SEQ ID NO: 31518 - RNA, 1623 nt, Artificial Sequence
  derived and/or modified sequence opt6 from VP1__Norovirus__AGK25921
augaaaauggccucuucugacgcuaacccuucugauggaucagcagcaaaccuaguaccagagguaaacaaugaaguuauggcacuugaaccaguagccggagcagcaauagcugccccuguagccggucaacaaaacguaauugacccauggauaagaaacaacuucguacaagccccagguggugaauuuacaguuucaccaagaaaugcaccgggagaaauauuauggucagcuccucuaggacccgauuuaaacccauaccuaucacaccuagcaagaauguacaacgguuaugcuggcgguuucgaaguacaaguuauacuagcagguaaugcauuuacagcuggaaaaguuauuuuugcagcaguaccacccaacuucccaacugaaggccuaucaccaucacaaguaacaauguuuccacauauaguuguagauguaagacaauuagaaccaguacuaauaccacuaccagauguacgaaacaauuuuuaucacuauaaucaauccaaugacccaacuauaaaauuaaucgcaaugcuauaugcccccuuaagagcaaauaaugcaggagaugacguauuuacaguauccuguagaguacuuacaagaccaucacccgauuuugacuuuauauuucuaguucccccaacaguagaauccagaacaaaaccuuucaguguaccaguauuaacaguugaagaaaugacaaacagucgcuucccaauaccauuagaaaaacucuucacaggaccgucuagugccuucguaguacaaccucaaaaugguagaugcacuacagacggcguauuacuaggcacaacucaacuuucaccaguaaacaucuguacauuuaggggagauguaacacauauuacaggaucaagaaauuacacaaugaaucuagccucacaaaauuggaauaacuacgacccaacagaagaaauaccagcaccucuaggaacaccagacuucguaggaaaaauucaaggaguauuaacucaaacaacacgaacagaugguaguacuagaggacacaaagccacaguauauacaggaucagcagauuuugcaccaaaacuaggaagaguacaauucgaaacagauacugaucaugacuucgaagcaaaccaaaacacaaaauuuacaccaguaggaguuauacaagacggagguaccacccaccgcaaugaaccacaacaauggguacuaccaagcuauucuggacgaaauacacauaacguacaccuagcaccagcaguugcaccaacuuucccuggugaacaacuacuauuuuuuagaucgacaaugccaggauguucaggauacccaaacauggaucuagacugccuauuaccacaagaauggguacaauacuuuuaccaagaagcugcaccagcacaaucugauguagcauuauuaagauucguaaauccugauacuggacgaguacuauucgaauguaaauuacacaaaucaggauauguaacaguagcacauacaggucaacacgauuuaguaauaccaccuaauggcuauuuuagauuugauagcugggucaaucaauucuauacacuagcaccaaugggaaacggaacagggcgaagaagagcaguauaa

SEQ ID NO: 31519 - RNA, 1623 nt, Artificial Sequence
  derived and/or modified sequence opt6 from VP1__Norovirus__AGK25924
augaaaauggcaucaucagaugcaaaccccucagauggaucagcagcuaauuuaguaccagaaguuaauaaugaaguuauggcacucgaaccaguagucggcgcggcaauagcagcaccaguagcaggacaacaaaacguaauagauccauggaucagaaacaauuuuguccaagcaccaggaggagaauucaccguuucaccacgaaaugcaccaggagaaauauuaugguccgcaccacucggcccagaucugaacccauaucucucacauuuagcacguauguauaacggauacgcuggugguuuugaaguacaaguaauccucgcuggaaaugcauucacagcuggaaaaguuauauuugccgcuguaccacccaauuucccaacugaaggacuaucaccaucacaagucacaauguuuccacauauaguaguagacgugagacaauuagaacccguuuuaaucccacuaccagauguaagaaauaacuucuaucacuauaaucaaucaaaugacccaacaauaaaacuaauagcaauguuauacacaccguuacgagcaaauaaugcaggagaugacguauuuaccguuucuuguagaguuuuaacaagaccaucaccagauuuugauuuuauauucuuaguaccaccaacuguugaaucuagaacaaaaccauucuccguaccuguacuaacaguagaagaaaugaccaacucaagauuuccuauacccuuagaaaaacuaucaaccggacccucaucagcuuucguaguacaaccacaaaacggaagaugcacaacugauggcguucuauuagguacaacacaacuauccccaguaaacauauguacauucagaggugauguaacacacauaacaggaagcagaaauuauacaaugaaucuagcaagccagaacuggaauaauuacgaucccacagaagaaauaccugcaccauuaggaacaccagauuuuguaggaaaaauacaagguguccuaacacaaacaacacguacagauggaucaacaagaggucauaaagccacuguauauacagguagcgcugauuucgcacccaaauuaggucgaguucaauucgaaacagacacagaucaugauuucgaagcuaaucaaaauacaaaauuuacacccguagguguaauacaagacggagggacaacacauagaaaugagccacaacaauggguccuaccaaguuauucaggaagaaauacacacaacguucauuuagcaccagcaguagcacccacauucccuggugaacaauuacuuuuuuuucgaucuacaaugcccggaugcucuggauauccaaauauggaucuagauuguuuauuaccucaagaauggguacaauauuucuaccaagaagcugccccagcucaaucugacguagcacuccuacgcuuugucaacccagauacaggaagaguucuauuugaauguaaauuacacaaaucagguuauguaaccguagcucauacaggacaacaugauuuaguaauaccaccaaaugguuacuuccguuuugauagcuggguaaaccaauucuacacacuugcaccuaugggaaauggaacaggaagaagacgagcugucuaa

SEQ ID NO: 31520 - RNA, 1623 nt, Artificial Sequence
  derived and/or modified sequence opt6 from VP1__Norovirus__AGK25927
augaaaauggcauccucagaugcuaauccgucagacggaucagcagcaaaccucguaccagaaguaaauaaugaagucauggcauuagaaccgguuguuggagcugcaauagcagcaccuguagcaggacaacaaaacgucauagaucccuggauucgaaauaacuuuguucaagcaccagguggagaauuuacaguaucaccacgaaacgcaccaggagaaauauuauggucugccccauuaggucccgaccuaaauccauaucuuucacaucuagcacgaauguauaacgguuaugcuggcggauucgaaguacaaguaauauuagcaggaaaugcauuuacagcaggcaaaguaaucuuugcagcaguaccuccuaacuuuccaacagaaggccuaucucccucccaaguaacuauguuuccccauauugugguugacguuaggcaauuggaaccaguacucaucccgcuuccagauguaagaaacaacuucuaccauuauaaucaaagcaacgauccuacuauaaaauuaauagcaauguuauacgcaccucuuagagcaaauaaugccggcgacgacguauuuaccguaucaugcagaguucuaaccagaccaucaccggacuuugauuucauuuuucucguaccaccaacagucgaaucaagaacaaaaccauuuucaguaccaguacuaacuguagaagaaaugacaaauucaagauucccaauaccacuagaaaaacuauuuacuggaccaucauccgcauucgucguacaaccacaaaacggaagauguacaacagacggaguguuacucggaacaacgcaacuuuccccaguaaacaucugcacauuucgaggagauguaacacacauaacuggaucucgaaauuacacaaugaaccuagcuucacaaaauuggaacaauuaugacccaacagaagaaauaccagcuccucuagguacuccagauuuuguaggaaaaauccaagguguacuuacucaaacaacaagaacugauggaaguaccagaggccacaaagcaacaguauauacaggcucagcagacuuugcaccaaaauuaggaagaguacaauuugaaacagauacagaccaugacuuugaagcaaaccaaaauaccaaauucacaccaguaggcguuauacaagacggaggaacaacacauagaaaugaaccacaacaauggguacucccuuccuauucugguagaaauacucauaauguacacuuagcaccagcaguagcaccuacuuucccaggcgaacaacuauuauuuuucagaaguacaaugccaggaugcucuggauauccaaauauggauuuagacugcuuacuaccacaagaauggguacaauacuuuuaucaagaagcagccccugcucaaucagacguugcacuccuaagauucguaaauccaaacacaggaagaguauuauucgaaugcaaauuacauaaauccggauauguaacaguagcucacacaggccaacaugaccuagucauaccaccaaacgacuauuuucgauuugacaguuggguuaaucaauuuuauacauuagcuccaauggguaauggaaccggaagaagacgagcaguuuaa

SEQ ID NO: 31521 - RNA, 1623 nt, Artificial Sequence
  derived and/or modified sequence opt6 from VP1__Norovirus__AGK25930
augaaaauggcaucaucugaugcaaacccaucugauggaucugcagcuaaucuaguaccagaaguaaauaaugaaguaauggcucuugaaccaguugucggagcagcaauagcugcaccaguagcuggacaacaaaauguaauugauccauggauaagaaauaacuuuguacaagcaccagggggcgaauuuacaguaagcccaagaaaugcaccaggagaaauauuauggucagcaccacuagggccagacuuaaaucccuaccucucacaccuugcaagaauguauaacggauaugcuggaggauucgaaguccaagucauucucgcagguaaugcauuuacagcaggaaaaguaauauuugcagcuguaccaccgaacuuuccaacagaaggccuaaguccuucacaaguaacaauguucccucauauuguaguugacguucgacaauuagaaccaguacuaauaccauuaccagacguagguaacaauuucuaucauuacaaucaaucaaaugauccaacaauaaaguuaauagcaauguuauauacuccacuaagagcaaacaacgcaggagacgacguauuuacaguaaguuguaggguauuaacucgacccucaccagauuucgacuuuauauucuuaguaccaccaaccguagaaucucgaacaaaaccauucuccguaccuguucuaacaguagaagaaaugacuaauucuagauucccaauaccacuagaaaaacuauucacagguccaucaucagcauucguaguucaaccucaaaauggacgauguacuacagacggaguauuauuaggcacaacucaacuauccccaguaaauauuuguacuuuucgaggugacguaacacauaucacaggaucuagaaauuauacgaugaauuuagcuucucaaaacuggaacaacuaugaucccacagaagaaauaccagcuccuuuaggaaccccugauuuuguugguaaaauacaaggaguauuaacacaaacaaccagaacagauggaaguacaagaggacauaaagccacugucuacaccggaucagcagacuuugcccccaaauuaggcagaguacaauucgaaacagauacugaccacgauuucgaagcuaaccaaaauacaaaauuuaccccaguaggaguuauacaagacggaggaacaacacauagaaaugaaccacaacaauggguacuaccaaguuauucaggacgcaacacacauaauguacaucuagcaccugcaguugcaccaacauuuccaggagaacaacuccuauuuuucagaucaaccaugccaggauguuccggauauccaaacauggauuuagauuguuuauuaccacaagaauggguucaauauuuuuaucaagaagcagcacccgcucaaucagacguugcacuacuaagauuuguaaauccagauacuggcagagucuuauuugaauguaaauuacauaaaucaggauauguaacaguugcacacacuggacagcaugaucuaguaauaccaccaaauggcuauuuuagauuugauucuugggucaaccaauuuuauacacuagcaccaaugggaaauggaaccgguagaagaagagccgucuaa

SEQ ID NO: 31522 - RNA, 1623 nt, Artificial Sequence
  derived and/or modified sequence opt6 from VP1__Norovirus__AGS08025
augaaaauggcaucaucagaugccaacccauccgauggcucuacagccaaucuuguaccagaaguaaacaacgaaguaauggcucucgaaccaguugucggcgcagcaauagcugcuccaguagcuggacaacaaaauguuauagauccauggauaagaaacaauuucguucaagcaccaggaggagaauucacaguaucaccaagaaaugcaccaggagaaauauuaugguccgccccacuaggacccgauuuaaacccauacuuaucucaccuagcaagaauguauaauggauaugcuggagguuuugaaguccaaguaauacuagcaggcaaugcauucaccgcuggaaaaaucauauucgcagcaguaccaccuaacuuuccaacagaaggucuuucacccucccaaguaacaauguuuccacauauaauaguagauguacgucaauuagaaccaguauuaauaccccuccccgacguaagaaacaauuucuaucauuauaaccaaucuaaugauccaacaauaaaacuuaucgcaaugcuauacacuccauuaagagcaaacaacgcuggugacgaugucuuuacaguuucauguagaguacuaacuagaccaucaccugauuuugacuuuauuuuuuuaguaccaccaaccguagaaucacgaacaaaaccauuuucaguacccguccuaacaguagaagaaaugacaaacucaagauuuccaauaccacuagaaaaacuauuuacaggacccucuucagcuuucguaguucaaccacaaaacggacgauguacaaccgacggaguucuuuuagguacaacccaacuaucaccaguaaauauaugcacuuucagaggugacguaacccacauuccaggaucacguaauuacacaaugaacuuagcuucacaaaauuggaauucauacgauccuacagaagaaauucccgcaccauuaggcacuccagauuuuguaggaaaaauccaaggaguuuuaacacaaacaacaaaaacuaauggaucaacaagaggucacaaagccacaguuuauacuggcagcgcagacuuuagcccaaaauuaggaagaguacaauucgcaacagauacagacaacgacuuugaaacaaaucaaaauacuaaauucaccccaguaggaguaauacaagacggaagcaccacaccuagaaaugaaccacaacaauggguacuuccaucauacucaggaagaaauauacauaauguucacuuagccccagcaguagcaccuacauuuccaggagaacaauuauuauuuuucagaucaaccaugccaggcuguucuggauauccaaauauggauuuagacugccuuuuaccacaagaauggguacaauacuucuaucaagaagcugcuccagcucaauccgacguugcauuacuaagauuuguuaaucccgauacugguagaguacucuuugaaugcaaacuacauaaaucuggauacguuacagucgcacacacaggacaacaugauuuaguuauaccacccaaugguuacuucagauucgauagcuggguaaaccaauucuacacucuugcuccaaugggcaaugguacaggacgcagaagagcacuauaa

SEQ ID NO: 31523 - RNA, 1623 nt, Artificial Sequence
  derived and/or modified sequence opt6 from VP1__Norovirus__AGS08026
augaaaauggccucaucugacgcaaaucccucugauggcucaacagcaaacuuaguccccgaaguaaauaacgaaguuauggcauuagaaccagucguaggagcagcaauagcagcgccaguugcaggccaacaaaacguaauagacccuuggauacgaaauaacuuuguacaagcaccugguggagaauuuacuguaucaccuagaaaugcaccuggagaaauucuauggucugcccccuuaggaccagaucuuaauccuuaucucucacaucucgcaagaauguauaauggauaugcuggagguuuugaaguucaaguaauacuagcaggcaaugcauuuacagcuggaaaaauaauauucgcugcuguaccacccaauuuuccaacagaaggacucucaccaucacaaguaacaauguucccccauauaauuguagauguaagacaacuagaaccuguguuaauuccauuaccagauguacguaacaauuuuuaccauuacaaccaaucaaaugacccaacaauuaaauuaauugcaaugcuuuacaccccauuacgagcaaauaacgcaggugaugacguauucacuguaucauguagaguauuaacaagaccuucuccugacuuugacuuuauauuucuaguaccaccaacaguagaaucacgaaccaaaccuuuuucuguaccuguauuaacaguagaagaaaugacuaacucaagauucccgauuccacuagaaaaauuauuuacaggaccaucaucagcuuucgucguccaaccacaaaacggcagaugcaccacagacggaguacuacuaggcacaacacaacuaucuccuguaaauauuugcacuuuuagaggagacguaacucauauaucuggcucuagaaauuacacaaugaauuuagcuucacaaaauuggaacucauacgaucccacugaagaaauucccgcaccauuagguacaccugacuucgucggaaaaauacaaggaguauuaacacaaaccacuagaacagacggcaguacuagaggacacaaagcaacaguauauaccggcucagcagacuucucacccaaacuaggaagaguacaauucgcuacagauacagauaaugauuuuguaacaaaucaaaacacaaaauucacuccuguaggaguaauacaagacgguucaacuacaccacgaaaugaaccucaacaauggguuuuaccuucuuauucaggacgaaauacccauaacguucacuuagcaccagcaguagcaccuacauuuccaggagaacaauuacuauucuucagaucuacaaugccaggauguucugguuauccuaauauggaccucgauugcuuacuaccacaagaauggguacaauacuucuaccaagaagcagcuccagcucaaucugacgucgcccuauugcgauuuguuaauccagauacagguagaguccuuuucgaauguaaacuacauaaaucuggauauguaacagucgcacauacuggucaacaugauuuaguaaucccuccaaacggcuacuuuagauuugauuccuggguaaaccaauuuuacacucucgcuccuauggguaauggaacaggacgaagaagagcccucuaa

SEQ ID NO: 31524 - RNA, 1623 nt, Artificial Sequence
  derived and/or modified sequence opt6 from VP1__Norovirus__AGS08027
augaaaauggcaaguucagacgcaaauccaucagauggcucaacagcuaaucuaguaccagaaguuaacaaugaagucauggcacuagagcccguaguuggagcagccauagcagcaccaguagcuggacaacaaaauguaauagacccuuggauuagaaauaacuuuguacaagccccaggcggcgaauuuacaguaagcccuagaaaugcacccggagaaauacuauggucagcaccucuaggaccugaucuaaauccauauuuaucacauuuagcccgaauguauaacgguuacgcugguggauucgaaguacaaguaauauuagcaggaaacgcauucacagcaggcaagauaaucuucgcagccguaccaccaaauuuccccacagaaggacuaucaccaucacaaguuacaauguuuccacacauaauaguagacguacgacaacuagaaccaguccuaauacccuuaccagacguacgcaacaacuucuaucacuauaaucaaucaaaugacucaacaauaaaacuaauagcuauguuauauacaccacuacgagcaaacaaugccggagacgacguauucacagucucaugucgaguucuaacaagaccaucucccgacuuugacuuuauauuuuuaguaccaccuacuguugaaucaagaacaaaacccuucucuguaccaauauuaaccguagaagaaaugacaaacucacguuuuccaaucccauuagaaaaacuauuuacaggccccucuucagccuucguuguacaaccacaaaacggaagauguaccacagacggaguauuauuaggaacuacacaacuuuccccaguaaacauuuguacauuccgaggagauguaacucauauucccggaucucacaauuacacaaugaaucuugcaucccaaaacuggaauucauacgacccaacagaagaaauaccugcaccauuaggaacaccagauuuuguaggaaaaauacaaggagucuuaacacaaacaacaucagccaacggaucaacaagaggacacaaagccacagucuauacaggaucagcagacuucuccccuaaacuaggucgaguccaauuugcaacagauacaaauaaugauuucgaaacaaaucaaaacacuaaauucacacccguaggaguuauacaagauggaaauacaacaccacgaaaugaaccacaacaauggguacuaccaagcuauucaggaagaaauauccauaacguacaccuugccccugcaguagcuccaacauuuccaggagaacaauuauuauucuuuagaucuacaaugccagguugcuccggcuaucccaacauggaucuagauuguuuacuuccacaagaauggguacaauauuucuaccaagaagcugcaccugcacaaucagauguugcacuccuaagauuuguaaauccagauacuggacgugucuuauuugaauguaaauuacauaaaucaggcuacgucaccguagcacacaccggacaacacgaccuuguaauacccccaaacggauauuuccgcuuugauucuuggguaaaucaauuuuauacacuagcaccaaugggaaauggaacuggaagaagaagagcauuauaa

SEQ ID NO: 31525 - RNA, 1623 nt, Artificial Sequence
  derived and/or modified sequence opt6 from VP1__Norovirus__AGS08028
augaaaauggcaaguucagaugccaauccaucugaugguucugcagcaaacuuaguaccugagguaaauaaugaaguaauggcucuagaaccuguaguaggugcugcaauagcagcccccguagcaggccaacaaaacguuauugacccauggauaagaaacaauuuuguacaagcaccaggaggagaauuuacaguuucaccucgaaaugcuccaggugaaauacuauggucagcaccccucgguccugaucuuaacccauauuuaucacauuuagcucggauguauaauggauaugcuggaggauuugaaguccaaguaauauuagcaggaaaugcauuuacagcugguaaagucauauuugcagcuguaccaccaaauuuucccacagaaggacuaucuccuucucaaguuacuauguuuccacauauaguaguagacguaagacaauuagaaccaguucuaauaccacuccccgacguaagaaauaauuuuuaucacuauaaucaaucaaaugacccaacaauaaaauuaauagcaauguuauacacaccuuuaagagcuaauaacgcuggcgacgauguuuucacgguauccuguagaguuuuaacuagaccuucaccagauuuugauuucauauuucuaguuccuccuacaguagaaucuagaacaaaaccauuuucaguuccaguauuaacugucgaagaaaugaccaauucaagauuucccauaccauuagaaaaacuuuucacuggucccuccucugcauucgucguacaaccacaaaacggaagauguacuacagaugggguucuucuagguacuacucaauuaucccccguuaacauaugcacauuuagaggugauguaacacauauaaccgguagcagaaauuauaccaugaauuuagcaucccaaaauuggaauaauuaugauccaacagaagaaauaccagccccacuaggaacaccagauuuuguagguaaaauacaaggaguauuaacacaaacuacaagaacugauggaucgacaagaggacauaaagcaacaguauacacagguucagcagauuuugcaccuaaauuaggacgaguccaauucgaaacagacacagaccacgauuucgaagccaaccaaaauacuaaauuuacaccaguugguguuauacaagacggcggaacaacacauagaaaugaaccacaacaauggguacuaccaucauauucaggccgaaauacccauaauguccaucuagcaccugcaguugcaccaacauuuccaggagaacaacuuuuauuuuuccguucuacuaugccaggcugcucaggauauccaaauauggauuuagauugucuccucccacaagaaugggugcaauauuuuuaucaagaaaccgcaccagcacaauccgauguagccuuacuaagauucguaaacccagauacaggcagaguauuauuugaauguaaacuacauaaaucaugcuacgucaccguggcacauacaggucaacacgauuuaguaauaccuccaaauggauauuucagauuugacucauggguaaaucaauuuuacacucucgcaccuaugggcaauggaacaggaagaagacgagcuguauaa

SEQ ID NO: 31526 - RNA, 1623 nt, Artificial Sequence
  derived and/or modified sequence opt6 from VP1__Norovirus__AGS08029
augaaaauggcauccucugaugcuaacccauccgauggcucuacugcuaacuuaguaccagaaguaaacaacgaaguaauggcccuugaacccguuguaggagcagcuauagcagccccuguugccggacaacaaaauguaauagauccauggauacgaaauaauuuuguacaagcaccaggaggugaauucacagugucaccaaggaaugcaccuggagaaauacuuuggucugcuccucuagguccggaucuaaacccuuauuuaucacauuuagcaagaauguauaauggauacgcaggcggauuugaaguacaaguuauucuugcagguaaugcauuuacagcaggaaaaauaauauuugcagcaguaccuccuaacuucccaaccgaaggauuaucaccaucucaaguuacuauguuuccacacauaauaguugacguuagacaacucgaaccaguauuaauaccacuuccagauguaagaaacaauuucuaucacuauaaccaaucuaaugauccuaccaucaaauuaauagcaaugcuauauaccccacuacgagcuaauaacgcaggagacgacgucuuuacaguuucauguagaguauuaacacgaccuucaccagauuucgacuucauauuuuuaguacccccaaccguugaaaguagaacuaaaccauucucaguaccaguacucacagucgaagaaaugacaaauucaagauuuccaauaccacuagaaaaacuauuuaccggacccucaucugcauucguaguacaaccacaaaacggcagaugcacaacagacggaguauuauuaggaacaacacaauuaucaccaguaaauaucuguacauuuagaggugacguuacacacauacccggaucucgcaauuacacaaugaaccuagcuucucaaaauuggaacucauacgauccaacagaagaaauaccugcaccccuuggaacaccagacuuuguaggaaaaauacaaggaguucucacacaaacuacaagaacaaauggauccacaagaggacauaaagcaacaguauacacaggaucagcugacuucucaccaaaacuuggacgaguccaauuugcaaccgauacagauaaugauuucgaaacaaaucaaaacaccaaauuuaccccaguaggugucauacaagacggauccacaacaccacgaaaugaaccacaacaauggguauuaccuucauacucuggaagaaauauacauaacguacauuuagcaccugcuguagcaccaaccuuuccaggugaacaacuauuauucuuucguagcacuaugccagguuguucuggauauccaaauauggaccuagacugccucuuaccucaagaauggguucaauacuucuaccaagaagcagcuccagcacaaucagacguagcacuccuaagauucguaaauccggacacaggaagaguuuuauuugaaugcaaacuacauaagucuggcuacguaacuguagcacacacaggacaacaugaucuaguuauaccucccaacggauauuucagauucgauuccuggguaaaucaauuuuauacccuagcuccuaugggaaacgguacaggaagacgaagagccuuauaa

SEQ ID NO: 31527 - RNA, 1623 nt, Artificial Sequence
  derived and/or modified sequence opt6 from VP1__Norovirus__AGS08030
augaaaauggcauccucagaugcaaauccauccgacggaucaaccgcaaaccuuguaccagaaguaaacaaugaaguaauggcauuagaaccaguuguaggagcagcaauagcugcacccguagccggacaacaaaauguaauagacccauggauuagaaauaauuuuguacaagcaccuggcggagaauuuacuguuucaccucgaaacgcaccaggagaaauacuaugguccgcaccucucggaccagaucuaaaucccuauuuaucacaccuagcaagaauguauaacggcuacgcaggaggauucgaaguacaaguaauuuuagccggaaaugccuuuacagcaggaaaaauuauauuugcugcagucccaccaaacuuuccaacugaaggauuaucuccaucacaaguaacuauguuuccucacauuaucguagacguaagacaacuagaaccaguauuaauuccauuacccgauguucguaauaacuucuaccauuauaaucaaucaaaugacccuacaauaaaauuaauagcaaugcuauacaccccacuaagagcaaacaacgccggugacgaugucuuuaccguuucauguagaguucuaacaagaccaagcccagacuuugauuuuaucuuucuaguaccccccacaguagaaucacgcacaaaaccauucagcguaccaguucucacaguugaagaaaugaccaacucuagauuuccaauaccauuagaaaaauuauuuacaggcccuucuucagcuuuuguuguucaaccacaaaacggaagauguacaacugacgguguauuacuaggaacaacacaauuaucaccaguaaauauuuguacauuccguggagacguaacccauauaccaggaucaagaaacuacacaaugaaccuagcaucacaaaacuggaauucuuaugauccaacagaagaaauaccagcaccuuuaggcacaccugacuuugucggaaaaauacaaggaguacuaacacaaacaaccagaacuaacggcagcacuagaggucacaaagcaacaguauauacagguuccgcagacuucucuccaaaacuaggcagaguccaauucgcaacagauacagacaaugauuucgaaaccaaucaaaacacaaaauucacaccaguaggaguaauacaggauggauccacaacaccaagaaacgaaccccaacaauggguacuaccaucauauuccgguagaaacauacauaauguacacuuagcacccgcaguagcaccaaccuuuccaggagaacaacuauuauucuuccgaucgacaaugccaggauguucaggauauccuaauauggaucuugauuguuuacuaccacaagaauggguucaauauuucuaucaagaagcugcaccugcucaaucugacguagcacuacuccgauucguuaacccagacacaggcagaguucuauucgaauguaaauuacauaaauccggauacgucacaguagcccacacaggccagcacgauuuaguaauaccuccaaaugguuauuuccgauuugauuccuggguaaaucaauuuuacacauuagcaccaaugggaaauggaacaggccgacgaagagcacucuga

SEQ ID NO: 31528 - RNA, 1623 nt, Artificial Sequence
  derived and/or modified sequence opt6 from VP1__Norovirus__AGS08031
augaaaauggcaucaagugaugcaaaccccucagacggcucaacagcuaaccuaguacccgaaguuaauaaugaaguaauggcacuagaacccgucguaggagcugcaauagcagcuccaguagccggacaacaaaauguuauagauccauggauaagaaauaauuuuguacaagcuccuggaggagaauuuacuguaaguccucguaaugcaccaggugaaauacuuuggucagcaccauuagguccagauuuaaauccauaccuuucacaccucgcccgcauguauaaugguuacgcaggcggauucgaaguacaaguaauauuagcagguaaugcauucaccgcaggaaaaauaauauucgcugcaguaccaccaaauuuuccaacugaagguuuauccccaucacaagugacuauguuuccacauauaauagucgauguuagacaauuagaaccaguucuaauaccccuaccugaugucagaaacaacuucuaucauuacaaccaaucaaaugacccuacaauuaaacuaauagcaaugcuauacacaccauuaagagcaaacaaugcaggagaugauguauuuaccguaucauguagaguacucacaagaccuuccccagacuucgacuuuauauucuuaguucccccaaccguagaaucacgaacuaaaccauucagugucccgguuuuaacaguagaagaaaugacaaauucaagauuucccauaccacucgaaaaauuauuuacugguccaucaucagcuuuuguaguccaaccacaaaacggacgaugcacaacagacggaguacuauuaggcacuacucaacucucaccagucaauaucuguacauuuagaggagacguaacacacauaccaggauccagaaauuauacuaugaauuuagcaucccaaaauuggaacucauacgaucccacagaagaaauaccugcaccauuaggaacaccugacuuuguagguaaaauucaaggaguacuaacucaaacaacacgaacaaauggaucaacccguggccacaaagcaacugucuauacaggauccgcagauuucucacccaaauuagguagaguacaauucgcaacagauacagauaacgacuuugaaacuaaucaaaauacaaaauuuacaccaguaggaguaauacaagacggaagcacuacaccaagaaaugaaccccaacaauggguacuacccagcuacucuggaagaaauauacacaacguucaccuugccccugcuguagcaccaaccuucccaggugaacaacuauuauucuuuagaucaacaaugcccggauguucaggcuaucccaauauggauuuagacuguuuauuaccacaagaauggguacaauacuuuuaucaagaagccgcuccagcacaaucugauguagcauuauuacgauucguuaacccagacacaggaagaguacuauucgaaugcaaacuacauaaaucaggcuacgucacaguagcacauacuggacaacaugauuuaguaauaccacccaacggauauuucagauucgauucauggguaaaucaauuuuacacauuagcaccaaugggaaacggaacuggccgccgcagagcacuauaa

SEQ ID NO: 31529 - RNA, 1623 nt, Artificial Sequence
  derived and/or modified sequence opt6 from VP1__Norovirus__AGS08032
augaaaauggccucaucagacgcuaacccauccgauggaucaacugcuaaucuagucccagaagucaacaaugaaguaauggcucuagaaccaguuguuggagccgcaauagcagcaccaguugcuggacaacaaaacguuauagacccauggauacgaaauaacuuuguccaagcucccgguggagaauucacaguaucaccaagaaacgcuccaggagaaaucuuauggucugcaccacuaggucccgauuuaaauccauauuuaucacauuuagcucgaauguauaacggauacgcaggugguuuugaaguucaaguuauucucgcaggaaaugcauuuacugcaggaaaaauaauauucgcagcuguaccaccaaauuucccaacagaagggcuaucaccaucacaaguaacaauguuuccacauaucauaguagacguucgacaacuagaaccaguucuaauaccacuaccagauguaagaaauaauuucuaucacuacaaccaauccaacgacuccaccauaaaauuaauagcaauguuauacacaccccuacgagccaauaacgcaggugaugacguauuuacaguuucaugccgcguccuuacuagaccaaguccugacuucgauuucaucuuucuugucccaccuaccgucgaaucacguacaaaaccauucucaguaccaguacuaaccguugaagaaaugacaaacuccagauuuccaauaccauuagaaaaauuauucaccggaccaucauccgcauuuguaguacaaccacaaaacggaagauguacaacagacggaguucuacuagguacaacacaauuauccccaguuaacauauguaccuuccgaggagacguaacacauauaccaggcucaagaaacuauacaaugaaucuagcaucacaaaauuggaacucauacgacccaacagaagaaaucccagcuccacuaggaacaccagauuuuguaggaaaaauucaaggcgucuuaacucaaacaacaagaacaaauggaucaacacgaggacacaaagcaacaguuuauaccggaucagcagauuuuucacccaaauuaggaagaguacaauucgcaaccgauacagauaacgauuuugaaacaaaucaaaacaccaaauucacaccaguaggcguuauacaagacggcuccacaacaccaagaaaugaaccucaacaauggguuuuaccaucauacucaggacgaaacauacacaauguucacuuagcaccagccguugccccaacuuuuccuggagaacaauuauuauucuuuagaucaacaaugccaggaugcucaggauaccccaacauggaucuagacugccuccuuccucaagaauggguacaauauuuuuaccaagaagcugcuccggcacaaucagacguagcauuacuccgcuucguaaauccagacacaggaagaguauuauucgaaugcaaacuacauaaaucaggauaugucacaguagcacauacaggucaacaugaucuaguaauaccucccaauggcuacuucagauucgauucauggguuaaucaauucuauacauuagccccaaugggcaacggaacaggaagacgaagagcuuuauaa

SEQ ID NO: 31530 - RNA, 1623 nt, Artificial Sequence
  derived and/or modified sequence opt6 from VP1__Norovirus__AGS08033
augaaaauggcuucaucagacgccaauccauccgacggaucuguagcaaauuuaguccccgaaguaaacaacgaaguuauggcacuagaaccaguaguaggagcagcaauagccgcaccuguagcaggacaacaaaacguaauugacccuuggauucgaaauaacuuuguacaagcaccagguggagaauuuacaguuuccccaagaaaugcuccaggagaaauauuauggucagccccucuugguccugaucuaaauccauaccuaucacacuuagcuagaauguauaacggauacgcaggaggauuugaaguacaaguuauauuagcaggaaaugcauucacggcaggaaaaguaauauucgcagcaguuccaccaaauuuuccaacagaaggucucucaccaucacaaguuacaauguucccacacauaguaguagacguucgccaacuagaaccaguacuaauuccacuaccugacguaagaaauaacuucuaucauuacaaucaaucaaaugacccaacaauaaaauuaauagcaaugcucuacaccccauuacgagcuaacaacgcaggagacgauguauuuaccguuucauguagaguacuaacaagaccauccccagauuuugauuucauauuuuuaguaccaccaaccguagaaucaagaacaaaaccuuuuucaguacccguauuaacaguugaagaaaugacuaacucaagauuuccaauaccauuagaaaaguuauucacaggaccaucaucagcauucgucguucaaccucaaaacggccgaugcaccaccgauggaguacuauuaggaacaacacaacuuuccccuguaaacauauguacauucagaggugacguuacucauauuacugguucacgaaauuacacaaugaaucucgcaagucaaaacuggaauaacuaugaccccacugaagaaauaccagcaccacuuggaacaccugauuuuguaggaaaaauacaaggaguccucacccaaacaacaagaacagacggcucaacuagaggccauaaagccacagucuacacugguagcgcagauuuugcaccaaaauuaggcagaguacaauucgaaacagauaccgaccacgacuucgaagcgaaccaaaauacuaaauucacacccguuggaguuauacaagacggaggaacuacucauagaaacgaaccacaacaaugggucuuaccaucauauucaggaagaaauacccauaacguacacuuagcacccgcaguagccccaaccuuuccaggcgaacaauuacuauucuuuagaucaacaaugccaggaugcucaggauacccaaauauggaccuagacugcuuacuaccacaagaauggguacaauauuuuuaccaagaagcagcuccagcacaaagugacguagcacuacuuagguucguaaauccagauacaggaagaguauuauuugaauguaaacuacauaaaucaggauaugucacaguagcucacacaggucaacacgaucuuguuauaccaccaaacgguuauuuucgauuugauucauggguaaaucaauucuauacuuuagcacccauggguaauggaacaggaagaagaagagcaguauaa

SEQ ID NO: 31531 - RNA, 1623 nt, Artificial Sequence
  derived and/or modified sequence opt6 from VP1__Norovirus__AGS08035
augaaaauggcaagcucagacgcaaacccaucugauggaucuacagcaucccuaguucccgaaguuaacaaugaaguaauggcucuagaaccagugguuggcgcagccauugcugcaccaguugcaggucaacaaaauguaauagacccuuggauacgaaauaauuucguacaagccccuggaggugaauuuacuguaucuccaagaaaugcaccaggagaaauacuauggucugcaccacuaggaccagauuuaaauccuuaucucucacacuuagcuagaauguacaauucuuaugcaggaggauuugaaguacaaguaauauuagcaggaaaugcuuuuacagcaggaaaaauaauauucgcagccguuccaccaaacuuucccacugaaggauuaucuccuucucaaguuacaauguucccacacauuaucguagacguaagacaauuagaaccuguccucauaccacuaccagauguacgcaauaauuucuaccacuauaaccaaucaaacgaccccacaauaaaacuaauagcaaugcucuauacaccauuacgagcaaacaacgccggcgacgacguauuuacuguaucuugucgagucuuaacaagaccaagcccagacuuugauuucaucuuuuuaguaccaccaacaguagaaucaagaacaaaaccauuuucaguaccuguacuaacaguagaagaaaugacuaauucccgauuuccaauaccccuagaaaaacuauucacaggaccaucuucagcauucguaguacaaccacaaaacggacgauguacaacagauggaguacuauuaggaaccacucaauuauccccagucaauauauguacauuuagaggagacguaacucauauaucaggaucacauaacuauacaaugaaccuagcuucucaaaacuggaacucauaugaucccacugaagaaauaccggcaccucucggaacaccagauuuuguaggcaaaauacaaggaguccuaacucaaacaacuagaauaaauggaucaacuagaggacacaaagcaacaguauacacuggcagcgcagauuuuaguccuaaauuaggcagaguccaauucgcaacagauacagauaaugauuucgaaacaaaucaaaacacuaaauucacaccagucggcguuauacaagauggaaguacaacaccacgaaacgaaccacaacaauggguacucccuucauauucaggacgcaacacacauaacguucacuuagcaccggcaguagcacccacauuuccaggagaacaauuauuauucuuuagaucuaccaugccaggaugcucuggauauccaaauauggaucuagauugccuacuaccucaagaauggguacaauacuuuuaucaagaagcagcuccagcucaaagugacguagcucucuuaagauucguaaauccagacacuggaagaguacuauucgaaugcaaauuacauaaaucuggcuacguaacugucgcacacacaggacaacacgaccuugucauaccaccaaacggauauuuccgauucgacucauggguaaaucaauucuauacacucgcaccaaugggcaauggaacuggacgaagaagagcauuauaa

SEQ ID NO: 31532 - RNA, 1623 nt, Artificial Sequence
  derived and/or modified sequence opt6 from VP1__Norovirus__AGS08036
augaaaauggcaucaucagacgcaaaccccuccgaugguucaacagcaaaucuuguaccagaaguaaauaacgaaguaauggcacuagaaccaguuguaggugcugcaaucgcagcaccagucgcaggacaacaaaacguaaucgauccauggauaagaaauaacuuuguucaagcaccaggcggggaauucacaguaucacccagaaaugccccuggagaaauucuuuggucagcaccacuaggaccagauuuaaauccuuacuuaucucauuuagcacgcauguauaacgguuaugcuggcgguuuugaaguccaaguuauucuagcaggaaacgcauucacagccggaaaaauaauauuugcugcuguuccaccuaauuuuccaacagaaggccuaucucccucccaaguuacaauguucccacacauaauuguagacguaagacaacuagaaccaguacuaauaccauuaccugauguuagaaauaauuuuuaccacuauaaccaaucuaacgauccuacaauaaaacucauagcaauguuauacacaccauuaagagcaaacaaugcaggagacgauguauuuacaguaucaugucgaguccuaacaagaccuucuccagacuucgacuucaucuuuuuaguaccacccacuguagaaucgcgaacaaaaccauucagugucccaguucuaacaguagaagaaaugacaaauucaagguuuccaauaccacuagaaaaauuauuuacaggaccaucuagcgcuuucgucguucaaccccaaaacggaagaugcacaaccgauggaguucuacuagguacuacccaacuaagcccuguaaauauuuguacuuuuagaggcgacguaacacauauaucuggaucaagaaacuacacaaugaaucuagcaucacaaaacuggaauucauacgacccaaccgaagaaauaccagccccauuagguacuccagacuuuguaggaaaaauacaagguguccuuacucaaaccacuagaacagauggaucaacuagaggacauaaagcaacaguauauaccggcagcgcagacuuuagcccuaaauugggaagaguacaauuugccaccgauaccgauaacgacuucguaacaaaccaaaauacaaaauuuacacccguaggaguaauccaagacggauccaccacuccacgaaaugaaccacaacaauggguucuuccaucuuauaguggaagaaacacucauaauguacauuuagcaccagcaguagcaccaacauucccaggagaacaacuauuauucuucagaucaacaaugcccggauguucaggauauccaaacauggaucuagauuguuuacuaccucaagaauggguacaauauuuuuaucaagaagcagcaccugcacaaucggauguagcacuacuuagguuuguaaacccagauacuggaagaguauuguuugaauguaagcuucauaaauccggauauguaacaguagcucauacaggacaacacgaccucguaauacccccaaauggauauuuuagauuugauuccuggguuaaucaauuuuauacauuagcaccuaugggaaaugguacaggaagacgacgagcauuauga

SEQ ID NO: 31533 - RNA, 1623 nt, Artificial Sequence
  derived and/or modified sequence opt6 from VP1__Norovirus__AGS08037
augaaaauggcuucaucagaugcuaacccuucagacgguucaacagcaaacuuaguacccgaaguaaacaaugaaguaauggcacuagaacccguagucggagcagcaauagcagcacccgucgcaggccaacaaaacguuaucgaccccuggauuagaaacaauuuuguacaagcaccaggaggagaauuuacagucaguccacgaaaugcaccaggugaaauacucuggucugcaccacuaggaccagauuuaaauccauaucuaagucaccuugcaagaauguauaauggauacgcaggaggauucgaaguacaaguuauacucgcagguaaugcauuuacagcaggaaaaaucaucuucgcagccguuccaccaaacuuuccaaccgaaggcuuaucaccaagccaaguaacaauguuuccacauauaauaguagacguacgucaacuagaacccguacucauuccuuuacccgacguucgaaauaauuuuuaccauuauaaccaaucaaaugacccaacaauaaaauuaauagcaaugcuauauacaccuuuacgugcuaauaacgcaggagacgauguauuuacuguaagcuguaggguuuuaacaagaccaucuccagacuucgauuucauauuucucguuccaccaacuguagaaucaagaaccaaaccauucucaguaccaguauuaacaguagaagaaaugaccaacucucgauuccccauaccauuagaaaaacuauuuacaggacccaguucugcuuucgucguucaaccucaaaacggacgauguaccacagacggaguauuacuaggaaccacacaacuaucaccuguaaacauauguacauucagaggagacguaacccauauacccgguucaagaaauuacacaaugaaucuagcaucacaaaauuggaacuccuaugauccaacugaagaaauaccagcaccauuaggcacaccagacuucguaggaaaaauacaaggaguacuaacccaaaccacaagaacaaacgguucuacacgaggacauaaagcaacaguauauacaggcucagcagauuuuucuccaaaauuaggaagaguacaauucgcaacagauacagauaaugauuucgaaacaaaccaaaauaccaaauuuacaccaguuggagucauacaagacggaucaacaacaccaagaaacgaaccccaacaauggguacucccaucauacucagguagaaauauucacaacgugcaccuagcucccgcaguagccccuacauuuccuggagaacaacuauuauuuuuuagauccacuaugccagggugcucagguuauccaaauauggauuuagauugcuuacuaccacaagaauggguacaauauuuuuaucaagaggcagcacccgcccaaucagauguagcauuacuaagauucguaaacccugacacuggacgaguacucuuugaauguaaacuacacaaaucuggauauguaacaguagcacacacaggacaacacgauuuaguaauaccaccaaauggauacuuccgauucgacucauggguaaaccaauuuuacacacuagcccccaugggaaauggaacuggaagacgaagagcucuauaa

SEQ ID NO: 31534 - RNA, 1623 nt, Artificial Sequence
  derived and/or modified sequence opt6 from VP1__Norovirus__AGS08038
augaaaauggcaucuucagaugcaaacccaucagauggaucugccgcuaaccuaguaccugaaguuaauaaugaaguaauggcacucgaaccaguugucggagcugcaauagcugcaccaguugcaggacaacaaaauguaauagacccauggauaagaaacaacuucguccaagcacccgguggagaauucacaguuuccccaagaaaugcaccaggagaaauauuauggucagcucccuuaggaccggauuuaaacccauauuuaucccaucuagccagaauguacaauggauacgcaggaggauucgaaguccaaguaauacuagcaggaaaugcauuuaccgcaggaaaaguaauauuugcagcuguaccaccaaauuuucccacagaaggucuaucaccaucucaagucaccauguuuccacacauaguuguagacgucagacaacuagaaccaguacuaauaccccucccagauguuagaaacaacuucuaucauuauaaccaaaguaacgauccaacuauaaagcuuauagcuauguuauacacacccuuaagagcuaacaaugcaggagaugauguauucacagucucaugcagaguauuaacaagaccauccccagacuuugacuuuauauuucuaguaccaccaacaguugaaucaagaacaaaaccauucucuguaccaguauuaacaguagaagaaaugacuaauucuagauucccuauaccacuagaaaaauuauucacaggaccaucaucagcauuuguaguacaaccccaaaacggucgauguacuacagacggaguauuacuaggaacaacucaacuaaguccuguaaacauaugcacauuuagaggagauguaacucauauaaccggaucuagaaauuauacuaugaacuuagcaagccaaaauuggaauaauuacgacccuacagaagaaauaccagcaccacuaggaacaccagacuuugucggaaaaauacaagguguuuuaacacaaacaaccagaacugacggaucuacccguggccacaaagccacaguauauaccggaucagcagacuucgcaccaaaacuuggacgcguucaauuugaaacagauacagaucacgauuucgaugccaaucaaaacacaaaauucacaccaguaggaguaauacaagauggaggcaccacacauagaaaugagccacaacaauggguauuaccuucuuauucgggaagaaacacacauaauguccaccucgcaccugcaguagcaccaacuuucccaggagaacaacuacucuucuuucgaucgacaaugccuggauguuccggauauccaaacauggacuuagauuguuuauuaccacaagaauggguucaauacuuuuaucaagaagcagccccugcacaaucagauguugcacuuuuaagauucguaaacccagauacaggaagaguauuauuugaauguaaauuacauaaaucaggauauguaacaguagcacacacaggucaacaugaccuaguuauuccaccaaauggauauuuccgauucgacucauggguaaaucaauuuuacacucuagcaccaaugggaaauggaacuggaagacgaagagcagucuaa

SEQ ID NO: 31535 - RNA, 1623 nt, Artificial Sequence
  derived and/or modified sequence opt6 from VP1__Norovirus__AGS08040
augaaaauggcaucuucagaugcaaaucccucagacggaaguacagcaaaccuaguaccagaaguuaauaacgaaguaauggcacuugaaccaguagucggagcugcaauagcagcuccugucgcaggccaacaaaacguuaucgauccuuggauuagaaacaacuuuguacaagcaccaggcggagaauuuacgguaucaccuagaaaugcaccaggagaaauccuauggucagcaccauuaggaccagaucuaaaucccuaccuuucccauuuagcaagaauguacaacggauaugcaggaggauucgaaguacaaguaauacuagcaggaaaugcauucaccgcaggaaaaauaauuuuugcagcaguucccccaaacuuuccaacagaaggauuaucaccaucucaaguaacaauguuuccacacauaaucguagacguaagacaacuagaaccaguucuaauucccuuaccagauguaagaaacaacuucuaucacuauaaccaaucaaacgauccaacaauuaaacuaauagcaauguuauacacaccauuacgagcuaacaacgcuggugacgacguauuuacggucucaugccgaguucuuacaagacccucacccgacuuugauuuuauauuucuuguaccacccacagucgaaucaagaacaaaaccauucucaguaccaguucucacaguagaagaaaugaccaauucaagauuuccuauaccacucgaaaaauuauuuaccggcccaucauccgcguucgucguacaaccacaaaauggucgauguaccacugacggaguucuauuaggaacuacccaacuaucacccgucaacaucugcacauucagaggugacgugacccacauaccaggaucacgaaauuacacaaugaaucuagccucucagaauuggaacagcuacgaucccaccgaagaaauaccagcuccacuaggaacaccagauuucguagguaaaauacaaggugucuuaacacaaacaacucgaacaaacggaagcacaagaggacacaaagcaacagucuauacagguucagcagacuuuuccccaaaacucggaagaguacaauuugcuacagacacugauaaugauuucgaaacaaaucaaaauacaaaauucacuccaguagguguaauacaagacggaucaaccacaccaagaaaugaaccacaacaauggguuuuaccaucuuauucuggacgaaauauccacaacguacacuuagcaccugcuguagccccuacauuuccaggagaacaacuacuauucuuucgaucaacaaugcccgguuguuccggauaccccaacauggauuuagacugcuuauuaccacaagaauggguacaauauuuuuaucaagaagcagccccagcacaaucugacguagccuuacuaagauuuguaaacccagacacuggacgagucuuauucgaaugcaaacuacacaaaagcggauauguaacugucgcacauacaggacaacacgaccuagucauaccaccaaacggauauuucagauucgauucauggguaaaucaauuuuacacacuagcaccaauggguaacggaaccggaagaagaagagcacuauaa

SEQ ID NO: 31536 - RNA, 1623 nt, Artificial Sequence
  derived and/or modified sequence opt6 from VP1__Norovirus__AGS08041
augaaaauggcauccucagacgcaaacccaucagauggaaguacagccaaucuugugccagaaguaaauaaugaaguaauggcauuagaacccguaguaggugccgcuauagcagcacccgucgccggacaacaaaauguaaucgauccauggauaagaaauaauuuuguacaagcaccaggaggagaauuuacaguuagcccacgaaaugcaccaggagaaauauuauggucagcaccacuaggacccgaccuaaacccauauuuaucacaucuagcacguauguauaauggauacgcaggcggcuucgaaguacaaguaauacuagcuggaaacgcauuuacagccgguaaaauaauuuucgcugcaguacccccaaacuuuccaacugaaggucucucacccucccaaguaacuauguucccacauauaauaguagacguaagacaauuagaacccgucuuaauucccuuaccagacgucagaaauaauuucuaccacuauaaccaaucuaaugaccccacaauaaaauuaauagcaaugcuauacacuccauuaagagcaaacaaugcaggagaugauguauucaccguaucuuguagaguuuuaacaagaccuucaccugacuuugacuucauauuuuuaguacccccaacaguugaaucuagaacaaaaccuuuuucugucccaguuuuaaccguagaagaaaugacgaacucacgauucccaauaccauuagaaaaacuauuuacaggaccuucaagugccuuuguaguacaaccccaaaacgguagauguacaacagacggaguccuacuagguacaacacaauuaucaccaguaaacauauguacauuuagaggugacguuacacauauaagcggaucaagaaauuauacuaugaauuuagcuucucaaaacuggaauuccuacgaucccacugaagaaauaccagcaccacuaggaacaccagauuucguaggaaaaauacaaggaguacuuacacaaacgacacgaacagauggaucaaccagaggucacaaagcaaccguuuacacaggaucagcagacuuuaguccaaaacucgguagaguucaauuugcaacagauacagauaacgauuuuguaacaaaucaaaauacaaaauuuacaccuguagguguaauacaagacggauccacaacaccaagaaaugaaccacaacaauggguauuaccuagcuauuccggaagaaacacacauaacguccacuuagcaccagcaguagccccaacauuuccaggagaacaacuauuauuuuuuagaucaacaaugccaggguguucaggcuauccaaauauggauuuagacugccuauuaccccaagaauggguacaauauuucuaucaagaagccgcaccagcacaaucagacguagcacuacuccgauucguuaacccugacaccggaagaguauuauucgaaugcaaacuacauaaaucaggauacguaacaguagcacacacgggacaacaugaucucguaauuccaccaaauggcuauuucagauuugacucuuggguaaaccaauuuuacaccuuagcaccaaugggaaauggcacaggacguagaagagcccuauaa

SEQ ID NO: 31537 - RNA, 1623 nt, Artificial Sequence
  derived and/or modified sequence opt6 from VP1__Norovirus__AGS08042
augaaaauggcaucaucagacgcgaauccuucagacgguucaacugcaaaccuagucccugaagucaauaaugaaguaauggcacuagaaccuguagucggugcagcaauagcagcaccggucgccggucaacaaaauguaauagaccccuggauucgaaauaacuuuguccaagcaccaggaggagaauucacaguuaguccuagaaacgcaccuggagaaauauuauggucagcaccacuagguccagaucuaaauccuuacuuaucacaccuagcccgaauguauaauggauacgcaggaggauuugaaguacaagucauacucgcaggcaacgcauuuacagcaggaaaaaucauauucgcagcagucccuccaaacuuuccaacagaaggucucucucccucccaagucacaauguucccccacauaauaguugauguaagacaauuagaaccaguauuaauaccauuacccgacgucagaaacaacuucuaccacuauaaccaaaguaaugauucgacaauuaaacuaauagcuaugcucuacacuccauuaagagcuaauaaugccggagaugacguuuuuaccguuucuugcagaguucuaacacgaccauccccagacuuugacuuuauauuccuaguaccuccaaccguugaaucuagaacuaaaccauucaguguaccagucuuaacaguugaagaaaugacuaauucaagauuuccaauuccauuagaaaaacuauucaccggaccaucaagugcuuuuguaguccaaccacaaaacggacguuguacaacagacggaguacuauuagguacuacucaauuaucaccuguuaauauauguaccuuuagaggugacguaacacauauaccaggcucaagaaacuauaccaugaaucuagcuucacaaaacuggaacucauacgaucccacagaagaaauaccagcaccauuaggaacaccagacuuuguaggaaaaauacaaggcguccuaacucaaaccacaagaacaaauggaucuacuagaggucauaaagcaaccguauacacaggaucagccgacuuuuccccaaaauuaggcagaguucaauucgcaacagauacagauaacgauuucgaaacaaaucaaaauaccaaauuuacaccaguaggaguaauccaagacggaagcacuacuccaagaaacgaaccacaacaauggguacuuccaucauacuccggucgaaauauccauaauguucaucuagcacccgccguugcaccaacauuucccggagaacaacuacuauucuucagaucaaccaugccaggaugcuccgguuauccaaauauggaccuagauugcuuauuaccacaagaauggguccaauauuucuaucaagaagcugcaccagcccaaucagauguagcacuccuacguuuuguuaauccagauacaggcagaguacuauuugaaugcaaacuacauaaaucuggauauguaacagucgcccacacuggccagcacgaccuaguaauaccaccuaacggauauuucagauucgauuccuggguaaaucaauucuauacucuagcaccaauggguaauggaaccggccgacguagagcauuauaa

SEQ ID NO: 31538 - RNA, 1623 nt, Artificial Sequence
  derived and/or modified sequence opt6 from VP1__Norovirus__AGS08043
augaaaauggcaucuucagaugcaaacccuucagauggaucaacagcaaaucuuguaccagaaguauccaacgaaguaauggcacuugaaccaguaguaggagcagcaauugcugcaccugucgcaggccaacaaaauguaauagacccauggauuagaaauaacuucguacaagcucccggaggagaauuuacaguaucaccacgaaaugcaccaggcgaaauuuuauggucugcaccccucgguccagaucuaaauccauacuuaucacauuuagcaagaauguacaauggauaugcuggaggauucgaaguccaaguaauauuagccgguaaugcauucaccgcaggaaaaauuauauuugcugcaguaccaccaaauuuuccaaccgaaggucucucuccaucccaagucacaauguuuccacauauaauaguagacguaagacaauuggaacccguacuaauuccucuacccgauguccgcaacaauuucuaccauuauaaucaaucaaaugauucuacaauuaaacuuauagcaauguuauacacaccauuaagagcaaauuccgcaggagacgauguauucacaguaucuugucgaguucuaacuagaccaucuccagacuuugauuuuaucuuuuuagucccaccuacaguagaaucucgaacaaaaccauuuucaguuccaauauuaacaguagaagaaaugacaaacucuagguucccaauaccucuagaaaaauuauuuacagguccaucuucugcauuuguaguacaaccacaaaauggaagaugcacaacagauggaguauuacuagguacaacacaauuauccccuguaaauauauguaccuuccgaggagacguaacccacauaccaggaucacauaacuauacuaugaaucuagcuucccaaaacuggaacucuuaugauccaacagaagaaauaccagccccacuaggaacgccagauuuuguaggaaaaauacaaggcguacuuacacaaacaacaucaacaaacggcucaacuagaggacacaaagccacaguuuauaccggaucagcagauuuuucaccuaaacuaggacgaguucaauucgcuacagauaccaauaacgauuuugaaacaaaucaaaauacaaaauuuacuccuguaggagucauccaagacgguucaacuacacccagaaaugaaccacaacaauggguccuaccuucauauucugguagaaacauacacaauguacaccucgccccugcuguagcaccaacauuucccggagaacaacuacucuuuuuuagaucuaccaugccaggaugcucaggauauccaaauauggauuuagauugcuuauuaccacaagaauggguacaauauuucuaucaagaagcagcaccagcacaaagcgacguagcauuauuaagauuuguaaauccagauaccgguagaguccucuuugaaugcaaacuacauaaaucuggcuauauaacaguugcucauacuggacaacaugaccucguaaucccaccaaauggcuauuuuagauucgauucauggguaaaucaauuuuauacacuugcaccuaugggaaauggaacaggaagacgcagagcacuauaa

SEQ ID NO: 31539 - RNA, 1623 nt, Artificial Sequence
  derived and/or modified sequence opt6 from VP1__Norovirus__AGS08044
augaaaauggcaucaucagacgcaaacccauccgauggaucaacagcaaaccuuguaccagaaguaaacaaugaaguaauggcauuagaaccagucguaggcgcagcaaucgcagcaccaguugcaggccaacaaaacguaauagacccauggauaagaaacaacuucguccaagcaccaggaggagaauucacaguauccccccgaaacgccccuggugaaaucuuauggucagcaccacucggaccggaucucaauccauauuuaucccacuuagcccguauguauaacgguuaugcagguggauucgaaguacaaguuauauuagcaggaaaugcauuuacugcaggaaaaaucauauucgcagcuguaccuccaaacuuuccaacugaagguuuaucaccaucucaagucacaauguucccucauauaauagucgacguaagacaacuagaaccaguacucauuccacuacccgauguacguaauaacuucuaucacuauaaccaaucaaaugacucaacaauaaaacuaauagccauguuauacaccccauuaagagcuaacaaugcaggugacgacguauuuacaguaucauguagaguacuuacaagaccaucuccugauuuugacuuuauauuucucguacccccaacaguagaaucacguacaaaaccauuuucuguuccaaucuuaacuguagaagaaaugacuaacucacgcuuuccaauuccauuggaaaaauuauuuacaggaccaucaucagcauuuguaguccaaccacaaaauggucgauguacaacagacggaguauuacuagguacaacccagcuaucaccuguaaauauaugcaccuuuagaggugacgucacacauauaccuggaucacacaauuauacaaugaacuuagcaucacaaaauuggaauaguuaugacccaacagaagaaauacccgcccccuuagguaccccagacuuuguagguaaaauacaaggagucuuaacacaaacaacaucaacuaacggaucuacuagaggacacaaagcuaccguauauacaggaucagccgacuucucaccaaaacuagguagaguccaauucgcaaccgauaccaauaacgauuucgaaacuaaucaaaauacaaaauuuacccccguuggaguaauacaagauggaucuacaacaccccgaaaugaaccccaacaauggguccuaccaucauauucaggacgaaauauucacaacguucaucuagcaccugcaguagcaccaacauuuccaggugaacaauuacuauucuuuagaucaaccaugccaggauguucuggauacccaaacauggaucuagauugucuacuaccacaagaauggguucaauacuucuaucaagaagcagcaccagcacaaucagacguagcauuauuaagauucguuaauccagauacaggaagaguacuauucgaaugcaaauuacauaaaucaggauacgucacagucgcccauacuggccaacacgacuuaguaauaccaccuaacggcuacuuccgauuugauucuugggucaaucaauuuuauacauuagcaccaaugggaaauggaacaggacgucgcagggccuuauaa

SEQ ID NO: 31540 - RNA, 1623 nt, Artificial Sequence
  derived and/or modified sequence opt6 from VP1__Norovirus__AGS08045
augaaaauggcaucaucagaugcaaauccuagcgauggaucaacagccaaucuagucccagaaguaaauaaugaaguaauggcauuagaacccguaguaggagcugccauagcagccccuguugcaggucaacaaaauguuauugauccauggaucagaaauaacuuuguacaagcacccgguggagaauucacaguaucaccacgaaaugcaccaggcgaaauacuauggagugcuccccucgguccugacuuaaauccauacuuaucucacuuagcccgaauguauaauggauaugcaggagguuucgaaguacaaguuauacuagcuggaaaugcauuuacagccggcaaaauaauauuugcagccguaccacccaauuuuccaacagaaggauuaucaccaucccaaguaacaauguucccccauauaauaguagacguacgccaacucgaaccaguucuaauacccuuaccagacgucagaaacaauuuuuaucacuacaaccaaucaaaugacccuacaauaaaacuuauagcaauguuauacacaccauuaagagcaaacaacgcaggugaugacguauuuacaguuagcugucgcguuuuaacuagaccaucacccgacuuugacuuuauauuucuaguuccaccaacaguugaaaguagaacaaaaccauuuucaguaccaguauuaacaguagaagaaaugacaaacagucgauucccaguuccccucgaaaaacuuuucacaggcccaucaagugcauucguaguacaaccacaaaauggaagaugcacaaccgacgguguauuacuaggaacuacccaacuuucaccaguaaauauauguacauucagaggagauguaacacacauaacuggaucacgcaauuauacaaugaaucuugcaucccaaaacuggaauucauacgaucccacugaagaaauuccugccccuuuaggaaccccagacuuuguaggcaaaauucaaggaguucuaacacaaacaacaagaacaaauggaucaaccagaggacauaaagcaacagucuacacaggaucagcagauuucucaccaaaauuaggcagaguacaauucgcuacagauacagauaaugauuucgaaacuaaucaaaacacaaaauucacaccuguaggcgucauccaagauggauccacaacuccaagaaacgaaccacaacaauggguccuacccucauacucaggaagaaacauacacaauguucacuuagcaccagcaguagcacccacauuuccaggugaacaacuucuuuuuuuuagaucaacuaugccugguuguucaggauaucccaauauggauuuagauugcuuacuaccacaagaauggguacaauauuuuuaccaagaagcagcaccagcacaaucugacguugcauuacuaagauuuguuaacccagauaccggaagaguauuauucgaaugcaaacuacauaaaagcgguuauguaacuguugcccauacaggacaacacgaccuaguaaucccuccaaauggauauuuuagauucgauucauggguaaaucaauuuuacacucuagcaccaauggguaauggaacaggccgaagaagagcauuauaa

SEQ ID NO: 31541 - RNA, 1623 nt, Artificial Sequence
  derived and/or modified sequence opt6 from VP1__Norovirus__AGS08047
augaaaauggcauccucagacgcuaacccaucagauggaucuacagcaaaccucguuccugaaguaaacaaugaaguaauggcacuagaaccuguaguaggcgcugcaauagcagcaccugucgcuggacagcaaaauguaauagauccauggauaagaaacaauuucguacaagcaccagguggagaauucacaguaucaccucgaaaugcacccggugaaauccucuggucugccccacuaggucccgauuuaaaucccuauuuaucacauuuagcccgaauguauaacucuuacgcaggaggauucgaaguucaaguaauuuuagcaggcaacgcauucaccgcaggcaaaauuauauucgcagcaguaccaccaaacuuucccacagaaggacuaucaccaucacaaguaacaauguuuccacacauaauaguagacguaagacaacuugaaccaguacuaauaccauuaccagauguaagaaacaacuucuaucacuacaaccaaucgaacgauccaaccauaaaauuaauagcaaugcuauacacaccauuaagagcuaauaaugcaggagacgaugucuucaccguaucaugccguguauuaacacgaccuagcccagacuucgacuuuaucuuccuagucccaccaacagucgaaucaagaacaaaaccuuuuucuguaccuguccuaacuguagaagagaugacaaauucccgcuuuccaauaccacucgaaaaacucuucacaggaccaucaucagcuuucguaguucaaccacaaaauggacgauguacaacagauggcguauuacuaggcacuacacaacuaucacccguaaauaucugcacauuucgaggugaugucacacauauaucaggaucucgaaauuacacuaugaauuuagcaagccaaaacuggaacucauaugauccaacugaagaaauaccagcuccauuaggaacaccagacuucguaggaaaaauacaagguguucuaacacaaacaacaagaacagacgguucaacaagaggacauaaagcuaccgucuacacaggauccgcugauuuuucaccuaaacucggaagaguacaauuugcaacagauacagauaacgauuucguuacaaaccaaaacaccaaauucacaccaguaggaguaauacaagauggaucaacaacaccacgaaaugaaccucaacaauggguacuaccuucauacagcggaagaaacacucacaacguucaucuagcaccagcaguggcaccaacauuucccggagaacaauuauuauuuuucagaucaacaaugcccggauguucuggauauccuaauauggaccuagauugcuuacucccucaagaauggguacaauauuuuuaucaagaagcugcuccagcacaauccgauguagcccuacuccguuucguaaacccagacacaggaagaguacuauucgaaugcaaacuacacaaauccggcuacgucacaguagcacauacaggccaacaugacuuaguaauaccaccaaauggauauuuccguuucgauuccuggguuaaccaauuuuacacacuagcuccuaugggcaauggaacaggcagaagaagagcauuauaa

SEQ ID NO: 31542 - RNA, 1623 nt, Artificial Sequence
  derived and/or modified sequence opt6 from VP1__Norovirus__AGS08048
augaaaauggcaucaucagacgcuaacccaucagauggauccacagccaacuuaguaccagaaguuaauaaugaaguaauggccuuagaaccuguuguaggugcggcaauagcagccccaguagcaggucaacaaaaugucaucgacccauggauaagaaauaacuucguacaagccccagguggagaauuuacaguaucaccaagaaacgcaccaggagaaauacuuuggucagcaccuuuaggcccagaccuaaauccauauuuaucccaccuagcacgaauguauaacggauacgcaggaggauucgaaguacaaguuauuuuagcagguaacgcauuuacagcuggaaaaauuauauucgcagcaguuccaccaaacuucccaacugaaggcuuaucaccuucacaaguaacaauguuuccucacauuauaguagauguaagacaauuagaaccaguauuaauaccacuaccugacguaagaaacaacuucuaucacuacaaccaaaguaaugauccaacaauaaaacucauagcaauguuauacacaccauuaagagcuaauaaugcaggcgacgaugucuuuaccguaaguugucguguauuaacaagaccaucuccugauuucgauuuuaucuuucucguaccaccuacaguugaaucuagaacaaaaccauucucaguaccugucuuaacaguagaagaaaugacaaauucuagauuuccuauaccacucgaaaaauuauucacaggaccaucaagcgcauucguaguacaaccacaaaauggucguuguaccacagacggaguauuauuggguacaacacaauuaucaccagucaauauaugcacuuuuagaggugauguaacacauauuuccggcagcagaaacuacacaaugaauuuagcaagucaaaauuggaauucuuacgauccaacugaagaaauuccugcuccuuuaggaacuccagauuuuguagguaaaauucaaggcguacuuacccaaacaacacgaacagacggcucaaccagaggccacaaagcaacaguuuacacaggaucugcagauuuuucaccuaaacucggaagaguacaauucgcaacagauacagauaacgauuucguuacaaaucaaaauacaaaauuuacaccagugggaguaauacaagacggaucuacaacacccagaaaugaaccacaacaauggguacuaccaaguuauaguggacgcaauacccauaacguucaccuagccccagcaguagcccccacuuuucccggagaacaacuauuauucuuuagauccacaaugccaggauguucagguuauccaaauauggaucuagacugcuuacucccucaagaauggguacaauauuuuuaccaagaagcagcaccugcacaaucagacguagcauuauuacgcuucguaaauccagacacaggcagaguacuauucgaauguaaauuacacaaaagcggauaugucacuguagcacacacaggucaacaugauuuaguaauaccaccaaauggcuacuuuagauucgauucauggguaaaccaauucuauacauuagcuccaaugggaaauggaacuggaagacguagagcccuauaa

SEQ ID NO: 31543 - RNA, 1623 nt, Artificial Sequence
  derived and/or modified sequence opt6 from VP1__Norovirus__AGS08050
augaaaauggcaucaucagaugcuaauccuucagauggaucugcugcuaaccuaguaccugaaguaaacaaugaagucauggcacuugaaccaguaguaggagcagcgauagcagcaccaguagcuggacaacaaaauguuauugaccccuggauacgaaauaacuuuguacaagcaccaggaggagaauuuacaguaucaccacgaaaugcaccaggagaaauacuauggucagccccacucggaccugauuuaaauccauacuuaucucaccuagcuagaauguauaauggauacgccggcggauucgaaguacaaguaauauuagcaggaaacgccuuuaccgcuggcaaaguuauauucgcagcuguaccacccaacuuccccacagaaggccucagcccaucacaagucacaauguuuccacacauaguaguagauguuagacaacuagaaccaguacuaauaccucuucccgacguaagaaacaauuuuuaccacuauaaccaaucuaaugacccaaccauaaaauuaauagcaaugcuauacacaccacuacgagcaaauaacgcuggagaugacgucuuuacaguaagcuguagagucuuaacacgaccauccccagacuuugacuuuauauuuuuaguaccaccaacaguagaaucaagaacaaaaccuuuuucuguaccaguauuaacaguugaagaaaugacuaacucucgauuuccaaucccauuagaaaaacucuucacaggaccaucaucagcauucguaguacaaccacaaaacggacgauguacaacagacggaguucuacuaggaacaacccaauuaaguccggucaauauuugcaccuucagaggagaugucacacauauaacaggaucgcgaaacuacacuaugaaccuagcaucacaaaauuggucaaauuaugaucccacagaagaaauaccagcuccccuugguacuccagacuucgucggcaaaauacaaggagucuuaacacaaacaaccagaacagacggaucaacacgaggacauaaagcaaccguauacaccggaucagccgacuuugcaccaaaacucggaagaguccaauuugaaacugauacagaucaugauuucgaagcaaaucaaaacacaaaauuuacaccaguaggcguaauacaagaugguucuacaacacaccgcaaugaaccacaacaauggguucuaccaucauauucaggacgaaacacacccaauguacaucuagcuccagccguagcaccaacauuuccaggugaacaacuacuuuucuucagaucaacaaugcccgguuguuccggcuacccaaauauggauuuagacugucuccuaccacaagaauggguucaauauuuuuaucaagaagccgcuccagcacaaucagauguagcauuauuaagauucguaaauccagacacuggaagaguauuauuugaaugcaaacuucauaaaucaggauauguaacagucgcucauacaggacaacacgaucuaguaauaccaccuaaugguuauuucagauucgacucauggguaaaucaauucuacacauuagcaccuaugggaaaugguacuggaagaagaagagcuuuauaa

SEQ ID NO: 31544 - RNA, 1623 nt, Artificial Sequence
  derived and/or modified sequence opt6 from VP1__Norovirus__AGS08051
augaaaauggcaucaucugaugcaaacccaucugacgguucuacagcaaaucuugucccagagguaaacaaugaaguaauggcucuagaaccaguaguaggugcagcaauagcagcaccaguagcuggacaacaaaaugucauagacccuuggauaagaaacaacuuuguccaagcaccuggaggagaauuuacaguaucacccagaaaugcaccaggagaaauuuuauggucagcaccgcucggucccgaucuaaacccauauuuaucacaucuagcacgaauguauaacggauacgcagguggauucgaaguacaaguaauucuagcaggaaaugcuuuuacagcaggaaaaauaauauucgcagcaguaccaccaaacuuuccuacagaaggacucucaccaucacaaguaacaauguuuccccacauaauuguugacguaagacaacuugaaccuguauuaauaccauuaccugauguaagaaacaacuuuuaucauuauaaucaaucuaaugacccaacaauuaaauuaauagcuaugcuauacacaccacuaagagcaaauaacgccggagacgaugucuuuacaguaucuugcagaguacuuacaagaccuucucccgauuuugauuucauauuucuaguaccaccaacuguagaaucaagaacaaaacccuucucuguuccuguacuuacaguugaagaaaugaccaauucacgauuuccaauaccguuagaaaaauuauucacagguccaucuucagccuuugucguacaaccucaaaacggaagauguacaacugacggaguacuacuuggaacaacucaauuaucacccgucaauaucugugccuucagaggagacguuacacauauaucuggaucuagaaacuacacaaugaacuuagccucccaaaauuggaauucauacgacccaacagaagaaauaccagccccccuuggcacaccagauuuuguaggaaaaauacaaggaaugcuuacacaaacaacuagaacugacggaucaacaagaggacacaaagcaacugucuauacaggauccgcagacuuuaguccuaaauuaggaagaguacaauucgccacagauacagacaacgacuucgugacaaaucaaaauacuaaauuuacacccgucggaguaauccaagauggauccacaacaccaagaaaugaaccucaacaauggguuuuaccaucauauuccggcagaaauacccauaauguacaucuagcaccagccguagccccaaccuuucccggugaacaacuacuauucuuucgaaguacuaugccugguugcucuggcuaucccaauauggauuuagauuguuuauuaccacaagaauggguacaauauuucuaucaagaagccgcaccagcacaaucugacguagccuuacuaagguucguaaacccagacacaggcagaguuuuauucgaaugcaaacuacauaaaucuggauacguaacaguagcucauacaggccaacaugacuuaguuaucccacccaacggauauuuuagauuugacucuuggguaaaucaauucuacacccucgccccaauggguaauggaacuggacgaagaagagcauuauaa

SEQ ID NO: 31545 - RNA, 1623 nt, Artificial Sequence
  derived and/or modified sequence opt6 from VP1__Norovirus__AGS08052
augaaaauggccucuucagaugcaaacccuucagaugguucagcagcaaauuuaguaccugaaguaaacaaugaaguaauggcauuagaaccaguuguaggagcugcaauagccgcuccaguagcuggucaacaaaacguaauagaucccuggauaagaaauaauuuuguacaagcaccaggaggugaauuuacaguuucaccuagaaaugcaccaggugaaauacuauggucugcaccucuaggaccagaccugaaucccuauuuaucacaucuagcacguauguauaacggauaugcaggaggauuugaaguacaaguaauacucgcaggaaaugcauucacagcaggaaaaguaauauuugcagcugucccuccuaauuuuccaacagaaggccucucaccuucacaagucacaauguucccacauauaguaguugaugucagacaacuagaaccaguauuaauaccccuuccagauguaagaaauaauuuuuaucauuauaaucaaucuaaugacccuacaauaaaauuaauagcaauguuauauacuccauuaagagcuaacaaugcaggcgaugauguauucaccguuuccuguagaguccuaacaagaccaucaccagauuucgauuuuauauuucuaguuccuccaacuguugaaaguagaacaaaaccauucucaguaccaguccuaacaguagaggaaaugacaaacucacgauucccaauaccacuagaaaaacuauuuaccggccccucgucagcauucguaguacaaccacaaaacggaagauguacgacagacgguguauuacuggguacaacacaauuaucaccaguaaauauauguacauuccgaggagaugucacacacaucacagguucuagaaauuauaccaugaauuuagccucccaaaauuggucaaauuaugacccuacagaagaaauacccgcacccuuagguacaccagacuuuguuggaaaaauacaaggaguauuaacacaaacaacacgaacugacggcucgacaagaggccauaaagcuacagucuauacagggucagccgacuucgcuccaaaacuaggaagaguccaauucggaacagacacugaccaugauuuugaagcaaaccaaaauacaaaauucacaccaguaggaguaauacaagacggaucuacaacucauagaaaugaaccucaacaauggguucuuccaucuuacucaggacgaaauacuccaaacguucacuuagcaccagcaguugcaccaacauucccaggugaacaacuacuauuuuuccguucaacaaugccaggauguucaggauauccaaacauggacuuagauuguuuacuuccacaagaauggguccaauauuucuaucaagaagccgcaccagcacaaagcgauguagcauuauuacgauuuguaaaucccgauacaggacgagucuuauucgaauguaaacuucauaaauccggcuacguaacaguugcacauacaggucaacacgacuuaguuauaccaccaaacggauauuuuagauucgauucaugggucaaucaauucuacacucuagcacccauggguaacggaacaggacgcagaagagcuuuauaa

SEQ ID NO: 31546 - RNA, 1623 nt, Artificial Sequence
  derived and/or modified sequence opt6 from VP1__Norovirus__AGS08054
augaaaauggcuucauccgacgcuaacccaucagauggaaguacagcaaaccuaguacccgaaguuaacaaugaaguaauggcacuagaaccaguaguaggugcugcuauagcagcacccguugcuggacaacaaaaugucaucgauccauggauaagaaauaacuucgugcaagcuccaggaggagaauuuacaguuuccccacguaacgcaccaggcgaaauacucuggucagcaccucuuggaccagauuuaaauccauaucuaagucauuuagcacgaauguacaacggcuaugcaggaggauuugaaguccaaguaauacucgcagguaacgcauuuacagcaggcaaaaucauauuugcugcaguaccuccaaauuuuccaacugaaggccuaucaccaucacagguaaccauguucccacacauaauaguagacguacgacaauuagaaccaguacuaauaccacuaccagauguaagaaacaauuucuaucauuauaaccaaucaaacgauccaacaauuaaacuaauagcaaugcuauacacuccauuaagagcaaauaaugcaggagaugacguauuuacaguuucaugcagaguauuaacaagaccauccccagauuucgauuuuauauuucuaguuccacccacagucgaaucaagaacaaaacccuuuucaguaccaguauuaacaguagaagaaaugacaaacucacgcuuucccauacccuuagaaaaacuauuuacaggaccuaguucagcauucguuguacaaccacaaaacgguagauguacaaccgaugguguauuauuaggaacaacacaacuaucaccaguaaauaucuguaccuuccgaggagacguuacacauauaucuggauccagaaauuacacaaugaauuuagcaucacaaaauuggaauuccuaugauccaacagaagaaauaccagcaccacuuggaacuccugacuucguaggaaaaauacaaggaguacuuacacaaacaacaagaacagacggaucaacacgaggacacaaagcuaccgucuauacaggaucagcagacuuuucaccaaaacuaggaagaguccaauucgcaacagauacugacaacgauuucgucgccgaucaaaauacaaaauucacaccaguaggaguuauccaagaugguagcacaacaccaagaaaugaaccucaacaauggguauuaccauccuacucuggacgaaauacacauaauguccacuuagcaccagccgucgcaccuacauucccaggagaacaauuauuauuuuuuagaucuaccaugccaggaugcucuggauacccaaauauggaucuugauugccuauuaccucaagaauggguacaauauuuuuaucaagaagcagcaccagcacaauccgacguagcacuacuaagauuuguaaauccagacacaggaaggguucuauuugaaugcaaacuccacaaaucaggauauguaacaguagcacauacaggucaacaugaucuugucauaccaccaaauggauauuuuagauucgauucauggguaaaucaauuuuauacacuagcuccaaugggcaauggaacaggccgaagaagagcacuguaa

SEQ ID NO: 31547 - RNA, 1623 nt, Artificial Sequence
  derived and/or modified sequence opt6 from VP1__Norovirus__AGS08056
augaaaauggcauccuccgacgcaaacccauccgaugguucugcagcaaauuuaguaccagaaguaaacaaugaaguuauggcauuagaaccaguaguuggagcugcaauagcagcaccaguagcaggacaacaaaauguaauagauccuuggauucgaaauaacuuuguacaagccccaggaggagaauuuaccgucucaccaagaaaugcuccaggugaaaucuuauggucagcaccacuaggaccugauuuaaauccauacuuaucacacuuagcaagaauguauaacggauaugcaggaggauuugaaguacaagucauacuugcaggcaaugcauuuacagcaggcaaaguaaucuuugcugcagucccgccaaacuuuccuacagaaggacucucuccaucacaaguuacaauguucccacauauugucguugauguaagacaacuagaacccguuuuaauaccccuucccgacguccgaaacaauuucuaucacuauaaccaaagcaacgauccuacaauaaaacuaauagcuauguuauauacuccacuaagagcaaacaaugcaggugaugacguauuuacaguaucauguagaguccucacaagaccaucaccagacuuugacuuuauauuucuaguaccaccaacaguagaaucacgaacaaaaccauucucaguaccaguucuuacaguagaagaaaugacuaauucaagauuuccuauuccacuugaaaaauuauuuacaggccccucuuccgcauuuguuguucaaccacaaaacggaagauguacaacagauggcgucuuauuagguacaacacaacuaucacccguaaauauauguacuuuccgaggagauguaacccauauaacuggcucaagaaauuauacuaugaaucucgcuucacaaaacuggucaaauuacgacccaacagaagaaauaccugcaccacuuggcacaccugauuuuguagguaaaauacaaggaguacuaacccaaacuacaagaacagacgguucaacucgaggacacaaagccacaguauacacaggaucugccgauuuugcaccaaaacuaggaagaguacaauucgaaacagauacagauagagacuucgaagcaaaccagaauacaaaauucacaccuguaggcguaauacaagacggaggaacaacacauagaaacgaaccucaacaauggguauuaccaucauacuccggaagaaauaccccaaauguacaccuagcucccgccguagcaccaacauucccuggagaacaauuauuauuuuuucgaucaaccaugccuggcugcucaggauacccaaauauggaucuagacuguuuacuaccacaagaauggguucaauacuuuuaccaagaagcagccccagcacaaucugacguugcacuucuaagauuuguuaacccagacacaggaagaguucuuuuugaauguaaauuacauaaaucaggauacguaacaguagcacacacuggacaacaugacuuaguaauaccucccaauggauacuuccgcuuugauucuuggguaaaccaauuuuauacacuagcaccaauggguaauggcaccggacgacguagagcauuauaa

SEQ ID NO: 31548 - RNA, 1623 nt, Artificial Sequence
  derived and/or modified sequence opt6 from VP1__Norovirus__AGS08057
augaaaauggcaucuucagaugcacacccaucugacggauccacagcaaacuuaguaccugaaguaaauaaugaaguaauggcacuagaaccaguaguaggagccgcuauagcagcacccguagcaggccaacaaaauguaauugacccuuggauacgaaauaauuucguacaagccccagguggagaauuuacaguaucaccaagaaacgcaccuggagaaauuuuauggagcgccccacuuggaccagauuuaaauccuuaucuaucccaccuugcaagaauguauaauggauacgcaggaggauucgaaguccaaguaauacuagcaggaaacgccuuuaccgcaggaaaaauaauuuuugcagcagucccaccuaauuuucccacagaaggacuaucaccaucucaaguaacaauguucccucacauaauaguugacguaagacaauuagaaccaguuuuaauaccacuaccagacguuagaaauaacuucuaccacuauaaccaaucaaaugaucccacaauaaaauuaauagcaauguuauauacacccuuaagagcaaacaaugcaggugaugauguauuuacaguaucuuguagaguacuaacaagaccaucaccagacuuugacuucauauuucuaguucccccuacaguagaaucucgcaccaagccauuuucaguacccguuuuaacaguagaagaaaugaccaacucaagauuucccauaccccucgaaaaauuauuuacuggacccucauccgcauucguaguacaaccacaaaauggcagauguaccaccgacgguguacuauuaggaacaacacaauuaucaccaguaaacaucuguacauucagaggagacguuacacauauauccgguagccguaacuacaccaugaauuuagccucacaaaacuggaacuccuaugaucccacagaagaaauaccagcaccccugggaaccccagauuuuguuggaaaaauacaaggcguauuaacccaaacaaccagagcagacggaucaacacgaggccauaaagcaacuguauauacaggaucagcagacuuuucaccaaaacuaggaagaguacaauucgcaacagacacagauaaugacuucguugcuaaucaaaacacaaaauuuacaccaguaggcguaauacaagauggcucaacaacuccacgaaaugaaccacaacaauggguacuaccaucauauucaggaagaaauacacacaauguacauuuagcuccugcaguagcaccaacauuccccggagaacaacucuuauuuuuuagaucaacaaugccaggaugcucugguuauccaaacauggacuuagacugccuacuuccacaagaauggguacaauacuucuaucaagaagcagcaccagcucaaucagauguagcacucuuaagauucguuaauccagauacaggaagaguauuauuugaaugcaaacuccauaaaucuggauacgucacaguagcacacacaggacaacacgaccuuguaauuccacccaauggcuauuucagauuugauucauggguaaaucaauuuuacacauuagcacccauggguaauggcaccggaagacgacgagcauuauaa

SEQ ID NO: 31549 - RNA, 1623 nt, Artificial Sequence
  derived and/or modified sequence opt6 from VP1__Norovirus__AGS08058
augaaaauggcauccucugacgcaaacccaucugauggcucugcagcaaaucuuguaccagaaguaaacaacgaaguaauggcauuagaaccaguaguuggagcagcaauagcagcaccaguagcuggacaacaaaauguuauagacccuuggauaagaaauaauuuuguacaagccccaggaggugaauuuacaguuucaccaagaaaugcccccggagaaauuuuauggagugcaccacuaggaccagauuuaaauccauacuuaucucaucuagccagaauguauaacgguuacgcaggagguuuugaaguucaaguaauauuagcuggaaaugcguuuacugcaggaaaaguuauauucgccgcaguaccaccaaacuuuccaacagaaggacuaucaccuucacaaguuacuauguuuccacacauaguaguugacguaagacaacuugaaccaguauuaauaccauuaccagacgucagaaacaacuucuaucauuauaaccaaucaaaugacccaacaauuaaacuaauagcaaugcuuuauacuccucuaagagccaacaacgccggagaugaugucuuuacaguaucauguagaguacuaacucgaccaucaccagacuuugauuucauauuccuagucccuccaacagucgaaucaagaacaaaaccauucucagucccaguauuaacuguagaagaaaugacuaauucaagauuuccaauaccccuagaaaaacucuucacggguccuucaucagcuuucguaguacaaccucaaaauggaagauguaccaccgauggaguacuuuuaggaaccacucaacuuucaccaguaaauauuugcacuuucaggggagauguaacucauauuacaggaagucgaaauuacacaaugaaucuagcaucucaaaacuggaauaauuaugacccaacagaagaaauaccugcaccacuaggcaccccugacuuuguaggaaaaauacaagguguauuaacccaaacaacuagaacagauggauccacuagaggacacaaagcaacaguauauaccggcucagcagacuuugcaccuaaauuaggaagaguacaauuugaaacugauaccgaucacgauuucgaagcaaaucaaaauacaaaauucacuccagucggaguaauacaagacgguggaacaacacacagaaaugaaccacaacaaugggucuuacccaguuacucaggcagaaauacacauaauguucauuuagcaccagcaguagcaccaacauuuccaggagaacaacuauuauuuuucagauccacaaugccaggaugcuccggauauccaaacauggaucuugacugcuuauuaccacaagaauggguccaauauuucuaucaagaagcagcaccagcacaaucagauguagccuuacuaagauucgucaacccagauacuggacgaguauuauuugaauguaaacuacauaaaucaggauauguaacaguagcacacacaggacaacaugaccuuguaauaccaccaaauggauauuuuagauuugacucuuggguaaaucaauuuuacacacuagcaccuaugggaaauggaacaggaagaagaagagcuguauaa

SEQ ID NO: 31550 - RNA, 1623 nt, Artificial Sequence
  derived and/or modified sequence opt6 from VP1__Norovirus__AGS08059
augaaaauggcaucaucagaugcaaacccauccgacggaucagcagcaaaccuaguaccugaaguuaacaaugaaguaauggcauuagaaccaguagucggcgcagcaaucgcagcaccagucgcaggacaacaaaacguaaucgacccauggauaagaaacaauuucguccaagcaccuggaggagaauuuacaguuuccccacgaaaugccccaggagaaauccuauggaaugcaccucuaggaccagaccucaauccuuacuuaucucacuuagcaagaauguauaauggauacgcaggaggguuugagguacaaguaauucuagcagguaacgcauuuacagccggaaaagucauauuugccgcagucccaccaaacuuuccuacagaaggauuaucaccaucucaagucacaauguucccacacauaguagucgauguaagacaauuagaaccaguucuuauucccuuaccagaugucagaaacaauuuuuaccauuauaaucaaaguaaugauccaacaauaaaacucaucgccauguuauauacuccauuaagagcaaacaacgcaggagacgauguauucacaguaucaugcagaguauuaacaagaccaagcccagauuuugauuuuauauuuuuaguaccacccacaguagaaucaagaacaaaaccuuucucaguacccguacucaccgucgaagaaaugaccaacucaagauuuccaauaccccuagagaaauuauucacaggaccaucauccgcauucguuguucaaccccaaaacggaagaugcacuacugauggcguacuacuaggaacaacacaauuaucaccuguaaacauauguacauuucgaggagacguaacacauauaacuggcuccagaaauuauacgaugaacuuagcaucccaaaauuggaacaacuaugauccaacagaagaaauaccagcuccacuagguacaccagacuuuguaggaaaaauacaaggcgucuuaacccaaacaacaagaacagacggaucuacuagaggucacaaagcaacaguauauacaggaucagcagacuucgcaccaaaauuaggaagaguccaauuugaaacugauacagaucacgauuucgaagccaaccaaaacacaaaauucaccccaguaggcguaauacaagauggaggaaccacucacagaaaugaaccacaacaauggguauuaccuaguuacaguggaagaaauacacauaauguucaccuugcaccagcaguagcucccacauuuccaggagaacaauuacuauucuuccgaucaacaaugccagguuguaguggcuauccuaauauggaucucgauugucuucuaccacaagaauggguacaauauuucuaccaagaagccgcaccagcacaaucugacguagcccuacuaagauuuguaaauccugacacaggacgaguacuauucgaaugcaaacuucauaaaucuggauacgcaacaguugcacauacuggccaacacgauuuaguuauaccaccaaauggauauuuuagauucgacucuuggguaaaccaauuuuauacacuugcacccaugggcaauggcacuggaagaagaagagcaguuuaa

SEQ ID NO: 31551 - RNA, 1623 nt, Artificial Sequence
  derived and/or modified sequence opt6 from VP1__Norovirus__AGS08060
augaaaauggcauccucggaugcaaacccuucagauggaucagcagcuaaccuaguccccgaagucaauaaugaaguaauggcauuagaaccaguaguaggugcagcuauagcagcaccaguagcaggccaacaaaauguaauagauccauggauaagaaacaauuuuguacaagcaccaggaggagaauuuacagucucuccaagaaaugcacccggugaaauacuauggucagcaccucuaggaccagaccuaaacccuuaccuaucacaucuagccagaauguauaacggauaugcuggagguuuugaaguacaaguaauauuagcaggaaaugcauucacugcaggcaaaguaauuuuugcagcagucccuccaaauuucccaacagaaggauuaucaccaucucaaguuaccauguuuccccacauaguaguagacguaagacaacucgaaccaguacuaauaccacuaccagacguucgaaacaauuucuaccauuauaaccaaucaaaugauccaacuauaaaauuaauagcaaugcuauacaccccacuaagagcaaacaacgccggugaugauguuuuuacagucucaugucgaguacuaacgagaccuucaccugacuucgauuucaucuucuuaguaccaccuacagucgaaucacgaacaaagccauuuucuguuccuguacucacugucgaagaaaugaccaacucacguuuuccaauaccauuagaaaaauuauuuaccggccccucaucagcauucguaguccaaccacaaaauggcagauguacaacagacggaguauuacucggaacuacccaacuaucaccaguaaacauuuguacauuucgaggagauguaacacacauaaccggcagccgcaauuauacaaugaauuuagcuucucaaaacuggaauaauuaugauccaacagaagaaauaccagcuccauuaggcacaccugacuuuguagguaaaauacaaggaguacuuacccaaacaacacgaacagaugguucaacuagaggacauaaagcaaccguauauacaggaucugccgacuuugcuccaaaacuuggcagaguccaauuugaaaccgauacagaucaugauuucgaagcuaaccaaaacaccaaauuuacacccguagguguuauacaagauggcggaacaacacacagaaaugaaccccaacaauggguccuaccaucauauuccggaagaaacacaccaaauguccauuuagcucccgcuguagcuccaacauuuccaggugaacaauuacuauuuuucagauccacuaugccuggaugcucaggauacccaaauauggaucuagacugcuuauuaccccaagaauggguccaauauuuuuaucaagaagcagcacccgcacaaucagacguagcuuuauuaagauuuguuaauccagacacaggaagaguacucuucgaaugcaaauuacauaaaucaggauacgucacaguugcacacacugggcaacacgacuuaguaauuccaccaaaugguuacuucagauucgacucauggguuaaccaauuuuauacauuagccccaaugggaaauggaacuggaagaagaagagccuuauaa

SEQ ID NO: 31552 - RNA, 1623 nt, Artificial Sequence
  derived and/or modified sequence opt6 from VP1__Norovirus__AGS08061
augaaaauggcaucaucagacgcaaaucccuccgacggaucuacugcaaacuuaguaccagaaguuaauaacgaaguaauggcccuagaaccaguagucggagccgcaauagcagcuccaguagcaggacaacaaaacgucauagacccuuggauacgaaauaacuucguacaagcaccuggaggagaauucacaguaagcccaagaaacgcaccaggagaaauacuuugguccgcuccucuuggacccgauuuaaaucccuaucuaucacaccuagccagaauguacaauggauaugcaggaggauuugaaguccaaguaauauuagcuggaaaugcauuuacagcaggaaaaauaauauucgcagcuguuccaccaaacuuucccacugaaggacuaucaccaucacaaguaacuauguucccccacauaauaguugacguacgccaacuagaaccaguuuuaauaccacuaccagacguuagaaacaauuucuaccauuauaaucaauccaaugacucaacuauaaaacuuauagcaaugcuauacacuccauuacgagcaaauaacgcaggggaugacguauuuacaguaucaugucgcguauuaacaagaccuucaccagacuuugacuuuauuuuucucguuccuccaacaguagaaucaagaacaaaaccauucucaguaccuguauuaaccguagaagaaaugacaaauucacgcuuucccauaccacuagaaaaauuauuuaccgguccauccucagcauucguuguccaaccacaaaaugguagauguaccaccgacggaguacuucuugggacuacacaacuaucuccagugaauauauguacauuuagaggagacguuacccacaucccaggaucacgaaauuacacaaugaaccuugcaagucaaaauuggaauaguuacgauccaacagaagaaauuccugcaccauuagguacaccugauuuuguagguaaaauacaaggaguacuaacacaaacaacuagaacaaacggaucaacacgaggacacaaagccacaguauauaccggauccgccgacuuuucuccaaaacuaggacgaguacaauuugcaacugacacagacaaugauuucgaaaccaaucaaaauacaaaauucaccccaguaggcguaauacaagacgguucaacaacuccaagaaacgaaccucaacaauggguucuacccucauauucaggcagaaauauacacaauguacaccuugcuccagcugucgccccaacauuuccaggagaacaauuacuuuuuuucagaucaacaaugccaggaugcucagguuauccaaauauggaccuagauuguuuacuaccacaagaauggguucaauauuucuaucaagaagccgcuccugcacaaucagacguagcauuauuaagauuugugaauccagacacaggaagaguauuauuugaaugcaaauuacacaaaucaggauauguaacaguagcacacacaggacaacacgacuuaguaauaccaccaaauggauauuuuagauucgacagcugggucaaccaauucuacacauuagcacccauggguaaugguacaggccgaagaagagcauuauaa

SEQ ID NO: 31553 - RNA, 1623 nt, Artificial Sequence
  derived and/or modified sequence opt6 from VP1__Norovirus__AGS08062
augaaaauggcuagcuccgaugcuaacccuucagauggaucagcagcaaacuuaguaccugaaguaaauaaugaaguuauggcuuuagaaccugucguaggagccgccauugccgcaccuguagcaggacaacaaaacguaauagauccguggauacgaaauaacuucguacaagcaccaggaggagaauuuacaguaucaccacgaaaugcaccaggagaaauacuauggucagcaccacuagggccagauuuaaacccauaccuaucacauuuagcaagaauguacaacgguuacgcuggagguuuugaaguacaaguuauccuagcaggaaaugcauuuacagcagguaaaguaauauucgcagccguaccaccaaauuuuccuacagaaggucuaucuccuucccaaguuacaauguucccacauauaguuguagauguucgucaacuagaaccaguauuaauaccucuacccgacguacgaaacaauuucuaccacuauaaucaaucaaaugacccuacuauaaaauuaaucgcaauguuauauacaccccuaagagcaaacaaugcaggagacgaugucuucaccguaagcugccguguauuaacacgaccuuccccagacuuugacuuuauauucuuaguaccaccaacaguugaaucaagaacaaaaccauuuucaguaccuguucuaacaguagaagaaaugacuaacucuagauuuccaauaccacuagaaaagcuauuuacagguccaucuucagcuuucguaguacaaccccaaaacgguagaugcacaacagacggaguacuacuagguacuacucaacuauccccaguaaauauauguacauuucgcggagauguaacacacauaacaggaucaagaaacuacacaaugaaucuagcaucucaaaacugguccaacuacgacccuacagaagaaauaccagcaccucucggcaccccagauuuugucggaaaaauacaagguguucuaacccaaacaacacgaacagacgguucaacaagaggacacaaagcaacuguauacacaggaucugcagauuuugcaccaaaacuaggaagaguacaauucgaaacagauacagauagagauuucgaagcaaaucaaaacacaaaauuuacuccaguuggagucauacaagauggaggaacuacccaucgaaaugaaccacaacaauggguauuaccgucauacucaggaagaaauacaccaaacguacaucuugcaccagcaguugcaccaacauuuccuggagaacaacuacuauuuuuuagaucaacaaugccuggauguucagguuauccaaauauggauuuagacugccuccucccacaagaauggguacaauacuucuaucaagaagcagcaccugcucaaucagacguagcauuauuacguuuuguaaacccagauacaggaagaguauuauuugaauguaaauuacauaaaucaggcuauguaacugucgcacacacaggucaacaugaucucgucauaccaccaaauggauauuuucgauucgauucauggguaaaccaauucuauacauuagccccaaugggaaauggcacuggaagaagaagagcauuauaa

SEQ ID NO: 31554 - RNA, 1623 nt, Artificial Sequence
  derived and/or modified sequence opt6 from VP1__Norovirus__AGS08063
augaaaauggcaucaucugacgcaaacccaagugauggauccaccgcaaauuuaguccccgaaguuaauaacgaaguaauggcauuagaaccaguaguaggcgcagccauagcagcaccuguagcaggacaacaaaacguaauugaccccuggauaagaaacaacuuuguacaagcaccuggaggagaauuuacaguaucaccacgaaaugcucccggagaaauacuuuggucagcaccucuagguccagaucuaaacccauaccuaucccaucuagcuagaauguauaacggauaugcaggcggauucgaaguacaaguaauacuugcaggaaaugcauuuacagcaggaaaaauaauauucgcagccgucccaccaaauuuuccuacugaaggauuaucaccaagccaagucacaauguuuccacacauuauagucgauguaagacaauuagaaccaguacuaauacccuuaccugauguuagaaauaauuucuaucauuauaaucaauccaaugauucaacaauaaaauuaauagcuauguuauauacaccccuaagagccaauaaugccggcgacgacguauuuacaguaucauguagaguacuaacaagaccuuccccagacuuugacuuuauauuuuuaguaccaccaacuguagaaucucguacaaaaccauucagcguaccaauauuaacaguagaagaaaugacaaacucacgauuuccuauaccacuagaaaaacuauuuacaggaccgucaucagcauucguaguacaaccccaaaauggacgauguacaacugauggaguuuuacuagguacaacacaauuaucaccugucaauaucuguacuuuuagaggagauguaacccauauaccuggaucucauaacuauaccaugaaccuagcaucucaaaauuggaacucauaugauccaacagaagaaauaccagcaccucuaggaacaccugauuuuguaggcaaaauacaagguguacuaacucaaacaacaagcacuaacggaucuacaagaggacacaaagcaacaguauacaccggcucagccgacuucucaccaaaacucggaagaguacaauucgcuacagacaccaauaacgauuucgaaaccaaucaaaauacaaaauuuacuccaguaggugucauucaagacggaaguacuacaccacgaaacgaaccacaacaauggguucucccaucauauuccggcagaaauauacacaacguacaucuugcuccagcaguagcuccaacauuuccaggugaacaauuacuauucuuucgaucaacaaugcccgguuguucaggauauccaaauauggaucucgauugccuacuuccacaagaauggguacaauauuuuuaccaagaagccgcacccgcacaaucagacguugcucuucucagauucguuaauccagacacaggacgcgucuuauucgaaugcaaauuacauaaaucuggauauguaacaguagcucacacaggccaacacgaucuaguaaucccaccaaauggauacuuuagauucgauucauggguaaaucaauuuuacacacuagcaccaaugggaaacggaaccggacgaagaagagcccuauaa

SEQ ID NO: 31555 - RNA, 1623 nt, Artificial Sequence
  derived and/or modified sequence opt6 from VP1__Norovirus__AGS08064
augaaaauggcuucaucagaugcaaacccaucagauggaaguacagcuaauuuaguaccagaagucaacaaugaaguaauggcuuuagaaccaguaguuggagcagcaauagcugccccaguagcuggacaacaaaauguaauagauccauggauaagaaauaauuucguacaggccccaggaggagaauucacaguauccccaagaaaugcuccaggagaaauacuuuggucugcaccauuaggaccagaucuaaauccauauuuaucacacuuagcccgaauguauaacgguuaugcaggaggauucgaaguucaaguaauucuugcagggaacgcuuucacagcuggcaaaauaaucuucgcagcaguacccccaaacuucccaacagaaggcuuaucuccuucccaaguaaccauguucccucacauaauaguagacguuagacaacuagaaccaguacuaauuccauuaccugaugucagaaacaacuuuuaucacuauaaccaaucaaaugauccaacaauuaaauuaauagcuaugcuuuauacuccauuaagagcaaacaaugcaggagacgacguauucacaguuaguugcagaguuuuaacacgaccaucucccgacuucgacuucaucuuuuuaguaccuccaaccguagaaucaagaacuaaaccauuuucagucccuguccuaacuguugaagaaaugacaaacucaagauuuccaauaccacuagaaaaauuauuuacuggaccaaguucagcauuuguaguacaaccacaaaacggcagaugcaccacagacggaguacuacuaggaacaacacaacuaagcccaguaaauauaugcacuuuuagaggcgauguuacccauauaucagguagcagaaacuacaccaugaaucuagccagccaaaauuggaacucauacgauccuacugaagaaaucccugcuccacuagguacuccugacuuuguagguaaaauacaaggaguauuaacccaaacuaccagaacagacggaucaaccagaggucacaaagcaacaguauauaccgguucagcagacuucucaccaaaacuaggcagaguccaauucgcaacagacacagauaacgacuuuguaacaaaucaaaacacaaaauucacaccaguaggugucauccaagaugguucaacaacaccaagaaaugaaccucagcaauggguacuaccuucauauucaggaagaaacacacauaauguacaccuagcaccagcaguagcaccaacauuuccaggugaacaauuauuauucuuucgcucaacaaugccaggcuguucagguuacccaaacauggaucuagacuguuuacuaccacaagaauggguacaauauuucuaccaagaagcagcacccgcucaaucagacgucgcacuucuuagauuuguaaauccugacacagguagaguauuauuugaauguaaacuucacaagucaggauacguaaccguagcacacacuggacaacaugauuuaguaauaccaccuaauggauauuucagauucgauucauggguaaaucaauuuuacacucuagcuccaaugggaaauggaacaggacgcagacgagcucuauaa

SEQ ID NO: 31556 - RNA, 1623 nt, Artificial Sequence
  derived and/or modified sequence opt6 from VP1__Norovirus__AGS08065
augaaaauggcuagcucagacgcaaacccauccgacgguucaacugcaaaccuaguaccagaagucaauaaugaaguuauggcacuagaaccuguagucggagcugcuauagcugcaccaguagcaggacaacaaaacguaauagaccccuggauacgaaacaauuuuguacaagccccaggaggagaauucacagucucuccaagaaacgcuccaggagaaauauuauggucagcaccuuuaggaccagauuuaaauccauauuuaucccaccuagcaagaauguauaacgguuaugcagguggauucgaaguccaaguuauucuugcaggaaacgcauuuacagccggaaaaauaauauucgccgcaguuccuccaaauuucccaacagaaggacuaucaccaucacaaguaacaauguucccacacaucaucguagacguaagacaauuagaacccguacuaauacccuuaccugauguaagaaacaauuuuuaccauuauaaccaaucaaaugacccaacaauaaaauuaauagcuaugcuauauacaccccuacgcgcaaacaacgcaggagaugauguauuuacaguaucaugcagaguacuaacaagaccaucacccgacuuugauuucaucuuccuuguaccaccaacaguagaaucaagaacaaaacccuuuucuguaccaguuuuaaccguagaagaaaugacaaacuccagauuuccaauaccacuugaaaaacuauucacaggaccaucaucugcauuuguuguucaaccucaaaacggaagauguacuacugauggaguacuccucggaacaacucaacuaucaccuguaaacauauguaccuuucgcggagacgugacacauauaccuggcucuagaaauuacacuaugaaucucgcaucacaaaacuggaacucauaugacccaacagaagaaauacccgcaccuuuaggaacaccagacuucgucggcaaaauacaaggaguauuaacccaaacaacaagaacaaacggaucaacccgaggacacaaagccacuguauauacaggaucagcagacuuuucaccaaaauuaggccgaguacaauuugccaccgauacagauaaugauuucgaaaccaaccaaaauacaaaauuuaccccaguagguguaauacaggauggcaguacaacacccagaaacgaaccacaacaauggguacuuccaucauacucaggcagaaacauccauaacguacaccuugcaccagcuguagccccaacauuccccggugaacaacuacucuucuuuagauccacaaugccagguugcucugguuaucccaauauggauuuagauugccuuuuaccccaagaauggguccaauauuucuaucaagaagcagcacccgcacaaucagacguagcacuacuccgauuuguaaauccagauacaggaagaguccuauucgaauguaaacuacauaaaucaggauacguaaccguagcacacacaggacaacacgauuuaguaauaccaccaaacggcuacuuuagauucgacucaugggucaaucaauucuacacacuagcaccaaugggaaacggaaccggcagaagaagagcauuauaa

SEQ ID NO: 31557 - RNA, 1623 nt, Artificial Sequence
  derived and/or modified sequence opt6 from VP1__Norovirus__AGS08066
augaaaauggccucuucugacgcaaacccuagugacggaucaacagcaaauuuaguaccagaaguaaacaaugaaguaauggcacucgaaccaguagucggagcagcaauagcagcaccaguagcaggacaacaaaaugucauugauccauggauucgaaauaacuuuguacaagcacccggcggagaauuuacaguaaguccaagaaaugcaccaggagaaauauuauggucagcaccauuaggaccugaucucaauccauaucuaagccacuuagcccgaauguauaacgguuaugcaggcggauuugaaguccaaguaauauuagcaggcaaugcauuuacagcuggaaaaauaauauuugcugcuguacccccaaauuuuccaacugaaggacuaaguccaagucaaguaacaauguuuccacauaucauaguggacguaagacaacuagagcccguucucauuccauuaccugauguaaggaacaacuuuuaccauuacaaccaaucaaaugauucuacaauuaaacucauagcuaugcuuuauacacccuuacgcgcaaacaaugcaggagaugaugucuuuacuguuucuugcagaguacucacaagaccaucuccagacuucgacuucaucuuucuaguaccacccacaguagaaucacgaacaaaacccuuuuccguaccuauauuaacaguagaagaaaugacaaacuccagauuccccaucccacucgaaaaacuauucacuggcccauccucagcauucguaguucaaccacaaaacggaagaugcacaacagacgguguauuacucgguacuacacaacuaucucccguaaacauauguacauuuagaggagauguuacacacauccccggaucccacaauuacacuaugaauuuagcaucacaaaauuggaacagcuacgacccaacagaagaaauaccagcaccuuuaggcacaccagauuuuguaggaaaaauucagggaguccuuacacaaacaacuucaaccaacggauccacacgaggacauaaagccacuguauauacaggaucagcagauuuuucaccaaaauuaggcagaguacaauucgcuaccgauacaaacaacgauuuugaaacaaaucaaaauaccaaauuuacacccguaggaguaauucaagaugguucaaccacuccacgaaacgaaccacaacaauggguacuuccauccuacucaggacgcaauauacauaacguucacuuagcacccgcuguagcaccaacauuuccaggugaacaacuauuauuuuuucguaguacaaugccaggaugcuccggauacccaaauauggaccuagauugucuacucccacaagaauggguacaauacuucuaucaagaagcugcaccagcucaaagugauguggccuuacuaagauucguuaauccugacacaggaagaguauuauucgaaugcaaauuacauaaaucaggauaugucacagucgcacacacaggacaacacgaucuaguaauaccaccuaacggauauuuuagauucgauucuuggguaaaucaauuuuacacacuugccccaaugggaaauggaacuggaagaagaagagcacuuuaa

SEQ ID NO: 31558 - RNA, 1623 nt, Artificial Sequence
  derived and/or modified sequence opt6 from VP1__Norovirus__AGS08067
augaaaauggcauccucagacgcaaacccaucggauggaucuacagcaaaccuuguaccagaaguuaacaaugaagucauggcauuagaacccguagucggagcagcuauagcagcacccguagcaggccaacaaaacgucauagauccauggauaaggaauaacuuuguacaagcaccaggaggagaauuuacaguuucaccucgaaaugcaccaggcgaaauauuauggucagcuccucuaggcccagaccuuaauccauacuuaucucaccuugcaagaauguauaauggauacgcuggaggauucgaaguacaaguaauacuugcagguaaugcuuuuacugccggcaaaauaauuuucgccgcaguaccaccaaacuuuccaacagaaggccuuucuccaucacaaguaacaauguuuccacacauaauuguagacguaagacaauuagaaccuguccuuauuccauuaccugauguaagaaacaauuucuaucauuauaaucaaucuaaugacccaaccauaaaauuaauagcaaugcucuacaccccauuaagagcaaacaacgcaggugacgacguauuuacagucucauguagaguauuaacacgcccuucuccagacuucgauuuuauauuccuuguuccaccaacaguagaaucccgaacaaaaccauucuccguaccaguauuaacaguagaagaaaugaccaacucaagauucccaauuccacuagaaaaacuauuuacaggaccaucuucagcuuucguaguccaaccucaaaacgguagauguacaacugaugguguacucuuaggaacaacacaauuaucaccaguaaacauuugcacauuuagaggugauguaacacauauaucagguucucgaaauuacacaaugaaucuagcaucacaaaauuggaacucauacgauccaacugaagaaauuccagcaccacuaggaacaccagacuuuguaggaaaaauacaaggaguauuaacacaaacaacacgaacagacggaucaacuagaggucacaaagcaacaguauauacagggucagcagacuuuucaccaaaacuaggacgaguucaauucgcuacagacacagauaaugauuucguaacuaaucaaaauacaaaauucacuccaguuggaguaauacaagacggaucaacaaccccuagaaacgaaccacaacaaugggucuuaccaucuuauucaggacgcaacacucacaacguacacuuagccccagcaguagcaccaacauucccaggugaacaacucuuauuuuuuagaucaaccaugcccgguuguuccgguuaucccaauauggauuuagauugucuacuaccacaagaauggguucaauacuucuaucaagaagccgcaccagcacaaucagauguagccuuacucagguuugucaacccagauacaggaagaguacuguuugaaugcaaauuacauaaaucagguuaugucacuguagcacacacaggacagcacgaucuaguaaucccuccaaacggauacuucagauucgauucauggguaaaucaauuuuauacauuagcuccuaugggaaacgguacaggucggagacgugcauuauaa

SEQ ID NO: 31559 - RNA, 1623 nt, Artificial Sequence
  derived and/or modified sequence opt6 from VP1__Norovirus__AGS08068
augaaaauggcauccucagacgcaaacccuucagauggaucaacagcaaaucuagucccagaagucaacaacgaaguaauggcucuugaaccaguuguaggagcagcuauagcagcaccagucgcaggacaacaaaauguaaucgauccauggauacgaaauaauuuuguacaagcaccuggaggagaauuuacagucucaccccgaaaugcaccuggagaaauauuauggagugcaccacucgguccugaucuaaaccccuaucuaucacacuuagcaagaauguauaacggauaugcaggaggauucgaaguacaagucauucuagcaggaaaugccuucacagcaggcaaaauaauauuugcagcaguaccaccaaauuuuccaacagaaggacuaucaccaucacaaguaacaauguucccucauauaauagucgacguuagacaguuagaaccaguauuaauaccauuaccagauguacgaaacaauuuuuaucacuauaaucaaagcuccgacccaacaauuaaacuaauagcuaugcuauacacaccacuacgagcaaauaacgcaggcgacgauguauuuacagucucauguagaguauuaacaagaccaucaccagacuucgacuuuauauucuuaguaccaccuacaguugaauccagaacuaagccauucucugucccaguauuaacuguagaagaaaugacaaauucuagauucccaauacccuuagaaaaacuuuuuacaggacccucaucagcuuucguaguacaaccacaaaacggacgauguacaacagauggaguccuacuaggaacaacacaauuaucaccagucaauauauguacauucagaggagacguaacacauauaucuggcucaagaaacuauacuaugaacuuagcaucgcaaaacuggaacucauacgauccaacagaggaaaucccugccccacuagguacuccagacuucguaggaaaaauucaaggaguauuaacucaaacaacaagaaccgauggaucuacaagaggacacaaagccacaguauacacuggaucagccgacuuuucaccaaaacucggaagaguacaauucgcuacagauacagacaaugacuucgucacgaaucaaaacacaaaauuuacuccaguuggaguaauucaagacgguuccacaacaccacgaaaugaaccucaacaauggguuuuaccaucauauuccgguagaaauacacauaacguacauuuagcacccgcaguugcucccacuuuuccuggugaacaauuacuauucuucagaucaacaaugcccggaugcucaggauauccaaauauggaucuagauuguuuauuaccacaagaauggguucaauauuucuaucaagaagcagcaccagcacaaucagaugucgcauuacuaagauuuguaaacccagacacuggccgcguauuauuugaaugcaaacuccauaaaucugguuauguaacagucgcacacacaggacaacaugaucuaguaauaccaccuaauggauacuucagauuugacucauggguaaaucaauucuacacauuagcaccaauggguaacggaacaggcagacguagagcacuauaa

SEQ ID NO: 31560 - RNA, 1623 nt, Artificial Sequence
  derived and/or modified sequence opt6 from VP1__Norovirus__AGS08069
augaaaauggccucaucugaugcaaaccccuccgauggaucaacagcaaacuuagucccagaaguuaacaaugaagucauggcccuugaaccaguuguaggagccgcaauugcagcaccuguugcaggccaacaaaacguaaucgauccauggauaagaaacaacuucguacaagcaccaggaggugaguuuacaguaucacccagaaaugcaccaggugaaaucuuauggucagcaccuuuagguccagaccuaaauccauaucuaucucaucucgcaagaauguauaacgguuacgcaggcggcuuugaaguacaaguuauauuagcaggaaacgccuuuacagcuggcaaaauaauuuuugcugcuguuccaccaaacuuuccaacagaaggauuauccccuucccaaguuacaauguuuccacauaucaucgucgacguucgccaacuagaaccaguuuuaauuccauuaccagauguacguaacaauuuuuaccacuauaaccaaucaaaugauucaacaauaaaacuuauagccaugcuuuauaccccauuacgagcuaacaaugcaggugaugauguauuuacaguaucaugucgaguauuaaccagaccaucuccagauuucgacuuuaucuuuuuaguacccccaacagucgaaucucgaacuaaaccuuucucaguaccuguauuaacuguagaagaaaugacaaacaguagauuuccaauuccauuagaaaaauuauucacuggcccuucaucagcauucguaguucaaccacaaaauggucgaugcacaacagacggaguauuacuuggaacaacacaauuaucuccaguuaacauaugcacauucagaggugacguuacacauauaccuggcuccagaaauuacacuaugaauuuagccucccaaaacuggaacaguuaugauccaacugaagaaauaccugcaccauuggguacaccugacuuuguaggaaaaauacaaggaguucuaacucaaacaacccgcacuaauggaucaacucgaggucauaaagcaacuguuuauacaggauccgcugauuuuucuccaaaauuaggcagaguacaauuugcuacugauacagauaacgauuucgaaacuaaccaaaauacaaaauuuacaccaguuggaguaauucaagacggauccacaacaccuagaaaugaaccacaacaauggguacucccaucuuacuccggaagaaauacacauaacguccaccuugcacccgcaguagcaccaacuuuuccaggcgaacaauuauuauuuuucagaucaacaaugccaggauguucuggauacccaaauauggaccuagauuguuuauuaccacaagaauggguacaguauuucuaccaagaagcagcuccagcacaauccgauguugcucuccuaagauucguuaacccagauaccgguagaguacuauuugaaugcaaacuacacaaaucaggauauguuacuguagcacacaccggucaacaugacuuaguaauaccuccaaauggauauuuuagauucgacucuugggucaaucaauuuuacacacuagcaccaaugggcaacggcacuggaagacgccgagccuuauaa

SEQ ID NO: 31561 - RNA, 1623 nt, Artificial Sequence
  derived and/or modified sequence opt6 from VP1__Norovirus__AGS08070
augaaaauggccucuucagacgccaauccaucugauggaucagcagcaaauuuaguucccgaagucaauaacgaaguaauggcacuagaaccaguaguaggcgcagccauugcagcuccaguugcaggucaacaaaauguuauagauccauggauacgaaacaauuucguccaagcaccuggaggagaauuuacuguaucaccuagaaaugcaccaggcgaaauacuauggucagcucccuuaggaccagaucuuaauccuuaccuaucacacuuagcuagaauguacaauggauaugcaggagguuuuggaguccaaguaaucuuagcugguaacgcauuuacugcaggcaaaguaauuuucgcagcaguuccaccaaacuuuccuacugaaggguuaucaccuucacaaguaacaauguuuccccacaucguaguaaauguaagacaacuagaacccguacuaauacccuuacccgauguacgaaacaauuuuuaucauuauaaucaaucuaaugacccaacaauaaaauuaauagcaauguuauauacuccacuacgagcaaacaacgcaggugacgauguauucacaguuucauguagaguauuaaccagaccuucaccugauuuugauuuuauuuucuuaguaccacccacuguagaaaguagaaccaaaccauuuucaguaccuguccucacaguagaagaaaugacaaauucaagauuuccuauaccacuagaaaaacuauucacuggaccaucuucagcauuuguaguacaaccacaaaauggaagauguaccacagauggaguacuacucggaacuacacaauuaagcccuguaaacauaugcaccuuucggggcgauguuacucacaucacuggaucaagaaauuauaccaugaacuuagcaucacaaaacuggaauaacuaugauccaacagaagaaacuccagcaccucuaggaacacccgauuucgucggaaaaauccaagguguauuaacccaaacaacaagaacagacggaucuacacguggacacaaagcaacaguauauacuggaucugccgacuucgcuccaaaauuaggcagaguacaauuugaaacugauacagaccaugacuuugaagccaaccaaaacacaaaauuuacaccaguaggaguaauccaagaugguagcacaacacauaggaacgaaccccaacaauggguauuacccucauacaguggaagaaauacacauaauguacauuuagcaccagcaguugcaccuacuuuuccaggagaacaacuacuauucuuuagauccacaaugcccgguugcucugguuacccaaauauggaccuggauuguuuacuuccacaagaauggguacaauauuucuaucaagaagcagcuccagcacaaucagauguagcauuacugcgcuucgucaauccagauacuggacguguacuauuugaauguaaacuacacaaaucaggauauguuacaguugcauuaacaggacaacaugaccuaguuauaccaccaaauggauauuucagauuugacuccugggucaaucaauuuuauacauuagcaccaauggguaauggaacaggacgaagaagagcaguauaa

SEQ ID NO: 31562 - RNA, 1623 nt, Artificial Sequence
  derived and/or modified sequence opt6 from VP1__Norovirus__AGS08071
augaaaauggcaucaucagacgcaaaucccucugacggcuccgccgcuaacuuaguaccagaaguaaauaaugaaguuauggcauuagaaccaguuguaggagcagcaauagcggccccuguagcaggacaacaaaacgucauagacccuuggauaagaaauaauuucguacaagcaccagguggugaauucacaguaucuccaagaaaugcaccaggagaaauauuauggucugcaccacuaggaccagauuuaaaccccuaucuaucacauuuagcaagaauguacaacggauacgcaggagguuucgaaguccaaguuauauuagcagguaaugcauucaccgcaggaaaaguaauauucgcugcagugccaccuaacuucccaacagaaggauuaucaccaucucaaguaacuauguucccacacauaguaguagauguaagacaauuagaaccuguauuaauacccuuaccagauguaagaaacaacuucuaccacuacaaucaauccaaugacccaacuaucaaauuaauagcaaugcucuacaccccuuuaagagcaaauaaugcaggagacgauguauuuacaguauccugcagaguauuaaccaggccuuccccagacuuugauuuuauauuuuuaguacccccaacaguagaaucaagaacuaagccuuuuucaguaccuguacuaacaguagaagaaaugaccaauucaagauuucccauaccauuagaaaaacucuuuacaggaccaucuucugcauuuguaguacaaccucaaaacggaagaugcaccacagacggaguacuccuaggaacuacacaauuaucaccuguaaauauauguacauuuagaggcgacguaacacacauaacaggaucaagaaauuacaccaugaaucuagcaucacaaaacuggaguaauuacgacccuacagaagaaauaccagcaccauuagguacaccagacuucgucggcaaaauacaaggaguacuaacacaaacaacaagaacugauggaucaaccagaggucauaaagcaacuguauacacaggaucagcugacuuugcaccaaaacuaggacguguacaauuugaaacagauacagauagagacuuugaagccaaucaaaauacaaaauuuacaccuguugguguaauacaagacggaggcacaacccacagaaaugaaccacaacaauggguacuaccaagcuauucaggacgaaacacccccaacguacacuuagcaccagccguagcaccaacauuuccaggagaacaauuauuauuuuuucgaucuacuaugccagguugcucuggauauccgaauauggauuuagauugcuuacuaccacaagaauggguacaauacuucuaucaagaagcagcaccagcacaaucagauguugcacuacucagauuugucaauccugacacuggaagaguuuuauuugaauguaaacuacacaaaaguggauauguuacaguagcacauacgggacagcacgaccuaguaauaccaccaaauggauauuucagauucgauucauggguaaaccaauuuuauacauuagccccuaugggaaauggaacaggaagaagaagagccuuauaa

SEQ ID NO: 31563 - RNA, 1623 nt, Artificial Sequence
  derived and/or modified sequence opt6 from VP1__Norovirus__AGS08072
augaaaauggcaucaucagacgcaaacccaagcgacggaucaaccgcaaaucuagucccugaaguaaauaacgaagucauggcauuagaaccaguagucggagcugcaaucgcagcuccaguagccggucaacaaaauguaauagacccauggaucagaaacaacuuuguacaagccccaggcggagaauuuacaguuucaccaagaaaugcaccuggagaaauuuuauggucugcaccuuuaggacccgacuuaaacccauaucuuucacacuuagcacgaauguauaauggauacgcagguggauucgaaguucaagucauacuagcaggaaaugcuuuuacagcaggaaaaauuauauuugcagcuguccccccuaacuuuccaacagaaggucuaaguccaucucaaguuacaauguucccacauauaauaguagacguacgacaauuagagcccguccucauuccucuuccagauguaagaaacaauuuuuaucacuauaaccaaucuaaugacccuacaauaaaacuuaucgcuaugcuuuauacacccuuaagagcuaacaaugcaggcgacgauguuuucacaguaucauguagaguccucacuagaccaucuccagauuuugauuuuaucuuucuuguuccaccaacuguagaaucccgaacuaaaccauucucugucccaguauuaacagucgaagaaaugacaaacagcagauuucccauuccccuugaaaaacuuuuuacagguccaucuucugcauuuguuguacaaccacaaaauggaagaugcaccacagacggagucuuacuagguacaacccaauuaagcccaguaaauauauguacuuuuagaggugacguuacacauauaccaggauccagaaauuacacaaugaaucuagcuucacaaaacuggaauucauacgauccaacugaagaaauaccagcucccuuaggaacaccugauuuuguaggcaaaauacaagguguacucacacaaaccacaagaacuaacggaucuacaagaggacauaaagcuacaguauacacaggaucagcugauuuuucaccaaaacuaggcagaguacaauuugcaacugauacugauaaugacuucgaaacaaaucaaaacacaaaauucacaccaguuggaguaauacaagauggaucaacuacaccacgcaaugaaccacaacaauggguacuaccaucauauucuggaagaaauauacauaacguacacuuagccccagcuguagcuccaacuuuuccaggagaacaacuauuauucuuuagaucuaccaugccagguugcuccggauauccaaacauggaucuagacugucuacucccucaagaauggguucaauauuucuaccaagaagcagcaccugcucaaucugauguagccuuauuaagauuuguaaacccagacacaggaagaguccuauucgaaugcaaacuucauaaaucaggauacgucacaguagcccacacaggacaacaugaucuaguuaucccuccaaacgguuauuuucgauucgauucaugggucaaucaauuuuacacucuagcucccaugggcaauggaacaggacgcagacgugccuuauaa

SEQ ID NO: 31564 - RNA, 1623 nt, Artificial Sequence
  derived and/or modified sequence opt6 from VP1__Norovirus__AGS08073
augaaaauggcaucauccgacgcaaauccauccgacggcucaacagcaaauuuagucccagaaguaaacaacgaaguaauggcacuugaaccaguaguuggagccgcaauugccgccccugucgcaggucaacaaaauguaaucgauccauggauuagaaauaauuuuguacaagcuccagggggagaauuuaccguaucaccaagaaaugcaccaggagaaauacuuugguccgccccacugggaccugauuuaaaucccuaucuaucacacuuagcaagaauguacaauggauaugcaggaggauuugaaguccaaguaauacuagcaggaaaugccuucacagcaggaaaaauuauauuugcagcagucccaccaaauuuuccuacagaaggauuaucuccaucacagguaacaauguucccacacauaauaguagauguccgccaauuagaaccaguauuaauuccauuaccugacguacgaaauaacuuuuaucacuacaaucaaucuaaugacucaacaaucaaacuaauagcaauguuauacacaccauuaagagcaaacaacgcaggagaugauguuuuuacaguaucaugcagaguauuaacccgaccaaguccagacuucgacuucauauuucucguuccuccuaccguugaaucuagaacaaaaccauuuagcguuccaguauuaacaguugaagaaaugacaaacuccagauuuccaauacccuuagaaaaauuauuuacuggaccuucaucagccuucguaguacaaccacaaaauggacgauguaccacugaugguguacuacuaggaacgacacaacuauccccagucaauaucuguacuuuuagaggagauguuacucauaucucaggaucaagaaauuauacaaugaaucuugccucacaaaauuggaauucuuaugaucccaccgaagaaauaccagcaccccuaggaacaccugauuuuguugguaaaauucaaggaguacuaacacagacaacaagaacaaacggauccaccagaggacacaaagcaacaguuuauacuggaucagcagacuucucacccaaacuaggaagaguacaauuugccacagauacagauaacgacuuugaaacaaaucaaaauacuaaauuuacuccuguaggaguaauacaagaugguucaacaacuccucgaaaugaaccacaacaauggguauuaccauccuauuccgguagaaauauacauaauguacaccuagcuccagcaguugcaccaacauuuccaggugaacaacuauuauuuuuccguucaacaaugcccggauguuccggauauccuaacauggauuuagacugccuacuuccacaagaauggguacaauauuucuaucaagaagcagcaccugcucaaagugauguagcucuauuaagauucgucaauccagacacaggcagaguauuauuugaaugcaaauuacacaaaagugguuacguaacaguagcacacaccggucaacaugaucuaguaauaccaccaaacggauacuuuagauucgauucuuggguuaaucaauuuuauacuuuagcaccuaugggaaauggaacuggccgcagaagagcauuauaa

SEQ ID NO: 31565 - RNA, 1623 nt, Artificial Sequence
  derived and/or modified sequence opt6 from VP1__Norovirus__AGS08074
augaaaauggcauccucagaugcaaacccaucagacggcucaacagccaauuuaguaccagaaguaaauaaugaaguaauggcucuagaacccguugucggagcagcaauagcagccccagucgcuggacaacaaaaugucauagauccauggauacgcaauaauuuuguccaagcacccggaggcgaauuuacaguaucuccaagaaaugcuccaggugaaauauuauggucagcaccauuaggaccugaccuaaaucccuauuuaucucaccuugcaagaauguacaacgguuaugcuggaggauuugaaguacaagucauacuagcaggaaacgcauucacugcagguaaaauaauauucgcagccguuccaccuaacuuuccaacagaaggacuaucaccaucacaaguaacaauguuuccacauauuauaguagacguuagacaacuagaaccuguacucauaccacuaccagacguaagaaacaauuuuuaccauuauaaccaaucaaaugacucaaccauuaaacuaauugcaaugcuauauacaccccuacgugcaaacaaugcaggugacgauguauuuacuguuuccuguagaguauuaacaagaccaucaccagacuuugacuuuauauuucuaguaccaccaaccguagaaucaagaacuaaaccauuuucaguuccaauacucacaguagaagaaaugacaaacucccgauuuccaauuccacuagaaaaacuauucaccggucccuccucugcauuuguaguacaaccacaaaauggacgauguacaacagauggaguccuacuuggaacaacacaauuaucaccuguaaauauauguacauuucgcggagauguaacccauauaccaggcucucacaacuacacuaugaaccucgcgucccaaaauuggaauuccuaugaucccacagaagaaauaccagcaccacuaggaacacccgacuuugucgguaaaauucaaggaguucuaacacaaacaacaucaaccaacgguuccacacgaggacauaaagccacugucuauacaggaucugccgauuuuucuccaaaacuaggaagaguacaauuugccaccgauacaaauaacgauuuugaaacaaaucaaaauacaaaauucacuccaguagguguuauacaagauggaucaacaacaccucguaacgaaccucaacaauggguacucccaucuuauucaggacgaaauauacacaacguacaccuagccccagcagucgcaccaacauuuccuggugaacaacuauuauuuuuuagaucuaccaugccaggaugcucuggauaucccaacauggaccuagacugccuuuuaccucaagaauggguucaauauuucuaccaagaagcagcacccgcucaauccgacguagccuuauuaagauucgucaacccagauacgggaagaguacuauucgaaugcaaacuacauaaauccggauauguuaccguagcacauacaggacaacaugacuuaguaauuccaccaaaugguuauuuccgauuugacucuugggucaaucaauuuuauacauuagcaccaaugggaaauggaacuggaagaagacgagcucucuaa

SEQ ID NO: 31566 - RNA, 1623 nt, Artificial Sequence
  derived and/or modified sequence opt6 from VP1__Norovirus__AGS08076
augaaaauggcaucuuccgaugcaaauccaucagauggaucaaccgcaaaccuaguccccgaaguaaacaaugaaguuauggcacuagaaccaguaguuggagcagcaauagcagcaccaguagcaggacaacaaaauguaauugaccccuggauaagaaacaacuuuguucaagccccaggaggagaauuuacuguaucacccagaaaugcaccuggagaaaucuuauggucagcuccucuuggacccgaccuaaaucccuauuuaucacaccuagcacgaauguacaacggauaugcugguggauucgaaguucaaguaaucuuagcaggcaaugccuuuacagcaggaaaaauaauuuuugcugcaguaccaccaaacuuuccaacugaaggacucucacccucucaaguaacaauguuuccacauaucauaguagacguucgacaacucgaaccaguacuaauaccauuaccagaugucagaaacaauuucuaucauuauaaucaaucaaaugacccaacuauaaaauuaauagcaauguuauacacaccauuaagagcaaacaaugcuggagaugaugucuucaccguauccugucgaguauuaacgagaccuucaccagauuuugauuuuaucuucuuaguuccuccaacaguagaaucaagaacaaaaccauucuccguaccaguucucaccguugaagaaaugacaaacuccagauuucccauacccuuagaaaaauuauuuacaggcccuucuuccgcauuuguaguccaaccacaaaacggccgauguacaacagauggaguacuucucggcaccacacaacuuaguccuguaaacauaugcacauuucgaggggacguuacucauauaucugguucaagaaauuacacaaugaaucuagcuucacaaaacuggaauucuuaugauccaacugaagaaauacccgcuccacuaggaacacccgacuuuguagguaaaauacaaggcguauuaacacaaaccacuagaacagacggaucaacaagaggacacaaagcaacaguguacacaggcagcgcagacuuuucaccuaaacuuggcagaguacaauuugcuacagacacagauaacgacuuuguaacaaaucaaaauacaaaauucacaccaguaggcguuauacaagacggcucaacaacaccaagaaacgaaccacaacaauggguacuaccaucauauucaggacgaaauacacacaacguacaccuagccccagcuguugcaccaacauuuccuggagaacaauuauuauucuuuagaucaaccaugcccgguugcucuggauauccaaauauggaucuagauugucuacuaccucaagaauggguacaauauuucuaucaagaagcagcuccagcucaauccgauguugcccuauuaagauucguuaaucccgauaccggaagaguacuauucgagugcaaacuacauaaaucaggauauguuacaguagcacauaccggacaacacgacuuaguaauaccucccaaugguuauuuccgauuugacuccuggguaaaucaauuuuacacacuagcuccaaugggaaaugguacuggacgaagacgugcacuauaa

SEQ ID NO: 31567 - RNA, 1623 nt, Artificial Sequence
  derived and/or modified sequence opt6 from VP1__Norovirus__AGS08079
augaaaauggcauccuccgacgcaaauccaucagacggaucaacugcaaacuuaguaccugaaguuaacaaugaaguaauggcacuagaaccaguaguaggcgcagccauagcagcaccagucgcaggacaacaaaauguaauagacccauggauacgaaauaacuucguacaagcacccggcggcgaauuuacagucucaccaagaaaugcaccaggagaaaucuuauggucugccccacuuggaccagaucuaaaccccuacuuaucacacuuagcucguauguauaacggauaugcaggagguuucgaaguacaaguaauacuagcaggaaaugccuucacagcaggaaaaauuauauuugcugcaguaccuccgaacuucccaacugaaggucucucccccagucaagucacaauguuuccucacauaauaguagacguccgacaauuagaaccaguacuaauaccacuaccagauguaagaaauaacuucuaucacuacaaucaauccaaugacccaacaauaaaacuaauagcaaugcuauacacaccccuaagagcaaacaaugcaggagaugacguauuuacaguaucauguagaguacuaacaagacccagcccugacuuugauuucauauuucuaguaccccccacagucgaaucaagaacaaaaccauuuucaguaccaguacuaacaguagaagaaaugaccaacucaagauuuccaauaccacuagaaaaauuauucacaggaccaucuagugcuuuuguaguacaaccacaaaauggacgcuguacaacagacgguguauuacucgguaccacgcaacuuagccccgucaacauaugcacauuuagaggugauguaacacauauaucaggaucaagaaacuauacuaugaauuuagccucucaaaacuggaauuccuacgaucccacagaagaaauaccagcaccacuagguacuccugauuucguugguaaaauacaagguguacuuacucaaacaacaagaacagauggaucaacacgaggacauaaagcaacuguauauacaggaucagccgauuuuucaccuaaauuaggaagaguacaauuugccacugacacagauaaugauuuuguaacuaaucaaaauacaaaauuuacaccaguaggcguaauucaagacggaucuaccaccccaagaaaugaaccucaacaauggguauuaccaucauacucuggacgcaauacacauaacguacaccuagcaccagcaguagcaccaaccuuuccaggcgaacaacuauuauucuuuagaucuaccaugcccggauguucaggauauccaaauauggaucuugauuguuuacucccacaagaauggguucaauacuucuaucaagaagcugcuccagcucaaagcgacguagcauuauuaagauucguaaauccugacacuggaagaguauuauucgaaugcaaauuacauaaauccgguuauguaacaguagcacacacaggucaacaugauuuaguaauuccuccaaacggauacuucagauuugauucauggguaaaucaauucuacacuuuagcacccauggguaauggaaccggaagaagaagagcacuuuaa

SEQ ID NO: 31568 - RNA, 1623 nt, Artificial Sequence
  derived and/or modified sequence opt6 from VP1__Norovirus__AGS08080
augaaaauggccucaucagaugcaaauccaucagaugguucuacagcaaaucuaguaccagaaguaaacaaugaaguaauggcauuagaaccaguuguaggagcugcuaucgcagcaccagucgcaggacaacaaaaugucauagacccauggauuagaaauaauuuugugcaagcaccaggcggagaauuuaccgucucaccaagaaaugcacccggagaaauacuuuggagcgcaccuuuaggaccagauuuaaaucccuauuuaagucaucuagcccgaauguauaacggcuacgcaggaggauucgaaguccaaguaauauuagccggcaaugccuuuacagcaggaaaaaucauuuucgcagcagucccaccaaacuuucccacggaaggucucaguccaucacaaguaacaauguucccacauauuauaguagauguaagacaauuagaaccuguauuaauaccauuaccagauguacguaauaauuuuuaccauuauaaucaaucaaaugacucaacaauaaaauuaauagcaaugcuauacacacccuuacgagccaacaaugcaggugacgauguauucaccguuucauguagaguauuaacuagaccuucaccugauuuugacuuuauauuccuaguaccaccuaccguagaaucacgaaccaaaccauuuucaguaccgauauuaaccguagaagaaaugacaaacucacgauucccaauaccacuugaaaaacuauuuacaggaccaucuagugcauucguaguccaaccacaaaacggacgauguaccacagauggaguauuauuaggaacaacccaauuauccccuguaaauauauguacauuuagaggagaugucacccauauacccggcagccacaauuauaccaugaaucuagcaucccaaaacuggaauucauacgacccaaccgaagaaauaccagcccccuuaggaacaccagacuuuguaggaaaaauacaagguguacuaacacaaacaacuucaacaaacgguucaacucgcggucauaaagcaacaguauacacagguuccgcagacuuuucaccaaaacuaggacgaguacaauucgcgacagacacaaauaaugacuucgaaacaaaccaaaauacuaaauuuaccccagucggaguuauacaagauggcucaacaacaccaagaaaugaaccacaacaauggguacuuccaagcuacucaggacguaauauacauaauguacacuuagccccagcagucgcaccaacauucccaggagaacaacuauuauucuuuagaucuacaaugccaggaugcucaggcuacccaaacauggacuuagauuguuuacuaccccaagaauggguccaauauuuuuaccaagaagcagcacccgcacaaucagauguagcacuacuaagauucguaaauccagauacaggucguguacucuuugaaugcaaacuccauaaauccggauauguaacaguugcucacacaggacaacaugaucuaguuauaccaccaaauggcuauuuucgcuucgauucauggguuaaucaauuuuacacauuagcuccaauggguaauggaaccggucgaagaagagcauuauaa

SEQ ID NO: 31569 - RNA, 1623 nt, Artificial Sequence
  derived and/or modified sequence opt6 from VP1__Norovirus__AGS08081
augaaaauggcaucaucagacgccaauccaucagauggaucaacagcaaacuuagucccagaaguaaauaaugaaguuauggccuuagaaccaguaguuggugcagcaauagcagcuccugucgcuggacaacaaaacguaauagaccccuggaucagaaacaauuuuguccaagcaccaggaggagaauuuaccgucucaccaagaaaugcaccuggagaaauauuauggucugcaccucuuggaccagaucuaaauccuuaucuaucacacuuagccagaauguauaacggauaugcaggaggcuucgaaguacaaguaauuuuagcagguaaugcauuuacagcuggaaaaauuauauucgcagccguaccuccaaacuuuccaacugaaggauuaucaccuagucaaguaacuauguucccacacauaaucguugacguuagacaacuagaaccaguacuaauacccuuaccagaugucagaaauaacuuuuaccauuacaaccaaaguaaugacuccacaauuaaauuaauagcaauguuauacaccccccucagagcaaauaaugcaggagacgacguauucacagucucauguagaguccuuacacgaccuucacccgauuuugacuucauauuuuuaguaccaccaaccgucgaaucaaggacaaaaccauucucuguaccuauauuaacaguagaagaaaugacaaauucacgauuuccaauuccucucgaaaaacuauuuacaggcccaucaucagcauucguuguacaaccacaaaacggaagauguacaacagacggaguacuacuuggaaccacucaacuaucaccuguaaacauaugcaccuuuagaggagacguaacucauauaccaggaucacacaauuacacaaugaaucuagcaucccaaaacuggaauaguuacgacccaacggaagaaauaccugcaccacuugguacuccagauuucguaggaaaaauacaaggaguacuuacacaaacaacaaguacuaacggaucuacacgaggacauaaagcaacagucuauaccgguucagcagacuucucaccaaaacuaggaagaguacaauucguaaccgauaccaauaacgacuuugaaacaaaccaaaauacuaaauucacaccaguaggagucauacaagacgguucaaccacaccucgaaaugaaccacaacaaugggucuuaccauccuauucagguagaaauauacacaacguucaucuagcaccagcaguagcuccaacauuucccggagaacaauuacuauucuucagaucuaccaugccaggaugcucuggauauccuaauauggaucuugacugucuauuaccacaagaauggguacaauauuucuaucaagaagcagccccagcccaaagugacguugcauuauuacgauucgucaauccagacacaggcagaguacuauucgaaugcaaacuacacaaaagcggauacguaaccguagcacauacaggacaacaugacuuaguuauaccucccaacggauauuuuagauucgacucauggguaaaucaauuuuauacacuagcucccaugggaaaugguacaggcagaagaagagcauuauaa

SEQ ID NO: 31570 - RNA, 1623 nt, Artificial Sequence
  derived and/or modified sequence opt6 from VP1__Norovirus__AGS08082
augaaaauggcaucuucagaugcuaacccaucugacggaucaacagcuaaccucguaccagaaguuaauaacgaaguuauggcacuagaaccagucgucggagccgcaauagcagcuccaguagcaggacaacaaaauguaauugaucccuggauacgaaauaauuuuguccaagcaccaggcggagaauuuaccguauccccaaggaacgcaccaggagaaauucuuuggagugcaccacucggacccgaucuaaauccauaucuaucucauuuagcaagaauguacaacggauaugcugguggauucgaaguacaaguaauuuuagcuggaaaugcauuuacugcaggcaaaaucauuuucgcagcaguaccaccaaauuucccaacagaaggucuaucaccaucacaaguuacaauguucccacacauuaucguagacguaagacaauuagaaccaguauuaauuccauuaccugauguaagaaauaacuuuuaucacuacaaccaaucaaacgacccaaccaucaaacuaaucgcaauguuauauacaccacuaagagcaaacaacgcaggggacgauguauuuacaguuucaugcagaguauuaacaagaccaucaccugacuuugacuuuauuuuucucguaccacccacaguagaaucaagaacuaaaccauuuucaguaccgguacuuaccguagaagaaaugacaaacucaagauuuccaauuccacuagaaaaacuauucacaggaccaaguuccgcuuucguaguacaaccccaaaacggaagaugcacaacugacggcgucuuauuaggaacaacacaacuauccccugucaauaucugcacauuuagaggugacguaacccauauauccggaucaagaaauuauacuaugaauuuagcuucccaaaauuggaauucuuacgauccuacugaagaaauaccagcaccucuaggaacacccgauuuuguaggaaaaauacaaggcguauuaacccaaaccacaagaacagauggaucuacucgcggacauaaagcaacuguauauacaggaucugcagacuuuacaccaaaacuaggaagaguccaauuugcuacugacacugacaacgacuucguaacaaaucaaaacaccaaauucacaccagucggcguaauacaagacggaaguacaaccccuagaaaugaaccucaacaauggguauuaccaaguuauagcggaagaaacacucacaacguacauuuagcacccgcaguagcaccaacauucccaggagaacaacuauuauuuuuuagaucaacuaugccagguugcuccggauauccaaauauggaccuugacugcuuacuuccucaagaauggguucaauauuucuaccaagaagcagcaccagcucaauccgauguagcacuacuaagauucguaaauccagauacugggcgaguauuauucgaaugcaaacuacauaaauccggcuauguaacaguagcacacacaggacaacaugauuuaguaauaccaccaaauggcuauuuuagauucgauucaugggucaaucaauuuuauacucuggccccaaugggaaauggaacuggaagaagaagagcacuauaa

SEQ ID NO: 31571 - RNA, 1623 nt, Artificial Sequence
  derived and/or modified sequence opt6 from VP1__Norovirus__AGS08083
augaaaauggcauccucagacgcaaauccauccgauggaucaacagcaaaucucguaccagaagucaacaaugaaguaauggcucuagaaccaguuguaggcgccgcaauagcugcaccaguagcuggacaacaaaacguaauagauccuuggauaagaaauaauuuuguacaagcaccagguggagaauuuacaguaucacccagaaaugcaccaggcgaaauauuauggucagcaccuuuaggaccagaucuaaauccauacuuaucacaccuagcaagaauguauaacggauacgccgguggauuugaaguacaaguaauauuagcagguaacgcauucaccgcaggaaaaauaauauucgcagcaguaccaccaaacuuccccacagaaggucuaucaccaucucaaguaacaauguucccacauauaauaguugauguaagacaauuagaaccaguucuaauuccauuaccagauguaagaaauaacuuuuaccauuauaaccaaucaaacgauccaacaauuaaauuaaucgcaauguuauacacuccauuaagagcaaacaacgcaggugacgaugucuuuacaguuucaugcagaguauuaacacgaccaucaccugacuuugauuucauauuuuuaguucccccaaccguugaaucuagaacaaaaccauuuucaguaccaguacuuacaguagaagaaaugacaaacucuagauuuccaauaccauuagaaaaacuauuuaccggccccucauccgcauuuguaguacaaccacaaaauggaagauguacaacagacggaguccuccuugguacaacacaacucucaccaguaaacauuuguacguuuagaggugacguuacacacauaucaggaucucgcaacuacacaaugaauuuagcaucacaaaauuggaauucauacgauccuacagaagaaauaccagcaccacucggaacaccagacuuuguaggcaaaauacaagguguacuaacccaaacaaccagaacagacggaucaacuagaggacauaaagcaacaguauacacaggcagcgcagacuuuucaccaaaacuagguagaguucaauucgcaacagauacugauaacgauuuuguuacaaaucaaaauacaaaauucacaccuguaggcguaauccaagauggcucaacaacaccacgaaacgaaccacaacaauggguauuaccaucauauucuggacgcaacacacauaacguacaccuugcacccgccguagcaccaacuuucccaggagaacagcuacuauuuuuucgaagcacaaugccaggaugcucaggauauccuaacauggaucuagauugccuuuuaccucaagaauggguucaauauuucuaucaagaagcagcaccagcucaaucagauguagcauuacucagauuugucaauccagacacaggaagaguacuauucgaaugcaaauuacauaaaucaggauauguaacaguagcacauacaggucaacacgauuuaguaaucccuccgaauggauauuucagauuugauucuugggucaaucaauuuuauaccuuagcaccaaugggcaacgguaccggcagacgaagagcacuauaa

SEQ ID NO: 31572 - RNA, 1623 nt, Artificial Sequence
  derived and/or modified sequence opt6 from VP1__Norovirus__AGS08084
augaaaauggcaucaagugacgcaaauccaucagauggcaguacagcuaacuuaguaccagaagucaauaacgaaguaauggcucuagaacccguaguaggagccgcuauagcagcuccuguagcaggacaacaaaauguaauagacccauggauaagaaauaacuucguacaagccccaggaggagaauuuacaguaucaccaagaaaugcacccggugaaaucuuauggucagcuccuuuaggaccagaucucaauccuuaucuaucacacuuagcaagaauguauaauggauacgcaggaggauucgaaguacaaguaaucuuagcaggcaaugcuuuuacugcuggaaaaauaauuuuugcagcggucccaccaaauuuuccaacagaaggacuaucaccaucccaaguaacaauguuuccacauauuauuguagauguuagacaacuagaaccagucuuaauaccacuacccgauguacguaacaauuucuaucacuauaaucaaucauacgauccaacaauaaaacuuauagcuaugcuuuauacaccacuacgagccaauaacgccggagaugauguauucacaguuucuugucgcguacuuacaagaccgucucccgacuuugacuuuauuuuucuuguaccacccacaguugaaagccgaaccaaaccuuucucaguacccguacuaaccguagaagaaaugacuaauucacgauuccccauaccacuagaaaaacuauucacaggaccaucaucagcuuuuguuguacaaccucaaaacggaagauguaccacagauggcguauuacuuggaacaacucaauuaucaccuguaaauauauguacauucagaggagauguuacacauauacccggcucccacaauuacaccaugaauuuagcaucucaaaacuggaauucuuacgacccaacagaagaaauaccagccccuuuagguacacccgacuuuguaggaaaaauacaagguguacucacccaaacaacaaaaacaaauggaucuacacgaggacauaaagcaacaguauauacaggauccgccgauuucucaccuaaauuaggacgaguacaauucgcgacagauacaaauaacgacuuugaaacaaaucaaaauacaaaauuuacacccguaggugucauacaagacggaucaacaaccccaagaaacgaaccacaacaaugggucuuaccuucauacucaggaagaaauauacauaacguacaccuagcacccgcaguagcaccaacauuuccaggagaacaauuauuauuuuuuagaucaacaaugccaggaugcuccggauacccaaauauggaucuagauugcuuauugccacaagaauggguccaauauuuuuaucaagaagcagccccagcacaaucagauguugcauugcuacguuuuguaaacccagacacuggaagaguauuauuugaauguaaacuacauaaauccggauacguaacaguagcauacacuggccaacacgauuuaguaauaccccccaacggauacuuccgcuucgauucaugggucaaccaauuuuacacacuugccccaaugggcaauggcaccggaagaagaagagcauuauaa

SEQ ID NO: 31573 - RNA, 1623 nt, Artificial Sequence
  derived and/or modified sequence opt6 from VP1__Norovirus__AGS08085
augaaaauggcaucaucagacgccaauccaucagauggaucugcugcaaauuuagugccagaaguaaauaaugaaguuauggcacuugaaccaguaguaggagcagcaauagcagcuccaguagccggacaacaaaauguaauagauccauggauaagaaacaacuucguucaagcaccaggaggagaauuuacaguaucgccuagaaaugcuccaggagaaauauuauggucugcaccacuaggaccagaucuuaacccauauuuaucucacuuagcuagaauguauaacggcuacgcuggaggauucgagguacaagucauacuagcaggcaaugcuuuuacagcuggaaaaguaauauuugcagcagucccaccaaauuuuccaacugaaggccuauccccuucacaagucacuauguucccucacauagucguugacguuagacaacucgagccuguacuaauaccauuaccagauguacgaaacaacuucuaccauuauaaccaaagcaacgacccaaccaucaaauuaauagcaaugcuauacacaccauuaagagcuaauaacgcaggcgaugaugucuuuacaguaucuuguagaguacuaaccagaccaucaccugauuuugauuucauauucuuaguuccaccgacuguugaaaguagaacaaaaccuuuuucagucccuguucuaacaguugaagaaaugacaaauucuagauuuccuauaccacuagaaaaacuauucacugguccuuccucugcauuuguaguacaaccacaaaauggaagauguacuacagauggaguauuacuuggaacaacacaauuaucaccaguaaauauaugcacuuuucgaggagacguuacucacaucacaggaagcagaaauuauacaaugaaucuagcuucccaaaauuggaauaacuacgauccaacagaagaaauaccagcaccacuaggcacaccugacuucgucggaaaaauucaaggcguuuuaacacaaacaacaagaacagacggaucaacaagaggacauaaagcaacaguauacacagguagcgcagacuuugcaccuaaauuaggacgcguacaauuugaaacugacacagaucaugauuuugaagcaaaucaaaauaccaaauuuacaccaguaggcguaauacaagacggaggcacaacacauagaaaugaaccacaacaauggguucuaccuaguuacucaggaagaaauacacauaacguucaccuugcaccugcugucgcaccaacauucccaggagaacaauuauuauuuuuuagaucuacaaugccaggaugcucaggauauccuaauauggaucuagauugcuugcuuccucaagaauggguacaauauuuuuaccaagaagcugcaccagcacaaucagauguagcacuauuacgguucguuaacccagacacuggaagaguccuauuugaaugcaaauuacacaaauccggauaugccacagucgcacauacaggucaacacgaccuuguaauaccaccaaacggcuacuucagauucgauuccuggguaaaucaauucuacacccuugcaccaaugggaaauggaacagguagaaggcgagcaguauaa

SEQ ID NO: 31574 - RNA, 1623 nt, Artificial Sequence
  derived and/or modified sequence opt6 from VP1__Norovirus__AGS08086
augaaaauggcauccucagacgcaaacccaagugacgguucaacagcuaauuuaguaccagaaguaaacaaugaaguaauggcauuagaaccaguaguaggcgcugcaauugccgcaccagucgcuggacaacaaaacguaauagaccccuggauaagaaauaacuucguccaagcaccaggaggagaauuuaccguaucuccuagaaaugcuccuggugaaauacuuuggucagcuccuuuaggaccagaucuaaauccauaucucucacauuuagcccgaauguacaacggauacgcaggaggauucgagguacaggucauauuagcagguaaugcauucacagcuggaaaaauuauauucgcugcaguaccaccaaauuucccaacugaaggauuaucaccuucccaaguaacaauguuuccucacauaauaguagacguucgacaauuagaaccaguucucauaccauuaccagauguaagaaacaauuuuuaccacuauaaccaaucuaacgacuccacuauaaaacuaauugcaaugcuauauacacccuuaagagcaaauaaugcaggugacgauguauucacuguaucauguagaguauuaacccgaccaagccccgacuucgauuuuaucuuccuuguaccaccaacaguagaaaguagaacuaaaccauucucaguaccaauacuaaccguagaagaaaugacaaacucaagauuuccaauuccacucgaaaaacucuuuacaggaccaucaucagcauuuguaguucaaccacaaaauggaagaugcacaacagauggcguauuacucgguacaacccaacucucaccuguaaacauauguaccuuccgaggagacguuacacauauaccaggaucucauaauuacacaaugaaucuagcaagccaaaacuggaacucauacgauccaacagaagaaauaccagcaccucuaggaacaccagacuuuguagguaaaauucaaggaguacuaacacaaacaaccucaacuaauggaagcacacgcggacacaaagcaacaguauauacaggaucagcagacuucucaccaaaacuuggaagaguacaauucgccaccgauacaaauaacgauuuugaaacaaaucaaaacacaaaauuuacuccaguaggaguaauucaagauggaucaacuacaccucgaaacgaaccacaacaauggguccuaccaucauauuccggaagaaauauucauaauguacauuuagcuccugcagucgcaccaacauuuccuggagaacaacuacuuuuuuuuagaucaacaaugccaggauguucaggauauccaaauauggauuuagauugcuuauuaccacaagaauggguccaauauuucuaccaagaagcagcaccagcacaauccgauguagcccuccuaagauucguaaacccagauacuggaagaguauuauuugaauguaaacuacauaaaucagguuauguaacaguagcacacacaggacaacacgaucuuguaauaccuccaaauggauauuuccgauucgauuccuggguaaaucaauuuuacacacuugcuccaaugggaaauggcacaggucgaagaagagcccucuaa

SEQ ID NO: 31575 - RNA, 1623 nt, Artificial Sequence
  derived and/or modified sequence opt6 from VP1__Norovirus__AGS08087
augaaaauggcaucaucagacgcaaaccccucagauggcucaacagcuaauuuaguaccugaagucaauaaugaaguaauggcacuagaaccaguuguaggcgcagcaaucgcagcaccaguagcaggacaacaaaaugucauugauccauggauaagaaacaacuuuguacaagcaccaggaggagaauucacaguaucaccaagaaacgcaccaucuaccauacuauggucagcaccauuaggacccgauuuaaaucccuaucuuucacacuuagcucgaauguauaaugguuacgcaggaggauuugaaguacaaguaauucuagcaggaaaugcuuuuacugccgguaaaauaauauucgcagcaguuccaccuaacuuuccaacugaaggacuaucaccaucucaaguuacuauguucccucacauaaucguagacguuagacagcuugaacccguacuuauuccauuaccagacgucagaaauaacuucuaccacuauaaucaauccaaugacccaacuauaaaacucauagcaaugcuauauacaccacuuagagcaaacaaugcaggcgacgauguauucacaguaucaugcagaguacucacuagaccaagcccagacuuugauuucaucuuucuaguuccaccuaccguagaaucaagaacaaaaccuuucucaguaccuguacuaacaguagaagaaaugacuaacucacgauucccaauccccuuagaaaaacuauuuacuggaccaucaucugcauucguaguucaaccccaaaacggaagaugcacaacagacggcguauuauuaggaacaacccaauuaagcccugucaauauauguacauucagaggagacguaacacauauaucaggaucuagaaauuacaccaugaaccuagcaucucaaaacuggaacucuuaugacccuacagaagaaauaccagcaccucuaggaacacccgacuuuguaggcaaaauacaaggaguauuaacacaaacuacaagaacagauggaucaacacgcggccacaaagcaacaguauacacaggcucagcugacuucucaccaaaauuaggaagaguucaauucgcaaccgacacagacaacgacuucguuacaaaccaaaauacaaaauucaccccugucggcguuauacaggacggcuccacuacaccccgaaacgaaccucaacaauggguucuaccaucauauucaggaagaaauauacacaauguacacuuagcaccagcaguagcaccuacauuuccuggugaacaacuacuauucuuucgaucuacaaugccuggauguucuggauauccaaauauggaucuagacuguuuacuaccccaagaauggguucaauauuucuaccaagaagcagcaccagcacaaucagacguagcacuauuacgauucguuaacccagacacaggacgaguucuuuucgaaugcaaauuacacaaauccggauacguaaccguagcacacacaggacaacacgaucuaguuauaccaccaaauggcuauuuccgcuucgauucauggguaaaucaauuuuacacccuagcaccaaugggaaauggaacuggaagaagaagagcuuuauaa

SEQ ID NO: 31576 - RNA, 1623 nt, Artificial Sequence
  derived and/or modified sequence opt6 from VP1__Norovirus__AGS08088
augaaaauggcaucaucagacgcaaaucccuccgauggaucaaccgcaaaucucguaccagaaguaaacaaugaaguuauggcauuagaaccaguagucggcgcagcuauagcagcaccaguagcuggacaacaaaauguaaucgauccauggauaagaaacaacuuuguacaagcaccuggcggagaauuuacagucucuccacgaaacgcaccaggagaaauauuauggucagcaccucuugguccagaucuaaauccauaucuaucucaccuggcaagaauguacaacggauacgcuggaggauucgaaguucaagucauuuuagcaggaaacgcuuucacagcagguaaaauaauauuugccgcaguuccacccaauuuuccaaccgaaggauuaucuccaucucaaguaacuauguucccucacauaauaguugacguacgucaauuagaaccaguauuaauaccauuaccugaugucagaaauaauuuuuaucauuauaaccaaucaaaugauucaacaauaaaacuuauagccauguuauacacaccauuaagagcaaauaaugcaggcgaugacgucuucacaguaagcuguagaguacucacacgcccaucaccagacuuugacuuuauauuccuuguuccaccuacaguugaaucaagaacaaaaccauucucagucccuauauuaaccguagaagaaaugacaaacucaagauucccaauaccacuagaaaaauuauuuaccggucccucuagcgcauucguaguucaaccacaaaacggaagauguacuacugacggagucuuauuaggaacaacacaacuaucaccaguaaauaucugcacauuuagaggagacguuacacacauaccuggaucacauaauuauacaaugaauuuagcaucacaaaacuggaacucuuacgauccaacugaagaaauuccagcaccauuagguacaccagauuuuguagguaaaauacaaggaguacuuacacaaacaaccucaacaaacggcucaaccagaggccauaaagcaacaguauauacaggaucagcagauuucaguccaaaacucggaagaguacaauuugcaacugacaccaacaacgauuucgaaacaaaucaaaauaccaaauuuacaccuguaggaguaauucaagaugguucaacaacaccaagaaaugaaccccaacaauggguuuuacccucauauucuggacgcaauauacacaauguccaccuagcaccagcaguagcaccaacuuucccaggggaacaauuauuauucuuccgcaguacaaugccaggaugcaguggauacccaaauauggaccuagauuguuuauuaccacaagaauggguacaauauuuuuaccaagaagcagcaccagcacaauccgaugucgcauuacuaagauucguaaacccagacacaggucgcguacuauucgaaugcaaauuacacaaaucaggauacguaaccguagcacacacuggacaacacgaucuuguaaucccaccgaauggauauuuuagauuugauucauggguaaaccaauuuuacacauuagcaccaaugggaaacggcacagguagacgaagagcauuauaa

SEQ ID NO: 31577 - RNA, 1623 nt, Artificial Sequence
  derived and/or modified sequence opt6 from VP1__Norovirus__AGS08089
augaaaauggcaucaucagacgcaaaccccucagauggauccacagccaaucuuguuccugaaguaaauaaugaaguaauggcacuagaaccaguaguaggagccgcaauagcagccccagucgcaggacaacaaaacgucauugacccuuggauuagaaauaauuucguacaagcacccggaggagaauucacaguaagcccaagaaacgccccaggagaaauacuauggucugcaccauuagguccagaccuaaauccauaccuaucccaucuagcacgaauguacaacggauacgcaggaggauucgaaguacaaguaauacuagcaggcaaugcuuuuacagcaggaaaaauuauauuugcagcagucccaccaaauuuuccaacggaaggauuaaguccaucacaaguaacaauguuuccacacauaauaguugauguaagacaauuagaaccaguucuaauaccccuaccagacgucagaaauaauuuuuaccacuauaaucaaucaaacgauucaacuaucaaauuaauagccaugcuauauacaccacuaagagccaacaaugcaggagaugacguauuuacaguuuccugucgaguauuaacaagaccaucaccugauuucgacuuuauauuuuuaguuccaccaacuguagaaagcagaaccaaaccauucucuguaccagucuuaacaguugaagaaaugaccaacuccagauucccaauaccacuagaaaaacuauuuacaggaccaucuagcgccuucgucguacaaccccaaaaugguagauguacaacagauggaguacuacucggaacaacacaauuaucuccagucaauauauguacauucagaggagacguaacacacauaccuggaagcagaaacuauacuaugaacuuagcaucucaaaacuggaauucauaugauccaaccgaagaaauaccagcaccacuaggcacaccugacuucguaggaaaaauucaaggaguccuaacacaaacaacucgaacaaacggaucaacacguggucacaaagcaacaguauauacaggaucagcagacuuuucaccaaaacuuggacguguacaauucgcuaccgauacagacaacgacuucgaaacaaaccaaaauacuaaauucacaccuguaggcguaauccaagacggaaguacaacaccuagaaaugaaccacaacaauggguacuaccaucuuacucaggacguaauauccauaacguccauuuagcaccagcaguagccccaacuuucccaggagaacaacuauuauucuuuagaucaaccaugcccgguuguucaggcuaucccaauauggaucuagauugccuacuaccacaagaauggguacaauauuucuaucaagaagcugcccccgcacaauccgacguugcacucuuacgauucguaaauccagauacaggacgaguacuuuucgaaugcaaacuacauaaaucaggauauguaacaguugcacacacuggacaacacgacuuaguaauaccuccaaauggcuacuuuagauucgacucauggguaaaucaauucuacacacuagcaccaaugggaaauggaacaggcagaagaagagccuuauag

SEQ ID NO: 31578 - RNA, 1623 nt, Artificial Sequence
  derived and/or modified sequence opt6 from VP1__Norovirus__AGS08090
augaaaauggcauccucugaugccaauccauccgauggcuccacagcaaacuuagucccagaagucaacaacgaagucauggcacucgaaccaguaguaggagcagccauagcagcuccaguagcaggacaacaaaacguaauagacccauggaucagaaauaacuucguacaagcaccaggcggagaauucaccguauccccaagaaaugcaccaggagaaauauuaugguccgcaccucucggcccugaucucaauccauaucuaucacauuuagcaagaauguauaacggauacgcuggaggcuuugaaguucaagucauacucgccggcaaugccuuuacagcaggaaaaaucauauuugcugcuguaccacccaacuucccaacugaaggucuaucaccaucacaaguuacaauguucccacacauaauagucgacguaagacaacucgaaccaguauuaauacccuuaccagacgucagaaauaauuuuuaucauuacaaccaaucuaacgauccaacaauaaaauuaauagcaaugcuauauacacccuuaagagcaaauaaugccggagaugacguauucacaguaucaugucgcguacuuacuagaccuucaccagacuucgauuucauauuucucguacccccaaccguagaaucuagaacaaaaccauucuccguaccagucuuaacaguagaagaaaugacaaacaguagauuuccaauaccauuagaaaaauuauuuacaggacccucgagcgcuuucguaguacaaccacaaaauggccgcuguacaacagauggugucuuacuagguacuacucaacuaucccccguaaauauaugcacauucagaggugacguaacucauauaucuggaucaagaaacuacacaaugaaucuagcaucacaaaacuggaacucauacgauccaacagaagaaauaccagcaccucuaggaacaccugauuuuguaggaaaaauucaagguguccuuacacaaacaacaagaacagauggaaguacaagaggacacaaagcaacaguauacacaggaagcgcugacuuuaguccaaaacuuggaagaguacaauucgcaacagauacagauaacgacuucguuaccaaucaaaacacuaaauucaccccagucggcguaauacaagauggauccacuacaccccgaaacgaaccacaacaauggguauuaccaaguuacucaggaagaaauacccacaacguacacuuagcaccagcagucgcuccaacauuuccaggugaacaauuguuauucuucagaucaacuaugccuggauguucaggauauccuaauauggaccuagauugcuuauuaccccaagaauggguacaauauuucuaccaagaagcagcaccagcacaaucugacguagcauuacuaagauucgucaacccugauacagguagaguauuauucgaaugcaaacuacacaaaucaggcuacguaaccguagcccacacaggucaacacgaucuaguuaucccaccaaauggauauuucagauucgauucauggguuaaucaauucuauacucuagcuccaaugggaaaugguacaggaagaagacgagcacucuaa

SEQ ID NO: 31579 - RNA, 1623 nt, Artificial Sequence
  derived and/or modified sequence opt6 from VP1__Norovirus__AGS08091
augaaaauggcauccagugacgcuaauccuacagauggauccgccgcuaacuuagugccagaaguuaauaaugaaguaauggcauuagaaccaguuguaggagccgcuauagccgcuccaguagcaggucaacaaaauguuauagacccuuggauuagaaauaacuuuguacaagcacccggaggcgaauucacaguaucucccagaaaugcaccaggagaaauacuuugguccgcccccuuaggcccugauuuaaaucccuacuuaucacauuuagcccgaauguauaauggauacgccgguggauuugaaguacaaguaauauuagcuggaaaugcuuucacagcagguaaaauaauuuucgcagcaguaccaccaaacuucccaacagaaggacuaucaccaucacaagucacaauguuuccccauauuauaguugacguucgucaauuagaaccaguacuaauaccccuuccugaugucagaaauaauuuuuaucacuacaaucaaucaaaugauucuacuauaaaauuaaucgcuaugcuuuauacuccacuaagagcaaauaaugcaggagaugacguauucacagucucauguagaguacuaacaagacccucaccagacuuugauuuuauauuuuuaguaccaccuacagucgaaucaagaaccaaacccuuuucaguaccaguauuaaccguagaagaaaugacaaauucacguuucccaauaccacuagaaaaacucuuuacaggaccaucauccgcauuuguaguacaaccccaaaauggaagaugcacaacagacggagucuuacuaggcacaacacaacuuuccccagucaacauauguacuuuuagaggugacguaacucauauaacaggaucaagaaacuacacaaugaaucuugcaucucaaaacuggaacaauuacgacccaaccgaagaaacuccagccccuuuaggaacaccagauuuuguagguaaaauacaagguaugcuuacgcaaacaacuagaaccgacggaaguacaagaggacacaaagccacuguauacacaggaucagcagauuucgcaccaaaacuagguagaguacaauuugaaacagauacagaccacgacuuugaagcaaaccaaaauacaaaauuuacaccaguaggaguuauucaagacggaucuacaacacauagaaaugaaccccaacaauggguacuaccaucuuacaguggacguaacacacacaacguacaccuagcaccagcaguagcccccacauuuccuggugaacaacuacuauucuuucgcuccacaaugccaggaugcucaggauacccuaauauggaucuagacugcuuauuaccucaagaauggguacaauacuuuuaccaagaagcagcacccgcacaaucagacguagcacuauuaagauucguuaacccugauacaggaagaguccuuuucgaaugcaaauuacauaaaucuggauauguaacuguagcacacaccggacaacacgaccucguaauaccuccuaacggauauuucagauuugacuccuggguaaaucaauuuuacacuuuagcaccaaugggaaacggaacugguagacguagaguaguauaa

SEQ ID NO: 31580 - RNA, 1623 nt, Artificial Sequence
  derived and/or modified sequence opt6 from VP1__Norovirus__AGS08092
augaaaauggccuccucugacgcaaacccaucagauggaucaacugcaaaucuuguaccagaagucaacaaugaaguuauggcauuagaaccaguaguaggagcagcuauagcagcuccuguagcuggacaacaaaauguaauugauccauggauaagaaauaacuuuguccaagcaccaggcggagaauuuaccguaucaccacguaaugcaccaggagaaauauuauggucugcaccacucggaccugacuuaaacccauacuuaucacacuuagcacgaauguauaaugguuaugcaggaggauucgaaguacaagucauuuuagcaggaaaugcauuuaccgcagguaaaaucauauucgcagcuguacccccuaacuucccaacagaaggucucucaccuagucaaguaacuauguucccacacauaauaguagacguaagacaauuagaaccaguacuaauaccauuaccagauguaagaaacaauuucuaucacuauaaucaaucuaacgacccaacaauaaaacuuauagcaaugcuauacaccccccuucgcgcaaauaacgcaggagacgauguauucacuguaagcugucgaguacuaacaagaccaagccccgacuuugacuuuauauucuuaguaccaccaacaguagaaucaagaaccaaaccauuuagcguaccaguauuaacaguugaagaaaugacaaacucacgauucccaauaccacuugaaaaauuauuuacaggaccaucaucagcauucguuguacaaccacaaaaugguagauguacaacagacggugucuuacuaggaaccacucaacuauccccaguaaacauauguacauuucgaggagacgucacacauauaucuggaaguagaaacuacacuaugaaccuagcaucucaaaauuggaacaguuaugauccaacugaagaaauaccagcaccacuaggaacaccagauuucguaggcaaaauacaaggagucuuaacacaaaccacacgcacagacgguucaacacgaggacacaaagcaacuguauauacaggauccgcagacuuuucaccaaaauuaggcagaguacaauucgccacagauaccgacaaugauuucgucaccaaucaaaauacaaaauucacaccaguuggcgucauacaagaugguucaacaacacccagaaaugaaccacaacaauggguacuaccaucauauucagguagaaacacacauaacguacaccucgccccagccguagcaccuacauuuccaggagaacaacuccucuuuuuuagaucaacaaugcccggaugcucaggauauccaaacauggauuuagacuguuuauuaccacaagaauggguccaauauuucuaucaagaagcagcacccgcccaaucagacguagcucuauuacguuucguaaauccagauacaggcagaguccuauuugaauguaaacuccacaaaucaggauacguaacaguagcacauacuggucaacacgaucuaguaauaccaccaaaugguuauuucagauucgauuccuggguaaaccaauucuacacacuagcuccaaugggaaauggaacuggccgaagacgagcacuauaa

SEQ ID NO: 31581 - RNA, 1623 nt, Artificial Sequence
  derived and/or modified sequence opt6 from VP1__Norovirus__AGS08093
augaaaauggcuuccucugaugcaaacccaucagacggaucaacugcuaacuuaguacccgaaguuaacaacgaaguaauggcauuagaaccaguaguaggcgcagcaauagccgccccaguagccggacaacaaaauguaauagauccauggauaagaaauaacuuuguccaagcuccaggaggagaauuuacaguaucuccaagaaaugcaccaggagaaauacuauggucugcuccccuuggaccagaucuuaaccccuauuuaucucacuuagcacgaauguacaacgguuaugcagguggauucgaaguucaaguaauacuagcaggaaacgccuucaccgcagguaaaauaauuuuugccgcagucccacccaauuuuccaacagaaggacuaucaccaucccaaguaacuauguucccacacauaauuguagacguacgccaauuagaacccguccuuauaccacucccagacguaagaaauaacuuuuaccauuauaaucaauccaaugauucaacaaucaaauuaauagcaaugcuuuacacaccuuuaagagccaacaaugccggagaugauguauuuacugucucauguagaguacuaacacgaccaucaccagacuuugacuuuauauuuuuaguaccacccacuguagaaucaagaaccaaaccauucuccguaccaauuuuaacuguagaagaaaugacuaauuccagauuucccauuccauuagaaaaauuauucaccgguccaucaucagcauuugucguucaaccacaaaacggaagauguacuaccgaugguguacuacuagguaccacacaauuauccccaguaaauauauguacauuccgaggugacguuacacacaucccaggaagucacaauuacacuaugaaccuagcaucacaaaacuggaauaguuacgaucccacugaagaaauacccgcuccacucgguacuccagacuuugucggaaaaauucaaggaguauuaacccaaacuacuucaacaaaugguucaacacguggacacaaagcaacagucuauacaggaucagccgauuucucaccaaaacuaggacgaguacaauucgcaacagauacaaacaaugauuucgaaacaaaccaaaauacaaaauucacaccaguaggagucauucaagacggaucaacaacaccucgaaaugaaccacaacaauggguauuaccaagcuauuccggucgcaauauacacaacguacaucuugccccugccgucgcaccaacauucccaggugaacaacucuuauucuuuagaucaacuaugccuggaugcuccggauauccaaauauggauuuagacugcuuauuaccacaagaauggguacaauauuucuaucaagaagcagccccagcacaaucagacguagcacuauuaagauucguaaacccagacacuggaagaguacuauuugaaugcaaacuucauaaaucagguuacgucacaguagcacacacaggacaacaugaccuagucauaccaccuaaugguuauuuccgauucgauucauggguaaaucaauucuacacacuagcccccaugggaaaugguacuggccgcagacgagcgcuauaa

SEQ ID NO: 31582 - RNA, 1623 nt, Artificial Sequence
  derived and/or modified sequence opt6 from VP1__Norovirus__AGS08094
augaaaauggcaagcuccgaugcaaaucccucagauggauccacagcuaauuuaguaccagaaguuaauaaugaaguuauggcacuagaaccagucgucggugcagcaauagcagcaccaguagcaggccaacaaaauguaauagauccuuggauacgaaauaacuuuguacaagcaccuggaggugaauuuacaguaucuccacgaaaugccccaggagaaauacuauggucagcaccucuaggcccagaucuaaaucccuaucuaagccaucuugcaagaauguacaauggcuacgcggguggcuuugaaguacagguaauauuagcaggaaaugcauucaccgccggaaaaauaauauucgcugcaguuccaccaaacuuuccuacagaaggccuauccccaucucaaguaacaauguuuccucauaucauagucgaugucagacaauuagaaccaguauuaauaccacuucccgauguuagaaauaacuuuuaucacuauaaucaaucaaaugauccaaccauaaaacuaauagccaugcuauacacaccacuuagagcaaacaaugccggugacgauguuuucacagucagcugcagaguacuaaccagaccaucuccagacuucgauuuuauauuucuaguaccaccaacaguugaaucacgaacuaaaccauuuuccgucccaguauuaacaguugaagaaaugacaaauucuagauuuccaauaccacuagaaaaacuauuuaccggaccuucaucggcauucguuguacaaccacaaaacggccgguguacaaccgauggaguauuauuagguacaacucaauuaucaccaguuaauauauguacuuuuagaggagacgucacacacauaccaggcucuagaaacuacacaaugaauuuagcuucucaaaacuggaacaguuaugaccccacagaagaaauaccagccccucuaggaacacccgacuuuguagguaaaauacaaggaguacuuacacaaacaacaagaacaaacggauccacuagaggacacaaagcuacaguauauacagguagcgccgacuuuucaccaaaauuaggaagaguccaauuugcaacagacacagauaacgauuucgaaacaaaccaaaauaccaaauucacaccagucggaguaauacaagauggaucaacaacaccacgcaaugaaccacaacaaugggucuuaccuucuuauucaggaagaaauauacauaauguacaccuagccccagcaguagcuccaacauuucccggagaacaacuccucuucuuucgaucaacaaugccaggauguuccggauauccaaauauggaucuugacugcuuauuaccacaagaauggguacaauauuucuaucaagaagcagcaccagcucaaucagacguagcuuuacuaagauucguuaacccagauacuggacgaguauuauucgaaugcaaacuccauaaaucuggauauguaacaguugcacacacaggacaacaugaccuagucauuccucccaacggauauuuucgauuugauucaugggucaaccaauuuuauacucuagcacccaugggaaacggaacaggacgaagaagagcauuauaa

SEQ ID NO: 31583 - RNA, 1623 nt, Artificial Sequence
  derived and/or modified sequence opt6 from VP1__Norovirus__AGS08095
augaaaauggcuaguucugacgcaaauccuucagauggaucaacagccaauuuaguuccagaaguaaacaaugaaguaauggcacuagaaccaguaguaggagccgccaucgcagcccccguagcaggacaacaaaacguuauagacccauggauaagaaauaacuuuguacaagcuccagguggugaauuuacagucucaccuagaaacgcaccaggugaaauauuauggucagcuccauuaggaccagaucucaaucccuaccuuucacaccuagcccgaauguacaauggauacgcugguggauuugaaguacaagucauacuagcaggcaacgcuuuuacagcaggaaaaauaaucuucgcagccguuccuccaaacuuucccacagaaggacuaucaccaucacaaguaacaauguucccacacauaauagucgacguuagacaacuugaaccaguacuaauaccacuaccagacgucagaaacaauuuuuaucauuauaaucaaucaaacgauccuacaauaaaauuaauagcaauguuauacacaccauuaagagcaaacaacgcaggugacgaugucuucacuguaucuugccgaguacuaacaagaccauccccugauuucgacuucaucuuccuaguuccacccacaguagaaucaagaacuaaacccuucuccguaccaguauuaaccgucgaagaaaugacuaacucucgcuuccccauaccuuuagaaaaacuauucacaggacccucaucagccuucguuguucaaccucaaaacggaagauguacaacagauggaguauuacuagguacaacacaauuaucaccuguaaacauauguacauuuagaggagacguaacccauaucccuggaucucguaauuauacaaugaaucuagccucccaaaauuggaauucauacgacccaacagaagaaauuccggcaccauuaggaacaccagauuuuguaggaaaaauacaaggaguauuaacccaaacuacuagaaccaacggaucaacaagaggucauaaagcaacagucuauaccggauccgcagauuuuucuccuaaauuaggacgcguacaauucgccacagacaccgauaacgauuucgaaacuaaucaaaauaccaaauuuacaccuguaggaguaauacaagacgguucaacaacaccaagaaaugaaccacaacaauggguacuaccaucauauucaggaagaaauauacacaauguacaccucgcacccgcaguagcuccuacauuuccaggagaacaacuacuuuuuuuuagaucaacaaugcccggcugcucagguuacccaaauauggauuuagauuguuuacucccacaagaauggguacaauacuucuaucaagaagcagcacccgcacaaucagauguagcccuucuacgauuuguaaacccagauaccggaagaguuuuauucgaaugcaaauuacacaaaucuggauauguaacaguagcacauaccggacaacacgacuuaguaauuccaccaaacggauacuuuagauucgacuccuggguaaaucaauuuuacacacuagcuccaaugggcaaugguacuggaagaagaagagcacucuaa

SEQ ID NO: 31584 - RNA, 1623 nt, Artificial Sequence
  derived and/or modified sequence opt6 from VP1__Norovirus__AGS08096
augaaaauggcuuccucagacgcaaauccaucagacggaucagcagcaaaccuaguacccgaagucaauaaugaaguaauggcauuggaaccaguuguuggagcagcaauagcagcaccagucgcaggccaacaaaauguaaucgacccauggaucagaaauaacuuuguacaagcaccuggaggagaauucacaguaagcccaagaaacgcacccggagaaaucuuaugguccgcaccacuaggucccgaucuuaaucccuaucucucucacuuggcaagaauguacaauggcuaugcaggaggauuugaaguacaaguaauccucgcuggcaaugcauucaccgccgguaaaguaauuuucgcagcaguaccaccaaauuuuccaacagaaggacuaucaccaagucaaguaacaauguucccacauauaguaguagacguacgacaauuagaacccguauuaauaccacuaccagaugucagaaauaauuuuuaccacuauaaucaaucaaaugacccaacaauuaaauuaauugccauguuauacacaccacuacgagcaaauaaugcaggugacgauguuuuuacaguaucauguagaguucuaacacgaccaucaccagacuuugauuuuauauuuuuaguaccaccuacaguagaaucacgcacaaaaccuuuuucuguuccaguauuaacaguagaagagaugacaaacuccagauuuccaaucccuuuagaaaaauuauuuaccggacccuccagcgccuuuguaguacaaccacaaaauggaagauguacaacagacggaguauuauuagguacaacacaacuuucaccagucaauauuugcacauuuagaggagauguaacacacauaacuggcucuagaaauuauacaaugaaucuagcuucccaaaauuggucaaauuaugauccaacugaagaaauaccagcccccuuaggcacaccugauuucgucggaaaaauccaaggaguauuaacacaaacaacaagaacagacggcagcaccagaggacauaaagccacaguauauacagguucagcagacuuugcuccaaaacuuggaagaguacaauuugaaacagacacagauagagauuucgaagcaaaucaaaauacaaaauucacaccuguaggaguuauacaagauggaggaacaacccaucgaaaugaaccacaacaaugggucuugccaaguuauucuggaagaaacacaccuaauguacauuuagcuccugcaguagcuccaacauuuccaggugaacaacuacuauuuuuuagaucuacaaugccugguugcagcggcuauccaaauauggauuuagauugcuuauuaccacaagaauggguacaauauuucuaucaagaagcagcaccagcacaaucagacguugcacuacuaagauucguaaacccagauacaggcaggguucucuucgaaugcaaacuacauaaaucuggcuauguaacaguagcacauacaggacaacacgauuuaguaauaccaccaaaugguuauuucagauucgauucauggguaaaucaauuuuacaccuuagcaccaaugggaaauggaacaggacgccgacgagcauuauaa

SEQ ID NO: 31585 - RNA, 1623 nt, Artificial Sequence
  derived and/or modified sequence opt6 from VP1__Norovirus__AGS08097
augaaaauggcauccucagaugcaaacccaucagauggaucaacagcuaaccuaguaccugaaguaaacaaugaaguaauggcucucgagccaguaguaggagcagcaaucgcagcaccaguagcuggccaacaaaauauaauugacccuuggauuagaaacaacuuuguccaagcaccuggaggagaauuuacaguaucaccaagaaaugcacccggagaaauacugugguccgccccauuaggaccagaucuuaauccuuaccuuucacauuuagcacgaauguacaacggauacgcaggcggauucgaaguacaagucauauuagcaggaaaugcauucacagcaggaaaaauaaucuucgcagcaguuccaccaaacuuucccacagaaggacuaucaccaucacaaguuacaauguuuccacacauuauaguagauguuagacaacuagaaccuguauuaauaccacuacccgauguuagaaauaauuuuuaccauuacaaccaaucaaaugauucaaccauaaaauuaauagcaaugcucuauacaccacuacgcgccaacaaugcaggagaugauguuuuuacuguuucuugucgaguauuaacaagaccaaguccugauuuugacuuuaucuuccucguaccccccacaguagaaucaagaacaaaaccauuuaguguaccaguacuaacuguagaagaaaugacaaauaguagauuuccaauaccucuagaaaaauuauuuacagguccaucauccgcauucguuguccaaccucaaaacgguagaugcacaaccgacggaguucuacuuggaacaacacaauuaucaccagucaauauaugcacauuuagaggugacguaacccauauaucagguuccagaaauuauacaaugaaccuagcuucacaaaauuggaacucuuaugacccaacugaagaaaucccagcacccuuaggaacaccagacuucguaggaaaaauucaaggagucuuaacacaaacaaccagaaccgauggaucaacacgaggccauaaagcaacaguauacacagguucagcugauuuuucaccaaaauuaggacgaguacaauucgcaacagauacagacaaugacuuuguaaccaaucaaaauaccaaauucacacccguagguguuauucaagauggcagcaccacaccaagaaaugaaccacaacaauggguauuaccuucauauucuggaagaaauacacacaacguacacuuagcaccagccguugcuccaacauuucccggagaacaacuacuauucuuucgaucuacaaugccaggauguuccggcuauccaaauauggacuuagauugcuuauuaccucaagaauggguacaauauuucuaccaagaagcugcacccgcccaaucugauguagcacuucuaagauucguaaacccagauacaggaagaguucuauuugaauguaaacuacauaaauccgguuauguaacaguagcccacacaggacaacaugaucuaguaaucccaccaaauggauauuucagauuugauagcuggguaaaccaauucuauacacuagcaccaaugggaaacggaacaggaagacgaagagcacuuuaa

SEQ ID NO: 31586 - RNA, 1623 nt, Artificial Sequence
  derived and/or modified sequence opt6 from VP1__Norovirus__AGS08098
augaaaauggcauccucagacgcaaacccuucugauggaucaacagcaaaccucguacccgaagucaacaaugaaguuauggcccucgaaccaguaguuggugcugccaucgcagcaccagucgcuggccaacaaaacgucauagauccauggaucagaaacaauuucguacaagcaccagguggcgaauuuacaguaucaccuagaaaugcaccaggagaaauauuauggucagcuccacuaggaccagauuuaaacccuuacuuaucacacuuggcccgaauguauaacggauaugcaggcggauuugaaguacaagucauacuagcuggaaaugcauuuacagcuggaaaaauaauauucgccgcaguuccaccuaacuuccccacugaaggauuaucuccuucacaaguuacaauguucccucacauuauaguagacguaagacaacuagaaccaguacuaauaccauuaccagauguuagaaacaacuuuuaucauuauaaucaaucuaaugaucccaccauaaaacuuauagcaaugcuauacacaccauuaagagccaacaaugccggcgacgauguauuuaccguauccuguagaguauuaacaagaccauccccugacuuugacuucauuuuucuaguaccaccaacaguugaaucaagaacaaaaccuuucucaguaccaguauuaacuguugaagaaaugacaaacucacguuuuccaauuccauuagaaaaacuauucacaggcccaucaucagcauuugugguacaaccucaaaacggaagaugcacaacagacgguguacuacucggaacaacucaacuaucccccguaaacaucugcacguuuagaggagauguaacccauauaucaggaucucauaauuacacuaugaacuuagcaucacaaaacuggaacaguuacgaccccacagaagaaauaccagcaccauuaggaacacccgauuuuguaggaaaaauacaaggaguuuuaacacaaacaacacggaccgacggaucaacacgcggacauaaagcaacaguauauacaggauccgcagauuuuucuccaaaauuaggccgaguacaauuugcaacagauaccgauaaugauuuuguaacaaaucaaaauacaaaauuuacuccagucggagucauacaagacggaucaacaacacccagaaaugaaccucaacaauggguacuaccaucauauuccggacgcaauacacacaauguucaccuugcaccugcaguagccccuaccuuuccaggcgaacaauuacuauuuuucagaucaacaaugccaggauguucuggauauccaaauauggaucuagauuguuuacuaccucaagaauggguacaauacuucuaucaagaagccgcaccagcucaaucagauguagcauuacuacgcuucguaaauccagauacaggaagaguacuuuucgaaugcaaacuucacaaaucuggcuacguuacaguagcccacaccggucaacacgaccuaguaauaccaccaaauggauauuuccguuuugauuccugggucaaucaauuuuacacacucgcaccaaugggcaauggcacaggaagacgaagagcauuauaa

SEQ ID NO: 31587 - RNA, 1623 nt, Artificial Sequence
  derived and/or modified sequence opt6 from VP1__Norovirus__AGS08099
augaaaauggcuagcucagacgcaaacccaucagacggaucaacugcaaacuuaguaccugaaguuaauaacgaaguuauggcuuuagaaccaguagucggagcugccauagcagcaccaguagcuggacaacaaaacguaauugauccauggauuagaaauaauuuuguacaagccccaggcggagaauuuacaguaucaccaagaaaugcuccaggagaaauauuauggucagccccauuagguccugauuuaaauccuuacuuaucacaccuugcaagaauguauaacggauaugcagguggcuuugaaguacaagucauucucgccggaaacgcauuuacagcaggcaaaauaauauuugcugcaguacccccaaauuuuccaacugaagguuuaucaccaucucaagucacuauguucccacauauaauuguagacguaagacaacuugaacccguauuaauaccacucccagauguaagaaauaauuucuaucacuauaaccaaaguaaugaucccacaaucaaauuaauagcaaugcucuauacuccacuccgugccaauaaugcaggagaugacgucuuuacagucucuuguagaguacucacaagaccuucaccagacuucgauuuuauauuuuuaguaccaccaacaguugaaucuagaaccaaaccauucucagucccaguacuaaccguagaagaaaugacaaacucuagauuuccaauuccauuagaaaaacuuuuuacaggaccaagcucugcauuuguaguacaaccacaaaauggaagauguaccacugauggcguacuacucggaacuacacaacucaguccaguaaacauauguaccuuuagaggugacguaacucauauaucaggcagcagaaauuacaccaugaaucuagcaucccaaaacuggaacucauaugauccaacugaagaaauuccugcaccucucggaacaccagauuuugucggaaaaauccaagguguacuaacacaaacaaccagaacagauggaucuacuagaggacacaaagccacugucuauaccgguucagcagacuuuucucccaaacuaggaagaguccaauuugcuaccgacacagauaacgauuucguaaccaaucaaaauacaaaauucacuccaguaggcguuauucaagauggaucaacaacaccuagaaaugaaccacaacaauggguacucccaucauauucuggaagaaauacacacaauguucauuuagcaccagcaguagcacccacuuuuccuggagaacaauuacuauucuuuagaucaacuaugccaggauguucaggcuaccccaauauggauuuagauugucuccuaccucaagaauggguacaauacuucuaucaagaagccgcuccagcccaaucagacguagcccuauuaagauuuguaaauccugacacuggacgaguacuauucgaaugcaaauuacauaaaucagguuacguaacaguagcccauacaggccaacacgaucucguuauaccuccuaauggauacuuccgauuugauucuuggguuaaucaauuuuauaccuuagcaccaauggguaauggaacagguagacgacgagcucuauaa

SEQ ID NO: 31588 - RNA, 1623 nt, Artificial Sequence
  derived and/or modified sequence opt6 from VP1__Norovirus__AGS08100
augaagauggcuucaucagaugcaaacccaucagacggaucuacagcaaaccuaguaccagaaguuaacaaugaaguuauggcauuagaaccagucguaggagccgcaauagcagcaccuguagcaggacaacaaaauguaauugacccauggauucgaaauaacuuuguacaagcaccuggaggugaauuuacaguaucaccaagaaaugcaccaggagaaaucuuauggucagcaccucuaggaccagaccuaaauccauaucucucacacuuagcacgaauguacaacggauaugcuggaggauuugaaguacaaguuauacuagcuggaaaugcuuuuacagccgguaaaauaauuuucgcagcagucccacccaauuuucccacagaaggcuuaucgccaucacaaguuacaauguucccacacaucaucguugacguuagacaacuagaaccaguucuaauuccacuaccagauguaagaaauaacuuuuaucacuauaaucaaucaaaugaccccacuauaaaacuaaucgcaaugcuauacacuccuuuaagagcaaacaaugcaggagaugacgucuucaccguauccugucgaguuuuaacaagaccauccccagauuuugacuuuauauuucuaguuccaccaaccguagaaaguagaacuaaacccuucuccguacccguacucacaguugaagaaaugacuaacucaagauucccaauaccauuagaaaaauuauuuacaggaccauccucagcauucgucguacaaccacaaaauggucgaugcacaacagaugggguacuauuagguacaacacaauuaucacccguuaacauuuguaccuuuagaggcgacguuacacauauaucaggaucacgaaauuauacaaugaaccuaguaucacaaaacuggaacucauacgacccaacagaagaaauaccugcaccacucggaaccccagauuucguaggaaaaauacaaggaguccucacucaaacuacacguacaaacggaucaacacgaggacacaaagcaacaguuuauacuggauccgcagauuuuaguccuaaacuaggaagaguucaauuugcaacagacacagauaacgauuucgaaaccaaucaaaacacaaaauuuacaccaguaggaguuauacaagacggcucuaccacaccacggaaugaaccacaacaaugggucuuaccaucauacuccggcagaaacauacauaacguucauuuagcaccagcaguagcaccuacauucccaggagaacaacuacuauucuuucgauccacuaugccaggaugcucaggguauccaaauauggaccuagauuguuuacuaccacaagaauggguacaauauuuuuaccaagaagcagcuccugcacaaucagacguugcccuauuacguuucgugaauccagacacaggaagaguauuauuugaaugcaaacuacauaaaucaggguaugucacaguagcacacacaggacaacacgaucuaguaaucccaccaaauggcuauuucagauucgauucauggguuaaucaauucuacacauuagccccuaugggaaauggaacuggacgacgaagagccuuauaa

SEQ ID NO: 31589 - RNA, 1623 nt, Artificial Sequence
  derived and/or modified sequence opt6 from VP1__Norovirus__AGS08101
augaaaauggcuucaucagaugcaaauccgucggaugguucagccgcaaaucuaguuccagaaguaaauaaugaaguaauggcucuagaaccagucgucggagcugccauagcagcuccuguagcaggacaacaaaauguaauagauccuuggauacgcaauaauuucguucaagcuccagguggagaauuuacaguaagcccucgcaaugcuccaggagaaauucuaugguccgcaccucuaggcccugauuuaaauccauacuuaucucaccuagcaagaauguacaauggcuaugcagguggauucgaaguacaaguaauucuugcagguaaugcauucacagcaggaaaaauuauauuugcagcaguuccuccaaauuuuccaacagaagguuuaaguccaucccaaguuacuauguucccccauauaaucguugacguucgacaacuugaacccguauuaauaccauuaccagauguaagaaauaacuucuaccauuauaaccaauccaaugacucaacaauaaaacucauugccaugcuauacacacccuuacgagcaaauaacgcaggagaugauguuuuuacagucucaugcagaguacuaacaagaccaaguccugauuuugacuuuauuuuuuuagucccaccaacaguagaaucacguacaaaaccuuuuucuguaccaguauuaacaguagaagaaaugacuaauucaagauuuccaauaccacuagaaaaauuauuuacaggaccuuccucagcuuucguaguucaaccucaaaacggcagauguacuacagacggcguacuauuagguacuacacaacuaucuccaguaaauauaugcacauuucgaggagacguaacucauaucucuggaucaagaaauuauacaaugaauuuagcaucacaaaacuggaacucauaugauccaacugaagaaauaccagcuccauuaggaacaccagacuuuguaggaaaaauacaagguguacuaacucaaacaacaagaacugauggauccacacgaggacacaaagcgacaguauauacagguucugcagacuuuucuccuaaauuaggccgcguacaauuugcuacagauacugauaaugauuuuauaacaaaucaaaauaccaaauucacaccaguagguguaauacaagauggaaguacaacuccacgaaaugaaccacaacaauggguacuaccaucauauucaggaagaaacacacauaauguacaucuagccccagcaguugcaccuacauuuccaggugaacaauuguuauucuuuagaucaacaaugccaggaugcaguggauauccaaauauggaucuugauugccuacucccacaagaauggguacaauauuuuuaccaagaagcagcaccagcacaaucagacguagcacuccuaagauuuguaaacccagacacaggaagaguuuuauuugaauguaaacuccauaaacccggauauguaacaguagcacauaccggucaacaugaucucguuauuccuccuaauggauauuucagauuugacucuuggguuaaccaauuuuacacucuagcaccaaugggaaaugggacuggaagaagacgagcauuauaa

SEQ ID NO: 31590 - RNA, 1623 nt, Artificial Sequence
  derived and/or modified sequence opt6 from VP1__Norovirus__AGS08102
augaaaauggcaucaagugacgcaaacccaucagauggaucagcagcaaauuuaguuccugaaguaaacaaugaaguaauggcacuagaaccaguagugggagcagcaauagcagccccuguagcaggucaacaaaacguuauagacccuuggauccgcaauaauuuuguacaagccccaggcggagaauuuacaguuucuccacgaaaugcaccuggcgaaauauuaugguccgcaccacugggacccgaucuaaauccuuaccuaucacaucuugcuagaauguauaauggauacgcuggaggcuuugaaguacaaguaaucuuagccggaaaugcauuuaccgcaggcaaaguuauauuugcagcaguuccaccaaauuucccaacugaaggauuaucaccuagccaagucaccauguucccacauauaguaguagaugucagacaauuagaaccaguauuaauaccacuaccagacguaagaaacaauuuuuaucauuauaaucaaucaaaugauccaacaauaaaauuaaucgcaaugcucuacacuccacuaagagcaaacaaugccggugacgauguauucaccguaucauguaggguauuaacaagaccaucaccagacuuugauuuuauauuuuuagucccuccaacaguugaauccagaacaaaaccauuuucuguaccuguacuaacaguagaagaaaugacuaauucaagauucccuauuccacuagaaaaacuauucacaggaccaucuucagccuucguaguacaaccacaaaacggcagauguacaacagauggcgucuuacuaggaacaacucaauuaucaccuguaaauauauguacauucagaggagacguuacacacaucacaggcagucgcaauuauacuaugaacuuagcaucacaaaauuggucaaacuacgauccaacagaagaaauaccagcuccuuuaggaacacccgauuuuguggguaaaauacaaggaguacuaacccaaaccacaagaacagacggaucuacaagaggacacaaagccacaguauacacagguucagcugauuuugcaccaaaauuaggcagaguucaauucgaaacagauaccgauagagauuuugaagcaaaccaaaauaccaaauuuacuccaguaggaguuauacaagauggaucuacaacucauagaaaugaaccucaacaauggguacuuccauccuauucaggaagaaauacacccaauguacacuuagcaccagcaguugcaccuacauuuccaggcgaacaauuacuauucuuuagauccacaaugcccggauguucaggcuacccuaacauggaccuagacuguuuacuaccccaagaauggguacaauauuuuuaccaagaagcagcucccgcacaaucagauguagcucucuuaagauucguaaaucccgauacaggacgcguacuauucgaaugcaaauuacauaaaucuggcuauguaacuguagcacacaccggacaacacgauuuaguaauccccccaaauggcuauuuucgauucgacuccuggguaaaucaauuuuauacccuugcuccaaugggcaacggcacaggaagacgaagagcccuauaa

SEQ ID NO: 31591 - RNA, 1623 nt, Artificial Sequence
  derived and/or modified sequence opt6 from VP1__Norovirus__AGS08103
augaaaauggcaucaucagacgcacacccaucagacgguuccaccgcaaaccuaguaccagaaguaaacaaugaaguaauggcacuggaaccaguaguaggcgcagcaaucgcugcaccaguugcaggacaacaaaacguuauugauccuuggauucgcaauaacuuuguucaagcuccggguggagaauuuacaguaucaccaagaaacgcaccuggagaaauauuauggucugcaccucuaggucccgaucuuaauccauaucuaucacaucuagcuagaauguauaacggauacgcaggagguuuugaaguacaaguaauacucgccggcaaugcuuuuacagcaggaaaaaucauauucgccgcuguacccccaaacuuuccaacagaaggucucucaccaucacaaguaacaauguucccucacauuauuguagacguuagacaauuagaaccaguacucauacccuuaccagacguaagaaacaauuuuuaccacuauaaccaauccaaugaccccacuauaaaauuaauagccauguuauacacuccauuacgagcgaacaaugcuggcgaugaugucuucacaguaucaugucgaguacuaacaagaccaagccccgacuuugacuuuauuuuucuuguaccuccuacaguagaaucaagaacaaaaccuuuuucaguacccguccucacaguagaagaaaugacaaacucacgcuuuccaauaccauuagaaaaauuauuuacagguccauccucagcuuucguaguacaaccccaaaacggacgauguacaacagauggaguccuacuaggcacaacacaacucucaccagucaauaucuguacauuucguggagacguaacccauaucucuggaaguagaaauuacacaaugaauuuagcaucacaaaauuggaacucauacgauccaacagaagaaauaccagcaccauuaggaacaccagacuuuguaggaaaaauacaagguguccuaacccaaacaacaagaacagaugguuccacuagaggacacaaagcuaccguauauacaggaucagcugacuucucacccaaacuuggaagaguucaauucgcaacagacaccgacaaugauuuuguaacaaaucaaaacacaaaauucacaccagucggcgugauacaagauggaaguacuacuccacgaaaugaaccacaacaauggguacuaccuucauauucagguagaaauacacauaacguacacuuagcaccagccguagcaccaacuuuuccaggcgaacaacuuuuguucuucagauccacaaugccaggcuguucuggauauccaaauauggacuuagauugcuuacuaccccaagaauggguacaauacuucuaucaagaagccgcaccagcccaaucugauguagcccuucuacgauucguaaauccagauacaggcagaguucuauuugaaugcaaauuacauaaaucaggauacguaacaguagcacacacaggacaacaugaccucguaauaccaccaaauggauacuuuagguucgauucauggguaaaucaauuuuacacauuagcuccaaugggaaauggcaccggaaggagaagagcacuauaa

SEQ ID NO: 31592 - RNA, 1623 nt, Artificial Sequence
  derived and/or modified sequence opt6 from VP1__Norovirus__AGS08104
augaaaauggcaucaagugacgccaacccauccgauggaucaacugccaaccuagucccagaaguaaauaacgaaguuauggcacucgaaccaguaguaggagcugcaauagcagccccaguagcaggacaacaaaacauaauagacccuuggauucgaaauaauuuuguacaagcaccaggaggcgaauuuaccgucucaccacgaaaugcaccaggagaaauauuauggucagcaccacuaggaccagauuuaaauccauauuuaucacacuuagcuagaauguauaacggcuacgcaggaggauucgaaguacaaguaaucuuagcuggcaaugcuuuuacagccggaaaaaucauuuuugcugcaguaccaccaaacuucccuacagaaggacuaaguccuucacaaguaacaauguucccucauauaauaguugacguaagacagcuagaacccguucucauacccuuaccagacguaagaaacaacuuuuaucacuauaaucaaagcaaugacucaacuauaaaacuaauagccauguuauauacaccacucagagcaaacaacgcaggagaugacguauuuacaguaucaugcagaguuuuaacacgucccucaccagauuucgacuucaucuuccuaguaccaccaacaguugaaucucgaacaaaaccauuuucaguaccaguacuaacaguagaagaaaugacaaauucacguuuuccaauaccacuagaaaaauuauucacaggaccaucaucagcuuucgugguucaaccucaaaauggucgcuguaccacagacgguguacuccuagguacaacucaacuauccccaguaaauauauguacauuuagaggagauguaacacauaucuccgguucacgcaauuacaccaugaauuuagcuucacaaaacuggaacucauacgaucccacugaagaaauccccgcaccccuuggaacaccagauuucguaggaaaaauucaaggaguacuaacacaaacaacaagaacagacggaucaacuagaggacacaaagcaacaguuuacacaggaucagcugacuuuuccccgaaacucggaagaguccaauuugcaacagacacagauaaugauuuuguaacuaaucaaaacacaaaauucacaccaguagguguaauacaagauggaaguacaacuccacgcaaugaaccacaacaauggguucuacccuccuacucaggaagaaauacacauaacguacaucuagcaccagccguagcacccacauuucccggagaacaacucuuauuuuuuagaucaacaaugccaggauguucuggauaccccaauauggaccuagauugcuuacucccacaagaauggguacaauauuucuaccaagaagcagcaccagcacaaucagacguagcacuccuuagauuuguaaauccagauacaggcagaguauuauuugaauguaaauuacacaaaucaggauacgugaccguagcacacacaggacaacacgacuuaguaauacccccaaauggauacuucagauucgacucuuggguaaaucaauuuuacacucuagcaccaaugggaaacggaacaggacguagacgagcuuuauaa

SEQ ID NO: 31593 - RNA, 1623 nt, Artificial Sequence
  derived and/or modified sequence opt6 from VP1__Norovirus__AGS08105
augaaaauggcuucaucagaugcaaaccccucagacgguagugcagcaaaccuaguaccagaaguaaauaaugaaguaauggcauuagaaccaguuguaggagcagcaauagcagccccuguugccggacaacagaauguuauagacccauggauaagaaauaacuuuguacaagcaccaggaggcgaauucacgguaucuccacgaaaugcacccggagaaauauuauggucugcaccuuuaggcccagaccuuaauccuuaucuaucucaucuagccagaauguauaauggauacgcaggaggauucgaaguucaaguaauauuagcaggaaacgcauuuacagcaggaaaagucauuuuugcagcaguaccaccaaacuuuccaacugaaggauuaucaccaucacaaguaacaauguuuccccauauagucguagacguccgacaacuagaaccaguauuaauuccauuaccagacguaagaaacaacuucuaucauuauaaucaaaguaaugauccaacaauaaaauuaauagcaaugcuauacacaccucuaagagcaaacaacgcuggagaugauguauuuacaguaucuugcagaguacuaacaagaccaucaccagauuuugacuuuauauuucuuguaccaccaacuguagaaucucgaacaaaaccauucucaguaccaguacuaacugucgaagaaaugacuaauucuagauuuccuauaccacuugaaaaacuauuuacaggaccuucaucugcauuuguaguccaaccacaaaacggaagauguacaacugacggaguauuauuaggaacaacacaauugucaccagucaauauauguacuuuuagaggugauguaacacacauaaccggcucacguaacuauacaaugaaucuagcaagccaaaauuggaacaacuacgauccaacagaagaaauaccagcaccacuaggcacaccagacuuugucgguaaaauccaaggaguacuuacucaaacuacacgaaccgacgguucaacaagaggucauaaagcaacagucuacacuggaucugcugacuucgcaccaaaacuaggucgaguacaauucgaaacagacacagaucaugauuuugaagccaaucaaaacacuaaauuuacaccuguaggaguaauacaagacggagguacaacucauagaaaugaaccacaacaauggguauuaccuucauauucaggaagaaauacuccuaaugugcacuuagcaccagcaguagcaccaacauuuccaggagaacaacuacuauuuuuucguucaacaaugccaggcugcucuggauauccaaacauggacuuagauugccuacuaccacaagaauggguacaauacuuuuaucaagaagcagccccugcucaaucagauguugcacuacucagauucguaaauccagauaccgggagaguacuuuuugaaugcaaauuacauaaaucaggauauguaacaguagcccauacaggacaacacgaucuuguaauucccccuaauggauauuuucgauuugauagcuggguaaaccaauuuuacacauuagcacccaugggcaaugguaccggccgacgaagagcucuauaa

SEQ ID NO: 31594 - RNA, 1623 nt, Artificial Sequence
  derived and/or modified sequence opt6 from VP1__Norovirus__AGS08106
augaaaauggcaucaagcgaugcaaauccaucagacggaucuaccgcuaauuuaguaccagaaguaaacaacgaaguaauggcacuagaaccagucgucggagcagcuauagcugcaccuguagcaggacaacaaaacguaauagauccuuggauacgaaauaacuuuguucaagcaccuggaggagaauuuaccguuucaccaagaaaugcuccaggagaaaucuuauggucagcaccuuuaggacccgauuuaaauccauauuuaucacaccuagcaagaauguacaacgguuacgccggagguuuugaaguccaaguaauauuagccggaaaugcauuuacagcugguaaaaucauauucgcugcaguucccccuaauuuuccuacugaaggauuaucaccaucucaaguaacgauguuuccacauauaauagucgacguaagacaauuagaacccguacuaauaccauuaccugauguacgaaauaauuuuuaucauuacaaccaaucaaaugacccaaccauuaaacuaauagcuaugcuauacacacccuuaagagcuaacaaugcaggagaugauguuuuuaccguuucuugucguguacucacaagaccaucaccagauuuugacuuuauauuucuaguccccccaacaguugaaucaagaacuaaaccauucucaguaccaguauuaaccgucgaagaaaugacaaacucaagauuuccuauaccauuggaaaaacuuuucacaggaccaucauccgcuuuuguaguacaaccacaaaacggacgauguacuacagacgguguucuacuaggaacaacacaacuaucgccagucaacauaugcacauuuagaggagauguaacucauauauccgguucacgcaauuacacaaugaauuuagcuucccaaaacuggaauuccuaugauccaacagaagaaauaccugcaccucuagguaccccagacuuuguaggaaaaauacaaggaguauuaacacaaacuacaagaacugacggaucaacacgaggucauaaggcaacaguauauacugguucagccgacuuuacuccaaaauuaggaagaguacaauuugcaacagacaccgauaacgauuuuguaacaaaucaaaauacaaaauuuacuccaguuggcguaauacaagacgguucuacaacaccacgaaaugaaccccaacaauggguuuuaccauccuacucaggacgaaauacucauaauguacaucuagcaccggcuguagcaccuacauuuccaggugaacaacuacuauuuuuuagaucuacuaugccagguuguucuggauacccaaauauggaccucgauugcuuauuaccacaagaauggguacaauauuuuuaucaagaagcugcuccagcacaaucagacgucgcacuacuuagauucguaaauccagacacaggacgaguauuauucgaaugcaaacuacauaaaucaggauacguuacuguagcacacacuggacaacacgaucuaguaauaccaccaaauggcuauuuccgauucgauucauggguaaaucaauucuacacacuagcaccuaugggaaauggaacuggaaggagaagagcucuauaa

SEQ ID NO: 31595 - RNA, 1623 nt, Artificial Sequence
  derived and/or modified sequence opt6 from VP1__Norovirus__AGS08107
augaaaauggcaagcagcgacgcaaauccaucugacgguaguacagcaaaucucgucccagaaguaaauaaugaaguaauggcucuugaacccguuguaggcgcagcaauagcugccccaguagcaggacaacaaaacguaaucgacccauggauaagaaauaauuuuguacaagcccccggaggagaauuuaccguaucaccuagaaacgcaccaggugaaauauuauggucagcucccuuagguccagaucuaaacccauacuuaagucauuuagcaagaauguacaacggcuaugcuggaggcuucgagguacaaguaauacucgcuggaaaugcauuuacagcugguaaaauuauauucgcagcaguaccaccgaacuuuccaacagaaggacuaucaccaucucaaguuacuauguuuccccauauuauaguugauguaagacaauuagaaccaguacuaauaccacuaccugauguuagaaacaauuucuaucacuauaaccaaucaaaugacucuaccaucaaauuaauagccauguuauacacucccuuacgagcaaacaacgcaggcgaugauguauuuacuguauccuguagaguacuaacuagaccaucaccugauuuugacuuuauauuuuuaguaccaccuacaguagaaucaagaacaaaaccauucucaguuccaauacuaacaguagaggaaaugacuaacucaagauucccaauaccacuagaaaaacuauucacuggcccaucaucagccuuuguaguacaaccacaaaacggacguuguaccacagacggaguacuauuaggcacaacacaacuuucuccaguuaauauaugcaccuuuagaggagauguaacacauaucccaggaucacauaacuauacuaugaacuuagcuucucaaaauuggaacucauacgacccaacagaagaaauaccagcaccacuaggaacaccagacuuuguaggaaaaauacaaggcguacuaacccaaacaacaucaacuaacggaucaaccagaggucacaaagcuacaguauacacuggaucagcagacuuuucaccaaaauuaggaagaguacaauucgcaacagauaccaacaacgacuucgaaacaaaucaaaauacuaaauuuacaccaguaggcguuauucaagacgguuccacaacaccucgaaacgaaccucaacaauggguuuuaccaucauauucaggaagaaauauacauaacguacaccuagcaccagcaguugcuccaacuuuuccaggagaacaauuauuauucuucagauccacaaugccaggcugcucagguuacccaaauauggaccuagauugcuuauuaccccaagaaugggugcaauauuucuaucaagaagcugcaccagcucaauccgacguagcccuacuaagauuuguaaacccugauacuggaagaguacuauucgaauguaaacuacauaaaucaggauauguaacuguagcucauacaggccaacacgacuuaguaauuccaccuaaugguuacuuuagauucgauuccuggguaaaucaauucuauacuuuagcaccaaugggcaauggaaccgguagaagaagagcccuauaa

SEQ ID NO: 31596 - RNA, 1623 nt, Artificial Sequence
  derived and/or modified sequence opt6 from VP1__Norovirus__AGS08108
augaaaauggcuuccucugaugcaaauccuucagauggcucuacagcaaaccucguacccgaaguaaacaaugaaguaauggcacucgaaccaguagucggagccgccauagcagcaccaguagcaggacaacaaaaugucauugacccauggauaagaaauaacuucguacaagcaccaggaggcgaauucacaguuucaccuagaaaugcaccaggugaaauuuuauggucagcaccacuggguccagacuuaaacccauaucuaucucacuuagcaagaauguacaacgguuacgcaggugguuucgaaguacaagugauccuagccggcaaugccuucacagcaggaaaaauaauauuugcugccguccccccaaacuuuccaacagaagguuuaucuccaucacaaguaaccauguucccacacauaauaguagacgucagacaacuagaaccaguacuuauaccauuaccagauguacgaaauaacuucuaucacuauaaccaaucuaacgacccaacaauuaaacuaauagcaauguuauacacaccauuaagagcaaacaaugcaggagaugauguuuucaccguaucaugccgcguacuaacucgaccaucaccagauuuugauuuuauauucuuaguaccacccacaguagaaucaagaacaaaaccauuuucaguucccguacuaacaguagaagagaugacaaauucacgauucccaauaccacuugaaaaauuauucacaggaccuuccucugcuuucguaguccaaccacaaaacgguagaugcaccacagacggaguacuuuuagguacuacacaacuuucaccagucaauauuugcaccuucaggggagauguaacacacauaucaggaucaagaaauuacaccaugaaucuagcuucucaaaacugguccuccuacgacccaacagaagaaaucccagcucccuuaggaacacccgacuuuguaggaaaaauacaaggaguacuaacucaaacaacaagaaccgacgguucaacaagaggccauaaagcaaccgucuauacagguucagcugacuuuucuccaaaauuaggaagaguccaauucgcaacagauacagauaacgacuucguuaccaaucaaaauacaaaauucacaccaguaggaguaauacaagauggcuccacaacuccaagaaaugaaccacaacaauggguacuaccuucauauucagguagaaauacacauaacguucaucuagcaccagcaguagcucccacauucccaggagaacaauuacuuuucuuuagauccacaaugccagguugcucaggauacccaaauauggacuuagauugccuuuuaccacaagaauggguucaauauuuuuaccaagaagcagcuccagcucaaucagacgucgcuuuacuaagauucgugaauccugauaccggccguguuuuauuugaauguaaacuacauaaauccggauauguaacaguagcacauacaggacagcaugauuuaguuauucccccaaauggcuacuuccgauucgauagcuggguuaaccaauuuuacacacuugcacccaugggcaauggaaccggacgaagaagagcucuuuaa

SEQ ID NO: 31597 - RNA, 1623 nt, Artificial Sequence
  derived and/or modified sequence opt6 from VP1__Norovirus__AGS08109
augaaaauggcaucaagcgacgcaaauccaucugacggaucugcagcaaauuuaguaccugaaguaaauaaugaagucauggcccuagaaccgguagcaggagcagcaauagcagcaccuguugcuggacaacaaaauguaaucgauccauggauaagaaauaauuuuguacaagcaccaggaggagaauuuacaguuuccccaagaaacgccccaggcgaaauccuauggucagccccauuaggaccagaucuaaacccuuaucuuucacaucuggccagaauguauaauggcuacgcaggaggauucgaaguacaaguaauacuagcaggcaaugcauuuaccgcaggcaaaguuauauucgcagcagucccacccaacuucccaacugaaggacuaucuccaucucaaguaacaauguucccacauauaguagucgacguacgacaauuagaacccgucuuaauaccauuaccagauguaagaaacaauuuuuaccauuauaaucaauccaaugauucaacuauaaaacuuauagcaauguuauacacaccauuaagagcaaacaacgccggagacgauguauuuacuguuucaugucgaguauuaacaagaccaaguccagacuuugacuucauauuucuaguaccaccaacaguagaaucaagaacaaaaccauucucaguaccaguucuaacaguagaagaaaugaccaauucucgauuuccaauaccacuagaaaaauuauuuacaggaccaucuucugcuuuugucguucaaccucaaaauggcagauguacaacagacggcguauuauuaggaacaacacaacuauccccugucaauauauguacauuuagaggagacguuacacauauaaccggcucacgaaauuauacaaugaaucuugcaucacaaaacuggaacaauuaugauccaacugaggaaauacccgcccccuuagguacaccagacuuuguagguaaaauucaagguauguuaacucaaacuaccagaacagacgguucaacaagaggacacaaagcuacaguuuauacaggaucagccgacuuugcaccaaaauuaggacgcguucaguuugaaacagacacagaucacgauuuugaagcaaaucaaaauacaaaauucacacccguuggaguaauacaagacggaucaaccacacauagaaaugaaccacaacaguggguacuaccauccuacuccggccgaaacacccacaacguacaucuugcaccagccguugccccaacauuuccuggagaacaacuacuauuuuuuagaucaaccaugccagguugcuccggauauccaaacauggaccucgauugccuucuaccucaagaauggguacaauacuuuuaucaggaagcagcaccagcccaaucugacguagcauuacuaagauucgucaacccagauaccggacgaguauuauuugaaugcaaauuacauaaaaguggauaugucacagucgcacauacaggucaacaugaucuaguuaucccaccaaauggauauuuuagauucgacucauggguaaaucaauuuuauacauuagcaccaaugggaaauggaacaggaagaagaagaguaguauaa

SEQ ID NO: 31598 - RNA, 1623 nt, Artificial Sequence
  derived and/or modified sequence opt6 from VP1__Norovirus__AGS08110
augaaaauggcaucaucugaugcaaauccaucagauggaucuacagccaacuuaguaccagaaguaaacaacgaaguaauggcacuugaaccaguaguaggagccgcaaucgcagcacccguagcaggacaacaaaaugucauagauccauggauacgcaacaacuucguacaagcuccagguggugaauuuacaguaucuccacgaaacgcaccuggagaaauauuauggucagcaccacuaggaccagaccuaaacccauaccuuucacaccucgccagaauguacaauggauacgcuggagguuuugaaguacaaguaauacuugcaggaaaugcauucacugcuggaaaaaucauauuugcagcaguaccaccuaauuuuccaacagaaggacuaaguccaucucaaguaacaauguucccacacauaauaguagacguccgacaacucgaaccaguauugauaccacuucccgacguuagaaacaauuuuuaucauuacaaccaaagcaacgacucaaccaucaaauuaauagcaauguuauauacaccauuaagagcuaauaaugccggcgacgaugucuuuacaguaucauguagaguacuaaccagaccaucaccagauuuugacuuuauuuucuuaguacccccaacaguugaaucuagaacaaaaccauuuucaguaccuguacuaacaguagaagaaaugacuaacucacguuucccaauaccacuagaaaaauuauuuacaggaccaucuucagccuucguaguccaaccccaaaacggaagauguacaacugacgguguacuauuagguaccacacaacuaucaccuguaaauaucuguacauuucgcggugacgucacacauaucccaggaucccacaauuauacaaugaauuuagcaucucaaaacuggaauucuuacgauccaacugaagaaauaccagcaccccuaggaacaccugacuuuguaggaaaaauacaaggaguauuaacucaaacaacaucaacaaauggcuccacacgaggccacaaagcaacuguuuauacaggaucagcagacuucucuccaaaauuaggucgaguucaauuugccacagauacaaacaacgauuuugaaacuaaucaaaauacaaaauucacacccguuggaguaauucaagauggaucaacaaccccuagaaaugaaccacaacaauggguccuaccaucauauucaggucgcaacauacauaacguacaccuagcacccgcuguagcacccacauuuccuggugaacaauuacuauucuuccgauccacuaugcccggaugcuccggauaucccaauauggauuuagauugccuuuuaccccaagaauggguucaauacuuuuaucaagaagcagcaccagcucaauccgacguugcacuacuacgauucguaaauccagacacaggacgaguacuauucgaaugcaaauuacauaaaucaggauacguaaccguagcacacacaggccaacacgaucuagugauaccacccaacggcuauuucagauucgauucauggguaaaucaauuuuacacucucgcuccaaugggaaacggaaccggccgaagacgagcacuauaa

SEQ ID NO: 31599 - RNA, 1623 nt, Artificial Sequence
  derived and/or modified sequence opt6 from VP1__Norovirus__AGS08111
augaaaauggcaagcucagacgcaaauccuucagacggaucaacagcaaaccuaguaccugaaguaaauaaugaaguaauggccuuagaacccguaguuggagccgccauugcagcaccaguagcaggacaacaaaacguaauagauccauggaucagaaauaauuuuguacaagcuccuggaggcgaauucaccguauccccacgaaaugcacccggugaaauauuauggucugcaccacuaggcccagaccuaaauccauacuuaucacaucuagcaagaauguauaacggauacgcuggugguuucgaaguacaagucauacucgcuggaaacgcauucacagcaggaaaaauaauuuucgcagcaguacccccaaauuucccaaccgaaggucucucacccucacaaguaacaauguucccccauauaauaguagauguaagacaacuagaaccaguucuaauacccuuaccagacguuagaaauaauuucuaccacuauaaucaaucaaaugacccaaccauaaaacuaauagcaauguuauauacaccauuaagggccaauaaugccggggacgaugucuuuaccguaucauguagaguacuaacacguccaucacccgacuuugauuuuauuuuuuuaguaccuccaaccguagaaucaagaacaaaaccauucucaguaccaguacuaacuguagaagaaaugaccaacucaagauuccccauuccacuagaaaaacuauuuaccggaccaucaucagcauucguaguacaaccccaaaauggaagauguacaacagacgguguccuauuaggaacaacacaacucucuccaguuaauaucuguacauuuagaggagauguaacccauauaccaggaucaagaaauuacacaaugaauuuagcaagccaaaacuggaacucauacgauccaacagaagaaauaccagcacccuuaggaacuccagauuucguaggaaaaauacaagguguacucacacaaacaacaagaacuaauggaucaacaagaggacacaaagcuacaguauauaccgguucagcagauuuuucaccuaaacuaggccgaguucaauuugcuacugacacagauaaugacuucgaaacuaaucaaaacaccaaauucacucccguagguguuauucaagacggaucaacaacaccaagaaaugaaccacaacaauggguacuaccaucauacucaggacgaaacauacauaacguucacuuagcacccgcaguugcaccuacauuuccaggcgaacaauuauuauucuuuagaaguaccaugccagguuguucaggcuacccaaacauggaucucgacuguuuacuaccacaagaauggguacaauauuucuaccaagaagccgcaccagcacaaucagauguagcucuauuacgcuucguaaacccugauacaggaagaguauuauucgaaugcaaacuucauaaaucuggauauguaacaguugcacacacaggucaauaugaucuaguaaucccuccuaauggauauuuuagauuugacucauggguuaaccaauuuuacacauuagccccaaugggcaacggaacaggccgaagaagagcacuauaa

SEQ ID NO: 31600 - RNA, 1623 nt, Artificial Sequence
  derived and/or modified sequence opt6 from VP1__Norovirus__AGS08112
augaaaauggcuucaucugaugcaaacccaucagauggaucaaccgcaaaucuuguuccagaaguuaacaaugaaguaauggcacuggaacccguaguuggagcagcaauagcagcaccagucgcaggucaacaaaauguaauagacccauggauacgaaauaacuuuguacaggcuccaggaggagaauucaccguauccccucgaaaugcaccuggcgaaauacuauggucugccccacuaggacccgacuuaaauccuuauuuaucucaccuagcaagaauguauaacggauacgcuggcggauucgaaguacagguaauccuagcaggaaaugccuuuacagcaggcaaaauaauauuugccgcaguuccaccaaauuuuccaaccgaaggccuauccccuucgcaaguaacuauguucccacacauaauaguugacguacgccaacuagaaccaguucuuauuccccuaccagauguuagaaacaauuucuaccacuauaaccaaucaaaugacccaacaauaaaauuaauagcaauguuauacacaccucuaagagccaauaaugcuggcgaugauguauucacaguaucaugucgaguuuuaacacgaccaucuccagacuuugacuuuauauucuuaguuccaccaacaguugaaucucgaacaaaaccauucucaguaccaguuuuaacaguugaagaaaugacuaauuccagauuccccauacccuuagaaaaauuauucacagguccuuccucagcauuuguaguacaaccacaaaacggucguugcacuacagauggcguauuauuaggaacaacacaauuaucucccguaaauauauguacauuuagaggagacguaacacauauauccggaucccgaaauuacacaaugaaucuugcaucacaaaacuggaacucauaugauccaacagaagaaauaccugcaccucuaggcaccccagauuuuguaggcaaaauacaaggagucuuaacacaaacaacaagaacagacggaucuacacguggccacaaagcaaccguauauacagguucagccgacuuuucaccuaaauuaggaagaguacaauucgcaacagauacagauaaugauuuugucacaaaucaaaauacaaaauucacuccaguaggaguaauacaagacggaagcacaacuccaagaaaugaaccacaacaauggguauuaccuuccuauucaggaagaaauacucauaauguacauuuagcuccagcaguagcaccaacauuuccuggagaacaauuacuuuuuuuccguaguacaaugccaggaugcucaggauauccaaacauggacuuagauugcuuacuaccacaagaauggguacaauacuuuuaccaagaagcagcaccagcacaauccgauguagcauuacuuagauucguaaauccagacacugguagaguauuauucgaauguaaacuacauaaauccggcuauguuacaguugcacauacaggacaacacgaucuaguaauaccaccaaauggauauuuuagauucgauuccuggguaaaucaauucuacacacuugcaccaaugggaaacggaacaggaagacgaagagccuuauaa

SEQ ID NO: 31601 - RNA, 1623 nt, Artificial Sequence
  derived and/or modified sequence opt6 from VP1__Norovirus__AGS08113
augaaaauggcaucuucagacgcaaauccuucagacggaucaacagcaaaucuaguaccagaaguuaauaaugaaguuauggcuuuagaaccugucguuggggcagcaauagcagccccaguagcaggacaacaaaauguaauagacccuuggauacgaaauaacuuuguccaagcaccuggcggagaauuuacagucucaccaagaaaugccccaggagaaauacuauggagcgcaccacucgguccagauuuaaauccauauuuaucucauuuagcucgaauguauaacggauacgcaggcgguuuugaaguacaaguaauacuagccggaaacgcauuuacagcuggcaaaauuauauuugcagcuguacccccaaacuucccaaccgaaggauuaucaccaucccaaguuacaauguucccacauauaauaguagauguacgccaacuagaacccguuuuaauuccuuuaccagacgucagaaacaacuucuaucauuauaaccaaucuaaugacccaacuauaaaacuaauagcaaugcucuauacaccauuaagagcaaauaacgcaggugacgauguauuuacaguaucauguagaguacuaacaagaccaucaccagacuucgacuuuauauuuuuaguacccccuacaguugaaucaagaacaaaaccauucucaguuccaguacuuacaguugaagaaaugacuaacucaagauuucccaucccccucgaaaaauuauuuacaggaccaucaagugcuuuuguuguacaaccacaaaauggacgaugcacaacagacggaguacuacuagguacaacacaacuuagcccaguuaauauauguacauuuagaggugacguaacacauauaucagguucaagaaauuacacaaugaauuuagccucacaaaauuggaacucauaugauccaacugaagaaaucccugcaccacuagguacaccagacuuuguaggaaaaauacaaggagucuuaacccaaacuacaagaacugacggauccacacgcggacauaaagcaacaguauacacaggaucagcagacuucucuccaaaacuuggaagaguacaauuugcaacagacacagauaaugauuuuguaacuaaccaaaauacaaaauucacucccguaggcguaauucaagacggaagcaccacaccaagaaaugaaccacaacaauggguauuaccaucauacucaggucgaaacacacauaauguacaccuagcaccagcagucgcaccuacauuuccaggugagcaauuacuauuuuuuagaagcacaaugccuggauguucaggauacccaaauauggaucuugacugccuacuuccacaagaauggguacaauauuucuaucaagaagcugcaccagcucaaucugacguagcccuucuaagauucguaaauccagacacaggacguguccuauucgaaugcaaacuccauaaaucaggauacguaacuguagcacacaccggccaacaugauuuaguaauaccaccaaauggauauuuucgauucgacucauggguaaaucaauucuauacauuagccccaauggguaauggggccggaagacguagagcacuauaa

SEQ ID NO: 31602 - RNA, 1623 nt, Artificial Sequence
  derived and/or modified sequence opt6 from VP1__Norovirus__AGS08114
augaaaauggcaucaucagacgcaaacccaucugacggauccacugccaauuuaguaccagaaguuaauaacgaaguaauggcacuagaaccaguaguaggugccgcaauagcugcacccgucgcaggccaacaaaauguaauugacccauggauacgaaauaauuuuguucaagcaccuggaggcgaauuuaccguaucaccucgaaacgccccuggagaaauccuuuggagugcaccacuaggaccugaccuaaacccuuaucuaucucauuuagcaagaauguauaacggauacgcuggagguuucgaaguacaaguuauauuagccggaaacgcauuuacagcuggaaaaauaauauuugcagcaguaccaccuaauuucccaacagaaggacuaaguccaucacaaguaacaauguuuccucacaucauaguagauguacgacaauuagaaccaguacuaauaccacuaccagauguccgaaauaauuucuaucacuacaaucaauccaaugacuccacaauuaaacuuauugcaaugcuauacacaccacucagagccaauaacgcaggugaugauguauuuacuguaucauguagaguacuaacucgcccuucaccagauuucgacuucauauuuuuaguaccuccaacuguagaauccagaacaaaaccuuuuucagucccuauauuaacaguagaggaaaugacaaacucaagauuuccaauuccauuagaaaaauuauuuacaggaccaucuucagcauucguuguacaaccacaaaauggaagauguaccacagacggaguacuacucgguacaacacaacuaaguccaguaaauaucuguaccuuccgaggagauguaacucacauaccaggcucacauaauuauacuaugaaucuugcaucacaaaacuggaacucauacgauccaacugaagaaaucccagccccacuaggaacaccagauuuuguaggcaaaauacaaggagucuuaacacaaacuacaucaacaaacggaucuacaagaggccacaaagcaacaguauauacugguucagcagauuucucaccuaaauuaggcagaguccaauuugcaacugacacaaauaacgauuucgaaacaaaucaaaauacaaaauuuacccccguaggaguaauacaagauggaucaacaacaccucguaacgaaccacaacaauggguauuaccaucauacucgggaagaaauauucacaaugugcauuuagcaccugcuguagcaccaacauuuccaggugaacaauugcuauuuuucagaucuacuaugccagguuguuccggauacccaaauauggaucucgauugcuuacucccccaagaauggguacaauauuuuuaucaagaagcagccccagcacaaucugacguagcuuuacuaagguucguuaacccagauacaggaagaguauuauucgaaugcaaauuacauaaaucaggauauguaaccguagcacacacaggacaacaugacuuaguaauaccuccaaauggauauuucagauucgauucuuggguaaaucaauucuacacauuagcaccaauggguaacgguacaggacguagacgagcuuuauag

SEQ ID NO: 31603 - RNA, 1623 nt, Artificial Sequence
  derived and/or modified sequence opt6 from VP1__Norovirus__AGS08115
augaaaauggcaucuagcgacgcuaacccauccgauggcucuacagcaaaccuaguuccagaaguuaauaaugaaguuauggccuuagaaccaguagucggugccgcaauagccgcaccaguagcuggucaacaaaauguaauagacccauggauuagaaacaacuuuguucaagcaccuggaggugaauucacaguaucaccuagaaaugcacccggugaaauauuauggucagcaccauuaggacccgaucuaaaucccuaucucucacaccuagcacgaauguauaacggauaugcaggaggauucgaaguacaaguaauacuugcaggaaacgccuucaccgcugguaaaauaauuuucgcugcaguaccccccaauuuuccaacugaaggcuuaucuccaucacaaguuacuauguuuccacacauaauaguagauguacgacaauuagaacccguucuaauaccauuaccagauguuagaaauaacuuuuaucacuauaaccaauccaaugaucccacuaucaaacuaauagcaauguuauacacaccauuaagagcaaauaacgccggagacgacgucuucaccguaucauguagaguauuaacaagaccaucaccagacuucgacuuuauauucuuaguaccaccaacaguagaaaguagaacaaaaccuuucucaguaccaguacucacugucgaagaaaugacaaacucaagauucccaauaccacucgaaaaacuauuuacaggaccaucuucagcauucguaguacaaccacaaaacggucgaugcacaacagauggaguauuauuaggaaccacucaacuaucaccagucaauauaugcaccuucagaggagacguaacacauauaucagguucucguaauuacacaaugaaccucgcaucucaaaauuggaacucauacgacccaacugaagaaauaccagcuccauuaggcaccccagacuuuguaggaaaaauacaaggagucuuaacucaaacaacaagaacugauggcuccacaagaggacacaaagcaacaguauauaccggaucagcugauuuuucaccaaaauuaggccgaguucaauuugcaacagacacugacaaugacuucguaacuaaccaaaauaccaaauucaccccaguagguguaauccaagauggaucaacaacccccagaaaugaaccacaacaauggguacucccaucauauagcgguagaaauacacauaacguacaucuagcaccagcaguagcuccaacauuucccggagaacaauuacuauucuuuagaucaaccaugccaggcuguucuggguaucccaacauggaucuagauugccuucucccacaagaauggguccaauacuucuaccaagaagcagcccccgcacaaucugauguugcauuauuacgauuuguaaaucccgauacaggacgcguucuauucgaaugcaaacuccauaaaagugguuauguaacuguagcucauacaggacaacaugacuuaguaauuccuccaaauggauauuuuagauuugauagcugggucaaucaauuuuauacauuagcuccaaugggaaauggcacaggacguagaagagccuuauaa

SEQ ID NO: 31604 - RNA, 1623 nt, Artificial Sequence
  derived and/or modified sequence opt6 from VP1__Norovirus__AGS08116
augaaaauggcaagcucugacgcaaacccaucagauggcucaguagcuaacuuaguaccagaaguaaauaaugaagucauggcauuagaacccguuguaggugcagcaauagcagcaccaguagcaggucaacaaaacguaauugacccauggauuagaaauaacuuuguacaagcaccagguggagaauuuacaguuucaccaagaaacgcaccaggagaaauauuauggucugcaccauuagguccagaucuuaauccauaucuuucucacuuagcaagaauguauaacggcuacgcuggagguuuugaaguacaaguaauacucgcugguaaugcauuuacagcagguaaaguaauauuugcugcaguaccaccaaauuucccaacagaaggacuaucuccaucacaaguuacaauguuuccacauauaguuguugacguacgacaauuagaaccaguauuaauuccuuuaccagauguuagaaacaacuucuaccacuacaaccaauccaacgacccaacaauaaaauuaauagcaaugcuauauacuccuuuaagagccaauaaugcaggugacgaugucuuuaccgugucauguagaguauuaacaagaccaucaccagauuuugacuuuauauuucuagucccaccaacaguagaaucaagaacaaaacccuuuucaguaccaguccuaacaguagaagaaaugacaaacucccgauuccccauaccccuugaaaaacuauuuacagguccuucauccgcauuuguaguacaaccacaaaauggaagaugcacaacagaugguguacuauuaggaaccacucaauuauccccuguaaacauuuguacuuucagaggagacguaacacauauaacuggauccagaaauuacacaaugaaccuagcaagucaaaacuggaacaacuaugauccaacagaagaaaucccugccccucuaggcacuccagacuuuguagguaaaauacaaggaguauuaacucaaacuacaagaacagauggaucaacccgaggucacaaagcaaccgucuauacaggaucagccgacuucgcaccaaaauuaggucgaguacaauuugaaacugauacugaucaugauuuugaagcaaaucaaaauaccaaauucaccccaguaggagucauacaagauggcggaacuacacaucgaaacgaaccacaacaauggguauuaccaucauauucaggaagaaacacccauaacguacauuuagcccccgcaguagccccaacauucccuggagaacaacuccuauucuuucgaucaaccaugccaggauguuccggauauccaaauauggaucuugauugucuucuaccacaagaauggguccaauauuucuaucaagaagcagcaccagcucaaucagacguagcauuauuaagauucguaaauccugacacaggaagagucuuauucgaauguaaauuacauaaaucaggcuauguuacaguagcacacacaggacaacaugauuuagugauccccccaaauggauauuuuagauuugacuccuggguaaaccaauuuuauacacuagcaccaaugggaaauggaacaggaagaagaagagcaguauaa

SEQ ID NO: 31605 - RNA, 1623 nt, Artificial Sequence
  derived and/or modified sequence opt6 from VP1__Norovirus__AGS08117
augaaaauggcauccucagacgcuaacccuucagauggcucaacagcuaacuuaguuccagaaguaaacaacgaaguaauggcccuugaaccaguagucggagcagcuauagcagcuccaguagcaggacaacaaaauguaauagacccuuggaucagaaauaauuuuguacaagcaccagguggugaauuuacaguaucgccacguaaugcccccggagaaauacuauggucggcuccacuaggaccagauuuaaauccauauuuaucacauuuagcaagaauguauaacggauaugcaggaggauucgaaguccaaguaauacuagcuggaaacgcauucacugcaggcaaaauuauauuugcagcuguaccaccaaacuuccccacagaaggacuaucuccaucccaaguaacaauguucccccacaucauuguagacguaagacaacuagaaccuguacuaauaccauuaccugacgucagaaauaauuuuuaucauuauaaccaaucaaaugauccaacaauuaaauugauagcaaugcuauacacaccauuaagagccaauaacgcaggagaugauguauuuacaguaucuugcagagucuuaacucgaccaucaccugacuuugauuuuaucuuucucguacccccuacaguugagucacgaacaaaaccauuuuccguaccaguauuaacaguagaagaaaugacaaacucucgauucccaauacccuuagaaaaacucuucacaggaccauccucagcauucguuguacaaccacaaaaugguagauguacaaccgauggcguguuacuaggaacuacacaacuaucaccuguaaacauauguacuuuuagaggagauguuacacauauaucuggaaguagaaauuacacaaugaacuuggcaucccaaaacuggaacucauacgauccaacagaagaaauaccagcuccacuagguacaccugacuuugucgguaaaauacaaggaaugcucacacaaacaacaagaacagauggaucaacaagaggacacaaagcaacagucuauacaggaucagcagauuucucuccuaaacuugguagaguucaauucgcaacugauacagauaacgauuuuguuacaaaucaaaacacaaaauuuacaccaguaggaguaauacaagauggaaguacaacaccaagaaaugaaccacaacaauggguauuaccaucauacucuggaagaaacacucauaacguucacuuagcgccagcuguugccccaacuuuuccaggagaacaacucuuauucuuuagaucaacaaugccaggaugcucaggauauccaaauauggaccuagauuguuuauuaccucaagaauggguacaauacuucuaucaagaagcagcuccagcccaaucagauguagcauuauuaagauuuguaaacccagauaccggaagaguauuauucgaaugcaaauuacauaaaucaggauauguaacuguagcacacaccggacaacacgacuuaguaauaccuccuaauggauacuuucgauuugacucauggguaaaucaauucuacacacuugcaccuaugggaaacggaacuggaagaagaagagcucuuuaa

SEQ ID NO: 31606 - RNA, 1623 nt, Artificial Sequence
  derived and/or modified sequence opt6 from VP1__Norovirus__AGS08119
augaaaauggcauccucagaugcaaacccaucagacggaucaacagcaaaccuugucccagaaguuaauaacgaaguaauggcuuuagaaccaguaguaggagcagcuauagcugcaccaguugcaggacaacaaaauguaauagacccuuggauuagaaauaacuuuguacaagcacccggcggagaauuuacaguuucuccaagaaaugcaccaggagaaauacuuuggucggcaccccucggaccugaccucaaccccuaucuaucgcaccucgcacguauguauaauggauacgcaggaggauuugaaguccaagucauacuagcaggaaacgcauucacagcagguaaaauaauauucgcagcaguuccaccaaauuuuccaacagaaggucuaucuccaucacaaguaacaauguucccacacauuauaguugauguacgucaacuagaaccuguacuaauaccuuuaccagauguacgcaauaacuuuuaucacuauaaucaaucgaaugacucgacaauuaaauuaauugcaaugcuauacacaccauuaagagcuaauaacgcaggggaugacguauuuacagucagcugcagaguauuaacucguccuucuccagauuuugacuuuauauuccuaguaccuccaacaguagaaucaagaacaaaaccauucucugucccaauauuaacaguagaagaaaugaccaauucacgcuuuccaauuccauuagaaaaacuauuuacaggaccaucaucagccuucgucguacaaccacaaaacgguagauguacaacagauggcguauuacuuggaacaacgcaauuauccccaguaaauauauguacauuucgcggcgacguuacucauauaccaggaucacacaauuacacaaugaaucuagcaucacaaaauuggaacucauaugauccaaccgaagaaauacccgcaccauuaggaacuccagacuucguaggaaaaauucaaggaguccuaacccaaacaacaagcacaaauggauccacuagaggucacaaagcuacuguuuauacaggaucagcagacuucaguccaaaauugggucguguccaauuugcaacagauaccaacaacgauuuugaaacaaaucaaaauacaaaauucacaccagucggcguaauccaagauggaucaaccacuccuagaaaugaaccucaacaauggguccuaccuucauauucaggaagaaacauacacaauguacacuuagcuccugcuguagcaccaacauuuccaggagaacaauuacuauuuuucagauccacuaugccaggaugcucaggauacccaaauauggauuuagauugccuacucccucaagaauggguacaauauuucuaucaagaagcagcucccgcacaauccgauguagcauuauuaagauuuguaaaccccgacacaggcagaguucuauucgaauguaaacuccauaaaucuggauacgucacuguugcucacacaggccaacacgaucuaguaauaccaccaaacggauauuuuagauucgacucaugggucaaucaauuuuauacacuagcaccaaugggcaauggaacaggacgcagacgcgcauuauaa

SEQ ID NO: 31607 - RNA, 1623 nt, Artificial Sequence
  derived and/or modified sequence opt6 from VP1__Norovirus__AGS08120
augaaaauggcauccucagacgcuaauccaucagacggauccacagcaaauuuaguacccgaaguaaacaacgaaguuauggcauuagaacccguaguaggugcagcaauagccgccccaguagcaggccaacaaaauauaauagacccguggaucagaaauaauuuuguacaagcacccgguggagaauuuaccguuucaccuagaaaugcacccggagaaauauuauggucagcuccacuaggaccagaucucaaucccuauuuaucacaucuagcacgaauguauaacggauacgcaggaggauuugaaguccaaguuauauuagcaggaaacgcuuuuacugcaggaaaaauaauauuugcagcagucccaccuaacuucccaacugaaggacuuucaccaucacaaguuacaauguucccacacauaauaguagacguaagacaauuagaaccaguauuaaucccacuaccugacguacgaaacaauuucuaccacuauaaucaaucuaaugacucaacaaucaaauuaauagcaauguuauauacaccacuuagagcaaacaaugcaggagaugauguuuuuacaguuuccugcagaguuuuaacaagaccaucuccagauuucgacuuuauauuucuaguaccaccuacuguagaaucaagaacaaaaccauuuuccguacccguauuaacagucgaagaaaugacaaacucucgauuucccauaccacuagaaaaacuauuuacaggucccucaagugcauucgucguccaaccacaaaacggaagauguacaacagaugggguucuuuuaggaacuacacaacuaucaccaguaaauauauguacuuucagaggugacguuacacauauaucuggaucaagaaacuacacaaugaaucuagcaucacaaaauuggaauucauaugauccaacagaagaaauaccagcgccacuaggcaccccagauuuuguaggaaaaauacaagguguauuaacucaaacuaccagaacagacggaucuacaagaggacacaaagcaacagucuauacaggaagugcugauuuuucaccaaaauuaggaagaguacaauucgccaccgauacagauaacgauuuuguaaccaaucaaaauacaaaguucacuccuguaggaguaauacaagacggaucaacaaccccuagaaaugaaccacaacaauggguacuacccucauacucaggaagaaauacacauaacguacacuuagcuccagcaguagcuccaacguuuccaggagaacaacuacuuuucuuuagaagcacaaugccggguugcucaggcuaccccaauauggauuuagauugccuauuaccccaagaauggguccaauauuucuaucaagaagcagcaccagcucaaucugauguagcauuauuaagauuuguaaacccagauaccggcagaguacuauuugaaugcaaacuccauaaaucagguuauguaacaguagcacauacuggucaacacgaucucguaauacccccaaacggcuauuucagauuugacucaugggucaaucaauuuuauacauuagcaccaaugggaaacggaacagguagaagaagagcacuuuaa

SEQ ID NO: 31608 - RNA, 1623 nt, Artificial Sequence
  derived and/or modified sequence opt6 from VP1__Norovirus__AGS08121
augaaaauggcaucuucugacgccaaucccucagacggaucaaccgccaauuuaguaccagaaguuaauaacgaaguuauggcauuagaaccaguaguaggugccgcuaucgcagcaccuguugcaggacaacaaaauguaauagacccauggauaagaaacaauuuuguacaagcaccaggaggagaauuuacaguaucuccaagaaacgccccaggagaaauccuuuggucagcacccuuagguccagauuuaaacccuuaccuuucacacuuagcuagaauguauaauggauacgcugguggauuugaaguucaaguuauauuagcaggcaacgcauucacagcuggaaaaauuauuuuugcagcagucccaccaaauuucccaacagaaggacuaucacccucacaaguaaccauguuuccacauauaaucgucgauguaagacaauuagaacccguuuuaauaccauuaccugacguaagaaacaauuucuaucauuacaaucaaucaaaugacucaacaauaaaguuaaucgcaaugcuauauacaccacuaagagcuaacaacgcaggagaugauguuuuuacaguauccuguagaguacucaccagaccaucccccgacuuugacuuuaucuuucuaguaccaccuacaguagaaucucgaacuaaaccuuucucaguucccauacuaacagucgaagaaaugacaaacuccagauuuccaauaccauuagaaaaauuauucaccggaccuucaucugcuuuuguaguacagccacaaaauggacgcugcacaacagacggaguccuacuuggcacaacacaacuaucaccaguaaacauauguacauuccgaggagacguaacacauauaccagguucacacaauuacacaaugaauuuagcaucacaaaauuggaacucauacgauccaacugaagaaaucccugcaccauuagguacuccagacuucguaggaaaaauacaaggaguccuaacucaaacgacaagcacaaaugguucuacacgcggacacaaagccacaguauacaccggauccgcagacuuuucuccaaaauuagguagaguucaauuugcaacagauacaaauaacgauuuugaaaccaaucaaaauacaaaauuuacaccaguagguguaauccaagacgguucaacaacaccaagaaacgaaccucaacaauggguacucccaucauauuccggacguaacauacacaauguacacuuagcaccagcaguagccccaacauuucccggagaacaguuacuguuuuucagaucaacaaugccuggauguucuggcuauccaaauauggaucuagacugcuuacuaccacaagaauggguacaauauuuuuaccaagaagccgcaccagcacaauccgauguagccuuacuaagauuuguuaacccugacaccggacguguauuauucgaauguaaacuacauaaaucuggauauguaacaguugcacauacuggacaacacgaucucguuauaccacccaauggauauuuuagauuugauucuuggguaaaccaauuuuacacucucgcaccaaugggaaauggaacagguagaaggcgugcacuauaa

SEQ ID NO: 31609 - RNA, 1623 nt, Artificial Sequence
  derived and/or modified sequence opt6 from VP1__Norovirus__AGS08122
augaaaauggcuuccucagacgccaauccuucagauggcagcacagcaaaucuaguaccagaaguaaauaaugaaguaauggcacuugaaccaguaguaggagcagcaauugcagcaccuguugcuggacaacaaaauguaauagaccccuggauacgcaauaauuuuguacaagcacccggaggugaauuuacaguuucaccaagaaaugccccaggagaaaucuuauggucagcaccccuagguccagaucuaaauccauaccucucccaccuagccagaauguauaacggauacgcagguggcuuugaaguacaaguaauccuagccggaaaugcuuucacagcuggaaaaauaauauucgcagcaguaccuccgaauuucccaaccgaagguuuaucuccaucacaagucacaauguucccacauauuauagucgacguacgucaacuagaaccaguucuaauaccacuacccgauguaagaaauaauuuuuaucauuauaaccaaucuaacgauccuacaauuaaauuaauagcaauguuauacacaccacuaagagcuaacaaugcaggcgacgacguuuuuacaguaucaugcagaguccuaacaagaccaucaccagacuuugacuucauauucuuaguacccccaacaguugaaucgagaacaaaaccuuucucaguccccguacuaacaguagaagaaaugacuaacucaagauucccaauaccauuagaaaaauuauuuacaggaccaucaucagcauuugucguccaaccacaaaauggaagauguaccacugacggcguacuacucggaacaacacaacucucuccagucaauaucuguacuuucagaggcgacguaacacauauaaguggaucacgcaacuauacaaugaaucuagcaucacaaaacuggaacucauaugauccaacugaagaaauaccugcaccacuaggaacaccagauuuugucggaaaaauacaagguguacuaacacaaaccacaagaacagaugguucaacuagaggucauaaagcuacaguauauacaggauccgcugacuuuucuccaaaauuaggaagaguacaauucgcaacagauacagauaacgauuuugucacaaaucaaaacacaaaauucacaccaguagguguaauacaagauggcaauacuaccccacgaaaugaaccacaacaauggguauuacccucauacuccggaagaaacacucauaauguacacuuagcaccagcaguagcacccacauuuccaggugaacaauuauuauuuuuuagauccaccaugccaggaugcucaggauaucccaauauggaucuagauugcuuauuaccacaagaauggguacaauacuucuaucaagaagcugcaccagcacaauccgacgucgcucuacucagauucgucaaucccgacacaggaagagucuuauucgaauguaaacuucacaagccaggauauguaacaguagcacauacaggacaacaugaccuagucaucccacccaacggauauuuucgauucgauucauggguaaaucaauucuacacauuagcaccaauggguaacggaacuggaagacgaagagcccuauaa

SEQ ID NO: 31610 - RNA, 1623 nt, Artificial Sequence
  derived and/or modified sequence opt6 from VP1__Norovirus__AGS08124
augaaaauggcaucaucagaugcuaacccaagugaugguucaacugcaaauuuaguaccugaaguaaacaaugaagucauggcccuagaaccaguagucggagcagcaauagcagcaccuguagcaggacaacaaaauguaauagacccauggauuagaaauaacuucguacaagccccagguggagaauucacaguuucaccaagaaaugccccuggugaaauauuauggucagcuccucuaggaccugaucuaaauccauaccuuucacaccuugcacgaauguauaacgguuaugcaggcggcuuugaaguacaaguaauauuagcaggaaaugcuuuuacagcuggaaaaauuauauuugccgccgucccaccaaacuuccccacagaaggccuaucacccucccaagucaccauguucccucacauaauaguagacgucagacaacuagaaccuguucuaauaccccuucccgauguaaggaacaauuucuaucauuauaaccaauccaacgacccaacaauaaaacucauugcaaugcuauauacaccucucagagcaaacaacgcuggagaugaugucuuuacaguaucaugucgcguacuaacacgaccaucaccagauuucgacuuuauauuucuaguaccccccacuguagaaucccgaacaaaaccguuuucaguacccguccuuacaguagaagaaaugacaaacucaagauuucccauaccucuagaaaaauuauuuacaggaccauccggagcauuuguuguucaaccacaaaacggacgcugcaccacagauggagucuuacuuggaaccacacaauuaucaccaguaaauauuuguacauuccgaggcgacgucacucacaucucaggcucaagaaauuacacaaugaauuuagcuucacaaaacuggaauucuuaugauccaacagaagaaaucccagccccacuaggaacaccagauuucguaggaaaaauacaaggcguauuaacacaaaccacuagaacagauggcuccacgagaggacacaaagccacaguauacacugggucagcugauuuuucaccaaaacuaggcagaguccaauucgcaacugauacagacagcgauuuuguuaccaaccaaaauacuaaauuuacaccaguaggaguaauccaagacggcucaacaacuccacgaaacgaaccacaacaauggguacuaccaucauauucaggaagaucaacccauaacguacaccuugcaccagcaguagcaccuacauucccuggcgaacaauuacuauucuuccguucaacaaugccaggaugcucagguuauccaaauauggauuuagauugccuucuuccacaagaauggguacaauauuucuaccaagaagcagcacccgcacaaucagauguagccuuauuaagauucguaaauccagauacaggcagaguccuuuucgaaugcaaacuacacaaaucagguuauguaacaguagcacauacaggccaacaugauuuagucauaccaccaaacgguuacuuuagauuugauucuuggguaaaucaauucuacacauuagccccaauggguaauggaacuggacgacgaagagcauuauaa

SEQ ID NO: 31611 - RNA, 1623 nt, Artificial Sequence
  derived and/or modified sequence opt6 from VP1__Norovirus__AGS08125
augaaaauggcaucaucugaugcaaacccuucagauggaucugcagcaaaucuaguacccgaagucaacaaugaaguaauggccuuagaaccuguaguaggugccgcaauagcagcaccaguagcaggccaacaaaauguuauagauccauggauaagaaacaauuucguccaagcccccggaggagaauucacaguaucuccccgaaaugcaccaggcgaaauauuaugguccgcaccauuagguccugauuuaaauccuuaucucucucaucuagcucgaauguauaacggauacgcuggcggauucgaaguacaaguaauuuuagcaggaaaugcauucacagcagguaaagucauauucgccgcaguuccaccaaauuuuccaacagaaggauuaucuccaucacaaguaacuauguuuccacacauagucguagacguacgacaacucgaaccaguucuaauaccccuaccagauguacgaaacaauuucuaucauuacaaccaaucaaaugacccaacuauuaaauuaauagcaauguuauacacuccauuaagagcuaacaaugcaggagaugauguauuuacaguuaguugucgcguauuaacuagaccaucgccagacuuugacuuuauauuuuuaguaccaccaacugucgagaguagaacaaaaccuuucucagucccaguauuaacaguugaagaaaugacaaacucuagauucccaauaccauuagaaaaauuauuuaccggcccaucuucagcauucguuguccaaccucaaaacggucgaugcaccacugauggaguacucuuaggaacaacacaauuaucaccaguuaacauauguacauuuagaggagacgucacacauaucacaggaucuagaaauuacacaaugaacuuagcuucacaaaacuggucuaacuaugacccaacugaggaaauaccagcaccccuaggaacaccagauuucgucggcaaaauucaaggaguauuaacccaaacaacaagaacagacggaucuacaagaggacacaaagcaacugucuacacagguagcgcaguauuugcaccaaaauuaggaagaguacaauuugaaacagacacagaccacgauuucgaagcaaaucaaaauacgaaauucacaccaguuggcguaauucaagauggaagcacaacacacagaaacgaaccucaacaauggguuuuacccucauauucaggaagaaauacaccaaauguacaucuagcccccgcaguugccccaacauuuccaggagaacaauuacuauucuuuagaucuacaaugccaggauguucuggauauccaaauauggaccuagauuguuuacuaccucaagaauggguacaauauuucuaucaagaagcagcaccagcacaaucugauguagcuuuacuaagauucguaaauccagacacaggccguguucuauucgaauguaaacuacauaaaucuggauaugucaccguagcacauacuggacaacaugacuuaguuauaccaccaaauggauauuuuagauucgacucauggguuaaucaauuuuacacucuagcaccaaugggaaauggaacaggacgcagacgagcucuuuaa

SEQ ID NO: 31612 - RNA, 1623 nt, Artificial Sequence
  derived and/or modified sequence opt6 from VP1__Norovirus__AGS08126
augaaaauggccucaucagaugcaaaccccagugacggaucugcagcaaaccuaguaccugaaguaaauaaugaaguaauggcacuugaaccaguagucggagcagcaauugcugcacccgucgcuggacaacaaaauguaaucgacccuuggauuagaaauaauuucguacaagccccaggaggagaauucacaguaucuccucgaaaugcaccuggagaaauuuuauggucagccccacuaggaccagauuuaaacccauaucuaucacaucuugcaagaauguauaaugguuaugcaggcgguuuugaaguccaagucauauuagcuggaaacgcauuuacagcaggcaaaguaaucuuugcagcuguaccaccuaauuucccaacagaaggacuaucaccaucacaaguaacuauguuuccacacauaguaguagacgucagacaauuagaaccaguacuuaucccauuaccugauguuagaaacaauuucuaucauuauaaccaaucaaacgauccaacaauaaaguuaauagcaaugcuauacaccccacuaagagcuaacaacgcaggagaugauguauucacuguaagcugucgagugcuaaccagaccaucuccugacuuugacuuuauauuccucguaccuccuacaguagaaucccgaacuaaacccuuuaguguaccaguauuaacaguugaagaaaugacaaauucaagauuuccuauaccuuuagaaaaacuauuuacuggaccaucuuccgcuuuuguaguacaaccacaaaaugguagaugcacaacagacggaguauuauuaggaaccacucaacuaucaccaguaaacauaugcacuuuuagaggcgacguaacccauauaacaggaucaagaaauuauacaaugaauuuagccagucaaaauuggaauaauuacgacccaacagaagaaauuccagcaccauuaggcacaccagauuuugucggaaaaauucagggaguuuuaacacaaacaaccagaacagaugguucaacacgaggccacaaagccacuguauauacagguuccgcugacuuugcaccaaaauuaggaagaguacaauucgaaacugauacagaccacgacuucgaagcaaaccaaaacacaaaauuuacuccaguaggaguaauacaagacggaggaacuacacaucgaaaugaaccacaacaauggguacuaccauccuauaguggaagaaauacucauaacguacaccuugcaccagcaguagcaccuacauuuccaggugaacaacuccuuuuuuuucgcucaacaaugccaggaugcucaggauauccaaauauggaucuagauugccucuuaccucaagaauggguucaauauuucuaucaagaagcagcaccugcucagucagacgucgcuuuauuaagauucguaaauccagauacuggacgaguacucuuugaaugcaaacuucauaaaucaggauauguaacagucgcccacaccggacaacacgauuuaguuauacccccaaauggcuauuucagauuugauucauggguaaaccaauucuacacauuagcuccaauggguaauggaacaggacgaagaagagcaguuuaa

SEQ ID NO: 31613 - RNA, 1623 nt, Artificial Sequence
  derived and/or modified sequence opt6 from VP1__Norovirus__AGS08127
augaaaauggcuucuucagacgcaaauccaagcgauggaucaaccgcaaaccuaguuccagaaguaaacaaugaaguuauggcuuuggaacccgucguaggcgcugcaauugcggcaccaguugcaggacaacaaaauguuauagacccauggauaagaaauaauuuuguacaagcacccgguggcgaauuuacaguauccccuagaaaugccccaggagaaauccuauggucagccccucucggacccgaucuuaauccuuaucuaucucaucuagcaagaauguauaacggauaugcagguggauucgaaguacaaguaauauuagcaggaaacgcauuuacagcaggaaaaauaauauucgcagcagucccaccaaacuuuccuacugaaggacuaucaccuucacaaguuacaauguucccccacaucauaguagacguaagacaacucgaaccuguacuaauaccacuacccgacguacguaacaauuucuaucacuacaaucaaucaaaugauccaacgauaaaacuuauagcaauguuauacacaccauuaagagcaaauaacgcuggagacgauguuuuuacaguauccugccgaguucuaacaagaccuucuccagacuucgacuuuaucuuucuaguaccucccacaguagaaucaagaacuaaaccauuuucaguaccuguccuaacaguagaagaaaugacuaacucacgauuuccaauuccacuagaaaaauuauuuacaggaccaucaagcgcuuucguaguacaaccacaaaauggaagaugcacuacugauggaguacuauuaggaacaacacaauugucacccgucaauauaugcacauucagaggagacguaacacauauaucaggaucuagaaauuacacaaugaaucuagcaucucaaaacuggaauucauacgauccaacugaagaaaucccagcaccacuaggaacaccagacuuugucggaaaaauacaagguguacucacacaaacuacaagaacagacggauccacaagaggacacaaagcuacagucuauacagguucagcagacuucucaccaaaacuaggucgaguacaauucgcaacagauacugacaacgauuucguuaccaaucaaaacacaaaauuuacaccaguaggaguaauacaagacggaucaacaacaccaagaaaugaaccacaacaauggguacuaccauccuacaguggcagaaauacucacaacguccaccuagccccagcaguugcuccaacauuuccaggagaacaauuacuuuucuuccgcuccacaaugccagguuguucuggauaucccaauauggaucuagacugccuguuaccacaagaauggguacaauauuuuuaucaagaagcagcaccagcacaaucugacguugcauuauuaagauucguaaacccagauacugguagaguauuauuugaaugcaaauuacauaaaucgggauauguaacagucgcacacacuggacaacacgauuuaguaauaccaccaaauggauauuuucgauucgauucuuggguaaaucaauuuuauacacuagcuccaaugggaaacggcaccggacgaagaagagcacuauaa

SEQ ID NO: 31614 - RNA, 1623 nt, Artificial Sequence
  derived and/or modified sequence opt6 from VP1__Norovirus__AGS08128
augaaaauggcuuccagcgacgcaaauccuucagaugguucaacagcaaaccuaguaccagaaguaaacaaugaaguuauggccuuagaacccguuguuggcgccgcuauagccgcacccguagcaggacaacaaaauguaauagauccauggauaagaaauaauuucguucaagccccagggggcgaauucacagugucaccacgaaaugcuccaggagaaauauuaugguccgcacccuuaggcccagaucuuaauccuuaucucucccacuuagcaagaauguauaacgguuaugccggaggauucgaaguucaaguaauauuagcagguaacgcauucaccgcuggaaaaauaauauuugcagcaguuccaccaaauuuuccaacagaaggacucucaccaucucaaguaacaauguuuccucacauaauaguugauguucgacaacuggaaccaguucuaauacccuuaccagauguaagaaacaauuuuuaccauuacaaucaauccaacgacccaacuauaaaauuaauagcaauguuauacacaccuuuacgagccaauaaugcaggagacgacguuuucacuguaaguuguagagucuuaacuagaccauccccagacuuugacuucaucuuucuaguuccaccaacaguagaaucacgaacuaaaccuuuuagugucccaguacuaaccgucgaagaaaugacaaacucacgauuuccuauaccauuagaaaaacuuuucacaggaccaucauccgcauuuguaguacaaccucaaaacggucgauguacaacagacgguguauuacuaggaacaacucaacuuuccccaguaaauauuuguacauuuagaggcgacguuacgcauauaccaggcucacgaaauuauacaaugaaccuagcgucacaaaacuggaacucuuacgauccaacagaagaaauaccagcaccacuaggaacaccagacuucguagguaaaauacaaggaguacuaacacaaacaacaagaacugacgguucaacacguggacacaaagcaacaguauauacggguucagcugacuuuucccccaaacuaggaagaguucaauucgcaacagacacagauaaugauuucgucacaaaucaaaauacaaaauucacaccaguuggaguuauacaagaugguuccacaacccccagaaaugaaccacaacaauggguauuaccuaguuauaguggacgaaacacacauaacguacauuuagcaccagccguagcaccaacauucccaggagaacaauuauuauuuuuuagaucaacaaugcccggcuguucaggauauccaaauauggauuuagauugcuuacuuccccaagaauggguucaauacuuuuaucaagaagcagcuccagcacaaucugacguagcauuauuaagauuuguaaauccugauacaggaagaguccuuuucgaauguaaacuacauaaaucaggcuaugucacaguagcacacaccggacaacaugauuuaguaauaccacccaacggauacuucagauuugauuccuggguaaaucaauuuuacacauuagcacccaugggaaauggaacaggaagacgaagagcauuauaa

SEQ ID NO: 31615 - RNA, 1623 nt, Artificial Sequence
  derived and/or modified sequence opt6 from VP1__Norovirus__AGS08129
augaaaauggcaucuucagaugcaaacccaucugauggcuccacagccaauuuaguaccagaaguuaacaaugaagucauggcacuagaaccaguugucggagcugcaaucgccgccccaguagcaggacaacaaaauguaauugacccauggauaagaaauaacuuuguacaagcaccaggaggagaauucacuguaaguccacgaaacgcaccaggagaaauauuauggucagcuccacuaggaccugaucuaaauccauaccuuucucauuuagcacgaauguauaaugguuaugcaggaggauucgaaguccaaguaauacuagcaggaaacgcauucaccgcggguaaaauuauuuucgcagccguaccaccaaauuucccaaccgaaggacuaucuccaucacaaguaacaauguucccacacauaauaguagauguaagacaauuagaaccaguucucaucccacuuccagacguaagaaauaacuucuaucauuacaaccaauccaacgauccuacaauaaaauuaauagcuaugcuauacacaccacuaagagcaaacaaugccggagacgaugucuucacaguauccugccgcgucuuaacacgaccaucacccgacuucgauuucauauuccucguaccaccaaccguagaaucaagaacaaaacccuucucaguaccaguuuuaaccgucgaagaaaugacuaacucucgcuucccaauaccauuagaaaaauuauuuacaggaccaucaucugccuuuguaguacaaccucaaaacggacgauguacaacagacggaguacuauuaggaacaacacaauuaucaccaguaaauauauguacauuucgcggagauguaacacauauaucaggcucacacaacuacacgaugaaccuagcaucucaaaacuggaauucauacgacccaaccgaagaaauaccggcaccucuaggcacaccagacuuuguaggaaaaauacaaggaauguuaacacaaacaacaagaacagacggaucaacccguggacauaaagcaacaguauauacugguucaguugacuucucuccaaaauuagguagaguacaauucaccacagacacagacaacgauuucgaaacaaaccaaaauacaaaguuuacaccaguaggaguaauucaagacggcucuacgacacaccgaaaugaaccacaacaaugggucuuaccaucauauaguggaagaaauacacacaacguccaucuagcaccagccguagcaccgacauuuccaggagaacaacuccuauucuuuagauccacaaugccaggcuguuccggauauccaaacauggauuuagauuguuuacuaccacaagaauggguacaauauuuuuaucaagaagcugccccagcacaaucugacguugcacuucuaagauuugucaacccagacaccggcagagucuuauucgaauguaaacuacauaaauccggauauguuacugucgcacauacaggacaacacgauuuaguuauuccacccaacggauacuuuagauucgauucuuggguaaaucaauuuuauacacuagccccaaugggaaacggaacaggaagaagacgagcauuauaa

SEQ ID NO: 31616 - RNA, 1623 nt, Artificial Sequence
  derived and/or modified sequence opt6 from VP1__Norovirus__AGS08130
augaaaauggccucaucagaugcaaacccuucagauggcucaacagcaaaucuaguaccugaaguuaacaaugaaguaauggcacuagaaccaguaguuggugccgcaaucgcugcccccguagcuggacaacaaaauguaauagauccauggauacgaaauaacuucguacaagcaccaggcggcgaguuuacugucucaccacgaaaugcaccaggagaaauacuauggucagccccacuaggcccagaucucaauccauaucuuucacacuuagcaagaauguauaacgguuaugcaggaggcuucgaaguacaagucauacucgcuggaaaugcauuuacagcagguaaaaucauauuugcagcaguaccuccaaauuuuccaacagaaggucuuucaccaucacaaguaaccauguucccacacauaauaguagacgucagacaacuagaaccaguauuaauaccauuacccgauguaagaaacaacuuuuaucacuacaaucaaucaaacgauccuaccaucaaacucauagcuauguuauauacaccauuacgcgccaacaaugcaggugaugauguuuuuacuguaucuuguagaguuuuaacacgaccaucaccugacuuugacuuuauauuccuagucccaccaacaguugaaucaagaacuaaaccauuuucaguuccaguuuuaaccguagaagaaaugacaaacuccagauuuccaauaccacuagaaaaacuauuuacaggaccaucaucugccuuuguaguccaaccacaaaacggcagaugcacaaccgacggaguacuuuuaggcacaacucaacuaucuccuguaaauauauguacauuucgaggcgacguuacacacauaucugguagucgcaauuacacaaugaaucuagcuucccaaaacuggaauucauacgauccaacagaagaaaucccagccccuuuaggaacaccagauuucguaggaaaaauccaaggaguacuaacccaaacaacaagagcagacggaucaacccgaggucauaaagcaacuguauauacuggaucagcagacuuuucuccaaaacuaggaagaguacaauuugccacagauacagauaacgacuucgucgcaaaucaaaauacaaaauucacaccaguuggaguaauacaagaugguucaacaacaccaagaaaugaaccucaacaauggguauuaccaucuuauucaggcagaaauacacauaauguacacuuagcaccagcagucgcuccaacauuuccaggugaacaacuacuauuuuuuagaucaacaaugccaggauguucaggauauccaaauauggaucuagacugccuccuaccacaagaauggguacaauauuucuaucaagaggccgcaccagcacaaucugacguagcacuucuucgauucguaaauccagacacaggccgaguacuuuucgaaugcaaacuacauaaaaguggauacgucaccguagcucauacaggacaacacgaucuaguaauaccaccaaacggcuauuuuagauuugauuccuggguaaaccaauuuuauaccuuagcacccaugggaaacgguacaggucguaggcgagcacuauaa

SEQ ID NO: 31617 - RNA, 1623 nt, Artificial Sequence
  derived and/or modified sequence opt6 from VP1__Norovirus__AGS08131
augaaaauggcaucuucagaugcuaacccuuccgaugguucugcugcaaauuuaguaccugaaguaaauaaugaaguaauggcacuagaaccaguaguaggcgcugcuauagcagccccaguugcaggacaacaaaacguaauagacccuuggauacgaaauaauuuuguacaagcaccaggcggugaauuuaccguaucacccagaaaugcaccaggugaaauacuauggucugcuccauuaggaccagacuuaaaucccuaucuaucacaccuagcuagaauguauaacggauaugcaggcggauuugaaguacaagucauccuagccggaaaugcauucacagcuggaaaaguuauauucgcugcaguaccaccuaauuucccuacagaagggcucucuccaucccaagucacuauguuuccacauauaguaguagacguuagacaacuagaacccguucuaauuccacuaccagauguacgaaacaauuuuuaucacuauaaucaaucaaacgacccaacaauuaaauuaauagcaaugcuauauacuccucuaagagcaaauaacgcaggagacgauguauuuaccguuuccugcagaguacucacacgaccaaguccugauuuugacuuuauauucuuaguaccaccuacaguagaaucaagaaccaaacccuuuucaguaccuguauuaacaguugaagaaaugacaaauucaagauuuccaauaccauuagaaaaacuauuuacaggaccuucauccgcauucguaguucaaccccaaaauggaagaugcacaaccgacggaguauuauuaggaacuacacaacuuagcccaguuaauauuuguacauucagaggaaauguaacucauauaacaggaucaagaaacuauacaaugaacuuagcaucacaaaacuggaauaacuaugauccuaccgaagaaauuccagccccauuaggaacuccagacuucguaggaaaaauacaaggaguauuaacacaaacaacaagaacagacggaucaacaagaggucacaaagcaacaguauauauaggaucggcagauuuugccccaaaacucggacguguucaauuugaaaccgauacagaucacgauuucgaagcuaaucaaaauacuaaauucacacccguagguguuauacaagauggcggaacaacccaucgaaaugagccacaacaauggguucuaccaucauauucaggaagaaacacacacaauguucaucuugccccagcuguagcaccaacauuucccggcgaacaauuacuuuuuuuccgaucaacuaugccuggcuguucaggauaucccaauauggauuuagauugcuuacuaccacaagaauggguucaauacuuuuaccaagaagcugccccagcccaaucagauguagcccuauuaagauucguuaauccagauacuggaagaguacuauucgaaugcaaauuacauaaauccggauauguaacuguugcacauacaggacaacacgauuuaguaauaccaccaaacggcuauuucagauuugacucauggguuaaucaauucuauacucuagcaccaaugggaaauggaaccggaagaagacgggcaguauaa

SEQ ID NO: 31618 - RNA, 1623 nt, Artificial Sequence
  derived and/or modified sequence opt6 from VP1__Norovirus__AGS08132
augaaaauggcuucaucagacgcaaacccaucagauggaucuacagcaaauuuagucccagaaguaaacaacgaaguaauggcacuugaaccaguagucggagcagccauugcugcaccuguagcaggacaacaaaauguaauagacccauggauucgaaauaacuuuguacaagcacccggaggugaauucacaguaucccccagaaaugcacccggagaaauauuauggucugcaccacuaggaccagaucuaaaucccuacuuaucacauuuagcucgaauguauaacggauaugcuggaggauucgaaguucaaguaauacuugcgggaaacgcuuuuacagcaggaaaaauaauauucgcagcaguuccaccaaacuucccaacagaaggucuaucuccaucacaaguaacaauguuuccacacauaauaguagauguuagacaauuagaaccaguacuaauaccauuaccagauguacgcaacaacuucuaucacuacaaccaaucuaaugauccuacaauuaaacuaauagcuaugcuauacacaccacuaagagcaaacaaugcaggagacgauguauuuacaguguccuguagaguuuuaacuagaccaucaccagauuucgacuucauuuuuuuaguuccaccuacaguagaauccagaacaaaaccauucucaguaccgguacuaacaguugaagagaugacaaacucaagauuuccaaucccauuggaaaaacucuucacaggaccauccucagcuuucgucguacaaccacaaaacggaagauguacuacagauggaguacuuuuaggaacaacacaauuauccccaguaaacauuuguacauuuagaggagauguuacacauauaucaggaucucacaauuauacaaugaaucuugcaucccaaaacuggaauucauacgacccaacugaagaaauuccagcaccacucggaacaccagauuuuguaggaaaaauacaaggaguacuuacccaaaccacaagaacagauggaucuacacgaggucacaaagcaacaguuuauacuggaucugccgauuuuuccccaaaacuaggaagaguacaauuugccacagauacagauaaugauuuugaaaccaaucaaaacaccaaauuuacaccaguaggcguuauacaagacggaggcaccacacacagaaacgaaccacaacaauggguacuccccucauauuccggacgcaauauccacaauguacacuuagccccagcaguugcacccacauuuccaggagaacaacucuuauuuuuuagauccacaaugccaggaugcucugguuaucccaacauggacuuagauugcuuauuaccucaagaauggguacaauauuucuaucaagaagcugcuccagcacaaucugacguagcauuacuuagauucguuaacccagauacaggacgcguacucuucgaauguaaauuacauaaaucuggauaugucacaguugcucacacuggacaacacgaccuaguaauaccacccaauggcuauuucagauuugauagcuggguuaaccaauucuacacuuuagcaccaaugggcaauggcacaggccguagacgagcacuauaa

SEQ ID NO: 31619 - RNA, 1623 nt, Artificial Sequence
  derived and/or modified sequence opt6 from VP1__Norovirus__AGS08133
augaaaauggcuucaucugacgcaaacccaucagauggaucaacagcuaacuuaguaccagaaguaaacaaugaaguaauggcacuagaaccaguaguaggagcagcaauagcagcuccaguugcaggucaacaaaauguuauugauccuuggauaagaaacaacuucguucaagcaccagguggagaauuuacaguuaguccaagaaacgcacccggagaaauacuaugguccgcaccauuaggaccagaucuaaauccauacuuaucacaucuugcaagaauguauaaugguuacgcaggaggauucgaaguacagguaauccuagcaggaaaugcauucacagcugguaaaauuauauucgcugcagucccaccaucauuuccaacugaaggcuuaucaccaucucaaguaacaauguucccacauauaauuguugacguaagacaacuagaaccaguacuaauuccccuacccgauguaagaaacaauuucuaccacuacaaccaaucaaaugauccaaccauuaagcuaauugcaaugcuuuacacaccauuacgagcuaauaacgcaggagacgauguauuuacuguuuccuguagaguauuaaccagaccaaguccugauuuugauuuuauauuccuaguaccaccuacugucgaaucaagaacuaaaccuuucaguguaccaguccuaacugucgaagaaaugacuaacaguagguuuccaauaccuuuagaaaaauuauuuacaggaccaucaucagccuucguuguacaaccacaaaacggaagauguacaacugaugguguacuccucggcacaacacaacuaucaccuguaaauauaugcaccuuuagaggagacguaacacauaucuccggaaguagaaauuauacaaugaauuuagcaagccaaaacuggaauucauaugauccaacagaagaaauucccgcaccauuagguacaccugauuuuguaggaaaaauccaaggcguauuaacacaaacaacucgaacugacggaucaacaagaggacauaaagcaacaguauacacagguuccgccgacuuuuccccaaaauuaggcagaguucaauuugcuacagauaccgacaaugauuuuguaacuaaucaaaacacuaaauuuacaccaguaggaguaauucaagaugguucaacaacaccaagaaacgaaccacaacaauggguauuaccaucuuauucuggacgaaauacccauaacguccaucucgccccugcaguagccccuacauuuccaggagaacaauuauuauucuuucgaucaacaaugccaggaugcucuggauauccaaauauggaccuugauugcuuauuaccacaagaauggguacaauauuucuaccaagaagcagcacccgcacaaucagauguagcacuucucagauuuguaaacccagacacaggacgaguauuauucgaauguaaauuacauaaaaguggauacguaacaguagcacacacuggucaacaugauuuaguaauaccaccgaauggauauuucagauucgauaguuggguaaaccaauuuuauacacuagcacccaugggaaauggaacuggaagaagacgagcauuauaa

SEQ ID NO: 31620 - RNA, 1623 nt, Artificial Sequence
  derived and/or modified sequence opt6 from VP1__Norovirus__AGS08134
augaaaauggcuucaucagacgcuaauccuucagauggaucaacagcaaacuuaguaccagaagucaacaacgaaguaauggcacuagaaccuguaguaggcgcagcaauagcagcaccaguagcaggucaacaaaauguaauagaccccuggauaagaaacaacuucguacaagccccaggaggugaauucacaguauccccccgaaaugcaccuggagaaauacucuggucugcccccuuaggucccgaucuuaauccauauuuaagucaccucgcaagaauguauaacggauacgcuggaggcuucgaaguccaagucauuuuagccggaaaugccuuuacugcuggaaaaauaauauucgcagcagucccaccaaacuuuccaacagaaggacuuagccccucccaaguaacaauguucccacauauaauaguugauguucgucaacuagaaccaguauuaauaccauuaccggauguaagaaauaacuuuuaucacuacaaccaaucaaaugauuccacuaucaaacuaauagcaaugcucuacacuccacuucgagcaaacaacgcaggagaugacguauuuacaguaucaugcagaguacucacaagaccaucacccgacuucgauuuuaucuuccucguaccuccaacuguugaaagucgaacaaaacccuuuucaguuccuauauuaaccguagaagaaaugacaaacagcagauuucccauaccauuagaaaaacuauuuacaggaccuucaucagcuuuugucguacaaccacaaaacggacgaugcaccacugacggaguacuuuuaggaaccacucaacuaucaccaguaaacguaugcacauuuagaggagacguaacacauauucccggaucacacaauuacacuaugaaucuagcaucacaaaacuggaauucuuacgauccaacagaagaaauccccgcaccgcuaggaacaccagacuuuguaggaaaaauucaaggaguacucacgcaaacaacauccacaaaugguucaacaagaggucauaaagcaacuguauacacaggaagcgcagauuuuucgccaaaauuaggaagaguacaauuugcaacagauacaaauaacgauuucgaaaccaaucaaaacacaaaauuuacacccgucggagucauucaagacggaucaacaacaccaagaaaugaaccccaacaauggguccugccaucauauaguggaagaaauauacauaauguccauuuagcaccagcaguagcacccacauuccccggugaacaacucuuauucuuccgaucaacaaugccgggaugcagcggauacccaaauauggaucuagauugucuacuaccccaagaauggguccaauauuucuaccaagaagcugcacccgcucaaucagacgucgcauuauuaagauuugucaaccccgacacaggacgaguauuauuugaaugcaaauuacauaaaucugguuauguaacaguugcacacaccggacaacaugaccuaguaauacccccuaauggauauuucagauucgacucauggguuaaucaauuuuacacacuagcaccaauggguaauggaacaggaagaagacgugcacuauaa

SEQ ID NO: 31621 - RNA, 1623 nt, Artificial Sequence
  derived and/or modified sequence opt6 from VP1__Norovirus__AGS08135
augaaaauggccucuuccgaugcaaacccauccgacggcucaacagcuaaccuaguaccagaaguaaacaaugaaguaauggcgcuagaaccagucguuggagcagcaaucgccgcaccaguagcaggccaacaaaacguaauagacccuuggauaagaaacaacuucguucaagccccaggaggagaauuuacaguaaguccacgaaaugcuccaggagaaauacuauggucagcaccacuaggacccgaucuaaauccauauuuaucacauuuagcaaggauguauaacgguuaugcagguggauuugaaguacagguaguacuagcaggaaaugcauuuaccgcaggcaaaauaauauucgcagcaguacccccuaauuuuccaaccgaaggccucucaccaucacaaguaacaauguuuccucacauaauaguagacguccgacaauuagaaccaguacuaauaccauuaccagauguaagaaacaauuucuaucauuacaaccaaucuaaugaccccaccauaaaauuaauagcuauguuauauacaccccuacgggcuaauaaugcaggagaugacguauuuacaguuucauguagaguacuuacacguccuucaccugacuuugacuucauauucuuaguaccaccaaccguagaaucuagaacaaaaccauucuccguaccaguacugacaguagaagaaaugacaaacucaagauuuccaauuccacuagaaaaacuauuuacaggaccaucaagugcauucguaguacaaccacaaaacggacgauguacaaccgacggaguauuauuaggcacaacccaauuauccccaguaaauaucugcacauucagaggagacguaacccauaucucuggaaguagaaauuauacgaugaaucucgccucucaaaacuggaauucauaugauccaacagaagaaauaccagcacccuuaggaacaccagauuuuguaggaaaaauacaaggaguauuaacccaaacaacaagaaccgacggcaguacacgcggacacaaagcaacaguauacaccggauccgcagauuuuucaccaaaauuaggcagaguucaauucgcaacagauacugauaaugacuuuguaacaaaucaaaauaccaaauucacaccaguaggaguaauacaagacggaaguacuacaccuagaaacgaaccccaacaauggguucuacccuccuauucaggaagaaacacacauaacguacaccuugcaccugcuguagcaccaacauuuccaggagaacaacuucuauucuuuagaucaacaaugccuggcuguucuggcuacccaaauauggaucuugauugcuuauugccucaagaauggguacaauacuuuuaccaagaagcagcacccgcccaaucagaugucgcauuauuaagauucguaaacccggacaccggaagaguacuuuuugaauguaaacuucauaaaucagguuauguaacaguugcacauacaggucaacaugaucuagugaucccaccaaacgguuacuucagauuugacucauggguaaaucaauuuuacacucuagcaccaaugggaaauggaacagguagaagaagagccuuauaa

SEQ ID NO: 31622 - RNA, 1623 nt, Artificial Sequence
  derived and/or modified sequence opt6 from VP1__Norovirus__AGS08136
augaaaauggcaaguucagaugcaaacccaucagauggaucuaccgcuaacuuaguuccagaagucaauaaugaaguuauggcccuagaaccaguaguaggugccgcuauugcagcaccaguagcaggacaacaaaauguaauagacccuuggauaagaaacaacuucguacaagcaccaggaggagaauucacaguaagccccagaaacgcaccaggcgaaauauuauggucugcaccauuaggccccgaucuaaacccauacuuaucucaccuugcucgaauguauaacgguuacgcagguggauucgaaguccaaguaauccuagcaggaaacgcauuuaccgcaggaaaaauaauauucgcagcagucccaccaaacuuucccaccgaaggucuaucaccaucacaaguaacaauguuuccucacauaauaguagauguccgacaacuagaaccaguuuuaauuccacuuccagaugucagaaacaacuucuaucacuacaaccaaucaaaugacucaacaauaaaacuaauagcuaugcuauauacgccucuaagagccaauaaugccggagacgauguauuuacuguaucauguagaguuuuaacaaggccaucaccagacuuugacuuuauauucuuaguaccaccaacaguugaaucgcgaacuaaaccauuuucaguaccaauucuuacuguagaagaaaugacuaauucacgauuuccaaucccuuuagaaaaauuauuuacaggaccaucuucagcauuuguaguacaaccccaaaacgguagaugcacaacugacggagucuuacuugguacaacacaacuaucaccugucaauauauguacauuccguggcgacgucacccacauacccggcucacacaauuacaccaugaaucucgcuucacaaaacuggaacuccuaugaucccacugaagaaauacccgccccacucggaaccccugacuuuguuggcaaaauacaagguguuuuaacacaaacaacuucuacaaacggaucgacccgaggucauaaagcaacagucuacacuggauccgcagauuuuucacccaaauuaggucgcguacaauucgcaacagauacaaauaacgauuucgaaacaaaucaaaauacaaaauucacaccaguugguguaauacaagauggaucaacaacaccuagaaaugaaccacaacaauggguucuaccauccuauucaggacgaaacauacauaacguacacuuggcaccugcaguagcaccuacauucccaggagaacaacuacuuuucuucagaucaaccaugccagguuguuccgguuacccuaacauggauuuagauugccuauuaccacaagaauggguacaauacuucuaucaagaagccgcuccagcacaaucagacguagcacuucuacgauuuguuaauccagacacaggacgaguacucuucgaaugcaaauuacauaaauccggauacguaacaguagcacauacaggucaacaugauuuaguuauacccccaaauggauauuuuagauucgauucuugggucaaucaauuuuacacauuagcuccuaugggcaauggaacaggcagacgaagagcauuauaa

SEQ ID NO: 31623 - RNA, 1623 nt, Artificial Sequence
  derived and/or modified sequence opt6 from VP1__Norovirus__AGS08137
augaaaauggcuuccucagacgcaaauccaucagacgguucaucggcaaauuuagucccagaaguaaacaaugaaguuauggcuuuagaaccaguaguaggagccgcaauagcagcuccagucgcuggacaacaaaauguaauagacccauggauacgcaauaacuucguucaagcuccaggaggagaauuuacagugucaccaagaaacgcuccaggagaaaucuuauggucagcaccccuaggaccagaucuaaauccauaucuaucacacuuagcaagaauguauaacgguuacgcuggcggauucgaaguacaaguaaucuuagcaggaaaugccuuuacagcagggaaaauaauauucgcagccguaccaccaaauuucccaaccgaaggacuaucaccaucucaagugaccauguucccacauauaauaguagacguacgacaauuagaaccagucuuaaucccacuucccgauguaagaaacaauuuuuaccauuacaaccaaucaaaugacccuacaauuaaacuuaucgcaauguuauacacaccacuaagagcuaacaacgcaggagaugauguauuuacuguaucauguaggguuuuaacucgaccaucaccugacuuugacuucaucuucuuaguaccaccaacuguagaaucacgaacaaaaccauuuucaguaccugucuuaacaguagaagaaaugacaaacucaagauuuccaauuccguuagaaaaauuauucacaggcccaucaucagcuuucguaguacaaccacaaaacgguagauguacaacagacggaguauuacuuggaacaacucaacuuucuccuguaaauauauguaccuuuagaggagauguuacacauauaucaggaucaagaaauuauacaaugaaucuagcuucccaaaauuggaauuccuacgauccaacagaggaaauaccagcaccguuaggaacaccugacuucguaggaaaaauacaaggaguacuaacacaaaccacuagaacagaugguucuacuagaggucacaaagcaacugucuacacaggaucagcagauuucagccccaaacuuggaagaguacaauucgcaaccgacacugacaaugauuucguaacaaaucaaaauacuaaauuuacuccaguaggaguaauacaagacggaucuacuacaccuagaaaugaaccacaacaauggguauuaccauccuauucaggaagaaauacucauaacguucaucuagcaccagcaguagcucccacauuuccaggagaacaguuauuauucuuuagaucuacaaugccagguuguucaggcuauccuaauauggaccuagauugcuuacuaccucaagaauggguucaauauuuuuaucaagaagcagcucccgcacaaucugauguagcacuucuaagauucguaaaccccgacacuggaagaguauuauucgaaugcaaacuacauaaauccggauauguaaccguagcacacacaggacaacacgacuuaguaauuccucccaauggauauuuccguuucgacucaugggucaaucaauucuauaccuuagcaccaauggguaacggaacuggacgaaaacgcgcacucuaa

SEQ ID NO: 31624 - RNA, 1623 nt, Artificial Sequence
  derived and/or modified sequence opt6 from VP1__Norovirus__AGS08138
augaaaauggcuucaucugacgcaaacccuucugacggauccaccgcaaaccuuguuccagaaguaaacaaugaaguuauggcacuagaaccaguaguaggagcagcaauagcagcaccaguagcaggucaacaaaauguaauagaccccuggauacgaaacaacuuuguacaagcaccaggaggugaauuuaccguaucaccacgcaaugcacccggagaaauauuauggucagcaccucuaggaccagaccucaaucccuaucuaucacacuuagcacgaauguauaaugguuaugccggaggauucgaaguacaaguaauacucgcuggaaacgcauuuacagcaggaaaaauuauauucgcagcaguaccuccaaacuuuccaaccgaaggcuuaucaccaucccaagugacaauguucccacacauaauaguagacguaagacaauuagaaccagucuuaaucccauuacccgauguaagaaacaacuucuaucacuauaaucaaucaaaugacucuacuauaaaauuaauagcaaugcuuuauacaccauuaagagcgaacaaugccggagacgacguauuuacugucucauguagaguucuaacacgaccaucacccgauuuugacuucauauuucuaguuccaccuaccguagaaucacguacuaaaccuuuuucaguacccguacuaacaguugaagaaaugacuaauucaagauuuccaauaccauuagaaaaacuuuuuacuggaccauccucugccuucguaguacaaccacaaaauggacguuguacaacagacggaguccuacuaggaacaacacaauuaucgccuguuaauauauguacauuuagaggagauguaacacauauuccuggaagucguaauuacacaaugaaccuagcaucacaaaauuggaacucuuaugaccccacagaagaaauaccagcaccuuuaggaacaccugauuuuguaggaaaaauacaaggaguacuaacccaaacgacucgaacaaacgguaguacaagaggccacaaagcaacuguauauacuggcucugcagacuuuucaccaaaacuaggaagaguccaauucgcaacagacacagauaacgauuuugaaaccaaucaaaauacaaaauucacaccaguuggagucauacaagacggaucaacuacuccaagaaacgaaccacaacaauggguacuaccauccuacuccggaagaaauacccauaacguacacuuagccccagcaguagcaccuaccuucccaggagaacaauuauuauucuuuagaucuacaaugccaggauguucaggcuauccaaacauggaucucgacuguuuacuuccucaagaauggguacaauauuuuuaccaagaagcagcaccagcccaaucugacguagcacuauuaagauuuguuaauccagauaccggaagaguauuauucgaaugcaaacuacauaaaucaggauauguaaccguagcacauacaggacaacacgacuuaguaauuccaccaaaugguuauuuuagauucgacuccuggguaaaucaauuuuacacccuagcacccaugggcaacggaaccggaaggcgaagagcauuauaa

SEQ ID NO: 31625 - RNA, 1623 nt, Artificial Sequence
  derived and/or modified sequence opt6 from VP1__Norovirus__AGS08139
augaaaauggcaucauccgaugcuaauccaucagaugguucagcugcaaaucuagucccugaaguaaacaaugaagucauggcuuuagaaccaguuguaggagcagcuauagcagcaccaguagcuggacaacaaaacguaauagauccauggauaagaaacaauuuuguacaagcaccuggaggagaauuuacaguaucaccacgcaaugcaccaggagaaauauuauggucugcaccacuaggaccagauuuaaaccccuaucuaagucacuuagcaagaauguauaauggauacgcuggcggauucgaaguacaagucauauuagcaggaaaugccuuuacagcaggcaaaguaauauuugcagccguaccaccaaauuuucccaccgaaggauuaucacccucacaagucacaauguuuccccacauaguuguagauguaagacaacuagaacccguucuaauaccacuuccagauguaagaaacaacuuuuaccacuauaaccaaucuaaugauucaaccauaaaacuuauagcaaugcuauacacuccacuaagagcuaacaacgcaggagaugauguauuuacuguaucauguagaguacuaacucgacccucaccagacuuugauuuuauauuucuaguaccaccaaccguugaaaguagaacaaaaccauucuccguaccaguacuaacaguugaagaaaugacuaauucaagauuuccaauuccacuugaaaaacuauuuacaggaccaucaucagcauucguaguacaaccacaaaacggacgauguacaacagacggcguauuacuaggaacaacacaacuaucacccguuaauauauguaccuuccgaggcgauguaacccauaucacaggaucccgaaacuauaccaugaaucuagcuucacaaaacuggaauaauuaugaccccacugaagaaauaccugcaccauuaggcacaccugauuuuguuggaaaaauucaaggaaugcuuacucaaacuacacgaacagacgguucaacaagaggccacaaagcaacagucuauacuggaucagcagauuuugcaccaaaauuagguagaguucaauuugaaacugacacagaucaugauuucgaagcaaaucaaaauacaaaguuuacaccaguaggcguuauacaagauggcucuacuacucaucgaaaugaaccucaacaauggguacuuccaucauacucuggaagaaacacccauaacguccaucuagcaccagcuguagcaccaacauuuccaggagaacaacuccuauuuuucagaucuacaaugccuggcugcuccgguuacccaaauauggauuuagacugccuacuaccucaagaauggguccaauauuucuaccaagaagcagcaccagcacaaucagauguagcccucuuaagauuugucaacccagauacaggaagaguacucuucgaauguaaacuacauaaaucaggauauguaacaguagcacauacuggacaacacgaccuaguaauuccaccaaacggauacuucagauucgauucaugggucaaccaauucuauacuuuagcaccaaugggaaacgguacaggaagaagaagagucgucuaa

SEQ ID NO: 31626 - RNA, 1623 nt, Artificial Sequence
  derived and/or modified sequence opt6 from VP1__Norovirus__AGS08140
augaaaauggcaucaucagaugcaaauccuuccgacggaucugcagccaaucuaguaccagaaguaaauaacgaaguaauggcacuugaaccuguaguaggagcagcaauagcggcacccguagcgggacaacaaaaugucauagaccccuggauuagaaacaacuucguacaggcuccaggaggagaauuuacaguauccccuagaaaugcaccuggcgaaauacuuuggucagcaccacuuggaccugauuuaaauccauauuuaucacauuuagcuagaauguauaacgguuaugcaggcggauuugaaguccaaguaauucuagcaggaaaugcuuucaccgcaggaaaaauuauauuugcagccguaccaccaaacuuuccaacagaaggauuaucaccaucucaaguaaccauguucccacauauaauaguugacguuagacaauuagaaccaguccuaaucccacuaccagauguacgaaauaauuuuuaucacuauaaucaaucaaaugacucaacaauaaaauuaauagcaaugcuauauacaccauuaagagcaaacaaugcuggcgacgacguauuuacaguuucauguagaguauuaacuagaccuuccccagauuucgacuuuauauuucuaguuccuccaacagucgaaucucgcacuaaaccauucucgguaccaguacuaacaguagaagaaaugacaaauucaagauuuccaauuccucuagaaaaacuauuuacaggacccagcucagccuucguaguucaaccucaaaacggaagauguacuacagacggaguauuacucggaacuacucaacuaucacccguaaacauauguacauucagaggagacguaacacauaucacaggaucacgcaauuauacuaugaauuuagcaagccaaaacuggaauaauuacgauccaacggaagaaauaccugcacccuuagguaccccagacuuuguaggaaaaauucaaggaaugcuaacccaaacaacaaggacagacggaucuacucgaggacauaaagcaaccguauauacagguucagcagacuuugcaccaaaacuaggaagaguacaauucgaaaccgacacugaucaugauuucgaagccaaccaaaauacaaaauuuaccccuguaggagucauacaagacggagguacaacacaccgaaaugaaccacaacaauggguauuaccaucauauuccggacgaaauacacauaacguucaccuagcaccugcuguagccccaacauuuccaggugaacaguuauuauucuuuagaucaacaaugcccggaugcucaggauaccccaauauggauuuagacugucucuuaccacaagaauggguucaauauuuuuaucaagaagcagcaccagcucaauccgauguagcauuauuaagauucguaaacccagacacuggucguguauuauucgaaugcaaacuccacaaaucaggauauguaacaguagcacacacuggacaacacgauuuaguuauaccaccaaaugguuauuucagauucgacucauggguaaaucaauucuauacacucgcaccaaugggaaacggaaccggaagaagaagaguaguauaa

SEQ ID NO: 31627 - RNA, 1623 nt, Artificial Sequence
  derived and/or modified sequence opt6 from VP1__Norovirus__AGS08141
augaaaauggcaucauccgacgcaaacccuuccgauggaucagcagcaaaucuaguaccagaaguaaacaaugaaguaauggcuuuagaaccuguaguaggcgccgcaauugcagcuccaguagcaggacaacaaaacgucauagauccuuggauaagaaacaauuuuguccaagcaccuggaggagaauuuacagucaguccaagaaaugcaccaggagaaauacuuuggucugcaccguuagguccagaucuuaauccuuacuuaucccaucuugcaagaauguauaacgguuaugcaggcggauucgaaguucaaguaauauuagcaggaaaugcauuuacugcaggcaaagucauuuuugcagcuguacccccaaauuuucccacagaaggauuaaguccaucacaaguuacuauguuuccacacauaguuguugacguaagacaauuagaacccguauuaauaccuuuaccagaugucagaaacaauuuuuaccacuauaaucaauccaacgauccaacaauaaaauuaauagcuaugcucuacacaccauuacgagcaaauaaugcaggagacgaugucuuuacaguauccuguagaguucucaccagaccuuccccagauuuugacuuuauauuucuaguaccaccaacaguagaaucacgaacaaaaccauuuucaguaccaguacucacuguagaagaaaugacaaauuccagauuuccaauuccauuagaaaaacuauucacagguccaucuucagcauucguaguucaaccacaaaaugguagaugcacaacagacggaguauuacuaggaacaacucaauuaucacccguuaacauauguacauuuagaggagauguuacucacaucacaggcucaagaaauuacacuaugaauuuagcaucacaaaauuggaauaauuacgaucccacagaagaaauaccagcuccucucggagcaccagacuuugucggaaaaauacaaggaaugcuaacacaaaccacaagaacagacggaucaacuagaggacauaaagcuacagucuauacuggaucagcagauuucgcaccaaaacuaggaagaguccaauuugaaacugacaccgaccacgauuucgaagcuaaccaaaauacaaaauucaccccaguaggagucauacaagacggaucaacaacacauagaaaugaaccucaacaauggguucuaccuucauauagcggaagaaacacacauaacguccaccuagcaccagcaguagcaccaacuuuuccaggagaacaauuacuauuuuuuagauccacuaugcccggauguuccggcuauccaaacauggauuuagacugucuucuaccacaagaauggguacaauacuuuuaccaagaagcagcuccagcacaaucagacguugcacuacucagauuugucaacccugauacaggaagaguauuauucgaauguaaacuccauaagagcggcuauguaacaguagcacacacaggacaacaugauuuaguaauacccccaaauggauacuuccguuuugauucauggguaaaucaauucuacacacuagcucccaugggaaacggcacuggcagacguagagucguauaa

SEQ ID NO: 31628 - RNA, 1623 nt, Artificial Sequence
  derived and/or modified sequence opt6 from VP1__Norovirus__AGS08142
augaaaauggcauccuccgacgcaaauccaucugacggaucagcagcuaaucucguaccugaaguaaacaaugaaguaauggcacuagaaccuguuguaggagcagcaauagcugcaccagucgcaggacaacaaaacguaauugauccauggauccgcaauaauuuuguacaagcaccuggaggcgaauuuacuguuucaccuagaaaugcacccggcgaaauauuauggucagccccacuaggaccagaucuaaacccauaucuaucacauuuagcacgaauguauaacgguuacgcaggaggcuucgaaguccaaguaauauuagcuggaaacgcuuuuacagcaggaaaaguuaucuuugccgcagucccaccaaauuuuccaaccgaaggauuauccccuucucaaguaacaauguucccacacauagucguagauguuagacaacuagaaccaguacucauaccauuaccagauguaagaaauaauuucuaucacuacaaucaaucaaaugauccaacaauaaaacuaauagcaauguuauauacuccacuacgagcaaauaaugccggagaugauguauuuacaguaucaugucgaguauuaacaagaccaaguccagacuuugacuuuauuuuucuuguacccccaacuguagaaucuagagcuaaacccuucucagucccugucuuaacuguagaagaaaugacaaacucacgcuucccuauaccccucgaaaaauuauuuacaggacccucaucugcuuuuguaguucaaccucaaaacggaagaugcacaacagaugguguauuacuagguaccacacaauuaucaccuguaaauauauguacauuuagaggugauguaacacacauaacuggaucccgaaauuauaccaugaaccuagcgucacaaaauuggaguaacuaugauccaacagaagaaaucccagcuccccuaggaaccccugauuucguagguaaaauacaaggaguauuaacucaaacaacucgaacagacggaucuacaagaggacacaaagcaacaguauacacagguucagccgauuucgcaccaaaauuaggaagaguacaauucgaaacagacaccgaucacgauuucgaagccaaccaaaauacaaaauucacaccaguuggaguaauacaagauggaucaaccacccacagaaaugaaccccaacaauggguauuaccaucauauaguggacgaaauacaccaaauguucauuuagcaccagcaguagcaccaacauuuccaggagaacaauuauuauuuuuccguucuacaaugcccggaugcucaggauauccaaauauggaccuagauugucuacucccucaagaauggguacaauauuucuaucaagaagcagcaccagcacaaucagacguagccuuauuacguuucguaaacccagauacaggacgaguacuauucgaaugcaaacuacauaaaucaggcuaugucacagucgcucauacaggacaacacgauuuagucaucccuccaaacggauauuuccgauucgauucauggguaaaccaauuuuacacgcuagcaccaaugggcaacggaacagguagaagaagagcaccuuaa

SEQ ID NO: 31629 - RNA, 1623 nt, Artificial Sequence
  derived and/or modified sequence opt6 from VP1__Norovirus__AGS08143
augaaaauggcaucaucugacgcuaacccuuccgauggaucaacagcuaaccuugucccagaaguuaacaacgaaguaauggcccuagaacccguaguaggagccgccauagcagcacccguagcuggacaacaaaauguuauugacccauggauuagaaauaacuuuguucaagcaccagguggcgaauuuacaguaucuccuagaaaugcaccaggagaaaucuuauggucagcaccacuaggaccagaucuaaauccauaccuaucccacuuagcacgaauguauaacggcuacgccggaggauuugaaguacaagucauauuagcaggaaaugcauucacagcagguaaaauuaucuucgcagcaguaccaccuaacuucccuacagaaggcuuaucaccaucacaagucacaauguucccucacauuauaguugacguaagacaacuagaaccaguucuuauacccuuaccagacguacgaaacaacuucuaucacuauaaucaaucaaaugauucaacaauuaaauuaauagcuaugcuuuauaccccauuaagagcaaacaaugcaggagacgacguauucaccguauccugccgaguucuaacaagaccaucaccagauuuugauuuuauauuucuagucccaccaacuguagaaucccgaacuaaacccuucuccguacccguauuaacaguagaagaaaugacaaauucaagauuccccauaccacuagaaaaauuauucacuggcccaucauccgcauucguuguccaaccacaaaauggucgauguacaacagauggaguacuacucgguaccacacaacucucuccuguuaauauaugcacuuuuagaggagaugucacacacauaccuggaucuagaaacuacacuaugaacuuagcaucccaaaauuggaacucuuacgauccaacagaagaaauacccgcuccucuaggaacgcccgacuucguaggaaaaauacaaggaguccuaacacaaacaacucgaacaaauggauccacaagaggucacaaagcgacaguauacacaggauccgcagacuuuucaccaaaauuaggacgaguacaauuugcaacagacacagauaacgauuucgaaacgaaucaaaacaccaaauucacaccaguuggaguaauacaagauggaucaacuaccccaagaaaugaaccccaacaauggguacuaccaucuuacucuggacgaaauauacacaacguccacuuagcaccagcaguagcaccuacauuuccaggugaacaauuacuauuuuuucgaagcaccaugccaggaugcagcggauauccaaauauggaccuagauugccuacuaccacaagaauggguacaauauuucuaucaagaagcagccccugcucaaucagacguugcauuacuaagauucguaaauccugacacgggaagaguccuauucgaauguaaauuacauaaaucuggauacguaacaguagcucacacaggacaacacgaccuaguaaucccaccaaacggauauuucagauucgauucauggguaaaccaauuuuauacuuuagcacccaugggaaauggaacaggacguagaagagcacuauaa

SEQ ID NO: 31630 - RNA, 1623 nt, Artificial Sequence
  derived and/or modified sequence opt6 from VP1__Norovirus__AGS08144
augaaaauggcaucauccgacgcuaacccaucagauggcucuacugcuaaccuagucccagaaguuaacaaugaagugauggcacuugaaccaguaguaggagcagccaucgcagcacccguagcuggacaacaaaaugucauagacccauggauucgcaauaauuuuguucaagccccaggcggugaauucacaguaucaccaagaaacgccccuggagaaauauuauggucagcuccauuagguccugaccuuaaucccuacuuaucucaccuagcaagaauguauaauggauaugcuggaggcuucgaaguucaagucauauuagcaggaaaugcauuuacagcagguaaaauaauauuugcagcuguaccuccaaauuuuccaacagaaggccucaguccaucacaaguuacaauguuuccccacauaauaguugacguacgacaacuagaacccguacuaauuccauuaccagaugucagaaacaacuucuaucacuauaaucaaaguaaugacccuacaauaaaacuuaucgccaugcuauauaccccauuaagagcaaauaaugcaggagacgaugucuuuacgguauccugucgaguacuaacacgaccuagcccagauuuugauuuuaucuuuuuaguaccaccaaccguugaaucccguacaaaaccauucucagucccaguauuaacagucgaagaaaugacaaacucaagauuuccaauaccacucgaaaaacuauuuacaggcccaucaucagcauuuguaguacaaccccaaaauggaagauguacaacagauggaguacuucuugguacaacacaauuaagccccguaaauauaugcacauuucgaggugauguaacacacauaccaggaucuagaaauuauacaaugaacuuagcaagccaaaauuggaacucuuaugacccgacugaagaaaucccugcaccauuaggaacaccagauuucgucggaaaaauucagggaguauuaacacaaacaacacgaacgaacgguucaacacgaggacauaaagcaacuguauauacugguagcgccgauuuuaguccaaaauuaggucgaguacaauuugcaacagauaccgauaaugauuucgaaacuaaucaaaauacuaaauuuacaccaguuggaguaauucaagauggaucaacaacuccaagaaaugaaccccaacaauggguacuaccaucauauucuggcagaaauauacauaacguacacuuggcaccagcaguagcaccaacauuuccaggagaacaacuccuauucuucagaucaacaaugccaggauguuccggauauccaaauauggaucucgauuguuuacuaccucaagaauggguacaauauuucuaucaagaagcagcaccagcacaaucagauguagcacuacucagauuuguaaacccagauacuggaagagucuuauuugaauguaaauuacauaaaccuggauaugucacaguagcacauacaggacaacacgauuuaguaauuccaccuaacggauacuuuagauucgauucauggguaaaccaauuuuacacucuugcucccaugggcaauggaacaggaagaagacgugcauuauaa

SEQ ID NO: 31631 - RNA, 1623 nt, Artificial Sequence
  derived and/or modified sequence opt6 from VP1__Norovirus__AGS08145
augaaaauggcaagcucagacgcuaacccuucagauggaucuacagcaaauuuagucccagaaguuaacaaugaaguaauggccuuagaaccugucgucggagccgcuauagcagcaccaguagcuggacagcaaaauguaauagacccauggauaagaaacaacuuuguacaagcaccaggaggagaauuuacaguuucaccacguaacgcacccggagaaauuuuauggucagcuccacuagguccagaucuaaauccauaucuaucccaucuugccagaauguacaauggauaugcuggcggauuugaaguacaaguaauauuagcaggaaacgcauucaccgcaggcaaaauaauauucgcagcaguaccaccaaacuuuccuacagaaggucuaucccccucccaaguuaccauguucccacauaucauuguagacguaagacaacuagaaccaguccucauaccccuuccagacguuagaaacaacuucuaucauuauaaccaaucuaaugauucaaccauaaaauuaauagcaaugcuuuacacaccucuacgugcuaauaaugccggagacgauguauuuacaguuucauguagaguacuaacacgccccucaccugacuucgacuucauauuucuaguaccaccaacaguugaaucacgaacaaaaccauucucaguaccuauauuaacaguagaagaaaugacuaacucaagauuucccauacccuuagaaaaauuauuuacaggaccaucauccgcauuuguaguacaaccucaaaaugguagauguacaacugacggaguccuucuaggaacaacucaacuuaguccaguaaauauauguacauuuagaggagacguaacucauauaccaggaucacauaauuacacuaugaaccuagcuucucaaaacuggaauucauaugauccaacugaagaaacaccagcuccauuaggaacuccagacuuuguugguaaaauucaaggaguauuaacacaaacaacaaguacaaacggaucaacaagaggucauaaagcaacaguauauaccgguuccgcagacuucaguccaaaauuaggaagaguacaauucgcaacagauacaaacaaugacuucgaaacaaaucaaaauacaaaauuuacaccaguaggaguaauccaagaugguucaacaacuccaagaaacgaaccacaacaauggguauuaccaucauauucuggaagaaauauacacaauguccaccuagcaccugcaguggcaccuacauucccaggagaacaacuuuuauuuuuuagaucaaccaugccgggaugcucuggauaucccaauauggauuuagauugcuuacuaccucaagaauggguacaauauuucuaucaagaagcagcaccagcccagucugacguagcuuuauuaagauuuguuaaucccgauacagguagaguauuauucgaaugcaaacuacacaaaucuggauacguuacaguagcacauacuggacaacacgaucuuguaauaccuccaaacggauauuuuagauucgacucauggguaaaucaauuuuacacucuagcaccaaugggcaauggcacuggcagacgaagagcucuauaa

SEQ ID NO: 31632 - RNA, 1623 nt, Artificial Sequence
  derived and/or modified sequence opt6 from VP1__Norovirus__AGS08146
augaaaauggcauccucagacgcucacccuucagauggaucaacugcaaacuuaguaccagaaguuaacaaugaaguaauggcucuagaaccugucgucggugcagcaaucgcagcaccagucgccggacaacaaaauguaauugacccuuggauaagaaauaacuuuguacaagcuccaggaggagaauucacaguaucacccagaaacgccccaggagaaauauuauggucagcuccacuaggcccagauuuaaauccauaucuaucucacuuagcaagaauguauaacgguuacgccggagguuuugaaguacaagucauacucgcaggaaaugcuuuuaccgcaggcaaaauaauauucgcagcaguaccaccuaauuuuccaacagaaggacuauccccaucacaaguaaccauguucccucacauaauaguugauguaagacaauuagaaccuguacucauaccacuaccagacguacgaaauaauuuuuaccauuauaaucaaucuaaugacccaacuaucaaauuaaucgcaaugcuuuacacaccacuacgcgcaaacaaugcaggagacgauguauucaccguaucaugcagaguacuaacaaggcccucaccugacuucgacuuuauuuuuuuaguuccaccaacgguugaaucaagaacaaaaccauuuucaguaccugucuuaacagucgaagaaaugacaaacucucgauuuccaauaccauuagaaaaacuauuuaccggaccauccucagcuuuuguaguacaaccccaaaacgguagauguacaacagauggaguacuacuaggaaccacucaacuuucaccaguaaauauauguacauuuagaggagacguaacacauaucagcggaucaagaaauuauacaaugaaucucgcaucacaaaauuggaauucauacgacccuacugaagaaauccccgccccacuuggaacaccggacuuuguugggaaaauacaaggcguacucacucaaacaacaagaaccgacggaucuacacgaggacacaaggcaacaguauauacuggaucagcagauuuuucacccaaacuaggacgaguacaauuugccacagacacagauaaugauuucguuacaaaucaaaacacaaaauucacuccaguaggaguaauucaagauggaucaacgacaccacguaaugagccacaacaauggguauuaccaucuuauucaggaagaaauacucauaauguucaucucgcuccagcaguugcaccaacauucccgggagaacaauuauuauuuuucagaucaacaaugccaggauguucuggauacccaaacauggaccucgauuguuuacuaccccaagaauggguacaauauuucuaucaagaagcagcccccgcacaaucagauguugcacuucuaagauucguuaacccugauacaggaagaguauuauucgaaugcaaauuacauaaauccggauauguaacaguagcacauacaggccaacacgaccucguaauaccacccaauggauauuuccgauuugacucuuggguaaaccaguuuuacacacuagcaccaaugggaaauggcacagguagacgaagagcacuauaa

SEQ ID NO: 31633 - RNA, 1623 nt, Artificial Sequence
  derived and/or modified sequence opt6 from VP1__Norovirus__AGS08147
augaaaauggcaucaucagacgcaaaccccucagaugguucaacagcaaaccuuguacccgaagucaacaaugaaguaauggcucuagaacccguaguaggagcagcuauagcagcaccuguagcaggacaacaaaacguaaucgacccauggauaagaaacaacuucguacaagcaccaggaggugaauuuacaguuuccccccgaaaugcaccaggagaaauauuauggucagcaccauuaggaccagauuuaaauccuuaccucagucaucuugcuagaauguacaacggauacgcuggaggcuucgaaguccaaguaauucucgcagguaacgcauuuacagcaggaaaaauuauuuuugcugccguuccaccaaacuuucccaccgaaggacuauccccaucacaagucacaauguucccacacauaauaguugauguaagacaauuagaaccaguacuaauaccauuaccagauguaagaaauaauuucuaucacuauaaucaaucaaaugacccuacgauaaaauuaauugcaaugcuauauacuccacuacgagcuaacaaugcaggagaugauguuuucacugucuccugccgcguauugaccagaccaucaccagacuuugauuucauauuucuagucccaccaacagucgaaagcagaacuaaaccauuuagcgucccaguauuaacaguagaagaaaugacuaauucuagauuuccuauuccuuuagaaaaacuauucacaggacccuccuccgcauucguuguacaaccucaaaauggcagaugcaccacagacggaguacuacucggaacaacucaauuauccccugucaacauauguacauuccgaggagacguuacacauauaccaggauccagaaauuacacaaugaauuuagcaucacaaaacuggaauucuuacgauccaacagaagaaauuccagcuccuuuagguacacccgacuucgucggaaaaauucaagguguacuuacacagaccacccgaacuaacggauccacacgaggacauaaagcaacaguuuauacaggaucagcagacuuuucaccaaaacuaggaagaguccaauuugcuacagacacagauaacgauuucgaaaccaaucaaaauacaaaauucacaccuguaggaguaauacaagacggaucaaccacaccaagaaaugaaccucaacaauggguauuaccaaguuauaguggaagaaauauacauaacguacauuuagcaccagcaguagccccaacauuucccggagaacaacuauuauuuuucagauccaccaugccaggauguucaggauaucccaauauggacuuagacugcuuacuaccucaagaauggguacaauauuuuuaucaagaagccgcuccagcacaauccgacgucgcauuacuaagauuuguaaacccagauacaggcagaguacuauucgaauguaaacuccacaaaucaggauacgucaccguagcacacaccggccaacacgaucuuguaauaccaccaaauggauacuuccgauuugauucuuggguaaaucaauuuuacacacuagcaccaaugggaaauggaacuggaagaagaagagcauuauaa

SEQ ID NO: 31634 - RNA, 1623 nt, Artificial Sequence
  derived and/or modified sequence opt6 from VP1__Norovirus__AGS08148
augaaaauggcuucaucagacgcaaacccuucagauggcucuacagcuaacuuagucccagaaguaaacaacgaaguaauggcacuagaaccaguaguuggugcagccauagcagcaccaguagcaggucaacaaaacguaaucgacccauggauacgcaauaacuuuguacaagcucccggaggagaauuuacaguauccccgagaaaugcaccaggagaaauauuaugguccgcaccacuuggaccagaucuaaauccauaucuuagccacuuagcacgaauguauaauggauacgcaggaggauuugaaguccaaguaauacucgcuggcaacgcauucacugcaggaaaaauuauauuugcagcuguaccaccaaauuucccaacugaaggauuaucacccagucaaguaacaauguucccccauaucauaguagacguaagacaacuagaacccguacuuauaccauuaccugacguuagaaacaauuucuaccacuauaaucaaucaaaugauucaacaaucaaacuaauagcaauguuauauacaccauuaagagcaaacaacgcaggcgacgaugucuuuacaguaagcugucgaguacuuacgagaccauccccagacuucgacuucauauuuuugguaccaccuacaguagaaucuagaacuaaaccauucucaguaccaauauuaaccguagaagaaaugacaaauucaagauuuccaauaccacuagaaaaacucuuuacuggcccaagcuccgcauucguaguucaaccccaaaacggcagaugcaccacagacggaguauuacuaggcaccacacaauuaucaccuguuaauauauguaccuuuagaggagacguaacacauaucccaggaucacauaauuacacaaugaauuuagcuucacaaaacuggaacucauacgauccaacugaagaaauaccugcaccacuaggaacuccagauuuuguaggcaaaauucaaggagucuuaacccaaacuacaucaacuaaugguucaacaagaggacacaaagcuaccguauauacaggaucugcagacuuuucaccaaaacuuggaagaguacaauucgcuacugacacaaauaaugauuucgaaacaaaucaaaauacuaaauucacuccaguaggaguuauacaagacgguucaacaacaccucgaaaugaaccccaacaauggguauuacccuccuacucaggcagaaauauucacaauguacaucuagcacccgcaguagcaccaaccuuuccaggagaacaacuacuuuucuuucgguccaccaugccaggaugcucaggauacccuaauauggaucuugauugucuauuaccacaagaauggguacaauauuuuuaucaagaagcagcccccgcacaaucggacguagccuuauuaagauucguaaacccagauacuggaagaguauuauuugaaugcaaacuacacaaauccggauauguaacaguagcacauacaggccaacaugauuuaguaauaccacccaacggauauuuuagguucgauuccuggguuaaucaauucuauaccuuagcaccaauggguaauggaacuggcagaagaagagcucuauaa

SEQ ID NO: 31635 - RNA, 1623 nt, Artificial Sequence
  derived and/or modified sequence opt6 from VP1__Norovirus__AGS08149
augaaaauggcaucaucagacgcuaaucccagugauggaaguacagcuaaucuaguuccagaaguaaacaacgaaguaauggcucuagaaccagucguaggcgcagcuauagcagcaccaguagcuggacaacaaaaugucauagaccccuggauuagaaauaauuucguucaagcaccaggaggugaauuuacaguuucaccccgaaaugcucccggagaaauacuauggaaugcaccacuagguccagaccuaaauccauauuuaagccauuuagcaagaauguauaaugguuacgcuggaggauucgaaguacaaguaauauuagcaggaaacgcguucaccgcaggaaaaauaauauuugcagcaguaccaccuaauuuucccacugaaggauuauccccaucacaaguuacaauguucccucacauaauaguagauguaagacaacuagaacccguauuaauaccauuaccagaugucagaaacaauuucuaucauuacaaucaaucgaaugacccaacaauaaaauuaauagcaauguuauauaccccucuuagagcaaauaaugcaggugacgauguuuucacugucaguugucgcguacucacccgaccaagccccgauuuugauuucauauuccuaguuccaccaacaguagaaucaagaaccaaaccauuuuccguaccuguucucacaguagaagaaaugaccaacucacgauuuccaauuccauuagaaaaauuauucacaggccccucuucagcauucguaguacaaccacaaaacggaaaauguacuaccgacggaguuuuauuaggaacaacacaacuaucaccugucaauaucuguaccuuuagaggagacguaacacacauuccaggaucaagaaauuacacaaugaauuuagcaucacaaaacuggaacucauacgauccaacugaagaaauaccagccccccuaggcacuccagacuuuguaggaaaaauccaagguguauuaacacaaacaacaagaacaaaugguucaacuagaggucacaaagcaacgguauauacaggaucagcagauuuuucaccuaaacuaggaagaguacaauucgcaacagacacugauaacgacuucgaaacaaaucaaaacacuaaauucacaccaguaggaguaauccaagacgguucuacaacaccaagaaaugaaccucaacaauggguccuaccaucuuauagcggaagaaauauacacaauguacaccuugcuccagcaguagcaccaacauucccaggugaacaauuauuauuuuuuagaucaacaaugccaggcugcucaggauauccaaauauggaccuugauugccuacuaccacaagaauggguacaauauuucuaucaagaagcagccccagcccaaucugauguagcacuauuaagauucguaaacccugacacagguagaguauuauucgaauguaaauuacacaaaaguggauacgucaccguagcacacacuggccaacacgauuuagugauaccaccaaauggauauuuccgauucgauucauggguaaaucaauuuuauacauuagcacccaugggaaauggaacuggaagaagaagagcauuauaa

SEQ ID NO: 31636 - RNA, 1623 nt, Artificial Sequence
  derived and/or modified sequence opt6 from VP1__Norovirus__AGS08150
augaaaauggcauccucugaugcaaaccccucugauggaaguaccgcaaauuuaguuccagaaguaaauaaugaaguuauggcacuagaaccaguaguaggcgcagcaauagcagcacccguagcaggccaacaaaauauaauagacccauggauacgcaauaauuuuguacaagcucccggaggagaauuuacaguuucaccaagaaaugcuccuggagaaaucuuaugguccgcaccccuagguccagaucuaaauccuuaucuaucucaucucgcacgaauguacaauggauaugcagguggauucgaaguucaagucauacuugcuggaaacgcauuuaccgccggcaaaauaaucuuugcugcaguacccccaaacuuccccacagaaggauuaucaccaagucaaguaacaauguuuccacacauaauaguagacguaagacaauuagaaccaguacuaauaccauuaccagacguaagaaacaauuuuuaucacuauaaccaaucaaacgauucaacaauaaaauuaauagcaaugcuauauacacccuuaagagcaaacaaugcuggagacgauguuuuuacaguaucauguagaguacucacccguccaucaccugacuucgauuucauuuuucuagucccaccaaccguagaaucacguacaaaaccauuuucaguaccaguacuaacaguugaagaaaugacaaauaguagauucccaauuccacuugaaaaacuauucacuggucccucaucagcauuuguuguacaaccacaaaacggacgaugcacuacagacggaguacuucuagguacuacccaacuauccccaguaaauauaugcacauucagaggagauguaacucauauaucaggcucaagaaacuauacaaugaacuuagcaucacaaaauuggaauucauacgaccccacagaagaaauaccagcaccacucggaacaccagacuucguuggcaaaauacaaggaguucuaacacaaacaaccagaacagaugguucuacaagaggucauaaagcaacuguuuauacuggaagugcagacuuuucaccaaaauuaggaagaguacaauuugcuacagacacagauaacgauuucguuacaaaucaaaauacaaaauucacaccaguaggaguaauacaagaugguucaacaaccccaaggaacgaaccacaacaauggguauuaccaucauauucuggaagaaacacucacaacguucaucuagcaccagcaguagcaccaacuuuccccggagaacaguuauuauuuuucagauccacuaugccaggaugcaguggcuauccaaauauggaccuagauugucuccuaccacaagaauggguacaauauuucuaccaagaagccgcaccagcacaaucagacguagcacuacuucgauuugucaacccagauaccggcagagucuuauucgaauguaaacuacauaaaagcgguuacguaacaguugcccacacuggacaacaugaucuaguaauuccaccaaacgguuauuuuagauuugauuccuggguaaaucaauuuuauacauuagcgccuaugggaaacgguacuggaagaagaagagcacuauaa

SEQ ID NO: 31637 - RNA, 1623 nt, Artificial Sequence
  derived and/or modified sequence opt6 from VP1__Norovirus__AGS08152
augaaaauggcaucaucagacgcaaacccuucagauggcuccgcagcaaauuuaguaccagaaguaaacaacgaaguaauggcacucgaaccaguaguaggcgcagcaauagcagcaccaguagcuggacaacaaaacguaauagacccuuggauuagaaauaacuucguacaagcaccuggaggagaauucaccgucucaccuagaaaugcaccuggagaaauauuauggucagcacccuuaggaccagauuuaaauccuuaccuuucccacuuagcaagaauguauaacggauaugcagguggauucgaaguucaagucauauuagcaggaaacgcauuuacagcgggaaaaauaauuuucgcagcuguuccaccaaauuuuccuacagaaggauuaucucccucucagguaacaauguucccacauauaauuguugacguaagacaacuugaaccaguacucauaccauuaccagauguacgaaacaauuucuaucauuacaaccaaucuaacgauccuacuauuaaacuaauagcaauguuauacacuccauuaagagcaaauaacgcaggagacgacguuuuuaccguuucaugcagaguauuaacaagaccaucuccggacuuugacuuuauauuuuuaguuccaccaacaguagaauccagaacuaaaccuuucucuguaccaguacuuacagucgaagaaaugacaaacucaagauucccaguaccacuagaaaaauuauuuacugguccauccucagcuuuugucguacaaccacaaaacggucgaugcaccaccgacggaguuuuauuaggaacuacacaacuauccccaguuaauauauguacuuuuagaggagacguuacucauauaacaggaucccacaauuauacaaugaaccuagcuucccaaaauuggaacucauacgauccaacagaagaaauaccugcucccuuaggaacaccagacuucgucgguaaaauacaaggagucuuaacacaaacaacucgagcuaauggaucuacaagaggucauaaggcaacuguauacacaggaucagcagauuucgcaccuaaauuaggccgaguccaauuugcaacagauaccaacaaugauuuugaugcaaaucaaaauacaaaauucacucccguaggaguaauccaagauggugacacagcccaccgaaaugaaccacaacaauggguacuaccaucauauuccggaagaaauucacauaauguacacuuagcaccagcaguagcuccaacauuuccuggcgaacaauuauuauucuuuagaucuaccaugccaggcugcagcggauauccuaauauggacuuagacugucugcuaccgcaagaauggguccaauauuucuaucaagaagcagcaccugcccaaucagauguugcccuacuucgauucguuaauccagauacuggaagaguauuauucgaauguaaauuacacaaaucagguuacguaacagucgcacauacaggacaacacgaucuuguaauaccuccaaauggauauuuccguuuugauucauggguaaaucaauucuauacauuagcgcccaugggcaauggcacaggaagacgaagagcacuauaa

SEQ ID NO: 31638 - RNA, 1623 nt, Artificial Sequence
  derived and/or modified sequence opt6 from VP1__Norovirus__AGS08153
augaaaauggcuucaagugaugcuaauccaucagauggaucagcagccaauuuaguaccagaaguaaauaaugaaguaauggcauuggaaccaguuguaggagcagcuauugccgcaccaguugcuggacaacaaaacguaauagacccauggauacgaaacaauuucguacaagcacccgguggagaauucaccguaucaccacgaaaugccccuggagaaauuuuaugguccgcuccgcucggcccagauuuaaauccauauuuaagucacuuagcaagaauguauaacggauacgcuggaggguuugaaguacaaguaauauuagccggaaacgcauuuacagcaggcaagauaauauucgcagcaguaccaccuaauuucccaacagaaggccucucaccaucacaaguuaccauguuuccacauauaauagucgacguaagacaacuagaaccaguacuaauaccauuaccugauguaagaaacaauuuuuaccauuacaaucaaucaaaugacccaaccauaaaacuuauagcaauguuauauacaccauuaagagcaaacaaugcuggcgaugacgucuuuacaguuucuugucgaguacuuacuagaccaaguccagacuucgacuuuauauuucuaguaccgcccacuguugaaucucguacuaaacccuucucagucccaguauuaacaguagaagaaaugaccaauucaagauuccccgucccauuagaaaaauuauuuacaggaccaucaucagcuuuuguaguacaaccacaaaauggucgauguaccacagacggaguacuacuugguacaacacaauuaucaccaguaaauauaugcacauucagaggagacguuacacauauaacaggaucacauaauuacacaaugaacuuagcaagucaaaauuggaauucuuaugaucccacagaagaaauacccgcaccacuagguacaccugacuuuguagguaaaauacaaggaguauuaacacaaacaacacgcgcagauggaucaacacgagggcauaaagcaacaguuuacacagguagugcagauuucgcaccaaaacuaggucgaguacaauucgcaacugauacaaauaacgauuucgaugcuaaucaaaauacuaaauucacaccaguaggaguuauacaagacggcgauacugcacaucgaaaugaaccacaacaauggguacuaccaucauacucaggaagaaacucacauaacguccaccuagccccugcaguagcaccuacuuuuccaggagaacaauuacuauucuuuagaucaacuaugccaggauguucaggauauccaaacauggauuuagauugucuauuaccccaagaauggguacaauauuucuaucaagaagcagccccagcacaaucugauguagcauuacuuagauuuguaaacccugacaccggcagaguauuauucgaauguaaauuacauaaaucaggauauguaacaguagcucauaccggccaacaugauuuagucauaccaccaaauggcuauuuuagauucgauucauggguaaaucaauucuacacucucgcaccaaugggaaaugguacuggaagacgacgagcauuauaa

SEQ ID NO: 31639 - RNA, 1623 nt, Artificial Sequence
  derived and/or modified sequence opt6 from VP1__Norovirus__AGS08154
augaaaauggcuuccucagaugccaacccaucugaugguucagcagcaaaccuuguuccagaaguuaacaaugaaguaauggcauuagaaccuguuguaggagcugcuauagccgcacccguugcuggucaacaaaauguaauagacccauggauccgaaauaacuuuguacaagcuccaggcggagaauuuacaguaucaccccgaaacgcaccuggugaaauauuauggucagcuccucuugguccagaccuaaauccuuaucuuucacaucucgcaagaauguauaacgguuaugcaggugguuuugaaguagaaguaaucuuagcuggaaaugcauucacugcaggaaaaauaauauuugcugcaguaccaccaaauuuuccaacagaagguuuaucaccuucacaaguaacuauguuuccucauauaauaguagacguaagacaacuagaaccaguccugauaccucuuccugacguuagaaauaacuucuaucacuauaaucaaucuaaugauucuacaauuaaauuaauagcuauguuauacacaccguuaagagcaaacaaugcaggcgacgacguuuuuacaguaucaugucgaguucuaacaaggccaagcccagauuuugacuucauauuucuaguacccccaaccgucgaaucuagaacaaaaccuuuuucaguaccaguucuaacaguagaagaaaugacuaacucaagauucccaauuccacuugaaaaacuauucacaggaccaucaucagcauuugugguacaaccacaaaaugguagaugcaccacugacggcguccuuuuaggaacuacacaauuaaguccaguuaauaucuguacauuucgaggcgacguaacacacauaacaggcucacgcaauuacacaaugaauuuagcaucccaaaacuggaacaauuacgauccaacagaagaaauaccagcuccucuaggaacacccgauuucguaggaaaaauacaaggaacauuaacucaaacaacacgaacagacggaucuacacgaggccacaaagccacaguauacaccggaucugcugauuuugcuccaaaauugggcagaguacaauucgaaacagauacagaucacgauuuugaagcaaaccaaaauacaaaauuuacacccguagguguuauucaagauggaucaacaacacaucgaaaugaaccacaacaauggguauuaccaaguuauagcggaagaaauacacauaauguacacuuagcacccgcaguagcaccuacauuuccaggugaacaauuacuauucuuucguaguacaaugccaggaugcucaggcuauccaaauauggaucuugauuguuuacuaccacaagaauggguacaauauuucuaucaagaagccgcuccugcccaaucagacguagcacuucuacgauucgucaacccagacaccggaagaguccuauuugaauguaaacuucauaaaucaggauacguaacagucgcccauacaggacaacacgaucuugucauaccaccuaauggcuauuuccgcuucgauucauggguaaaccaauuuuauacauuagcaccaaugggaaacggcacuggcagacgacgcguaguuuaa

SEQ ID NO: 31640 - RNA, 1623 nt, Artificial Sequence
  derived and/or modified sequence opt6 from VP1__Norovirus__AGS08157
augaaaauggcaucaucugacgcaaacccaucagauggaucagccgcuaaccucguaccagaaguaaauaaugaaguaauggcuuuagaacccguuguuggagcagcaaucgcugcaccaguagcuggucaacaaaauguaauagaucccuggauaagaaauaacuucguacaagcuccaggaggagaauucacuguaucaccuagaaaugcccccggagaaauucucuggucugcaccauuaggaccagaucuuaacccuuacuuaucacacuuagcaagaauguauaauggauaugcaggagguuucgaaguccaaguaauacuugcaggaaaugcauucacagcuggaaaaguaauauucgcagcaguuccuccuaauuucccaacugaaggcuuaaguccuucccaaguuacaauguuuccccacauaguaguagacguuagacaacuagaaccaguauuaauaccacuaccugacguuagaaacaauuucuaccacuauaaccaaagcaaugacccaacaauaaaacuaauugcaaugcuauauaccccacucagagcuaacaacgcaggagaugacguauuuacaguuuccuguagaguauuaacacguccaucaccagauuucgauuuuaucuuuuuaguaccaccaaccgucgaaucucgaacuaaaccuuucucaguaccaguucuaacaguagaagaaaugacuaacucuagauuucccauaccacuagaaaaacuuuuuacaggaccgucauccgcuuucguaguacaaccucaaaacggaagaugcacaacagacggcguccucuuaggaacaacucaacuaucaccaguaaacauuuguacauuucgaggugacguaacacauauuacaggaucacgaaauuacacaaugaauuuagcaucacaaaacuggucaaacuaugauccuaccgaagaaauaccagcaccauuagguacaccagacuuuguuggaaaaauacaaggaguacuuacacaaacaaccagaacagacggcucaacacgaggacacaaagcaacaguauauacaggauccgcagacuuugcaccuaaacuaggacgaguccaauucgaaacugauacagaucgagacuucgaagcaaaccaaaauacuaaauucacaccaguaggaguaauacaagauggaggcaccacucauagaaacgaaccucaacaauggguauuaccuuccuauucuggaagaaauacgccaaauguacauuuagcuccagcagucgcaccaacauucccaggagaacaauuauuauuuuuuaggucaacaaugccaggauguuccggauauccaaacauggaucuagacuguuuauuaccucaagaauggguacaauacuucuaccaagaagcugccccagcacaauccgauguagcucuauuaagauuuguuaacccugauacuggaagaguauuauucgaauguaaacuccauaaaucuggauaugucacaguagcacauacaggacaacaugauuuagucaucccacccaacgguuauuucagauucgacucauggguaaaucaauuuuauacauuagcaccgaugggaaauggaaccggacguagacgagcauuauaa

SEQ ID NO: 31641 - RNA, 1623 nt, Artificial Sequence
  derived and/or modified sequence opt6 from VP1__Norovirus__AGS08158
augaaaauggccuccucugacgcaaacccuucagacggaucagcagcaaaucuaguaccagaagucaacaaugaagucauggcacuugaaccagucguaggagcugcuauagcagcaccaguugcuggacaacaaaauguaauagauccuuggauaagaaacaauuuuguacaagcaccagguggagaauucacaguuucuccaagaaacgcaccuggagaaauauuauggucagcaccauuaggaccagaucucaaccccuaccuaagccauuuagcaagaauguauaacggcuacgcaggaggauuugaaguacaaguaauacuagccggaaaugcuuucacagcuggaaaaguaauauucgcagcaguaccaccuaacuuuccuacagaaggccuaucaccaucacaaguaacaauguuuccccacauaguaguugauguaagacaauuagaacccguacuaauuccacuaccagacguacgaaacaauuucuaccauuacaaccagucaaacgacccaacuauaaaacuuauagcuauguuauacacaccauuaagagcaaacaacgcaggagaugaugucuuuacagucuccugucgcguuuuaacuagaccaagcccugacuuugauuucauuuuccucguaccuccaacagucgaaucacgaacaaaacccuuuucaguaccuguacucacuguugaagaaaugacaaauucuagauuuccaauaccacuugaaaaauuauuuacaggaccaucuucagcauucguaguccaaccacaaaauggacgcugcacaacagacggaguucuauuaggaacuacacaacuauccccaguaaauauauguacauuuagaggugacguaacacauauaacaggcucaagaaauuauacuaugaacuuagcaagccaaaacuggaauaauuaugauccaacugaagaaauaccagcaccauuaggaacuccugauuucguaggaaagauacaagguguucucacacaaacaacucgaacagaugguucuacccgaggccacaaagcaacaguauauacaggaagugcagacuuugcacccaaauuaggaagaguucaauucgaaacagauacagaucaugauuucgaagccaaucaaaauacaaaauuuacaccaguaggaguuauucaagauggagguacaacacaccgaaacgaaccacaacaauggguacuaccuuccuauucgggaagaaauacacauaacguacacuuagcgcccgccgucgcaccaacuuuuccuggagaacaauuacuauuuuuuagaaguaccaugccaggauguucugguuacccuaauauggaucuagacugccuucuaccacaagaauggguacaauauuuuuaucaagaagcagcaccugcacaaucagauguagcuuuacuaagauucguaaaccccgauacaggacguguuuuauucgaauguaaauuacauaaaucaggauauguuacaguugcccauacuggacaacacgaucuaguaauacccccuaacggauauuucagauucgauucauggguaaaucaauuuuacacacuagcacccaugggaaauggcacaggccgcagaagaguaauauga

SEQ ID NO: 31642 - RNA, 1623 nt, Artificial Sequence
  derived and/or modified sequence opt6 from VP1__Norovirus__AGS08160
augaaaauggcauccucugacgcaaacccaucugauggaucugccgcaaaccuaguuccugaagugaacaaugaaguuauggcacuagaaccaguagucggugcagcaauagcagcuccaguagccggacaacaaaaugucauagauccuuggauaagaaacaauuuuguccaagcaccaggaggagaauucacaguaucaccaagaaaugcaccaggagaaauuuuguggucagcaccacuaggaccugaucuaaauccauaucuuucacaucuugcacgaauguauaauggauaugcagguggcuuugaaguucaaguuauauuagcaggaaaugcauuuacagcaggcaaaguaauauuugcugcuguuccaccaaacuuuccaacagaaggacuaucaccaucucaaguaacaauguucccacauaucguaguagauguucgacaacuagaaccaguacucauaccacuacccgauguuagaaauaauuucuaccacuauaaucaaucaaaugauccuaccauaaaauuaauugcaauguuauacaccccccuaagagcuaacaaugcaggagacgacguauucacaguaucuugucgcguuuuaacuagaccaagucccgauuucgauuuuauauuccuuguuccuccaacaguagaaucacgaacaaaacccuuuucaguaccuguucuuaccguugaagaaaugacaaacucuagauuuccuauaccacuugaaaaacuauucacaggacccucaucugccuuuguuguccaaccacaaaacggcagauguaccacagaugguguuuuauuagguacaacacaacucucaccuguaaauauauguacauuuagaggugacguaacucacauaacagguuccagaaauuauacaaugaauuuagcaucacaaaacuggaacaacuacgauccaacugaagaaauaccagcuccauuaggaacaccugacuucguaggaaaaauacaagguguauuaacucaaacuacaagaacagauggcaguacuagaggacauaaagcaaccguauauacaggaucagcagauuuugcaccaaaacuaggacgaguucaauuugaaacagacacagaucaugauuucgaagccaaucaaaauaccaaauucacaccaguaggaguaauacaagauggaggcacaacacaccgaaacgaaccacaacaauggguuuuaccaucauacucaggaagaaacacaccaaacguacaucuagcaccagcaguugcaccuacauuucccggagaacaacuacuuuuuuuuagaaguacuaugccaggauguucaggauacccaaauauggaucuugacugcuuacucccucaagaauggguacaauauuuuuaccaagaagcagcaccagcacaaucugauguugcuuuacuaagauuugucaauccagacacaggacgaguacuauucgaauguaaacuccauaaaucagguuacguaacaguugcacacacaggacaacaugaucuaguaauaccccccaacgguuacuuucgauuugauucauggguuaaucaauucuauacucuagcaccaaugggcaaugguacaggacgucguagagcuuuauaa

SEQ ID NO: 31643 - RNA, 1623 nt, Artificial Sequence
  derived and/or modified sequence opt6 from VP1__Norovirus__AGS08161
augaaaauggcuucaucagaugcaaauccaagcgaugguuccgcagcuaacuuaguuccagaagucaauaaugaagucauggcucuagaaccagucguaggagccgcaauagcagcaccagucgcaggucaacaaaaugugauagacccauggauuagaaacaacuucguacaagcucccggcggcgaauuuacaguaucaccuagaaaugcuccaggcgaaauauuauggucugccccucuuggaccagaucuaaauccauaucuaucccaccuagcaagaauguauaacggauaugcuggaggauucgaaguacaagucauucuagcaggaaacgcuuuuacagcuggaaaaauaauauuugcagcaguuccacccaacuucccuacagaaggacuaucuccaucucaaguaacuauguuuccacauaucauugucgacguuagacaacuagaaccaguauuaauaccacuaccagauguaagaaacaauuuuuaucacuacaaccaauccaaugauucaacaauaaaacuaauagcaauguuauauacaccacuuagagcaaauaacgcaggagaugacguauuuacaguaucaugucgaguuuuaaccagaccaucaccagacuuugauuuuauauuuuuaguaccccccacaguagaaucaagaacaaaaccauuuucuguaccaguccuaacugucgaagaaaugacuaacagcagauucccaauuccacuagaaaaauuauuuacagguccauccucagcauucgucguacaaccucaaaaugguagaugcacaacugaugguguacuauuaggaacaacacaauuaucuccugucaauauauguacauuucgcggagauguaacacauauuacuggcagccgcaauuacacaaugaauuuagcuagucaaaauuggaacaauuaugaucccacagaagaaauacccgcuccacuaggaaccccugauuucguagguaaaauacaaggcauguuaacccaaacaacaagaaccgacggcucuacaagaggacauaaagcaaccguauauaccggaucagccgauuucgccccaaaauuaggacgaguacaauuugaaacagauaccgaccacgacuuugaagcaaaccaaaauacaaaauucacuccaguugguguaauacaagacggaagcacuacacaccgcaaugaaccacaacaguggguauuaccaucauacucaggaagaaauacacauaauguacacuuagcuccugcaguugccccaaccuucccuggggaacaacuacuauucuuuagaucaacaaugccagguugcucuggauauccaaacauggaucuagauuguuuacucccacaagaauggguacaauauuucuaucaagaagcagcacccgcccaaucagacguugcuuuacuuagauucguaaacccugauacaggaagaguuuuauucgaauguaaauuacauaaaucuggcuauguaacaguagcacauacaggucaacacgaucuaguaauuccuccuaauggauauuucagauuugauucuuggguuaaucaauuuuacacacuagcaccuaugggaaacggaacagguagaagaagagcaguuuaa

SEQ ID NO: 31644 - RNA, 1623 nt, Artificial Sequence
  derived and/or modified sequence opt6 from VP1__Norovirus__AGS08162
augaaaauggcuucaucugacgcaaaccccucagauggcucugcagcaaauuuaguaccagaagucaacaaugaaguaauggcacuagaaccaguaguaggugccgcaauagccgcaccaguagccggacaacaaaauguaauagacccauggauaagaaacaauuuuguacaagcaccugguggagaauucacuguaucaccaagaaaugcucccggcgaaaucuuauggucugcuccacuaggaccagauuuaaauccauacuuaucccaucuggcaagaauguauaauggauacgcaggugguuuugaaguacaaguaauacuagcuggcaacgcauuuacagcaggaaaaauaauuuuugcagcaguacccccaaauuuuccgacagaaggucuaucaccaucacaaguaacaauguucccacauauaauaguagauguaagacaacuagaaccaguacugauaccuuuaccagauguucgaaauaacuucuaccauuauaaccaaucaaaugauucuacaauaaaacuaauagcaauguuauacacuccccuaagagcaaacaaugcaggagacgaugucuuuacaguaagcugucgaguacuuacaagacccucacccgacuucgacuuuauauuucuaguaccaccaacugucgaauccagaacaaaaccauucuccguaccuguauuaacaguagaagaaaugacaaacucuagauuuccaauacccuuagaaaaacucuuuaccggaccaucuucagcuuucguaguacaaccacaaaauggacgauguacaacagacggcguacuucuagguacaacacaacuuucacccguaaauauauguacauuuagaggagacguuacacauauaacaggaucuagaaauuacacuaugaaucucgcaucacagaauuggaauaauuacgacccaacagaagaaauaccugcuccuuuaggaacaccagacuuuguugguaaaauucaaggaaugcuaacacaaacuacaagaacugacgguucuacucgaggacauaaagccacugucuauacagguuccgcggauuuugcuccaaaacuaggaagaguacaauucgaaacagauacagaucaugacuucgaagcaaaucaaaauacuaaauucacuccaguaggaguuauacaagacggauccacaacacacagaaaugaaccucaacaauggguucuaccaucuuauagcggaagaaacacacacaauguacacuuagcuccagcaguagccccaacauuuccaggagaacaacuccuauucuuucgcucaacaaugccuggaugcucaggcuaucccaacauggaucucgacugcuuacuuccucaagaauggguucaauauuucuaccaagaagcagccccugcacaaucagacguagccuuacuaagauuuguuaauccagacaccggaagaguacuauuugaaugcaaauuacauaaaucaggauauguaacuguagcucauacaggucaacaugauuuagucauaccucccaauggcuauuucagauucgacucauggguaaaucaauucuacacauuagcaccaaugggaaacggaacagguagacgaagaguaguauaa

SEQ ID NO: 31645 - RNA, 1623 nt, Artificial Sequence
  derived and/or modified sequence opt6 from VP1__Norovirus__AGS08163
augaaaauggcaaguucagacgcuaaccccuccgaugggucagcggcaaauuuaguaccagaagucaacaaugaaguaauggcacuagaaccaguaguuggagcagcaauugcagcaccuguagcaggacaacaaaauguaauugacccauggauaagaaauaauuuuguucaagcaccuggcggagaauuuacaguaucaccaagaaaugcaccaggcgaaauacuauggucagccccucucggaccagauuuaaauccauaccuaucacaccuagcaagaauguacaacggauaugcuggcggauuugaaguacaaguuauuuuagccggaaaugcauuuacagccggaaaaauaauauuugcagcaguaccaccaaacuucccaacugaaggacuaaguccaucacaaguaacaauguucccacauauaauaguagauguaagacaacuagaaccaguacuaauacccuuaccagacguacgaaacaauuucuaucacuauaaucaaucaaaugauucaacaauaaaacuaauagcuauguuauacacaccauuaagagcaaauaacgcaggcgacgacguuuucacagucucuugcagaguacuaacuagaccaagcccagacuucgacuuuauauuucuuguaccaccaacaguagaaucaagaacgaaacccuuuagcgucccagucuuaacaguagaagaaaugacaaauucuagauuuccaauuccauuagaaaaauuauuuaccggaccaaguucugcauuuguaguucaaccacaaaauggacgauguacgacugacggaguauuacuaggaacuacacaauuaucaccagucaauauaugcacauuuagaggcgauguaacacauauaacuggaucaagaaauuacacaaugaaccuagccucucaaaacuggaauaauuacgaucccaccgaagaaauaccagcaccccuaggaacaccugauuuugucggaaaaauacaaggaauguuaacacaaacuacacgcacugacggcucaacaagaggacacaaagcaacaguuuauacaggaucugcugauuuugccccaaaauuaggaagaguucaauuugaaacagauacagaccacgauuucgaagcaaaucaaaauacaaaauucacaccaguuggugucauacaagaugguagcacuacucacagaaacgaaccacaacaauggguacuaccaucauacucaggaagaaauacucauaauguacauuuagcaccagcaguagcacccacauucccaggugaacaauuacuauucuuccgaucaacaaugccaggaugcucaggauauccaaacauggaucucgauugcuuacucccacaagaauggguacaauacuuuuaccaagaagccgccccugcucaauccgauguagcauuauuaagauucguaaacccagacacuggaagaguucucuucgaauguaaacuccacaaguccgguuauguaacaguagcacauacgggucaacaugaucuaguaauaccaccaaauggauauuucagauucgauucauggguaaaucaauucuauacauuagcaccaaugggaaauggaacaggacgaagaagaguagucuaa

SEQ ID NO: 31646 - RNA, 1623 nt, Artificial Sequence
  derived and/or modified sequence opt6 from VP1__Norovirus__AGS08164
augaaaauggcuucaucugaugcaaauccuucagacggaucagcugccaaccucguaccagaaguaaacaaugaaguaauggcuuuagaacccguagucggagcugcaauagcugcaccagucgcaggucaacaaaaugucauagacccuuggauuagaaacaacuuuguacaagcaccuggcggagaauuuacuguauccccacgaaaugcaccaggagaaauuuuauggucagcaccacuaggaccagacuuaaauccauaccuaucacauuuagcuagaauguauaacggcuacgcugguggauuugaaguacaaguaauucuagcaggaaaugcauuuaccgccggaaaaguuauauuugccgcuguacccccuaacuucccaacagaaggucuuucaccaagccaaguaacaauguuuccccauauagucguugauguaagacaauuagaaccaguccuaauuccauuaccagauguaagaaacaacuucuaccauuauaaccaaucaaaugacccaacaauuaaauuaauagcuauguuauacacaccucuaagagcaaacaaugcaggagacgauguguucacuguaucauguagaguucucacaagaccaucaccagauuuugauuuuauauuucuuguucccccaacaguagaauccagaacaaaaccauuuuccguaccaguauuaacaguagaagaaaugacaaacucacgauucccaauaccucuagaaaaacuauuuaccggaccaucauccgcuuucguaguccaaccacaaaauggaagauguacaacagaugggguccuacucgguacaacacaauuaucacccgucaacaucuguacauuuagaggagacguaacacacauaacaggaucuagaaauuacacaaugaaucucgcuucacaaaacuggaauaacuacgauccaacagaagaaauaccagcaccacuagguacaccugacuuuguaggaaaaauacaaggcgucuuaacacaaacaacucgaacugacggaucaacaagaggacauaaagccacaguuuauacaggaucagcagauuuugccccaaaacuaggaagaguucaauuugaaacagauaccgaccacgauuucgaagcaaaucaaaauacaaaauucacuccaguaggcgucauacaagacggaggaacuacacauagaaaugaaccacaacaauggguucuaccuucauauucugguagaaacacacacaauguacauuuagcuccagcaguagcaccaacauuuccaggagaacaauuauuauuuuuuagaucaacaaugccaggauguucaggcuauccaaacauggaucuagauuguuuacuaccacaagaauggguacaauauuuuuaucaagaagccgcuccagcccaaucagacguagcuuuauuaagauuuguaaaccccgacacaggaagaguauuauuugaaugcaaauuacacaaauccggauaugucacaguagcacacaccggacaacacgacuuaguaauaccaccuaauggauauuuucguuucgauagcuggguuaaccaauuuuauacucuagcuccaaugggcaaugguacaggucguagaagagccguauaa

SEQ ID NO: 31647 - RNA, 1623 nt, Artificial Sequence
  derived and/or modified sequence opt6 from VP1__Norovirus__AGS08165
augaaaauggcuucaucagacgcaaacccaucugacggaucagcagcaaauuuaguaccagaaguuaacaaugaaguaauggcauuagaaccuguuguaggugcugcaauagcagcuccugucgcuggacaacaaaauguaauagacccauggauaagaaauaauuuuguacaagcgccaggaggcgaauucacaguaucaccacgaaaugcaccaggagaaauacuuuggucugcuccccuaggacccgauuuaaauccuuauuuaucacaucuagcucgaauguauaauggcuaugcaggcggauuugaaguagaaguaauuuuagcuggaaaugccuuuacagcaggaaaaauaaucuucgcagcaguuccuccaaacuuucccaccgaaggucuuaguccaucacaaguaacuauguucccacacauaauaguagacguucgacaauuagaaccaguauuaauaccacuaccagauguaagaaacaacuucuaucacuauaaucaaucaaaugacucaacaauaaaacucauagcaaugcuuuacaccccccuaagagcaaauaacgcaggagaugacguauucacaguuucgugcagaguacuaacgagaccauccccagauuuugacuuuauauuuuuaguuccaccaacuguagaaaguagaacaaaaccauuuucaguuccuguacuaacaguugaagaaaugacaaauucuagauuuccaauacccuuagaaaaacuuuuuacaggaccaagcucagcauucguaguacaaccacaaaauggacgauguaccacugacggaguacucuuaggaacaacacaacuuagcccaguuaauauauguacauuucgaggugacguaacacauauaacuggcucaagaaauuacacaaugaauuuagcaucacaaaauuggaauaacuacgauccaacagaagaaauaccagcacccuuaggaacaccagacuucguagguaaaauacaaggaauguuaacucaaacaacacgaacugacggaucuacuagaggucauaaagcaacagucuacaccggaucugcagacuucgcaccaaaacucggccguguacaauucgaaacugauaccgaccaugauuuugaagccaaccaaaacaccaaauuuacaccaguaggaguaauacaagauggauccacaacccauagaaaugaaccucaacaauggguauuaccuuccuauucaggacgaaacacacauaauguccaucuagcaccagcaguagcaccaacauucccaggcgaacaacuacuauuuuuuagaucuaccaugccuggauguucagguuauccaaauauggacuuagauugccuucuaccucaagaauggguacaauauuucuaucaagaagcagcuccugcacaaucugauguagcauuauuaagauucguuaauccugacacaggacgagucuuauuugaaugcaaacuacauaaaucaggauauguuacaguagcacacacaggacaacacgacuuaguaaucccaccaaauggauauuuucgauuugauuccuggguaaaucaauuuuacacucuugcacccaugggaaaugguacugguagaagacguguaguuuaa

SEQ ID NO: 31648 - RNA, 1623 nt, Artificial Sequence
  derived and/or modified sequence opt6 from VP1__Norovirus__AGS08166
augaaaauggcaucaucagacgcaaauccaagcgaugguagcgccgcuaaccuaguaccagaaguaaacaacgaaguaauggcuuuagaacccguaguaggagcagcuauagcugccccuguagcaggacaacaaaauguaauugacccauggauaagaaauaauuucguacaagccccagguggagaauuuacaguauccccacgaaacgcaccaggagaaauauuauggucagcaccacucggacccgacuuaaauccauauuuaucccauuuagccagaauguauaauggauaugcagguggauucgaaguucaaguaauauuagcuggaaaugcauuuacugcaggcaaaauaauauucgcagcaguaccaccuaauuuuccaacugaaggucuuuccccaagucaaguuacaauguuuccacacauaauaguugauguacgacaacuagaacccguccuaaucccacucccagauguuagaaauaacuucuaucacuauaaucaauccaaugauuccacaauaaaauuaauagcaaugcucuacaccccacuuagagcuaacaaugcaggagaugauguauuuaccguaucaugcagaguuuuaacccgaccaucuccugauuuugacuucauauuccuaguuccaccaacuguagaaucucguacuaaaccuuucucaguaccuguacuaacaguugaagaaaugacaaauucuagauuuccaauaccccuagaaaaauuauuuacaggacccucaucugcuuuuguuguacaaccacaaaaugguagguguacaacagauggaguacuacuaggaacaacacaauuaucuccaguuaauauauguacauuuagaggagacgucacucauauaacaggaucuagaaauuacacaaugaaucuugcaucacaaaauuggaauaauuaugauccaacagaagaaauaccagcaccauuaggaacaccagauuuuguaggaaaaauacaaggaauguuaacacaaacaaccagaacagacggaucaacaagaggacacaaagcaaccguauacacagguuccgcagacuuugcacccaaauuaggccgaguacaauucgagacagauacagaucaugauuucgaagcuaaucaaaacacaaaauuuacaccaguuggaguaauacaagauggcuccacuacacacagaaaugaaccacaacaaugggucuuaccaagcuacucgggacgcaacacacacaacguacacuuagcaccagcaguagcaccaacauuuccuggagaacaacucuuauuuuuucgaaguaccaugccaggcugcucuggauauccuaauauggaucucgacugucuauuaccucaagaauggguccaauauuucuaccaagaagcagccccagcucaaucagacguggcacuuuuaagauucguaaauccagacacaggacgaguauuauucgaauguaaauuacacaaaagcggauauguaacaguagcacauacuggacaacaugauuuaguuauacccccuaauggcuauuucagauucgauuccuggguaaaucaauuuuauaccuuagcccccaugggaaauggaacaggucgaagacgaguuguauaa

SEQ ID NO: 31649 - RNA, 1623 nt, Artificial Sequence
  derived and/or modified sequence opt6 from VP1__Norovirus__AGS08167
augaaaauggcuucuucagacgcaaacccauccgauggaucagcagccaacuuaguaccugaaguaaacaaugagguaauggcucuagaaccaguaguaggagcagcaauagcugcaccaguugcaggacaacaaaaugucauagacccauggauuagaaauaauuucguccaagcuccaggaggugaauucacagucucaccacgaaaugcgccuggagaaauacuauggucagcccccuuagguccagaccucaaucccuauuuaucucaccuagcacgaauguauaauggcuaugcaggaggauuugaaguacaaguaauucucgcugguaacgcauuuaccgcaggaaaaauaauauuugcugcaguaccaccuaauuucccaacugaagguuuaucaccaucucaaguaacaauguucccacacauaaucguugacguaagacaauuagaacccguacuaauaccucucccugacguaagaaacaacuucuaccacuacaaccaaucaaacgacucuacuauaaaauuaauagccauguuauauacaccacuacgugcaaacaaugcaggcgaugauguauuuaccgucuccugcagaguucuuacaagacccucacccgacuucgauuuuauauuucuaguaccacccacuguagaaucaagaacuaaaccuuuuucuguaccaguauuaacaguugaagaaaugacaaauucuagauuucccauuccucuagaaaaacuauuuacuggacccucaaacgcauucgucguacaaccacaaaacgguagauguacaacugacggaguacuccuagguaccacucaauuaucaccaguaaauauauguacauuuagaggugauguaacccacauaacuggaucacgcaauuauacaaugaacuuagcaucacaaaauuggaauaauuaugacccaacagaagaaaucccagccccacuaggaacacccgacuuuguaggaaaaauucaaggaauguuaacacaaaccacaagaacagauggaucaacaagaggucauaaagcaacaguauacacaggaucagccgacuucgcaccaaaauuaggucgaguacaauucgaaacagauaccgaccacgauuuugaagcaaaccaaaauacuaaauuuacaccaguaggaguaauucaagaugguuccacaacucaucgcaaugaaccacaacaauggguacuacccucauacucagguagaaacacucauaauguacauuuagcacccgcaguugccccuaccuuccccggugaacaacuauuauucuuucgaucuaccaugccaggauguucaggauauccaaacauggaccuugauugcuuacuaccacaagaauggguacaauauuucuaccaagaagcugcucccgcacaaucugacguagccuuacuaagauucguaaacccugacacugguagaguacuauuugaauguaaacuacacaaauccggauauguaacuguagcacauacaggacaacaugauuuagugauaccaccaaauggcuauuuuagauucgauuccuggguaaaucaauuuuacacacuagcuccaaugggaaacggaacgggaagaagacguguaguauaa

SEQ ID NO: 31650 - RNA, 1623 nt, Artificial Sequence
  derived and/or modified sequence opt6 from VP1__Norovirus__AGS08168
augaaaauggcaucaucagacgcuaauccaucagauggaucagcagcaaaccuaguaccagaaguaaacaaugaagucauggcucuagaaccaguagucggugccgcuauagcagcaccaguagcaggacaacaaaauguaauugauccauggauacgaaauaauuucguacaagcaccaggcggagaauuuacaguaucacccagaaaugcaccaggagaaauucuaugguccgccccacucggaccugauuuaaaucccuaccuaucacaccuugcacgaauguacaacggauaugcaggcggcuucgaaguugaaguaauucuagcagguaacgccuuuacagcaggcaaaauaauauuugcagcaguaccuccuaacuucccaaccgaaggucuaucuccaucacaaguuacuauguucccucacauuauaguagauguacgucaauuagaaccaguacuaauuccacuucccgauguuagaaacaauuucuaccacuacaaccaaucaaacgacucaacaauaaaacuuauugcaauguuauacacaccacuacgagcaaacaacgcaggugacgaugucuucaccgucuccuguagaguucuaacaagaccuagcccagacuucgauuuuauauuuuuaguaccccccacaguagaaucacgaaccaaaccauucucuguaccaguccuaacaguagaagaaaugacaaauucuagauuuccaauaccacuugaaaaauuauucaccggaccaucaucugcauucguaguacaaccacaaaacggacgauguacaacugacggagucuuacuagguacaacacaauuaucuccggucaauauauguacauuuagaggagacguaacucacauaacaggaucaagaaauuacacaaugaaccuagcuucacaaaauuggaacaacuaugaccccacagaagaaaucccagcaccauuaggaacaccagacuuuguaggaaaaauacaaggaaugcuaacacagaccaccagaacagauggauccacaagaggacacaaagccacugucuacacaggcucagcugacuuugcaccaaaauuaggaagaguacaauucgaaacugauacagaucacgacuucgaagcuaaucaaaauacaaaauuuacaccaguaggcguuauacaagauggcucaacaacacaucgaaacgaaccacaacaauggguucuaccaucauauagcggaagaaauacacauaacguacacuuagcuccagcaguagcaccaacauucccaggggaacaauuacuauuuuucagaucaacaaugccagguuguucaggauaccccaacauggaucucgacugccuacuaccacaagaauggguacaauauuucuaucaagaagcugcaccagcucaaucugauguagcauuacuaagauucguaaacccagauacaggaagaguacuuuuugaaugcaaacuucauaaaucaggcuauguaaccgucgcacacacuggacaacaugaucucguaauaccuccaaacggauauuuucguuucgacagcuggguaaaucaauuuuacacccuagcuccaaugggaaauggaacuggaagaagaagaguaguguaa

SEQ ID NO: 31651 - RNA, 1623 nt, Artificial Sequence
  derived and/or modified sequence opt6 from VP1__Norovirus__AGS08169
augaaaauggcuucaucagacgcaaacccaucugacggcucagcagccaacuuagucccagaagucaacaacgaaguaauggcacuagaaccuguaguaggagcugcaauagcagcaccaguagcaggucagcaaaauguaaucgauccuuggaucagaaauaauuuuguacaagcaccaggaggagaauuuacaguaagcccaagaaaugccccaggugaaauacucuggucugccccucuaggaccagaccuaaauccauauuuaucacaccuagcaagaauguauaacgguuacgcaggcggauuugaaguacaaguaauccuagcuggaaaugcguucacagccggaaaaauaauauucgcagcaguuccaccaaauuucccuacagaaggucuuucacccucacaaguuacaauguucccucacauaauagucgacguuagacaacuagaaccaguauuaauaccacuacccgacauacgaaacaauuuuuaucauuauaaccaaucaaacgacucuacaauaaaacuaaucgcaauguuauacacaccauuaagagccaauaaugccggagaugauguauuuacuguaucauguagaguacuaacuagaccaaguccugauuucgacuuuauauuucuaguuccaccaacaguugaaaguagaacaaaaccauuuucagucccaguauuaacaguagaagaaaugacaaacucacgauucccaauaccauuagaaaaacuauuuacaggaccaucaagugcuuucguuguacaaccccaaaauggacguuguacuacagacgguguauuauuaggaacuacacaacuaucuccaguaaauauuugcacauuuagaggagauguaacacauauuacagguucaagaaauuacacaaugaaucuagcaagccaaaauuggaacaacuacgaucccacagaagaaauaccagcaccucuagguacucccgacuuugucggaaaaauacaagguguacuaacacaaacaacaagaacagauggcucaacuagaggacacaaagccacuguauauacaggaucagcugacuucgcacccaaacuaggccgaguacaauucgaaaccgauaccgaucaugauuuugaagcaaaccaaaauacaaaauucaccccaguagguguaauacaagauggaucaacgacacaccgaaaugaaccccaacaaugggucuuaccaucauauucaggaagaaauacacauaauguucaccuagcccccgcagucgccccaacauuuccaggagaacaauuacuuuuuuuuagaucaacaaugccugguuguucaggauauccaaauauggaucuagauugccuacuaccacaagaauggguucaauacuuuuaucaagaagcagcaccugcccaaucagauguagcauuguuacgauucgucaauccagacacaggaagagucuuauuugaauguaaacuucauaaauccgguuauguaacaguagcacacacaggccagcaugauuuaguaaucccuccaaauggauauuucagauucgacucaugggucaaucaauuuuacacacuagcaccuauggguaacggaacuggacgaagaagaguaguauaa

SEQ ID NO: 31652 - RNA, 1623 nt, Artificial Sequence
  derived and/or modified sequence opt6 from VP1__Norovirus__AGS08170
augaaaauggcaucuucagaugcaaacccaucagacggcucagccgcaaacuuaguuccugaagucaauaacgaaguaauggcacuagaaccuguuguaggugcagcaauagcugcaccaguagcaggacaacaaaauguaauugacccauggauucgaaacaauuuuguacaagcgcccggaggcgaauuuacagucucaccucguaaugccccaggagaaauauuauggucugcaccacuaggcccagaucuaaaucccuaucuaucucaucuagcacguauguauaacggcuaugcuggaggauuugaaguacaaguaauauuagccggaaacgccuuuacagcgggaaaaaucauauucgccgcaguaccuccaaacuuuccaacagaaggacuuucuccaucucaaguuacaauguucccacauauaauaguagauguacgucaacuagaaccaguccuaauuccacuuccagauguaagaaauaauuuuuaucauuacaaccaaucaaaugacucaacaauuaaacuaauagcuaugcuuuauacuccauuaagagcaaauaacgcaggagacgauguauuuaccguauccuguagaguucucacaagaccaucaccagauuuugacuuuauauuucucguaccccccacaguugaaaguagaacuaagccuuuuucugucccaguacuaaccgucgaagaaaugacaaacucaagauuucccauuccacuagaaaaacuauuuacagguccuucuucagcauucguuguucaaccacaaaacggacgauguacaaccgacggaguacuauuaggaaccacccaacuauccccaguaaauauaugcacauuuagaggagauguaacacauauaaccggauccagaaacuacacaaugaaucuagccucccaaaacuggaacaacuacgauccuacagaagaaauaccugccccucuuggaacaccagacuucguuggaaaaauacaagguaugcuaacacaaacaacuagaacagacggauccacaagaggacauaaagcaacagucuacaccggaucagcugauuucgcaccaaaacuaggaagaguacaauucgaaacagauaccgaccaugauuuugaagcaaaucaaaacacaaaauucacaccuguaggaguaauacaagacgguucaacaacccaccgaaacgaaccucaacaauggguacuuccaucauauaguggacgaaauacacacaauguucacuuagcaccagcaguagcuccaacuuucccaggcgaacaguuauuauuuuucagauccaccaugccaggaugcucaggauauccaaauauggacuuagacugcuuacucccacaagaauggguccaauauuuuuaucaagaagccgcaccagcacaaucagacguagcauuacuaagauuuguaaauccagacacaggacgaguauuauuugagugcaaauuacauaaaucaggauauguuacaguugcacacacuggacaacacgaucuaguaauaccacccaacggauacuucagauuugauucaugggugaaucaauuuuauacacuagcaccuaugggaaauggaaccggaagaagacgaguagucuaa

SEQ ID NO: 31653 - RNA, 1623 nt, Artificial Sequence
  derived and/or modified sequence opt6 from VP1__Norovirus__AGS08171
augaaaauggcauccuccgaugcuaauccaucagacggaucagcugcuaaccuaguaccagaaguuaauaaugagguaauggcucuagauccaguaguuggagcagcaaucgcagcaccuguagcaggacaacaaaaugucauagacccauggauaagaaacaacuuuguacaagcaccaggcggugaauuuacaguuucaccuagaaaugcaccaggagaaauacuauggucugcaccauuaggaccagaucuaaauccauauuuaucacaccucgcaagaauguauaaugguuacgccggaggauucgaaguccaaguaauacuagcaggcaaugcauucacagcaggaaaaauaauauuugccgcaguaccaccuaauuuucccacugaaggacuaucaccaucacaagucacaauguuuccccacauaauaguugauguaagacaauuagaaccaguacuaauaccacucccugauguaagaaauaauuucuaucacuauaaucaauccaacgacagcacaauuaaauuaaucgcaauguuauacacacccuuaagagcaaacaaugcaggugaugacguauuuacaguauccugucgaguucuaacaagaccaagcccagauuuugauuuuauauuucuuguuccaccaaccguugaaucucgaacuaagccauucucuguaccaguauuaacaguagaagaaaugacaaacagccgauuccccauaccauuagaaaaacuauucacaggaccauccucagcauuuguuguacaaccacaaaaugguagauguacaacugauggaguacuacuaggcaccacacaauuaucaccuguaaauauauguacauuuagaggugacguaacacauauaacaggaucacgaaauuauacuaugaaucuagccucacaaaauuggaacaauuaugauccuacagaagaaauaccagccccacuagguaccccugauuucguagguaaaauucaagggaugcuaacacaaacaacgaggacagacggaucaacucgaggacauaaagcuacaguauacacaggaucagcagacuuugcaccaaaauuaggaagaguccaauucgaaacagauacagaucaugauuuugaagcaaaccaaaauacaaaauucacaccaguuggaguaauacaagacggaaguacuacacacagaaaugaaccacaacaauggguauuaccgucuuauaguggaagaaauacacauaacguacaccuugccccugccguugcacccacauucccaggagaacaauuauuauuuuuuagaucuaccaugccagguugcucgggcuauccuaauauggaucuagauugcuuauuaccacaagaauggguucaauacuucuaucaagaagcugccccagcucaaucugauguugccuuauuacgauucguaaauccagauacaggaagagucuuauucgaaugcaaauuacauaaaucaggauauguaacagucgcacauacaggacaacacgacuuaguaauaccaccaaauggauauuucagauucgacuccuggguaaaucaauuuuacacacuagcaccaaugggaaacgguacaggcagacgacguguagucuaa

SEQ ID NO: 31654 - RNA, 1623 nt, Artificial Sequence
  derived and/or modified sequence opt6 from VP1__Norovirus__AGS08172
augaaaauggcaucaucugaugcaaauccaucagacggaucagcagcaaaccuaguaccugaaguaaacaaugaaguuauggcacuagaaccaguaguaggagcugcaauagcugcaccuguagcaggccaacaaaacguaaucgacccauggauccgaaauaacuuuguccaagccccaggaggagaauuuacagucuccccaagaaacgccccaggcgaaauacuauggucugcaccauuaggaccagacuuaaacccauaucucucacaccuagccagaauguauaauggauaugcaggcggauucgaaguacaaguuauacucgcaggaaacgcauuuacagcaggcaaaguaauuuuugcagcugucccuccuaauuuuccaaccgaaggucuaucaccaucacaaguuacaauguucccacauauaguaguagacguuagacaacuagaaccaguauuaaucccacucccugauguaagaaauaauuuuuaccauuacaaccaaucuaacgacccaaccauaaaacuaauagcaauguuauauacaccauuaagagcuaacaacgcaggcgaugauguauuuacuguuucuuguagaguacuaacaagaccuucaccagauuuugacuucauauuucuaguuccaccaacaguagaaucaagaacuaaaccuuuuuccgucccaguauuaacaguugaagaaaugacaaauuccagauucccaauaccauuagaaaaacucuuuacaggacccucuagugcauucguuguacaaccacaaaaugguagauguacaacugacgguguauuauuagguaccacucaauuaucuccagucaacauauguacauuuagaggagauguaacacacauaacaggaucaagaaacuacacaaugaaccuagcaucacaaaacuggaacaauuaugaccccacagaagaaauaccagccccuuuaggaacuccugauuuugucgguaaaauccaaggcgucuuaacacaaacaacaagaacugacgguagcacacgaggucacaaagcaacuguuuauacaggaucagcugauuuugcaccaaaauuaggaagaguacaauuugaaacugauacagaucaugauuucgaggcuaaucaaaauacuaaauucacaccaguuggaguaauacaagacggugguacaacacauagaaaugaaccucaacaauggguauuaccgucauauucaggaagaaauacacacaacguucacuuagcacccgcaguagccccaacauuucccggagaacaauuauuauucuuuagaucaacaaugccaggaugcucaggauauccaaauauggaccuagauugccuccuaccacaagaauggguacaauauuucuaccaagaagcagcccccgcacaauccgacguagcauuacuacgauuuguaaacccagauacaggaagaguauuauucgaaugcaaauuacauaaaucaggauauguaacaguagcacacaccggucaacacgacuuagucauaccacccaauggauauuuucguuucgauagcuggguaaaucaauuuuacacacuagcuccaaugggcaaugguacaggcagaagaagagcaguauaa

SEQ ID NO: 31655 - RNA, 1623 nt, Artificial Sequence
  derived and/or modified sequence opt6 from VP1__Norovirus__AGS08173
augaaaauggcuucaucagacgccaaucccucagaugguuccgcugcaaacuuaguaccagaaguaaauaaugaaguaauggcucuugaaccaguaguaggagccgcaauagcugccccagucgcaggacaacaaaauguaauugacccauggauacgaaauaacuuuguacaagcacccggaggagaauuuaccguaaguccaagaaaugcaccaggagaaauacucugguccgcaccucuagguccagaucuaaauccuuaucuuucacaccuagcuagaauguacaacggauacgcaggaggauucgaaguagaaguaauucucgcaggaaacgccuuuaccgcaggaaaaaucauuuucgccgcuguaccaccaaacuuuccaacagaaggauuauccccaucacaaguaacaauguucccacauauaauaguagacguacgccaauuagaaccuguauuaauaccauuaccagauguucgaaacaauuuuuaucauuauaaccaaucaaaugauucuacaauaaaacucauagcaaugcucuacacuccccuacgagcuaauaacgcaggggaugacguauuuacaguaucaugcagaguauuaacacgaccauccccugacuuugauuucauauuucuaguuccaccuacaguagaaucucgaacaaaaccauucucagucccaguacuuacaguagaagaaaugacuaacucaagauucccaauaccguuagaaaaacucuucacaggaccaucaucagcuuucguaguccaaccacaaaacgguagaugcacaacugacggaguauuauuaggaacuacacaauuaucaccugucaacauauguaccuuuagaggagauguaacacacauaacaggaucaagaaauuacacaaugaaucuagccucacaaaacuggaacaacuacgauccaacagaagaaauaccagcaccauuaggaaccccagacuucguugguaaaauacaaggaaugcucacacaaacuacacgaacagaugguaguacaagaggacacaaagcuacagucuacacaggaucagcagacuucgcaccaaaauuaggccgaguacaauucgaaacagauacagaucaugauuucgaagcuaaucaaaacacaaaauuuacaccaguaggaguaauacaagacgguucuacaacacaucgaaacgaaccacaacaaugggucuuaccuagcuauagcggaagaaacacacacaauguacauuuagcaccagccguagcacccaccuucccaggagaacaguuauuauuuuuucgaucuacaaugccuggauguagcggauauccaaauauggauuuagacuguuuauuaccacaagaauggguacaauacuuuuaccaagaagcagcaccagcucaaagugacguagcacuacuacgauucguuaacccagacacuggaagaguauuauucgaauguaaacuccauaaauccggauauguaacugucgcacacacaggccaacacgauuuagucauaccaccuaacggauacuuuagauucgacucauggguaaaccaauuuuacacacuugcuccaaugggaaacggcacaggaagacgaagagucguauaa

SEQ ID NO: 31656 - RNA, 1623 nt, Artificial Sequence
  derived and/or modified sequence opt6 from VP1__Norovirus__AGS08174
augaaaauggcaagcucagacgccaacccaagcgauggaucagcagcaaauuuaguuccagaaguaaauaacgaaguuauggcauuagaaccaguagucggagcugcaauagccgcaccaguagcaggacaacaaaacguaauugacccauggauaagaaauaacuuuguacaagcaccaggaggagaauuuacaguuucaccaagaaaugcuccuggagaaaucuuauggucagccccucuaggaccagaucuaaacccuuacuuaucccaccuagcacgaauguauaacggauacgcaggcgguuuugaaguccaaguuauacuagcaggaaaugcauuuaccgcuggaaaaauaaucuucgcagcaguuccaccaaacuuuccaacugaaggccuaucaccaucccaaguuacaauguuuccacauauuauaguagauguaagacaauuagaacccguccuaauuccacuccccgauguaagaaauaacuuuuaucacuacaaucaaagcaaugacaguacaauaaaauuaauagcaaugcuauacacuccacuaagagcaaacaacgccggagaugauguauuuaccguaucuuguagaguacuuacaagacccucccccgacuuugacuuuauauucuuagucccuccaaccguugaaucaagaacaaaaccauucucaguaccaguucuuacaguagaagaaaugacuaacucaagauucccaauuccacuagaaaaacuuuucaccgguccaucaucagcauuuguaguacaaccacaaaacggaagauguacaacagauggaguauuauuaggaacaacacaacuauccccaguaaacaucugcacauuuagaggugacguaacacauaucacaggaucuagaaauuauacaaugaacuuagcaucacaaaacuggaacaacuacgauccuacagaagaaauaccagccccuuuaggcacaccagauuuuguagguaaaauacaagguaugcuaacacaaacaaccagaacugacgguucaacaagaggacacaaagccacaguauauacagguucagcagacuuugccccaaaauuaggacgaguucaauucgaaacagauacagaucaugauuucgaagcaaaccaaaauacaaaauucacaccugucggaguaauacaagacggcucaacaacucacagaaaugaaccacaacaauggguauuaccaucauacucaggaagaaauacccacaauguccauuuagcaccagcaguagcaccuaccuuuccaggagaacaacuauuauuuuuucgcucaacaaugccuggaugcucaggauauccaaauauggacuuagauugcuuacucccacaagaauggguacaauacuucuaucaagaagccgcaccagcacaaucugauguugcauuacucagauuuguuaacccugacaccggacgagucuuauuugaaugcaaacuacauaaauccggauacguaacaguagcacauacaggacaacacgauuugguaauaccaccaaauggauacuuccgcuucgauucauggguaaaucaauuuuauacauuagcaccaaugggaaauggcacugguagaagacgaguaguauga

SEQ ID NO: 31657 - RNA, 1623 nt, Artificial Sequence
  derived and/or modified sequence opt6 from VP1__Norovirus__AGS08175
augaaaauggccucauccgacgcaaacccaucagauggaucagcagcgaaccuuguaccagaaguaaacaacgaagugauggcauuagaaccaguagucggagccgcaauagcagcaccaguagcaggccaacaaaaugucauagauccauggauaagaaacaauuuuguacaagcuccaggcggcgaauuuacaguaagcccaagaaaugcacccggagaaauauuauggagcgcuccacuagguccagauuuaaauccauaccucucucaucuagcaagaauguauaacgguuaugcaggagguuuugaaguccaaguuauacuugcagguaaugcauuuacagccggaaaaguaauauuugcagcagucccaccaaauuuuccaacagaaggucucaguccaucucaaguaacaauguuuccacacauuguaguagauguacgacaauuagaaccaguccuaauaccucuucccgacguuagaaauaauuuuuaucacuacaaucaaucaaaugauccaacaauuaaauuaauagccaugcuauacacuccucuaagagcaaauaaugccggagacgacguuuucacaguauccugucguguacuaacaagacccucaccagacuuugauuucauuuuucuaguaccaccuaccguagaaucucgaacaaaaccauuuucaguaccuguuuuaacaguagaagaaaugacaaacucaagauuuccaauuccacucgaaaaacuauuuacaggaccaucaucagcauuuguaguucaaccgcaaaacggaagaugcacaacagacgguguuuuauuaggaacuacacaauuaucuccaguuaauauauguacauuucgaggugauguuacucauaucacaggcucuagaaauuauacaaugaauuuagcaagccaaaauuggucaaauuaugacccaacagaagaaaucccagcaccauuaggaaccccugacuuugucggaaaaauccaagguguacuaacacaaacuacaagaacagacgguagcacaagaggacauaaagcaacaguauauacaggaucagccgauuuugcuccaaaacuaggaagaguacaauuugaaacagauacugaucacgauuuugaagcaaaucaaaacaccaaauuuacaccaguagguguaauacaagacggauccacaacacaccgaaaugaaccucagcaauggguacucccaagcuauuccggucgcaauacaccaaacguucacuuagcuccagcaguagcaccaaccuucccaggagaacaauuauuauucuuuagaucaacaaugcccggauguucagguuaucccaauauggacuuagacugcuuauuaccccaagaauggguacaauauuuuuaucaagaagcagcaccugcacaaucagacguagcauuacuaagauuuguuaaucccgacacaggacguguuuuauuugaauguaaacuucacaaaucagguuacguaacaguagcgcauacuggucaacacgaucuuguaaucccaccaaauggauacuucagauucgacuccuggguaaaucaauuuuauacacuagcaccaaugggaaauggaaccggaagacguagagcuuuauaa

SEQ ID NO: 31658 - RNA, 1623 nt, Artificial Sequence
  derived and/or modified sequence opt6 from VP1__Norovirus__AGS08176
augaaaauggccucaucagacgcaaacccaucagaugguucagcugcaaacuuaguuccagaaguuaacaaugaagucauggcucuugaaccuguaguaggggcugcaauagcagcaccaguagcaggacaacaaaauguuauagauccauggauaagaaauaauuuuguucaagcaccaggaggagaauuuaccguaucaccuagaaaugcaccaggagaaauacuauggucugcaccacuaggcccagaucuuaacccauacuuaucacacuuagccagaauguacaauggauacgcaggcggauucgaaguccaaguaauucucgcuggaaaugcauuuaccgcaggcaaaauuauauuugcagcaguaccuccaaacuucccaacagaaggguuaucaccaucacaaguuacaauguuuccccauauaauuguagaugucagacaacuagaaccaguauuaauaccauuacccgauguacgaaacaauuucuaucauuacaaucaaucaaacgacucaacuauaaaauuaauagcaauguuauauacaccuuuacgagcaaauaaugcaggagaugauguauuuacaguaaguugccgagucuuaacaagaccuucaccagauuuugauuuuauauuucuuguaccuccaacuguagaaucuagaacaaaaccauucucaguaccaguacucaccguagaagaaaugacaaacagcagauucccaauaccauuggaaaaacuauuuacaggaccuuccucagcauuuguaguacaaccucaaaauggucgaugcacaacagacggaguacuauuaggcacaacacaacuaucaccuguaaauauauguacauuucgaggugaugucacccauauaacaggaucuagaaauuacacaaugaacuuagcaagccaaaacuggaauaacuaugaccccacagaggaaauuccagcuccacuaggaaccccagacuucguaggaaaaauccaagguauguuaacacaaacuacacgaacagacgguucaacacgaggacacaaagcuaccgucuauaccggaucagcagauuuugcaccuaaauuaggaagaguacaauuugaaacagacacagaucaugauuuugaagcaaaucaaaacacaaaauucacaccaguaggaguaauacaagacgguucuacaacccaccgcaacgaaccacaacaauggguauuaccauccuacucaggaagaaauacucauaauguucaccuagcaccugcaguagcaccaaccuuucccggugaacaauuauuguucuuucgaucuaccaugccaggaugcucaggauauccuaauauggaucuagacuguuuacuaccccaagaauggguacaauacuuuuaccaagaagccgcacccgcacaaucagacguagcauuacuuagauuuguaaauccugauacaggacgugucuuauucgaaugcaaacuacacaaaucaggauaugucacaguugcucacacaggacaacaugacuuaguaauuccucccaaugguuauuucagauucgauuccuggguaaaucaauucuauacauuagccccaaugggcaauggaacaggcagacgcagaguaguauaa

SEQ ID NO: 31659 - RNA, 1623 nt, Artificial Sequence
  derived and/or modified sequence opt6 from VP1__Norovirus__AGS08177
augaaaauggcuagcucugacgcuaacccaucagauggaucagcagcaaauuuaguaccagaaguaaauaacgaaguaauggcacuagaaccaguuguuggugcagcuaucgcagcccccguagcuggacaacaaaauguuauugauccuuggauaagaaauaacuuuguucaagccccuggaggagaauuuacaguaucuccaagaaaugcuccuggagaaauacuauggucugccccucuuggcccagauuuaaacccauaccucucccaucuagcacgaauguauaacggauaugcuggaggcuuugaagucgaaguuauauuagcugguaaugcauuuacugcaggcaaaauaauuuucgcagcaguaccaccaaauuuccccacugaaggcuuaucacccucgcaaguaacuauguucccacacauaauaguugacguaagacaacuagaaccuguauuaauaccacuuccugacguaagaaauaauuucuaucacuauaaccaaucaaaugauucaacaauaaaauuaauugcaauguuauacacuccauuaagagcaaacaacgcaggugacgacguauuuacaguaucaugcagaguacuuacaagaccaaguccagacuuugauuuuauauuuuuaguacccccaacaguugaaucaagaacuaaacccuucucaguuccaguccuaacuguagaagaaaugacaaauucaagauuucccauaccucuagaaaaacuauuuacaggaccaucuucagcauucguuguacaaccacaaaacggaagaugcacaacagacggaguccuacuagguacaacucaacuaucucccguaaacauauguacauucagaggugacguaacccauauaacaggaucacgaaauuauacaaugaaccuugcaucacaaaauuggaacaauuacgacccaacagaagaaauaccagcuccccuuggaacaccagacuuuguugguaaaauccaaggcauguuaacacaaacaacaagaacagacggaagcacuagaggacauaaagcaacaguauauacuggauccgcagacuuugcaccaaaacuaggaagaguacaauucgaaacagauacagaccacgauuucgaagcaaaucaaaauaccaaauucacuccaguaggcguaauucaagacgguucaacaacccacagaaacgaaccacaacaauggguauuaccauccuauuccgguagaaauacacacaacguucacuuagcacccgcaguagcaccuacuuuuccaggugaacaauuacuauucuucagauccacaaugccaggcuguucaggauauccaaauauggaccucgacugucuccuuccacaagaauggguacaauauuucuaucaagaagcagcaccagcacaaucagacguugcacuacuaagauuuguaaauccagacacaggacgaguacuuuucgaauguaaacuacauaaaucaggauauguaacugucgcccauacuggacaacacgaucucguuauaccaccaaacgguuauuuucgauucgacucauggguaaaccaauuuuauacacuagccccaaugggaaauggcacaggaagacguagaguuguauaa

SEQ ID NO: 31660 - RNA, 1623 nt, Artificial Sequence
  derived and/or modified sequence opt6 from VP1__Norovirus__AGS08178
augaaaauggcaucuucagacgcaaauccaucagacggcucugcugcuaaccucguaccagaaguaaacaaugaaguaauggcucuugaaccaguugucggcgcagcaauagcagcaccaguagcaggccaacaaaauguuauagacccauggauacgaaauaacuucguucaagccccaggaggagaauuuacugugucaccaagaaaugccccaggagaaauacuaugguccgcaccacuaggcccagaccuaaauccauaucuaucacaccuagcucguauguacaauggguacgcagguggauuugaaguucaaguuaucuuagcaggaaaugcuuuuacagcaggaaaaauaaucuucgcagccguaccaccuaauuucccaacagaaggcuuaucacccucccaaguaacaauguuuccucacauaauuguagacguuagacaauuagaaccaguacuaauaccccuuccagacguaagaaauaauuucuaucauuauaaccaauccaaugacucaacaaucaaauuaaucgcaauguuauacaccccccuacgagcaaauaacgccggagaugacguuuuuacuguaucuugcagaguuuuaacaagaccaucaccagacuuugauuucaucuuuuuaguaccaccaacagucgaaucaagaacaaaaccauuuuccgucccagucuuaacugucgaagaaaugacaaauucaagauuccccauacccuuagaaaaauuguuuacugggcccuccuccgcauucguaguacaaccacaaaacggcagauguacuaccgacggaguacuucuuggcacaacucaacuuucuccuguaaauauaugcacauuuagaggugauguaacacauaucacuggaucaagaaauuauacaaugaauuuagcaucccaaaacuggaauaacuaugacccaacagaagaaauaccagcaccacuagggacuccagacuuuguaggaaaaauacaaggaauguuaacacaaacaacacgaacagaugguucaacacgaggacacaaagcuacuguauauacaggaucagcugauuuugcaccaaaauuaggcagaguacaauuugaaaccgauacugaucaugauuucgaagcaaaucaaaauaccaaauucacaccuguaggaguuauacaagacggaaguacuacccacagaaaugaaccacaacaaugggucuuaccuucuuauucaggaagaaacacucauaauguacacuuagcaccagcaguagcuccaacauucccaggugaacaauuauuauuuuuucgcaguacaaugccagguuguucuggauauccuaacauggaucuagauuguuuauuaccacaagaauggguucaauacuucuaucaagaagcagcaccagcacaaucugauguugcacuauuaagauucguaaacccagauacuggaagaguccuuuucgaaugcaaauuacauaaauccgguuacguaacuguagcacauacaggacaacaugacuuaguaauaccacccaaugguuacuucagauuugauagcuggguaaaccaauuuuacacauuagcaccuauggguaacgguaccggaagaagacgcguaguauaa

SEQ ID NO: 31661 - RNA, 1623 nt, Artificial Sequence
  derived and/or modified sequence opt6 from VP1__Norovirus__AGS08179
augaaaauggcauccucugacgccaacccuucugacggaucagcagcuaaccucgucccagaaguaaacaaugaaguaauggcacucgaaccuguugugggugcagcaauagcagcuccuguagccggucaacaaaacguaauagauccauggauccgaaauaauuuuguacaagccccaggaggugaauuuacaguauccccaagaaaugcaccaggagaaaucuuauggucugcuccccuagguccagaucuaaauccauauuuaucacauuuagcaaggauguacaacggauacgcuggugguuuugaaguacaaguuauauuagcaggaaaugcuuuuacagcaggaaaaauuauuuucgcagcaguucccccuaacuuuccaacagaaggccuuucaccuucacaaguaaccauguucccacauauaaucguagacguuagacaacuagaaccaguauuaauaccacuaccagacguaagaaauaauuucuaucacuauaaucaaucaaacgacucuacaauuaaauuaauagcuauguuauauacuccccucagagcaaacaaugccggggacgauguuuuuacaguaucaugcagaguauuaacaagacccucaccugacuuugacuucaucuuucucgucccaccaacaguagaaucaagaacuaaacccuucucagucccugucuuaacaguagaagaaaugacuaacucaagauucccaauaccccuagaaaaauuauuuacaggaccauccuccgcuuucguuguacaaccacaaaauggaagauguacaacagaugguguacucuuaggaacaacacaacuuucaccuguaaauaucuguacauuuagaggagacguaacucauauaacagguucucguaauuacacuaugaauuuagcuucccaaaacuggaacaauuacgacccaacugaagaaauaccagcuccacucggaacaccagauuuuguagguaaaauacaaggaaugcuaacccaaacaacaagaacagacggaucuacacgcggacacaaagcaacuguauauacaggauccgccgauuuugcaccaaaauuaggcagaguacaauucgaaacagauacagaucacgauuuugaagcaaaucaaaacaccaaauucaccccaguuggcguaauacaagacgguaguacaacacacagaaaugaaccucaacaauggguauuaccaucauauucaggaagaaauacccauaacguucaucuagcaccagcaguagcacccacauucccaggugaacaauuacuauuuuuucgaagcacaaugccuggaugcucaggauaucccaauauggauuuagauugccuacuaccccaagaauggguccaauacuucuaucaagaagcagcacccgcacaaucugacguagcacuacuaagauucguaaacccagacacaggacgaguacucuucgaauguaaauuacacaaauccggauacgucacagucgcucacacaggccaacaugaucuaguuauaccaccuaauggauauuuucgauucgauucauggguaaaucaauucuauacacuagcaccaaugggaaaugguacaggaagacgaagaguaguauaa

SEQ ID NO: 31662 - RNA, 1623 nt, Artificial Sequence
  derived and/or modified sequence opt6 from VP1__Norovirus__AGS08180
augaaaauggcaucaucugacgcaaauccaucugauggcucagcagcuaaucuaguuccagaaguaaacaaugaaguaauggcccucgaaccaguaguaggagccgcaauagcagcaccaguagcaggucaacaaaauguaauagauccauggauccgaaauaacuuuguacaagcacccggaggugaauuuacaguaucuccacguaacgcuccaggagaaauauuaugguccgcaccacugggaccagaccuuaaccccuauuuaucacaucuugcaagaauguauaauggcuaugcaggcggauuugaaguacaaguaauacuagcagguaaugcuuuuacugccggcaaaauaauauuugcagcaguuccaccuaauuuuccaacugaaggccuuucccccucacaaguuaccauguuuccacauauuauaguugacguaagacaacuagaaccaguauuaauaccucucccagauguaagaaauaauuucuaucauuauaaucaaucaaaugauuccacaauaaaauuaauugcuauguuauauacaccccuaagagcaaauaacgcaggugaugauguauucacaguauccugucgaguacuuacucgaccaucaccugauuuugauuucauauuuuuaguuccaccaaccguugaaucucgaacaaaaccauucuccguaccaguacuaacaguagaagaaaugacaaauaguagguuuccaauaccacuagaaaaacuuuuuacuggucccaguagugcuuuuguaguacaaccacaaaaugguagauguacaacugacgguguacuauuaggaaccacacaacuaucacccgucaauauuugcacauucagaggagacgucacacauauaacaggaucacgaaauuauacaaugaaccuagcaucacaaaacuggaauaacuaugaccccacugaagaaauacccgcuccauuaggaacaccagauuuuguaggaaaaauacaaggaaugcuaacacaaacaacucgaacagacggaucuacaagaggacauaaagcaaccguuuauacuggauccgcagauuuugccccaaaacuaggaagaguccaauuugaaacagauacagaccaugacuucgaagccaaucaaaauacuaaauuuacaccaguaggaguaauucaagaugguucaacaacucacagaaaugaaccacaacaauggguacuaccuucauauuccggaagaaauacacauaauguucaucuagcucccgcaguugccccaacuuuucccggagaacaauuauuauuuuuuagaucuacuaugccagguuguucuggauaccccaacauggaucuugauugcuuacugccacaagaauggguucaauauuuuuaucaagaagcugcacccgcacaaucugauguagcccuauuaagauuuguaaacccagacacaggaagaguauuauuugaaugcaaacuacacaaauccgguuaugucacaguagcacacacaggucaacacgauuuaguaauuccaccaaacgguuacuuucguuucgauucuuggguaaaucaauuuuauacauuagcaccaaugggaaacggaacaggacgaagaaggguaguauaa

SEQ ID NO: 31663 - RNA, 1623 nt, Artificial Sequence
  derived and/or modified sequence opt6 from VP1__Norovirus__AGS08181
augaaaauggcaucaagcgacgccaauccaucagacggaucugcagcaaacuuaguaccagaaguaaauaaugaaguuauggcacucgaaccuguaguaggcgcagccaucgcagcaccaguugcuggacaacaaaacguaaucgauccauggauaagaaauaacuuuguacaagcaccagguggcgaauucacaguaucaccucgaaaugcaccaggagaaauccuaugguccgcuccuuuaggacccgauuuaaaucccuaccugagccacuuagcaagaauguacaauggauaugcaggagguuucgaaguugaaguaauauuagcaggcaacgccuuuacugcaggcaaaauaauauucgccgcaguaccaccaaauuucccuaccgaaggacuaucuccaucacaaguaaccauguuuccacacauaauaguagacguuagacaacuagaaccaguacuaauaccacuuccagauguaagaaauaacuuuuaccauuacaaucaaucaaacgauuccacaauaaaacuaauagcaauguuauacacaccuuuaagagcuaauaaugcaggggaugauguauucacaguaucuugcagaguauuaacaagaccaucaccagauuuugauuucauuuucuuaguaccaccaacagucgaaaguagaacaaaaccauuuucaguacccguuuuaaccguagaagaaaugacaaauucaagauuuccaauuccauuagaaaaauuauuuacaggaccaagcucagcauuugucguacaaccacaaaauggcagauguacaacagacggcguacuauuaggaacaacccaauuaucaccaguuaauauauguacauuuagaggagacguaacacauaucacuggaucaagaaauuauacaaugaaucuagcaucacaaaacuggaacaacuacgauccaacagaagaaauaccagcaccacuaggaacaccagauuucguuggaaaaauacaaggaauguuaacacaaacaacaagaacagauggauccacccgcggccauaaagcaacaguauauacagguucugcugacuuugcaccuaaacugggucgcguccaauuugaaacugauacagaucacgacuucgaagcaaaucaaaauacuaaauucacaccaguagguguuauacaagacggauccaccacacacagaaaugaaccacaacaauggguacuaccauccuauucuggaagaaauacccauaacguucauuuagcucccgcagucgcaccaacauuucccggagaacaauuauuauuuuuuagaucuacuaugccaggaugcuccggauaccccaauauggaucucgauugccuauuaccccaagaauggguucaauauuuuuaccaagaagcggcaccagcacaaucugauguugccuuauuacguuucguaaacccagauacaggccguguauuauuugaaugcaaauuacauaaaucaggguacguaacagucgcacauacuggacaacacgaucucguuauaccacccaauggauacuuccguuucgacucauggguaaaucaauuuuacacacuugcaccaaugggaaauggaacaggccguagaagagucguuuaa

SEQ ID NO: 31664 - RNA, 1623 nt, Artificial Sequence
  derived and/or modified sequence opt6 from VP1__Norovirus__AGS08182
augaaaauggcuuccucagacgcaaacccauccgacggaucagcagcaaaccuaguaccagaaguaaacaaugaagucauggcauuagaaccuguaguuggagccgcuauagcugcacccguagcuggacaacaaaacguaauagacccuuggauacgaaacaacuuuguacaagcaccaggaggagaauucacgguaucaccaagaaacgcacccggagaaauucuuugguccgccccauuaggaccagaccuaaauccuuaucuaucacacuuagcaagaauguauaauggauaugcaggaggauuugaaguugaaguaauauuagcaggaaaugcauuuacugcgggaaaaauaauauucgcagcaguacccccaaauuuuccaacagaaggucuaucuccaucacaaguaacaauguucccacacaucaucguagauguacgacaacuagaacccguucuaaucccauuaccagauguuagaaauaauuucuaucacuauaaucaaucaaaugauucaacaauaaaauuaaucgcaauguuauauacaccucuuagagcuaacaaugcaggagacgauguuuuuacuguaucuuguagagucuuaacaagaccaucaccagacuucgacuucaucuuccucgucccccccaccguagaauccagaacaaaaccuuucaguguaccaguccuaacuguagaagaaaugacaaauucaagauucccaauuccacuugaaaaauuauucacaggaccaucaucugcuuuuguaguacaaccacaaaacggaagauguacaaccgauggaguauuacuaggaacaacucaacucaguccaguuaauaucugcacauuucgcggugacguuacacauauaacaggcucccgaaauuacacaaugaaucuagcaucccaaaacuggaacaauuaugacccuacugaagaaauaccugcuccacuaggaaccccagauuucguuggcaaaauacaaggaaugcucacucaaacaacaagaacugauggaucuacaagaggacauaaagcaacagucuacacagguucagcugauuucgcuccaaaauuaggacgaguacaguucgaaacagauacagaucacgauuucgaagcuaaucaaaacacaaaauucacuccuguaggaguuauacaagacgguucaacaacacacagaaaugaaccacaacaauggguauuaccuucauauuccggaagaaauacacauaacguacacuuagcuccagcuguagcuccaacuuuucccggagaacaacuuuuauucuuuagaucuacaaugcccgguugcucagguuauccuaauauggauuuagauugucuuuuaccccaagaauggguacaauauuucuaccaagaagcagcaccagcacaaucagacgucgcauuacuacgauuuguuaauccagacacaggacgaguuuuauuugaaugcaaacuccauaaauccggcuaugucacuguugcccacacaggccaacacgaccuaguuauaccuccaaauggauacuuuagauuugauuccuggguaaaucaauuuuacacacuagcaccaaugggaaacggaacuggacgacgaagaguaguauaa

SEQ ID NO: 31665 - RNA, 1647 nt, Artificial Sequence
  derived and/or modified sequence opt6 from VP1__Norovirus__AGT39181
augaaaauggcaucaaaugacgcuacaccuucaaaugacggcgccgcuggcuuaguaccagaaaucaauaaugaagcaauggcacucgacccaguagcaggagcugccauagcugcuccacugacaggacaacaaaacauaauagacccuuggauuaugaauaauuucguacaagcacccggaggagaauuuacaguuaguccaagaaacucaccaggagaaguauuauuaaauuuagaacuaggaccagaaauaaauccauauuuagcacaucuugcaagaauguacaacggcuaugcuggagguuucgaaguucaagucguauuagcaggcaacgcauuuacagccggaaaaauaauauucgcagcaauaccaccaaacuuuccaauagauaacuuaucagcagcacaaauuacaaugugcccccacguaauaguagauguaagacaacucgaaccugucaaccuaccaaugccagacguacgcaacaauuuuuuccacuauaaucaaggaucagauagcagauuaagauuaguagcaauguuauauaccccacucagagcaaauaacaguggagaugauguauuuacuguaagcugucgaguacucacaagaccauccccagauuuuucauucaauuuccuaguaccaccaacaguagaauccaaaacaaaaccauucacauuacccauacuuacaauaagugaaaugagcaauucacgauuuccaguaccaaucgacucacuacacacaucaccaacagaaaauauaguaguccaaugccaaaacggaagaguaacauuagacggugaauuaaugggcacaacacaauuacuaccaucacaaauaugugcauuuagaggaguacuaacuagauccacuucccgagccucugaccaagcagauaccgcaacaccacgacuauuuaauuacuauuggcacauacaauuagauaauuuaaacggcacgcccuacgauccagcagaagacauaccagguccacuaggaacuccugacuuuagaggaaaaguauucgguguagccucacaacgaaauccagacagcacuacaagagcucaugaagcaaaagucgacacaacagcaggacgauucacaccaaaauuagguucuuuagaaauauccacagaauccggagauuucgaucaaaaucaaccuacaagauuuaccccaguaggaauaggcguugacagagaagcagauuuucaacaauggucacuaccagacuacucaggucaauuuacccacaacaugaaucuagcaccugcaguagcacccaauuuuccaggagaacaacuauuauuuuucagaucucaauuaccuucauccggaggcagaucaaaugguaucuuagauugccuuguaccacaagaauggguacaacauuuuuaccaagaaucagcuccagcacaaacacaaguagcauuaguucgauauguaaacccugauacaggaagaguacuauuugaagcaaaauuacauaaacuaggauuuaugacaaucgccaaaaacggagacucaccaaucacuguaccaccuaacggcuacuucagauuugaaucauggguaaacccauuuuauacacuagcaccaaugggaacaggaaacgguagaagacgaauacaauaa

SEQ ID NO: 31666 - RNA, 1608 nt, Artificial Sequence
  derived and/or modified sequence opt6 from VP1__Norovirus__AGT39191
augaaaauggcuucaaaugaugccgcaccaucaaaugacggagccgccggauuaguuccagaaguaacuaaugaaacaauggccuuagaaccaguagcaagagcaucaauagcagcaccacuaaccggacaaaauaauguaauagauccauggauaacuuuaaauuucggacaagcaccaacaggacaccuaacacuauccccaccauacucaccaggagaaguacuacuaaauuuagaacuaagaccagaauuaaauccauaucuagcaaauuuaucaagaauguauaauggcuaugcaggaggaguagaaguacaaguauuauuagcuggcaacgcuuuuacagcagguaaacuuguuuuugcagcaguacccccacacuuuccuuuagaaaauauaucaccaggccaaauaacaauguucccacacguaauaauagacguacgaacacuggaaccaguacuauuaccacuuccagauguaagaaauaacuucuuccauuauaaucaacaaaacgaaccaagaaugagacucguagcaaugcuauauacaccacuaagaaguaauggaucaggagaugacguauucaccguaaguuguagaguauuaacaagaccaucacccgacuucgacuuuaacuacuuaguaccaccaacaguugaaucaaaaacaaaaccauuuacacuacccauacuaaccauaggagaacuaacaaacucacgauucccuguaccaauagacgaacuauauacaagcccaaacgaaucauuaguaguacaaccacaaaauggcagaugcgcauuagauggugaauuacaagggacuacccaacuacuacccacagccauaugcagcuucagagguagaauaaaccaaaaaguuucaggagaaaaucacguauggaauaugcaaauaacaaacauuaauggaacaccauuugacccaacagaagacgucccagcaccccuaggcaccccugacuucuccgguaaacuauuuggaguauuaucacaacgagaccacgauaaugccugccgaucacacgacgcugucauugcaacaaauucagccaaauuuacaccaaaacuaggagcaauccaaauaggaacaugggaacaagaugacguacacauaaaucagccuacaaaauucaccccaguuggacuauucgaaucagaaggcuucaaucaauggacauuaccaaacuacuccggagcacuaacacuaaacauggguuuagcaccaccaguugcaccaaccuucccaggugaacaaauauuauucuuuagaucccauauucccuuaaaaggcggaguagcagaccccguuaucgacugucuacuaccucaagaauggauacaacaucuauaucaagaauccgcaccuucacaaaccgacgucgcauuaauuagauucacaaacccugacacaggaagaguauuauucgaagcaaaauuacaccguucaggcuauaucacgguagcaaauacuggaucccggcccauaguaguuccagccaacgguuacuuucgauucgauucauggguuaaccaauucuacucccuagcaccaaugggaacaggaaauggacgaagacgaguacaauaa

SEQ ID NO: 31667 - RNA, 1608 nt, Artificial Sequence
  derived and/or modified sequence opt6 from VP1__Norovirus__AGT39194
augaaaauggcaucuaaugacgcugcaccaucaaaugacggcgcagcaggacuaguaccugaaguaaacaaugaaacaauggcauuagaacccguagcuggagcaucuauagcagcaccacuaacaggacaaaauaauguaauagacccauggauacgacuaaauuucguacaagcaccaaauggcgaauucacagucucaccacgaaacucuccuggagaaguccuauuaaacuuagaauugggcccagaacuaaacccauaccucgcacauuuauccagaauguauaauggauacgcaggaggaguagaaguacaaguacuauuagcaggaaacgcauucacagccggcaaauuagucuuugcagcaguaccaccacacuuuccauuagaaaauauaucaccaggacaaauaacaauguuuccacauguaauuaucgauguaagaaccuuagaaccaguauuauuaccauuaccagauguaagaaauaacuucuuccauuacaaccaacaaaaugaaccaagaaugagacucguagcaaugcuauauaccccauuaagaucaaaugguucuggagaugacgucuuuacugucucaugcagaguauuaacucgcccaucucccgacuucgauuuuaauuaucuaguaccuccaacaguagaaucaaaaacaaaaccauucacccuucccauucuaacaauuggagaauuaacaaauucaagauucccaguaccaauugacgaauuauauaccucccccaacgaaucucucguaguacaaccacaaaauggacgaugcgcauuagacggagaauuacaaggcacuacccaauuauuaccaacugcuauauguuccuuucgaggacgaauaaaucaaaaaguaucaggagaaaaccauguuuggaacaugcaaauaacuaacauaaauggaaccccauuugauccaacagaagacgucccugcaccacuaggcacaccagacuuuucaggaaaauuauucggcguucuaucccaaagagaucaugacaacgcaugcagaucacacgacgcgguaauagcaacaaauucagccaaauucacaccaaaauuaggagcaauucaaauagguacaugggaacaagaugauguacacauaaaucaaccaacuaaauuuacacccguagguuuauuugaaucagaaggauuuaaccaauggacuuuaccuaacuacuccggagcacuaacauuaaacaugggauuagcaccaccaguagcaccaaccuuucccggugaacaaauccuauuuuuuagaucucauauaccacuaaaaggaggaguagcagauccaguaauagauugcuuauuaccacaagaauggauacaacacuuauaccaagaaucagcaccaucacaaacugauguagcacuaaucagauucacaaacccagacacaggacgaguuuuauuugaagccaaauuacacagaucaggauacauaacaguugcaaacacagguuccagaccaauagucguacccgcaaauggauauuuuagauucgauucuuggguaaaucaauuuuauucacuagcaccuauggguacaggcaacggacggcgacgaguacaauaa

SEQ ID NO: 31668 - RNA, 1608 nt, Artificial Sequence
  derived and/or modified sequence opt6 from VP1__Norovirus__AGT39197
augaaaauggcaucaaacgaugcugcucccucaaacgacggagcagccggacuaguuccugaaguaaauaacgaaacaauggcccuagaaccuguagcuggagcuucuauagcagcaccacuaacaggacaaaauaacguaauagauccauggauaagauuaaacuuuguucaagcacccaacggugaauuuacuguaucuccuagaaauucaccaggagaaguuuuauuaaacuuagaacuuggcccagaauuaaacccauacuuggcacaucuaucccgaauguacaauggauacgcgggaggaguagaaguucaaguccuauuagcagguaacgcuuucacagcaggaaaacucguauucgccgcagucccaccacauuuuccacuagaaaauauuucaccaggucaaauaacaauguuuccacaugucauaaucgacguccguacacuagaaccaguacuccuaccacuaccagacguaagaaacaacuuuuuccauuacaaucaacaaaacgaacccagaaugagacuaguagcuauguuauauacaccauuaagaucaaauggaucuggugaugacguauuuacugucucauguaggguauuaacacgaccaucacccgacuuugauuucaauuacuuagucccacccacaguagaaucaaaaacaaaaccauuuacauuaccaauuuuaacuauuggagaacuaacuaauagccgauucccuguaccaauagaugaauuauacacaucaccuaacgaauccuuagucguacaaccacaaaauggacgcugcgcucucgauggagaauuacaaggaaccacacaauuauugccuacagcaauuugcucauucagaggcagaauaaaccaaaaaguaucuggcgaaaaccacguauggaacaugcaaguaacaaauauaaauggaacuccauuugaccccacagaagacguaccagcaccauuaggaacaccagauuucucaggaaaauuauucgguguccucucacaaagagaccaugacaacgcaugccguucacaugaugccguuauagccacuaauucugcaaaauuuacaccaaaacuaggagcaauacaaauaggcaccugggaagaaaacgauguacauauaaaucaacccacuaaauucacaccuguaggauuauucgaaagcgaagguuuuaaccaauggacacuacccaacuauucaggagcacucacauuaaacaugggcuuagcaccaccaguagcaccaacauucccaggugaacaaauacuauucuuucgaucacacauaccauuaaaaggaggcguugccgauccuguaaucgauugucuacuaccccaagaauggauacaacauuuauaucaagaaucagcaccaucucaaacagacguagcacuuauaagauuuacuaauccagacacaggacgcguuuuauuugaagcaaaacuacauagaucagguuacauaacuguagcaaacacagguucacgcccaauaguaguaccagcaaauggguacuuuagauuugauuccugggucaaccaauucuacucucuagcacccaugggcacagguaauggucguagacguguacaauaa

SEQ ID NO: 31669 - RNA, 1608 nt, Artificial Sequence
  derived and/or modified sequence opt6 from VP1__Norovirus__AGT39200
augaaaauggcgucuaaugaugcagcaccaucuaaugauggcgcagcaggacuaguaccagagguuaauaaugaaacaauggcucuugaacccguagcaggagcaucaauagcagcaccauuaacaggacaaaauaacguuauagaucccuggauacgauuaaauuucguacaagcaccaaacggagaauuuacaguaucaccacgcaauucaccaggcgaaguucuccucaaccuagaauuaggaccagaacuaaaccccuacuuagcacacuuauccagaauguacaacggauacgcggguggaguagaaguacagguacuacuagcaggaaaugcauucaccgccggaaaacuaguauuugccgccguaccuccacauuuuccucuagaaaauauaaguccaggucaaauaacaauguucccacacguaauaauagauguuagaacucuagaaccaguacuauuaccauuaccagacguacgaaauaacuucuuccauuacaaucaacaaaaugaaccaagaaugagacuaguugcaauguuauacacaccacuacguucaaauggauccggagaugauguguuuacaguauccugccgaguccuaacccgacccaguccagauuuugauuucaacuacuuaguaccaccuacaguagaaucuaaaacaaaacccuuuacacucccaauauuaacaauaggagaauuaacuaacucuagauuuccuguaccuauagacgaacuauacacaucaccuaacgaauccuuaguaguacaaccacaaaauggaagaugugcucuagauggugaacugcaaggaacaacucaauuacuucccacagcuauauguucauuuagagguagaauaaaucaaaaaguaucuggcgaaaaccauguauggaauaugcaaauaacaaauauuaacggaacaccauuuggaccaacugaagauguaccagcaccauuaggaacaccugacuucucaggaaaacuauucgguguacuaagucaaagagaccaugauaaugcaugucgaucucacgaugcaguaauagcaacaaauucagcuaaauuuacaccuaaacucggagccauccaaauuggaacaugggaacaagacgacguucacauaaaucaacccacaaaauucacaccaguaggauuauucgaaucagaaggcuucaaucaauggacauuaccuaacuacucaggagcacucacucuuaacauggggcucgcaccuccaguugcaccuacauuuccuggagaacaaauauuauuuuauagaucacauauuccuuuaaaaggaggaguagcagauccaguuauagauugccuauuaccacaagaauggauacaacaucuauaucaagaaucugcuccaagucaaacagaugucgcacuaauaagauuuaccaacccugacacaggaagagucuuauuugaagcaaaauuacauagaucaggcuauauaacuguugccaauaccggaucaagaccaaucgucguacccgcaaaugguuauuuuagauucgauucauggguaaaccaauuuuacucacuagccccaaugggaacuggaaauggacgaagacgaguacaauaa

SEQ ID NO: 31670 - RNA, 1608 nt, Artificial Sequence
  derived and/or modified sequence opt6 from VP1__Norovirus__AGT39203
augaaaauggcuucuaacgaugcugcaccuuccaacgauggagcagcaggacuaguaccagaaguuaacaacgaaaccauggcuuuagaaccagucgccggugcaucaauagccgcaccguuaaccggacaaaauaauguuauugacccuuggaucagacuaaacuucguucaagcaccaaauggagaauuuacuguaucaccaagaaauucaccaggagaaguacuauuaaacuuagaacucggucccgaacuuaacccauaccuagcacauuuaucuagaauguacaacggcuacgcuggagguguugaaguccaaguacucuuagcuggcaaugcauucaccgccggaaaacuaguauucgcagccguaccaccacacuucccauuagaaaacauaucuccaggucaaauaaccauguuuccacauguuauaauagauguaagaacccuugaacccguauuacuuccacuaccugauguaaggaauaacuuuuuccacuauaaucaacaaaaugaaccaagaaugagacuaguagccaugcuauauacuccucuaagaucuaauggaucuggagaugauguauucacuguuucauguagagucuuaacacgaccaucaccagacuuugauuuuaacuaccucguaccaccuacaguugaaucaaaaaccaaaccauucacucuaccaauauuaacaauuggagaauuaacuaauucaagauuuccuguaccaauagacgaauuauauacaagcccaaacgaaucacuaguaguacaaccacaaaauggaagaugugcacuagacggcgaauuacaaggcacaacucaacuacuaccaaccgcuaucuguucauuccgaggcagaauaaaucaaaaaguaucaggagaaaaccacguauggaauaugcaaguaacaaacauuaacgguacaccauucgacccaacagaagauguuccagcaccacuagguacaccagacuuuuccggaaaacuauucggaguuuuaucucaaagagaucaugacaaugcaugccgaagucacgacgcuguaauagcaacaaauuccgcuaaauuuacuccuaaauuaggagcaauacaaauaggaaccugggaacaagacgauguccauaucaaccaacccacaaaauucacaccuguuggccuuuuugaaucagaaggauuuaaucaauggacacuaccaaauuacucuggagcacuaacauuaaauaugggauuagcaccaccaguugcacccacauucccaggagaacaaauuuuauuuuuuagaagucacauaccacuaaaaggaggagucgccgauccaguaauagauugcuuauuaccacaagaauggauacaacaccucuaucaagaaucagcacccucccaaacagacgucgcauuaauaagauuuaccaacccagacacaggaagaguacucuucgaagcuaaauuacauagaucaggcuauauaacaguagcaaauaccggaucgcgaccaauugucguacccgccaauggauacuucagauucgauucauggguaaaccaauuuuauucauuagcaccaaugggaacaggaaacggacgacgcagaguacaauaa

SEQ ID NO: 31671 - RNA, 1629 nt, Artificial Sequence
  derived and/or modified sequence opt6 from VP1__Norovirus__AGT39206
augaaaauggcaucuaacgacgcugcacccucaaccgauggcgcagccgguuuaguaccugaaucaaacaaugaaguaauggcacuagaaccaguagcaggugcagcacuagcagcaccaguaacaggacaaacaaauauaaucgauccauggauaagagcaaauuuuguacaagccccaaauggagaauucaccguaagcccuagaaauucaccaggugaaguauuacuaaauuuagaauuaggcccagaacuaaauccauaccucgcucaucuagcaagaauguauaauggauaugccggaggaauggaaguacaaguaauguuagcuggaaacgcauuuacugcuggaaaacuagucuucgcugcaguaccuccccauuuuccuguagaaaaucuauccccacaacaaauuacaauguuuccacauguuauaauagacguacgaacuuuagaaccaguacuauuaccucuaccagauguaagaaacaauuuuuuucauuacaaucaaaaagaugauccaaaaaugagaauuguagcaauguuauauacuccauuacgaucuaauggaucuggagaugauguauuuacaguauccuguagaguuuuaacaagaccuucuccagacuuugauuuuaccuacuuggucccuccaacaguagaaucaaaaacaaaaccauucacacuacccauccuaacauuaggagaauuaucaaacucgagguucccaguaucaauagaccaaauguauacuucuccaaaugaaguaauaucuguucaaugucaaaacggcagauguacuuuagacggugaacuccaagguacaacucaauuacaaguuagcggcauaugcgcauuuaaaggagaagucacagcacacuuacaugacaacgaccacuuguacaacguaacaauaacaaaccuuaacggaucaccuuuugacccaucagaagacauaccagcgccccuuggaguaccagauuuccaaggucgaguuuuuggagucauaucacaaagagauaaacauaauacuccuggacauaaugaaccagcaaauagagcacaugaugcaguaguaccaacauauacagcacaauauacaccaaaacucggacaaauacaaaucggaacuuggcaaacagaugauuuaacaguaaaucaaccaguaaaauucacccccguuggacuaaaugauacagaccauuuuaaccaauggguuguuccccguuacgcaggagcauuaaaucuaaacacaaaccuugcaccuucaguagcuccuguauuuccaggagaaagauuauuauucuuucgaucauauauacccuuaaaaggaggauacggcacaccagcaaucgauugcuuacucccacaagaauggguucaacauuuuuaccaagaagcagcaccaucaaugucagaaguagcauuaguacgauauauaaacccugacacaggaagagccuuauuugaagcaaaauuacauagagccggauuuaugacuguaucgucaaauacaucugcaccagucguaguucccgcaaauggauacuuccgauucgauucuuggguuaaucaauuuuauucacuagcaccaaugggcacaggaaauggaagaagaagaauacaauag

SEQ ID NO: 31672 - RNA, 1623 nt, Artificial Sequence
  derived and/or modified sequence opt6 from VP1__Norovirus__AHF45991
augaaaauggcaagcucagaugccaauccaucagauggaucuacugcaaaccuuguaccagaagucaauaacgaaguaauggcauuagaaccaguuguaggagcagcaaucgcagcucccguugcaggacaacaaaauguaauagauccauggauaagaaauaauuucguacaagcaccaggaggugaauuuacuguaucaccacgaaaugccccaggagaaaucuuauggucagcaccacucggcccagacuuaaauccauaucuaucacacuuagcacgaauguauaauuccuacgcgggaggauucgaaguacaagucauauuagcaggaaacgcauuuacagcugguaaaaucauauucgccgcaguaccuccaaacuucccaacagaaggauuaucaccaucacaaguaacaauguucccacacauuauaguugacguaagacaauuagaaccaguucuaauaccauuaccagauguaagaaacaacuucuaucacuauaaccaaucaaaugacccaacuauaaaacuaauagcgauguuauauacaccacuaagagccaacaacgcaggagacgacguauuuaccguaucaugccgaguucuaacacgaccaucaccagauuucgacuuuauauuucuuguuccucccacuguugaaucccgcaccaaaccauuuucaguaccuauacuaaccguagaagaaaugacuaauucaagauuuccaauaccauuagaaaaauuauuuacaggcccuuccucugcuuucguaguucaaccacaaaacggacgauguacaacagauggaguauuacuaggaaccacccaauuauccccagucaauauuuguacauuuagaggagacguaacacacauagcaucaacacaagaauauacaaugaauuuagcaucacaaaacuggaacaauuacgauccaacagaagaaaucccagcaccacuuggaacaccagacuuugucggaaaaauacaaggagucuuaacacaaaccaccagaagagacggcucaacccgaggacacaaagccacaguaucaacagggucaguacacuucacaccuaaauuaggucgaauucaauucaguacagauacaucaaacgauuucgaaacaggccaaaacacuagauucacaccaguagguguaguacaagacggaucaacaacucaucaaaacgaaccacaacaauggguacuaccaaacuauucaggacgagauucacauaacguucaccuagcacccgcaguagcacccucauucccaggugaacaacuauuauucuuuagauccacuaugccagguugcaguggauaucccaauaugaaucuagauugccuauuaccucaagaauggguacaacacuucuaucaagaagcagccccagcucaaucagauguagccuuauuacgauuuguaaacccugacacaggaaggguacuguucgaauguaaauuacauaaaucuggcuauguaacagucgcacacacaggacaacacgaccucgucauaccacccaauggcuauuuuagauuugacucauggguaaaucaauucuauacucuagccccaauggguaauggaacaggaagaagaagagcccuauaa

SEQ ID NO: 31673 - RNA, 1623 nt, Artificial Sequence
  derived and/or modified sequence opt6 from VP1__Norovirus__AHF45993
augaaaauggcgucuucagacgcaaaccccagcgauggcucaacagccaaccuuguaccagaagucaacaaugaaguuauggcauuagaaccaguuguaggagcagcaauagcagcaccaguagcuggacaacaaaauguuauagauccuuggauaagaaacaacuuuguacaagcaccugguggcgaauuuacuguuucaccacgaaaugcaccuggcgaaauacuauggucagcaccccuaggaccagaucuaaauccauaucuaucucacuuagcacgcauguacaauggauaugcaggaggauucgagguacaaguaauacuagcaggaaaugcauuuacagcaggaaaaauaauauucgcagccguaccccccaauuuucccacagaaggauuaucaccaucccaaguuacuauguucccucacauuauaguagacguuagacaacuagaaccaguauuaauaccauuaccugauguaagaaauaauuucuaucacuauaaucaaagcaaugauucuacaauuaaauuaauagcaauguuauacaccccuuuacgagcaaacaacgcaggagaugauguauuuacaguaucauguagaguucuaacacgaccaucaccugacuucgacuucauauucuuagucccaccaaccguggaaucuagaacaaaaccauuuuccguaccgguacucacuguugaagaaaugacaaauucaagauucccaauuccccuagaaaaacuuuuuaccggaccuucauccgcauucguaguacaaccucaaaacggaagaugcacuacugacggaguacuucuaggaacaacacaacucagcccaguuaacauuugcacauuucgaggugauguaacacacauacccggcucccgaaauuacaccaugaaucuagcaucccaaaacuggaacucuuacgacccaacagaagaaauaccugcaccuuuaggaacaccagauuuuguaggcaaaauucaaggaguauuaacacaaacaacuagaacaaacggaucaacuagaggccauaaagcaacagucuacacaggaagcgcugauuuuucaccuaaauuaggacgaguucaauucgcuaccgauaccgauaaugauuuugaaacaaaucaaaacacaaaauucaccccagugggcguuauacaagauggaagcacuaccccaagaaaugaaccacaacaauggguuuuaccaagcuauucaggacgaaacauccauaauguucacuuagccccugccguagcaccaacauuuccaggagaacagcuacuauuuuuuagaucaacaaugccuggaugcucaggcuauccaaauauggaucuugacugucuacuaccucaagaauggguacaauauuucuaucaagaagccgcaccagcacaaucugauguagcuuuauuaagauucguaaauccugacacaggacgaguauuauuugaaugcaaacuacacaaaucuggauauguuacugucgcccauacaggacaacacgauuuaguuauaccaccaaacggcuauuuccgcuucgauucauggguaaaccaauuuuauacacuagcaccaaugggaaauggcacaggaagacgaagagcacuauaa

SEQ ID NO: 31674 - RNA, 1623 nt, Artificial Sequence
  derived and/or modified sequence opt6 from VP1__Norovirus__AHF45997
augaaaauggcuaguucagacgcuaaccccucugauggaucagcagcuaaucuuguaccagaaguaaacaaugaaguaauggcacuagaaccaguagucggcgcugcaaucgccgcaccaguagcaggacagcaaaauguuauagauccauggauacguaauaauuucguacaagcaccaggcggagaauucaccguaucuccacggaacgcaccaggugaaauucucuggucggcaccauuaggaccagauuuaaauccauauuuaagucacuuagcacguauguauaauggauaugccggaggauucgaaguucaaguuaucuuagcaggcaacgcauucacagcaggaaaaguaauuuucgcagcaguaccaccaaauuuccccacugaagguuuaucacccagccaaguaacaauguucccacauauaguuguagauguaagacaacuagaaccuguauuaaucccauuaccugauguaagaaauaacuuuuaccauuauaaucaaucuaacgacccuacuaucaaauuaauagcaauguuauauacaccccuacgugcaaacaaugcaggagaugauguauuuacuguaucauguagagucuuaacaagaccuucaccagauuucgacuuuauauucuuagucccaccaacuguagaaucuagaacaaaaccauucucaguaccaguacuuacaguagaagaaaugacaaauaguagauuuccaauaccauuagaaaaauuauucacuggaccaucuucagcuuucguaguacaaccacaaaaugguagaugcacaaccgacgguguauuacuaggaaccacacaauuaucaccaguaaauauauguacauucagaggugauguaacacacaucacagguucacgcaauuauacaaugaacuuagcuagucaaaacuggaauaauuaugacccaacagaagaaauaccugccccauuagguaccccugacuuuguaggaaaaauacaaggaguauuaacacaaacaacacgaacagacggaucaacaagaggucauaaagcaacaguauauacaggaagugcagauuuugcaccaaaacuagguagaguacaguuugaaacagauacagaucacgacuucgaagccaaccaaaacacaaaauucacaccaguaggcguaauacaagacggaggaacuacccaucgaaaugaaccacaacaauggguauuaccuucauauaguggacgcaauacacauaacguacaucuagcuccagccguugcaccaaccuuucccggagaacaauuauuauucuuccgcucaacaaugccagguuguaguggcuacccuaauauggacuuagacugcuuacuaccacaagaauggguucaauacuuuuaucaagaagccgcaccagcucaauccgacguagcauuauuaagauuuguaaaucccgauacuggaagaguauuauucgaauguaaauuacauaaaucuggauauguaacaguagcucauaccggccaacaugauuuaguuauuccaccaaacggcuacuucagauuugauucauggguaaaccaauucuacacauuagcaccaaugggcaauggaacaggaagaagaagagcaguauaa

SEQ ID NO: 31675 - RNA, 1623 nt, Artificial Sequence
  derived and/or modified sequence opt6 from VP1__Norovirus__AHF45999
augaaaauggcauccucagacgcaaauccaucagacggaucugcugcaaaucuugucccagaaguaaacaaugaaguuauggcauuagaaccaguaguuggagcagcuauagcagcgccuguagcuggacaacaaaacguaauagauccauggauaagaaauaauuucguacaagcaccaggaggagaauuuacaguaucuccaagaaaugcaccaggugaaauacuauggucagcaccauuagguccagauuuaaaucccuaccuaucucaucuagcacgaauguauaacggauacgcaggaggauuugaaguacaaguaauauuagcaggaaaugcauucacagcaggaaaaguaauauucgcagcaguccccccuaacuucccuaccgaaggacucucaccaucucaaguaacaauguuuccacauauaguaguagauguacgccaauuagaaccaguauuaauaccucuaccagacguaagaaauaauuucuaccacuauaaucaaucuaaugacccuacuauaaaauuaauugcaaugcuauacacaccacuaagagcuaacaaugcuggagacgauguauuuaccguaucauguagaguacuaacuagaccaucuccagacuuugauuucauauuccucguaccaccaacaguugaaucaagaacaaaaccauucucuguaccaguacuaaccgucgaagaaaugacaaacucaagauuuccaauuccauuagaaaaauuauuuacaggacccaguucagcuuucgucguacaaccacaaaacgguagauguacaacagauggaguucuccuaggaacaacacaacuuucuccaguaaauauauguacguuuagaggagaugucacucacaucacuggaucccgaaauuacacaaugaauuuagccucacaaaacuggaauaauuacgauccaacagaagaaaucccagccccacuagguaccccagacuuugucggaaaaauucaaggagucuuaacacaaacuacacgaacagauggaucaacaagaggacacaaagcuacuguauauacuggaucagcagauuuugcgccaaagcuaggcagaguacaauuugaaacagauacagaucacgacuucgaagcuaaccaaaauacaaaauucacaccaguuggaguaauacaagacgguggaacaacucauagaaaugaaccacaacaauggguauuaccaucauauagcggaagaaauacacauaauguacaccuggcaccagcaguugccccuacauuuccaggagaacaacuucuauucuuuagaucaacuaugcccgguuguuccggcuacccaaauauggauuuagauugccuuuuaccacaagaguggguacaauauuucuaucaagaagcagccccagcucaaucugauguagcacuauuaagauuugugaauccagauacaggaagaguucuauucgaauguaagcuacauaaauccggauaugucacaguagcacacacaggacaacaugaucuaguaauaccuccaaauggauauuucagauucgauucauggguuaaucaauuuuacacucuagcaccuauggguaacggaacuggaagaagaagagcaguauaa

SEQ ID NO: 31676 - RNA, 1623 nt, Artificial Sequence
  derived and/or modified sequence opt6 from VP1__Norovirus__AHF46001
augaaaauggccuccucagacgcaaauccaucagauggauccgcagcuaaccuaguuccugaaguaaacaaugaaguaauggcacuagaaccaguaguaggugcagcaaucgcagcaccaguugcuggucaacaaaauguaauugauccuuggauaagaaacaacuuuguacaagcaccuggaggagaauuuacaguaagcccaagaaaugcuccaggcgaaauacuuuggucagcaccauuaggaccagauuuaaauccauaucucucacacuuagccagaauguauaacggauacgcaggcggauuugaaguacaaguaauauuagccggaaaugcauuuacugcuggaaaaguaauauucgccgcaguaccaccaaacuuucccacagaaggacuaucacccucccaaguaacaauguucccucauaucguuguugaugucagacaauuagaaccaguacuaauaccauuaccagauguaagaaacaauuuuuaucacuauaaucaaucaaaugacccaacaauaaaauuaauagcaaugcucuacaccccacuucgagcuaacaaugcuggagacgaugucuuuacagucuccuguagaguacuaacacgcccuagcccagacuuugacuuuauauuucuaguucccccuacaguugaauccagaacuaaaccauucaguguacccguacuuacagucgaagaaaugacaaacucaagauuuccuauuccauuagaaaaauuauucaccggacccucauccgccuuuguuguacaaccacaaaauggaagaugcacaacugacgguguccuuuuaggaacaacacaacuaucuccaguaaauauuuguacauucagaggagacguuacacauauaacugguaguagaaauuauacaaugaacuuagcaagucaaaacuggaauaauuacgauccaacugaagaaauaccagcaccacucggaacaccagacuucgucggaaaaauacaagguguacuuacacaaacaacuagaacagauggaucaacacgaggccacaaagcaacuguauacacaggaucagcagacuuugcaccaaaacuaggucgaguccaauucgaaacagacacagaccacgauuuugaagcaaaucaaaauacuaaauuuacaccaguaggaguaauucaagacggagguacuacacauagaaaugaaccacaacaauggguacuaccaucuuauucaggacgaaauacacauaacguacacuuagccccagcaguagcaccaacuuuuccaggcgaacaacuauuauuuuuuagaucgacaaugcccggcugcaguggauauccaaauauggauuuagacugccuacuaccacaagaauggguacaauauuuuuaccaagaagcagcaccagcacaaucugacguagcacuacuaagauucguaaauccugacaccggacgugucuuauuugaaugcaaacuccauaaaucuggauauguaaccguugcacacacaggacaacacgacuuaguaauaccaccaaauggauacuucagauuugauuccuggguaaaucaauuuuacacauuagcacccaugggaaacggaacaggaagacgaagagcuguauaa

SEQ ID NO: 31677 - RNA, 1617 nt, Artificial Sequence
  derived and/or modified sequence opt6 from VP1__Norovirus__AHH44876
augaaaauggcaucaaacgacgcuaauccaucagacgggucugcagccaauuuaguaccagaaguaaacaaugaaguaauggcacucgaaccaguaguaggcgcagcaauugcugcaccagucgcuggucaacaaaaugucauagauccauggauaagaaauaacuuuguacaagcaccaggaggagaauucacaauauccccacguaaugcuccaggagaaauacuauggucugccccucuaggaccugauuuaaauccauaucuaucucacuuagcccgaauguacaacggcuacgcgggcggauuugaaguacaaguuguucuagcaggaaacgcuuucacagcuggaaaaaucauauucgcagccguuccaccaaauuuuccaacagaagguuuaucaccuucacaaguaacaauguucccccacauaaucguugauguacgccaauuagaaccaguucuuauaccacuaccagauguaagaaacaacuuuuaucauuacaaccaaucaaaugacagcacuauuaaacuuauagcaaugcuauauacaccauuacgagcuaacaacgccggagacgacguauucacaguauccuguagaguucucacaagacccucaccagauuuugauuuuauauucuuaguaccaccuaccguagaaucccguacaaaaccauucacaguuccaguacuaacaguagaagaaaugaccaacucuagauuuccaauuccauuagaaaaauuauucacuggacccucuucugcauucguaguacaaccacaaaaugguagaugcacaaccgacggaguuuuauuaggaacaacacaacuaucugcaguaaauauauguaccuuuagaggugaugucacacauguaucagauaaaacuuuugcaaugaauuuagcaucuccaaacuggaauaauuaugauccaaccgaagauauaccagccccacuaggaacaccugauuucguagguagaauacauggaauguuaacacaaacaacuagaagagacggagcaacaagaggacacaaagcaacaguuucaacugguggagcagacuucacaccaaaauuaggauccguaagauacauuacagauaccacugacgauuuagaaguuagagaaaacacaaaauuuacaccaauaggcguacuacacucauccggagagcacagagcugaaccagaucaauggagacuaccugaauauucaggaagaaauguacauaauguacaucuagcaccugcaguagcaccaacauucccuggagaacaacuauuauucuuuagaucagcauuaccagguuguggcggauaucccaauacagauuuggauugucuucuaccccaagaauggguacaacauuuuuaccaagaagcugcaccagcccaaucagauguugcauuauuaagauuuguuaaucccgauacaggaagaguccuauucgaaugcaaauuacauaaaucaggauacguaacuguagcccauacagguccacacgauuuaguaauuccaccuaauggauacuuuagauucgauucauggguuaaucaauuuuacacauuagcaccuaugggaaauggaacagguagaagaagagccuuauaa

SEQ ID NO: 31678 - RNA, 1617 nt, Artificial Sequence
  derived and/or modified sequence opt6 from VP1__Norovirus__AHH44877
augaaaauggcuagcaacgaugccaauccaucagauggaagugcagccaaucuaguaccagaaguuaauaaugaaguuauggcauuagaaccaguuguaggagcagcaaucgcagcaccaguagcaggacaacaaaauguaauugaucccuggauucgaaacaauuuuguacaagcucccggaggcgaauuuacaauaucaccaagaaaugcuccaggcgaaauauuauggucagcuccacuagguccagauuuaaauccuuaucuaagucaucuagcaagaauguauaaugguuaugcuggaggauuugaaguccaagucguuuuagcagguaacgccuuuacugcugguaaaauaauauuugcagcaguaccaccaaauuuuccaacagaagguuuaucaccaucucaaguaacaauguuuccucauauaauaguagauguaagacaacuagaaccuguuuuaauaccacuaccagacguacgaaauaauuuuuaucacuauaaccaaucaaaagauucaacaaucaaauuaauagcaaugcuauauacaccauuaagagcaaauaaugcaggagacgacgucuucacagucucuugcagaguauuaacaagaccaucaccagauuucgauuuuauuuuucuaguuccaccaacaguagaaaguagaacaaaaccuuuuucaguccccguauuaaccguagaagaaaugacaaauucuagauuuccuauaccauuagaaaaacuauuuacaggaccaagcucagcauuuguuguacaaccacaaaacggaagauguaccacagauggcguauuauuagguacaacucaauuaucagcagucaacauaugcacuuucagaggugauguaacacauguagcaggagacacauuugcgaugaauuuagcaucuuuaaauuggaacaauuacgauccuacagaagaaacaccugcaccauuaggaaccccugauuucguaggcagaauccauggaauguuaacacaaacaacucgaucugauggagcaacucgagcacauaaagcaacuguaucuacagggggugccgauuucacuccuaaacuaggaucagucagguacucaacugacacaucaggugaccuagaaguacgugaaaauacaaaauuuacaccaaucggaguacuacacucaucaggcgaaagaagggcagaaccagaacaauggagacuuccagaauacuccggacgcaauguucauaaugugcaccuagcccccgcuguugcuccaacauuuccaggagaacaauuauuauuuuuuagaucaacaaugccuggaugcggaggauacccaaauauggauuuagauuguuuauuaccccaagaauggguacaacauuucuaucaagaagcugcaccagcacaaagcgacguagcauuacuacgauuugucaauccagacacuggaagaguauuauuugaauguaaacuacauaaauccggauacguuacuguugcacauacuggcccccaugaucuaguaauaccaccaaauggauauuucagauuugacucauggguaaaucaauucuauacucuagcaccaaugggaaaugguacaggacgaagaagagcuuuauaa

SEQ ID NO: 31679 - RNA, 1617 nt, Artificial Sequence
  derived and/or modified sequence opt6 from VP1__Norovirus__AHH44878
augaaaauggcuaguucagaugcaaauccuucagauggaucugcagcuaauuuaguaccugaaguaaauaaugaaguaauggcauuagaaccaguuguuggagcagccauugcagcaccuguagccggacaacaaaacguaauagauccuuggauucgaaauaacuuuguacaagcaccgggaggagaauuuacaauauccccuagaaaugcuccaggagaaauuuuauggagugcacccuuaggaccagauuuaaauccauaccucucacaucuagcaaggauguauaacggauaugcaggagguuuugaaguacagguaguauuagccggcaaugcuuuuacagcaggaaaaauaauauuugcagcaguaccuccuaacuucccuacagaaggcuuaucaccaucacaaguaaccauguuuccacauauaaucguagacguaagacaacuugaaccaguucuaauaccacuaccugauguaagaaauaauuucuaucauuauaaucaaucuaaagauucaacaauaaaacuaauagcaaugcuauauacaccacuacgagcaaacaacgcuggagacgacguauucacaguaucaugcagaguucuaacccgaccaucaccugacuuugauuucauauuuuuaguuccucccacaguagaaagucgaaccaaaccauucucaguuccaguauuaacaguugaagaaaugacuaauucuagauuuccaauaccccuugaaaaauuauuuacaggaccaucaucugcuuucguaguacaaccacaaaauggucgauguaccacagaugguguccuauuaggaacaacacaauuaucugcuguaaauauauguacauuuagaggagacgucacacacguagccggagauaccuuugcaaugaaucuagcauccuuaaacuggaauaauuaugauccaacagaagaaacaccugcaccuuuaggaacacccgauuucguaggaagaauccauggaaugcuaacccaaacaacaagaucugauggagcaacaagagcucauaaagccacuguaucuacaggaggugccgauuuuacaccaaaauuaggaucaguaagauauucaacagauacuucuucugacuuagaaguaagagaaaacacaaaauuuacaccaauaggaguauuacacucaucagguggacacagagcagaaccugaccaauggagguuaccagaauauucuggaagaaacguccacaauguucacuuagccccagcaguugcuccuacuuuuccaggagaacaauuacuauucuucagaucaacaaugccaggaugugguggauauccuaauauggauuuagauugcuuacuaccacaagaauggguacaacauuuuuaucaagaagcagcaccagcucaaucagauguagcucuauuaagauucguaaacccugauacuggccgaguucuuuucgaauguaaacuucauaaaaguggauaugucacaguagcacauacagguccccaugaccuaguaauaccuccaaauggcuacuucagauucgauucauggguaaaucaauuuuacacauuagcacccaugggaaauggaacuggaagaagaagagcauuauaa

SEQ ID NO: 31680 - RNA, 1617 nt, Artificial Sequence
  derived and/or modified sequence opt6 from VP1__Norovirus__AHH44879
augaaaauggcauccaaugaugcaaauccaucugacggauccgccgcaaauuuaguaccugaaguuaauaaugaaguaauggcauuagaaccuguagucggagcagcaauagcagcaccagucgcuggacaacaaaacgucauagauccauggauacgaaacaauuucguucaagcuccuggaggagaauucacaauuuccccacguaaugcaccaggagaaauauuauggucugcuccauuaggacccgauuuaaauccauauuuaucucaucuugcuagaauguauaacgguuacgcuggaggauucgaaguacaagucguucuagcuggaaacgcuuucacagcaggcaaaauuauauuugcagccguacccccaaauuuucccacagaagggcuaucaccaucacaaguuacaauguuuccucacauuauaguugauguaagacaacuagagccuguauuaauaccauuaccagacguucguaauaacuuuuaucacuauaaucaaucaaaagauaguacaauaaaacuaauagcaaugcuauacacaccacuaagagccaauaaugcaggagaugauguauuuacaguuuccugucgaguccuaacaagaccuucaccugacuuugauuuuauauuccuaguucccccaaccguagaaucaagaacaaaaccauucucuguuccaguuuuaacaguugaagaaaugacaaauucaagauuuccaauaccacuugaaaaacuauuuaccggcccaucaucagcauuuguaguucaaccacaaaauggaagauguaccacagauggaguacuuuuagguacaacccaacuuucagcuguuaauaucuguacuuuuagaggagauguuacacauguagcaggagacacauuugcaaugaacuuagcaucacuaaauuggaauaacuacgauccuacugaagaaacaccagcaccuuuaggaacaccugauuucgucggaagaauucauggaaugcuaacacaaacaacacgaucagauggagcaacuagggcucacaaagcaacuguaucaacaggaggagcagauuucacaccuaaacuaggaaguguaagauacucaacugacacauccucagauuuagaaguaagagaaaauacaaaauuuacucccauagguguuuuacauaguucaggaggacaucgagcagaaccagaccaauggagacucccagaauauucaggccgaaauguacauaacguucauuuagcaccagccguagccccuacauuuccaggugaacaacuacuauuuuuucgaucaacaaugcccggaugcgguggauauccaaauauggaucuugauuguuuacucccacaagaauggguacaacauuuuuaucaagaagcagcaccagcucaaucagacguagcucuuuuaagauuuguaaauccagauaccggaagaguauuauuugaauguaaacuacacaaaucuggauacguuacaguagcccauacaggaccacacgaccuaguaaucccuccuaauggauacuuuagauucgauucauggguuaaccaauuuuauacacucgcuccaaugggaaauggaacugguagaagaagggcauuauaa

SEQ ID NO: 31681 - RNA, 1617 nt, Artificial Sequence
  derived and/or modified sequence opt6 from VP1__Norovirus__AHH44880
augaaaauggcauccaacgaugcaaauccaagcgauggaagugccgcuaaucuaguccccgaaguuaauaaugaaguaauggcacuagaaccaguagucggagcagcaauagccgcuccuguagccggacaacaaaauguuauagacccauggauacguaauaauuucguccaagcaccagguggugaauuuacaauauccccccguaaugccccaggugaaauacuauggucagcuccacuaggaccagaucuaaauccuuaccuuucacaccuagcaaggauguauaauggauaugccggcggauuugaaguccaaguaguacuagcaggaaacgccuuuacugcaggaaaaauaauauuugcagcaguaccacccaauuucccaacagaaggacuaucuccaucacaaguaacaauguucccacacauaauaguagacguaagacaauuagagccaguauuaauaccauuaccagacguccggaauaacuuuuaucacuacaaucaaucaaaagauuccacaauuaaacuaauugcuaugcuauauacaccacuaagagcaaauaaugcaggagaugacgucuuuacaguaagcugucgaguucuuacaagaccuuccccagauuuugauuuuauauuucucguaccccccacaguagaauccagaacaaaacccuuuucaguuccaguacuaacugucgaagaaaugacaaacucuagauuuccaauaccauuagaaaaacuguucaccggaccaucaucagcauuuguaguccaaccacaaaauggaagauguacaacagauggaguauuauuaggaacgacacaauuaucagcaguaaauaucuguacauuucgaggugacgucacucacguagccggcgauacauuugcaaugaauuuagcaucacuaaauuggaacaauuaugaucccacugaagagacaccagcaccacuaggcacuccagacuucguaggcagaauacacggaauguuaacacaaacaacaagaucagauggugcuacacgcgcacacaaagcaacagucucaacaggaggugcugauuuuacaccaaaacuaggaucaguccguuacaguacagauacaucuucagaccuagaaguacgagaaaauacuaaauuuacuccuauaggagucuuacauucaucaggaggucauagagcagaacccgaccaauggagacuccccgaauauuccggaagaaauguccacaauguucaccuagcaccagcaguagcaccuacauuuccaggagaacaacuauuauuuuuuagaucaacaaugccaggauguggcggauaccccaauauggauuuagauugucuauuaccccaagaauggguucaacauuuuuaucaagaaacagcaccagcacaaucugauguagcucucuuacgauuuguaaacccagacacaggaagaguacuauuugaauguaaauuacacaaaucuggauacguaacaguagcacacacaggcccacaugauuuaguaauaccaccaaauggauauuuuagauuugacucuuggguuaaccaauuuuauacacucgcacccaugggaaacggaacaggaagaagaagagcauuauaa

SEQ ID NO: 31682 - RNA, 1617 nt, Artificial Sequence
  derived and/or modified sequence opt6 from VP1__Norovirus__AHH44881
augaaaauggcaaguaacgaugcaaauccauccgauggaagugcagcaaaccuuguaccugaaguaaauaaugaaguaauggcucuagaaccaguaguaggagcagcaauagcagcaccaguugcaggacaacaaaauguaaucgauccuuggauucgaaacaacuucguacaagcaccaggaggcgaauuuacaaucuccccacgaaacgcaccuggagaaauauuauggucagcaccauuaggaccagauuuaaauccauaucuuucucauuuagcuagaauguauaacggauaugcaggagguuuugaaguucaaguaguuuuagcuggcaaugccuuuacagcuggaaaaguaauuuuugcagcagucccaccaaauuuuccaacagaaggauuauccccaucacaagugacaauguuuccacacaucauaguagauguacgacaauuagaaccaguauuaauacccuuacccgauguaagaaacaacuuuuaucauuauaaucaaucaaacgauuccacaauaaaacuaauagcaauguuauacacaccccucagagcaaauaaugcuggagaugauguauucacuguaucaugcagaguacuuacaagaccaucaccagauuuugauuuuauauuuuuaguaccaccuacuguagaaucaagaacaaaaccauuuucaguuccuguacuaacagucgaagaaaugacaaauucuagauuuccaauaccucuagaaaaacuuuuuacaggaccaucuucagcauucguuguacaaccgcaaaacggaagaugcacaaccgauggcguacuacuaggaacaacccaacuaucagcuguaaacauuugcacauuccgcggagauguaacucacguagcaggugauaccuuugcuaugaauuuagcuucauuaaacuggaauaacuaugacccaacagaagaaacaccagcaccacucggaacaccggauuuuguaggaagaauacauggaaugcugacucaaacuacaagaagugauggagcaacaagagcacacaaagcaaccguuucaacaggaggcgcugacuuuacaccaaaacucggaucaguucgcuacucaacugacacaucaucugauuuagaaguaagagaaaauacuaaauuuacaccaauuggaguauuacacucaagcgguggucaccgugcagaaccugaccaauggagauuacccgaauauucuggaagaaacguucauaauguacauuuagcaccagcaguugcaccaacuuuuccaggagaacaacuauuauuuuucagaaguacaaugccuggaugcggcggauaccccaauauggauuuagauuguuuauuaccacaagaauggguacaacauuuuuaucaagaagcugcaccagcacaaucagacguugcacuacuaagauuuguaaauccagauacaggacgaguuuuauuugaauguaaauuacauaaaucaggauauguaacaguagcucacacaggaccccaugaucuaguuauaccaccuaauggauauuuccgcuuugauucauggguaaaucaauuuuauacauuagcaccuaugggcaacggcacaggucgacguagagcauuauaa

SEQ ID NO: 31683 - RNA, 1617 nt, Artificial Sequence
  derived and/or modified sequence opt6 from VP1__Norovirus__AHH44884
augaaaauggcgucuaaugacgccaauccuuccgacgguucagcagcuaaucuaguaccagaaguaaauaaugaaguaauggcacuagaaccagucgucggagcugcuauagcagcaccaguagcaggacaacaaaaugucauagauccuuggaucagaaauaauuuuguacaagcaccaggaggugaauuuacaauaucaccaagaaaugcaccuggagaaauauuauggucugcaccccucggacccgaucuaaauccauaccuaucacauuuagcgagaauguauaauggauaugcaggaggauucgaaguucaaguuguccuagccggaaaugccuucacagccggaaaaauaauauucgcagcaguaccaccaaauuuuccaaccgaaggacuuucaccaucccaaguaacaauguuuccccacauaauaguagauguaaggcaauuagaaccaguacuaauaccucucccagaugucagaaacaacuuuuaccauuauaaccaaucaaacgauaguauaauaaaauuaauagcaaugcuauauacaccauuaagagcaaauaacgccggagaugacguauuuacaguaucauguagaguuuuaacucgaccaucaccugauuucgacuuuauuuuucuaguuccaccuacaguagaaucacgaacaaaaccauucacaguuccuguauuaacaguagaugaaaugacaaauucacgauuuccaauaccacuugaaaaacucuuuacagguccuucuucagccuuuguaguacaaccacaaaaugguagauguacaacugacggaguacuauuaggaacaacacaauuauccgcaguaaauauauguacuuuuagaggggauguaacacauguuucagauaaaacauucgccaugaauuuagcauccccuaauuggaauaauuaugauccaacagaagaaauaccugcaccauuaggaacaccagacuucguuggaagaauccacggaaugcuuacccaaacaacacguagagacggagcgacacgaggacauaaagcaacuguaucaacuggaggagcugauuuuacaccaaaauuagguucaguaagauacauuacugacacuacagaugacuuagaaguccgagaaaauacaaaauuuacaccuauaggcguucuacauucaucuggagaacauagagcugaacccgaccaauggagauuacccgaauauuccggacgaaauguacauaauguacauuuagcaccugccguagccccaacauuucccggugaacaauuauuauuuuuucgaucagcacuuccugguugugguggcuacccuaauaccgaucuugacugccuucuaccgcaagaauggguacaacauuuuuaucaagaagcagcaccagcacaaagcgauguagcauuacuaagauucguaaauccagacacaggaagaguccucuuugaaugcaaacuucauaaaaguggauacgucacaguagcacauacaggaccacaugaccucguuauaccacccaacggauacuuucgauuugauucuuggguaaaccaauuuuacacguuagcaccaaugggaaauggaacaggaagaagaagagcauuauaa

SEQ ID NO: 31684 - RNA, 1620 nt, Artificial Sequence
  derived and/or modified sequence opt6 from VP1__Norovirus__AHH44886
augaaaauggccucaaaugaugcaucaccaucagauggaucagcagcaaaccuaguacccgaaguuaauaaugaaguuauggcauuagaacccguaguaggugcagcaauugcagcaccaguugcaggacaacaaaauguaauugauccuuggauacgaaauaauuuuguacaagcuccuggaggagaauuuaccguuucaccaagaaacgcaccgggugaaauucuuugguccgcaccccuaggaccagauuuaaauccauacuuaucacaccuagcaagaauguauaauggauacgcagguggcuucgaaguacaaguaauacuagcaggaaaugcauucaccgcuggcaaaauaaucuuugcagcaguaccaccaaauuuuccaacugaaggucuuaguccaucucaaguaacuauguuuccgcauauuguaguagacguaagacaacuagaacccguucuaauuccccuaccagauguacgaaacaacuucuaucauuauaaucaaucuaaagauccuacaaucaaauuaaucgccauguuauauacaccauuaagagcaaauaaugcuggugaagauguauuuacaguuuccugucgaguuuuaacacgcccaucgccagauuuugauuucauuuuuuuaguuccaccaacaguagaaucaagaucaaaaccuuuuacaguaccaauacuaacaguagaagaaaugacaaacucuagauuuccaauuccauuagaaaaacuauucaccggaccaucaggagcauucguuguacaaccccaaaacggucguuguacaacagauggaguauuauuaggaacaacacaauuaaguccaguaaauauauguacauuuagaggagauuuaacucacuuuacaggaacauccgaauaugcaaugaauuuagcuucacaaaauuggaacaauuacgauccuacagaagaaauaccagcaccacucggagcuccagacuuuguaggaaaaauuagaggaauguuaacacaaacuacacguagagacggaucaacaagaggacauagagcaacacuaucaacuggaucagcacauuucacaccaaaacucggcucaauacguuucucaacagacacaaauaaugauuuugaagccggacaaaacacuaaauucacucccgucgguguauuccaagaaggagauaaucaucaaaaugaaccccaacaauggguacuacccaauuacuccggagcaacagcacauaauguucauuuagcaccugcuguagcaccugcuuuuccaggugaacaauuauuauuuuucagauccaccaugcccgguugcggaggauauccuaauaugaaucuagauugcuuacuaccacaagaauggguacaacacuucuaucaagaagcagcaccugcacaaucagauguugcuuuauuacguuuuguuaaccccgauaccucacgaguacuguucgaauguaaauuacauaaaaguggcuacguaacuguagcacauacaggacaacacgauuuaguuaucccacccaauggauacuuuagauucgacuccuggguaaaucaauuuuauacauuagcaccuaugggaaaugguacagguagaagaagagcacuuuaa

SEQ ID NO: 31685 - RNA, 1620 nt, Artificial Sequence
  derived and/or modified sequence opt6 from VP1__Norovirus__AHH44888
augaaaauggcaucaaaugaugcaucuccuucagauggaucagcagcaaauuuaguuccagaaguaaauaaugaaguuauggccuuagaaccaguaguaggcgcagcaauagcagcuccaguugcuggucaacaaaauguaauagacccauggauacgaaacaauuucguacaagcaccagguggagaauucaccguauccccaagaaacgccccaggagaaauuuuauggucagcaccucuuggaccugauuuaaaccccuauuuaucucaucuugcuagaauguacaacggauaugcaggaggauuugaaguucaggucauauuagcagguaaugccuuuacagcaggaaaaauaaucuucgcagcuguaccaccaaauuuucccaccgaaggacuuucuccaucucaaguaacaauguuuccucacauagucguagacguaagacaauuagaacccguauuaauaccauuaccagauguaagaaauaacuucuaucauuauaaccaaucaaaagaucccacaauuaaauuaauagccaugcuuuauacuccacuuagagcaaauaacgccggagaagauguuuuuacuguuucauguagaguacucacuagaccaucaccagauuucgauuuuauauuucuuguaccaccaacagucgaaucacgcucaaaacccuuuacaguuccaauauuaacaguugaagaaaugacaaauucacgauuuccuauuccauuagaaaaauuauucacaggcccaucaggagccuuuguaguacagccacaaaaugguagauguaccacugauggaguucuuuuaggaacaacucaauuaucacccguaaauauuuguacauuuagaggagaucuaacacauuucaccggaaccucagaauacgcaaugaacuuagcuucucagaacuggaauaauuaugauccaacagaagaaauaccugcaccauuaggagcaccugacuucguagguaaaauacgagggaugcuuacucaaacaacuagaagagaugguucuacaagaggacauagagcaacauuauccacugguucagcacauuucacaccuaaacuaggaaauauaagauuuucuacagauacuaauaaugauuucgaagcuggccaaaauaccaaauuuacaccaguaggaguauuucaagaaggagauaaccaccaaaacgaaccccaacaauggguauuacccaauuauucuggagcaacagcccauaacguccaucuagccccagccguagcuccagcauuuccaggagaacaauuauuauucuucagaucaacaaugccaggauguggcggauacccaaauaugaauuuagauugucuacuaccucaagaauggguacaacauuucuaucaagaagcagcaccugcacaaagcgacguagcacuauuaagauucguaaauccugauaccagccggguucuauuugaauguaaacuucacaaaucuggauaugucacuguugcccauacaggacaacacgacuuaguaauacccccaaacggauacuuuagauucgacucauggguaaaccaauucuauacacuagcaccuauggguaaugguacaggaagacgaagagcucuuuaa

SEQ ID NO: 31686 - RNA, 1620 nt, Artificial Sequence
  derived and/or modified sequence opt6 from VP1__Norovirus__AHH44889
augaaaauggcuucaaaugaugcaucccccucggacggcuccgcagcaaacuuaguacccgaaguauccaaugaaguaauggcucuugaaccuguaguuggagcugccauugcagcaccaguagcaggacaacaaaauguuauagaccccuggauaagaaacaauuucguacaagcaccuggaggagaauuuacaguaucaccaagaaaugcaccuggagaaauacuauggucagcaccacucggcccagacuuaaauccauaucuaucacacuuagcacgaauguauaacgguuacgcaggaggcuucgaaguucaaguuauuuuagcaggaaacgcuuuuaccgcuggaaaaauaauuuuugcagcaguaccaccaaauuuuccaaccgaaggauuaucaccuucucaaguuacuauguucccucacauaguaguagauguacgacaacuagaaccaguacuaauaccuuuaccagauguaagaaauaauuuuuaucacuauaaccaaucaaaagacccaacaauaaaauuaauagcaauguuauacacuccauuacgagcaaacaaugcaggagaagacguauucacaguaaguugucgaguccuuacuagaccaucaccagauuuugauuuuauauucuuaguuccuccuacaguagaaucuagaucaaaaccuuuuaccguaccuauccuaacuguagaagaaaugaccaacucuagauuuccuauuccacuagaaaaauuauucaccggaccauccggagcauuugucguccaaccacaaaacggaagauguacaacagauggaguucuuuuagguaccacacaacuaucaccaguaaacauauguaccuuuagaggagauuuaacacacuuuacuggaacaucugaauaugcuaugaaucuugcuucacaaaauuggaauaauuaugauccaacugaagaaauuccagcacccuuaggugcaccugacuuuguaggaaaaauaagaggaaugcuaacacaaacaaccagacgcgauggaucaacaagaggacauagagcuacauuaucaacaggaagugcucauuuuacuccaaaauuagguucaauacgauuuucuacagacacuaauaaugauuuugaagcaggacaaaauacaaaauuuacccccguaggaauauuccaagaaggagauaaccaucaaaaugaaccccaacaauggguauuaccaaauuauagcggagcuacagcacacaauguucaccuagcaccagcuguagcccccgcuuucccuggagaacaauuacuauucuucagaucuacaaugccaggauguggaggauauccaaacaugaaucuagauuguuuacuaccacaagaguggguacaacauuuuuaucaagaagcagcaccagcacaaucugauguagccuuauuaagauucgucaauccagauacaucaagaguauuauucgaaugcaaacuccauaaaucagguuacguaaccguagcacauacaggacaacacgauuuagucauaccuccuaaugguuauuuucgauuugacucauggguuaaucaauuuuauacauuagccccuaugggaaauggaacaggaagaagaagagcacucuaa

SEQ ID NO: 31687 - RNA, 1620 nt, Artificial Sequence
  derived and/or modified sequence opt6 from VP1__Norovirus__AHH44890
augaaaauggcaucuaacgaugcaucacccuccgauggaucagccgccaaccuaguaccugaaguaaacaacgaaguaauggcuuuagaaccaguuguaggagcagcaauagcagccccuguagccggacaacaaaauguaauagauccauggauaagaaauaauuuuguucaagcaccaggaggagaauucacaguaucaccaagaaacgcaccaggagaaauccuauggagcgcaccacuagguccagaucuaaacccauaccuaucacauuuagcacgaauguacaacggauaugcaggaggguuugaaguacaaguaauccuagcaggaaaugcguucacagcaggaaaaauaaucuucgccgcaguuccuccaaauuuuccaacugaaggauuaucuccaucacaaguaacaauguuuccacacauuguagucgacguuagacaacuagaaccuguacugauaccacuacccgauguccgcaacaauuucuaucacuacaaucaaucaaaagauccuaccauaaaacuuaucgccaugcuauauacaccauuaagagccaauaacgcaggagaagacguauuuacagucucaugcagaguucuaacaagaccuucaccagauuuugacuucauuuuucuaguaccaccaacaguagaaucuagaucuaaacccuuuacagucccaauucuaacaguugaagaaaugaccaauucacguuuucccauaccacuagaaaaacuuuucacaggaccaucaggcgcauuugucguacaaccacaaaaugguagaugcacaacagacggaguacuauuaggaacaacccaacuauccccuguaaacauauguaccuucagaggagacuuaacacauuuuacaggaacaucugaauaugcaaugaauuuagcaucccaaaacuggaauaacuacgaccccacugaagaaauaccagccccacuaggagcaccagacuucgucggaaaaauacggggaaugcuuacacaaacaacaagaagagacggaucaacaagaggacauagagcuaccuuaucuacagguucagcacauuucacaccaaaauuagguaauauaagauuuucaaccgacacaaacaaugacuuugaagcaggucaaaauacaaaauuuacaccaguaggaguauuucaagaaggagauaaucaccaaaaugaaccucaacaauggguauuaccaaauuauucuggagcaacagcacauaacguacacuuagcucccgcuguagcaccagcauuuccaggagaacaauuacuuuucuucagaucuacaaugcccgguuguggaggcuauccuaacaugaacuuagauugucuacuuccucaagaauggguacaacauuucuaucaagaagcagccccagcccaaucugauguugcacuacuucgcuuuguaaaucccgauacaucaagaguucuuuucgaaugcaaauuacacaaguccggauacguaacaguagcacauacaggacaacaugaucuaguaauaccaccaaauggauauuuuagauuugacucauggguaaaucaauuuuauacauuagcaccaaugggaaauggaacaggccgccgacgugcauuauaa

SEQ ID NO: 31688 - RNA, 1620 nt, Artificial Sequence
  derived and/or modified sequence opt6 from VP1__Norovirus__AHH44891
augaaaauggccucaaaugacgcaucaccuucugacggaucagcagccaaccucgucccugaaguaaauaacgaagucauggcauuagaaccaguaguuggagcagcaauagcagcaccuguagcaggacaacaaaauguaauagacccauggauaagaaauaauuuuguccaagcacccggaggagaauuuacgguaucaccacgaaaugcaccuggagaaauauuauggucagcaccucuaggaccagaucuuaauccauauuuaucccacuuagccagaauguauaacggauaugcaggaggauuugaaguacaaguaauacuagcugguaaugcauuuacagcaggaaaaauaauauuugccgcaguaccucccaauuuuccaaccgaaggacuuucaccuucacaaguuacaauguucccucauauaguaguugacguacgucaauuagaaccaguacuaauaccauuaccagacgucagaaacaauuuuuaucacuauaaucaaucuaaagauccaacaauuaaacuuauagcaaugcucuauacaccuuuacgagcaaacaacgcaggagaagacguauuuacaguaagcuguagaguauuaacuagacccucaccugacuuugacuuuauuuuuuuaguaccaccaaccguagaauccagaucaaaaccuuuuacuguaccaauauuaacaguugaagaaaugacaaacagcagauuuccaauuccauuagaaaaauuauuuaccggaccaucaggagcauucguaguacaaccacaaaauggaaggugcacuacagaugguguacuauuaggaacaacacaacuaucuccagucaacauauguacauucagaggagacuuaacacauuucacaggaacaucagaauacgcaaugaaucucgcaucucaaaacuggaacaauuaugaucccacagaagaaauuccagcaccauuaggagcuccagauuuuguaggcaaaauucgaggaaugcucacacaaacaacaagaagagacggaucaacaagaggacacagagcaacacucucuaccgguucugcacauuucacuccaaaacuaggaaauauacguuucuccacugauacaaacaaugacuucgaagcaggacaaaauacaaaauuuacaccaguaggaguauuccaagaaggugauaaucaccaaaaugaaccacaacaauggguauuaccaaauuauucaggagcaacagcacacaauguacauuuagcuccagcaguagcaccagcauuuccaggugaacaauuacuauuuuuuagaucaaccaugccaggcuguggaggauauccuaauaugaauuuggauugccuauuaccacaagaauggguacaacauuucuaccaagaagcagccccagcccaaucagacguagcuuuacucagauucguuaacccagauacgucacgaguauuauucgaauguaaauuacauaaaagcgguuaugucacaguagcucauacaggucaacaugaucuuguaauaccccccaauggauauuucagauuugacucauggguuaaccaauucuauacuuuagcaccuaugggaaacgguaccggacgcagaagagccuuauaa

SEQ ID NO: 31689 - RNA, 1620 nt, Artificial Sequence
  derived and/or modified sequence opt6 from VP1__Norovirus__AHH44893
augaaaauggcaucaaaugaugcaucucccucagaugggucagcagccaacuuaguaccagaaguaaauaaugaaguaauggcucuagaaccaguaguaggagcagcaauagcagcuccaguagcaggacaacaaaauguaauagaucccuggauacgcaacaauuucguucaagcuccagguggagaauuuacuguaucaccucguaacgcaccaggagaaauauuaugguccgcaccauuaggaccagaucuuaaucccuaccuuucacaucuagcaagaauguauaauggauaugcaggagguuucgaaguucaaguaauauuagcaggaaacgcuuuuacugcaggaaaaauaauauucgcugcaguuccccccaauuuuccuacagaagguuuaucuccaucacaaguaaccauguucccacacauaguaguagacguaagacaauuagaaccuguauuaauuccauuaccugauguacgaaauaauuuuuaucauuacaaucaaucuaaagauccuacuauaaaacuaauagcuauguuauauacuccacuucgugcaaauaacgcaggagaggacguauucacaguaucaugccgaguauuaacuagaccaaguccugacuuugauuuuauauuucucguaccaccaacaguagaaaguagaucaaaaccauuuacagucccaauacuuaccguagaagaaaugacuaacucuagauuuccaaucccuuuagaaaaauuauucacgggaccaucaggagccuuuguaguacaaccacaaaacggaagauguacaacugacggaguacuucuaggcacaacccaacuaaguccagucaauauauguacauucagaggagaucuaacucacuucacaggaacaucagaauaugcuaugaauuuagcuagucaaaauuggaauaacuaugauccuaccgaagaaauaccagcaccauuaggcgcuccugauuuuguaggaaaaauuagaggaaugcuuacacaaaccacaagaagagacggaucaacccgaggacaucgagcuacauuaucaacugguucagcacauuuuacaccaaaacuaggaaauauacgauuuucaacugauacuaauaaugauuuugaagcaggacaaaacacaaaauuuacaccaguaggcgucuuucaagaaggugauaaccaucaaaaugaaccacaacaauggguacuuccaaauuauuccggagcaacugcucauaauguacaucucgcccccgcaguagccccagccuuuccaggugaacaauuacuguuuuuucgaucaacuaugccuggaugcggaggauacccaaauaugaacuuagauugucuauuaccacaagaauggguacaacauuuuuaucaagaagcagcaccagcucaaucagacguagcacuacuaagauucguaaauccugauacaucaagaguauuauuugaauguaaacuacauaaaagugguuacguaacaguagcacauacaggacaacaugaccuaguaauaccaccaaauggauacuuuagauuugacucuugggucaaucaauuuuacacacuagcaccaaugggaaauggaacaggacgaagacgagcauuauaa

SEQ ID NO: 31690 - RNA, 1620 nt, Artificial Sequence
  derived and/or modified sequence opt6 from VP1__Norovirus__AHH44894
augaaaauggccucaaacgaugcaaguccaucagauggaucagcugcaaaccuaguaccagaaguuucaaacgaaguaauggcauuagaaccaguaguuggagcagcaauagcugcaccaguagcaggucaacaaaacguaauagaucccuggauaagaaauaacuucguacaagcacccggaggagaauucacuguaucccccagaaacgcaccaggugaaauacuauggucagcaccuuuagggccagaucuuaauccauaccucucacauuuagcaagaauguacaauggcuaugcaggcggauucgaaguucaaguaauauuagcugguaacgcauucacagcuggaaaaauaauauucgcagcuguaccaccaaauuucccaacagaaggacuuagcccaucacaaguaaccauguuuccucauauaguaguugacguacgucaauuagaaccaguauuaauaccauuaccugacguuagaaauaauuucuaucacuauaaucaaucuaaagacccuacaauaaaauuaauagcaaugcuauacaccccgcuuagagcaaacaaugcaggagaagauguauucacaguaucaugucgaguauugacaagaccaucuccagauuucgacuuuauauucuuaguaccuccaacuguagaaucaagaucuaaacccuucacaguaccaauauuaacaguagaagaaaugacaaauucaagauuuccuauaccacuagaaaaauuauucacuggaccuagcggcgcauuuguaguacaaccucaaaauggaagaugcaccacagaugguguuuuauuaggaacaacacaauuaucaccaguuaauauaugcacauuuagaggagacuuaacacacuuuacaggaacaucugaauaugcuaugaauuuagcaucacaaaauuggaauaacuaugauccaacagaagaaauuccugcaccccucggugcgccagacuucguaggaaaaauacgaggaauguuaacucaaacaacacgaagagauggaucaacaagaggacacagagcaacccuuucaacaggauccgcacauuucacuccaaaauuagguucaauaagguucucaacugacacuaacaaugauuuugaagcaucacaaaacacaaaauuuacaccaguagguguauuccaagaaggagauaaccaucaaaacgaaccucaacaauggguuuuaccaaacuacucaggugcaacagcacauaacguacaccuugcuccagcaguagcucccgcauucccaggcgaacaauuacuauucuucagaaguacaaugccaggcuguggaggauaucccaacaugaaucuagauugcuuauuaccucaagaauggguucaacauuuuuaucaagaagcugcaccagcacaaucagauguagcuuuacuuagauuuguaaacccagauacaucuagaguauuauuugaaugcaaauuacauaaaucaggauaugucacuguagcccacacaggccaacacgauuuagucauaccaccaaaugguuauuucagauucgauucuuggguaaaccaauuuuauaccuuagcaccaaugggaaacggaacaggacgacgacgugcacuauaa

SEQ ID NO: 31691 - RNA, 1620 nt, Artificial Sequence
  derived and/or modified sequence opt6 from VP1__Norovirus__AHH44895
augaaaauggcaaguaaugaugcaucaccaucagacggauccgcagcaaacuuagucccagaaguaaacaacgaaguaauggcauuagaaccagugguaggagcagcaauagccgccccaguugcuggucaacaaaacguuauagaccccuggauaagaaauaauuucguacaagcaccuggaggagaauuuacaguaucaccaagaaaugcaccaggugaaauuuuauggagcgcaccacucggcccagaucuaaauccauauuuaucacaucuagccagaauguauaacggauaugcaggaggcuuugaaguccaaguaaucuuagcagguaaugcuuuuacagcuggaaaaauaauauucgcagcaguaccaccuaauuuccccacugaaggucuaucaccaucacaaguuacaauguucccacacauaguagucgacguacgucaauuagaaccaguuuuaauaccauuaccagauguacguaacaacuuuuaccacuauaaucaaucaaaagaccccacaauaaaauuaauagcaaugcuuuauacaccauuaagagcaaauaaugcaggagaagauguauuuacaguaucauguagaguccuaacaagaccaucaccagauuuugacuuuaucuuucuaguacccccaacagucgaauccagaucuaaaccauucacaguaccaauauuaaccguagaagaaaugacaaauucacguuucccaauuccgcucgaaaaauuauucacagguccaucuggugcauucguuguacaaccacaaaauggacgauguacaaccgauggcguauuauuagguacuacgcaacuaucaccaguuaacauauguaccuuucgaggagauuuaacacauuucacgggaacaagcgaauaugccaugaaucuagcaucacaaaauugggacaacuaugauccaacagaagaaauaccagcaccuuuaggagcaccugauuuuguaggaaaaauuagaggaaugcuaacucaaacaacaagaagagauggcucaacacgcggacauagagcaacacuaaguacaggaucagcacacuuuacaccaaaauuaggaaacauuagauucucaacagauacaaauaaugacuucgaagccggccaaaauacaaaauuuacaccaguaggaguauuucaagaaggcgauaaucaucaaaacgaaccccaacaauggguacuacccaauuauucaggagcaacagcgcacaauguacaucuagcaccugcaguagcuccagcuuucccaggugaacaacuauuauucuuuaggucaacaaugccaggauguggagguuacccaaacaugaacuuagacugccuauuaccucaagaauggguucaacauuuuuaucaagaagcugcaccagcacaaucagaugucgcacuauuaagauuuguaaauccagacacuagucguguauuauucgaauguaaauuacauaaauccggauauguaacagucgcucauacuggucaacaugaucuagucauaccaccuaauggauacuucagauuugacucauggguaaaucaauuuuauacacuugcuccaaugggaaauggcacaggacgaagaagggcauuauaa

SEQ ID NO: 31692 - RNA, 1620 nt, Artificial Sequence
  derived and/or modified sequence opt6 from VP1__Norovirus__AHH44896
augaaaauggcaucaaaugacgcuucaccaucugaugguucagcagcuaacuuaguucccgaaguuaauaaugaaguaauggcacuagaaccaguuguaggcgcagcaaucgccgccccaguugcaggacaacaaaauguaauugaucccuggauaagaaauaacuuuguccaagcaccaggaggugaauucacaguauccccuagaaaugcuccaggagaaauacucuggagcgcaccacuaggucccgaccucaauccauaucuaucucaccucgcacgaauguauaacggcuaugcaggaggauucgaaguacaaguuauauuagcuggaaacgcauucaccgcuggaaaaauaauauuugcugcagucccuccuaacuuucccacagaaggacuuucaccaucacaagucacuauguuuccucauauaguaguagacguaagacaacuagaaccaguccuaauaccacuuccagacguacgaaauaauuuuuaccauuauaaucaaucaaaagauccuacaauaaaacuuauagcaauguuauauacuccacuucgagcuaauaaugcaggcgaagauguauucacaguaagcuguagaguucuaacuagaccaucacccgacuuugauuuuauauucuuaguacccccaacaguagaaucaagaucaaaaccauucacaguacccauccuaacaguagaagaaaugacaaauagucgauuuccaauaccacuugaaaaacuauucacaggaccaucaggagcauucguaguacaaccacaaaauggaagauguacaacagauggaguacuacuaggaacaacacaacuuucaccaguuaauauauguacauuuagaggugauuuaacacacuucacaggcaccucagaauaugcaaugaaccucgcuucucaaaauuggaacaacuaugacccaacagaagaaauaccagcaccacuaggugcaccugauuuugucggaaaaauacguggaaugcuaacacaaacaacacgaagagauggcucaaccagaggacauagagcaacauuaagcacaggaucagcacacuuuacaccaaaauuagggaauaucagauuuucuaccgauacaaauaacgauuucgaagcaggacaaaauacaaaauuuacaccaguuggcguauuccaagaaggagauaaucaccaaaaugaaccucaacaauggguguuaccaaacuacucaggagcaacugcccauaauguacaccuagcaccagcaguagcuccagcuuuucccggugaacaacuauuauuuuucagaucuacaaugccuggcugcgguggauauccuaacaugaaucuagauuguuuauuaccacaagaauggguccaacauuuuuaucaagaagcagcaccagcacaaagcgacguagcauuauugagauuugucaauccagauacuucaagaguucuauuugaauguaaacuacauaaaucaggauauguaacaguagcucauacaggacaacaugaucuaguaauaccaccaaaugguuauuuuagauuugacucauggguaaaccaauucuauacccuugccccaaugggaaacggaacuggcagaagaagagcucuauag

SEQ ID NO: 31693 - RNA, 1620 nt, Artificial Sequence
  derived and/or modified sequence opt6 from VP1__Norovirus__AHH44897
augaaaauggcuucgaaugaugcuucccccucagauggaucugcagcaaacuuaguccccgaaguaaacaacgaaguuauggccuuagaacccguaguuggugccgcaauagcugcuccaguugcuggacaacaaaauguuauugauccauggauacgaaauaacuucguccaagccccaggaggcgaauuuacaguaucaccaagaaacgccccaggcgaaauacuuuggucugcaccauuaggaccugauuuaaauccauaucuaucucauuuagcacguauguacaacggcuacgccggaggauuugaaguacaagucauccuagcaggaaaugcuuuuacagcaggaaaaauaauauuugcagcaguaccaccaaauuucccuacagaaggucuaagcccaucccaaguaacuauguucccucacaucgucguagauguuagacaacuagaaccuguccucauuccucucccagacguaagaaauaauuucuaucacuacaaccagucaaaagauccaacaauuaaauuaauagcaaugcuuuauacuccccuaagagcaaacaacgcaggagaagauguauucacaguaucuugucgaguacuaacucgaccaaguccagacuuugauuuuaucuuuuuaguuccuccaacaguagaaucuagaucuaaaccuuuuacaguucccauucuaacaguagaagaaaugacuaacucaagguuuccuauaccauuagaaaaacuuuucacaggaccaucuggcgccuucguaguacaaccccaaaacggaagauguacaacagauggcguacuauuaggaacaacacaacuaucaccagucaauauauguacauuucgaggagacuuaacacauuuuacaggaacaucagaauacgcaaugaaccuugcaucacaaaacuggaacaauuaugauccaaccgaagaaauacccgcaccacuuggagcaccagauuuuguagguaaaauccgaggaauguuaacacaaacuacaagaagagauggauccacuagaggccaucgagcuacauuaucaacaggaucugcccauuucacuccaaaacuaggaaacaucagauuuucaacugauacuaauaacgacuuugaagcaggacaaaacacaaaauuuacuccuguuggaguauuccaagaaggugacaaucaccagaaugaaccucaacaauggguucuuccaaacuauagcggugccacagcccauaacguacaccuagcacccgcaguagcaccagcuuuuccaggugaacaacuucuauucuuuagaucaaccaugccagguuguggaggcuaucccaauaugaaccuagauugccuuuuaccacaagaauggguacaacauuuuuaccaagaagcugcaccagcucaaucagauguagcacuacuaagauucguaaauccagacaccagucgaguucuuuucgaaugcaaacuacauaaaagcggauacguaacaguagcacauacaggacaacaugaucuaguaauaccaccaaauggauauuuuagauuugacucauggguaaaccaauuuuauaccuuagcaccaaugggcaauggaaccggucgaagaagagcauuauaa

SEQ ID NO: 31694 - RNA, 1620 nt, Artificial Sequence
  derived and/or modified sequence opt6 from VP1__Norovirus__AHH44899
augaaaauggcauccaacgacgcuucuccaucagaugguucugcagcaaaucucguuccagaaguaaauaacgaaguaauggcuuuagaaccuguaguaggagcagcaauagcagcaccagucgcuggccaacaaaacguaauagauccauggauucguaauaauuuuguucaagcaccaggaggcgaauucacuguuuccccuagaaacgcaccuggagaaauauuauggagcgccccacucggaccagauuuaaacccauauuuaucucaucuagcaagaauguauaacggauaugcuggaggauuugaaguacaaguaauacucgcaggaaacgcauucacagccgguaaaauaauauuugcagcaguaccaccaaacuuuccaacagaaggauuaucuccaucacaaguaacaauguuuccacacauagucguugaugucagacaacuagaaccaguccuaauaccacuacccgauguaagaaauaauuuuuaccauuacaaccaaucuaaagauccaacaauuaaacuaauagccaugcuuuauacaccacuucgagcaaauaaugcaggagaagauguuuuuacagucucuugucgaguacuaacucgacccucuccagacuuugacuucauauuccuaguaccaccuacaguagaaucaagauccaaaccauuuacaguaccaauacucacaguagaagaaaugacuaauucaagauuuccaauacccuuagaaaaauuauucacaggaccaagcggagccuuuguaguccaaccacaaaacggacguuguacaaccgacggaguuuuauuaggcacaacacaacucucuccuguaaauaucuguacauuccgcggagaucuaacacauuuuacagguacaucugaauaugcaaugaacuuagcaucacaaaacuggaauaacuaugauccaacagaagaaauaccagcaccauuaggagcaccagacuuuguuggaaaaauccgagguauguuaacacaaacaacccgucgagauggaucaacuagaggacauagagccacucucagcacagguuccgcacauuuuacaccaaaacuugguaauauaagauuuagcacagacaccaacaaugauuuugaagcaggacaaaacacaaaauuuaccccagucggaguuuuucaagaaggagauaaccaucaaaaugaaccucaacaaugggucuuaccaaauuauucaggagcaacagcacacaacguucaucucgcucccgcagucgcaccugccuuuccaggagaacaauuacucuuuuucagaucaacaaugcccggaugugguggauauccaaauaugaauuuagauugccuguuaccccaagaauggguacaacauuuuuaccaagaagccgcaccagcacaaucagacguagcacuguuacgauucguuaauccagauacauccagaguccucuuugaauguaaacuccauaaaucaggauacguaacaguugcucauacaggacaacaugaccuaguaauuccaccuaauggauacuuuagauuugauucauggguaaaccaauucuacacauuagcaccaaugggaaauggaacagguagacgaagagcauuauaa

SEQ ID NO: 31695 - RNA, 1620 nt, Artificial Sequence
  derived and/or modified sequence opt6 from VP1__Norovirus__AHH44900
augaaaauggcaucuaacgacgcuuccccaagcgauggaucugccgccaaucuuguaccagaaguuaauaacgaaguaauggcauuagaaccaguaguaggugcaacaauagccgccccuguugcaggccaacaaaauguaauagacccauggaucagaaauaauuuuguacaagcaccagggggcgaauuuacaguuagcccaagaaacgcaccaggagaaauauuaugguccgcaccauuaggaccagaucucaaccccuauuuaagucacuuagcaagaauguauaacggcuaugcagguggauuugaaguccaaguaauccuagcaggaaaugcauuuaccgccggaaaaauaaucuucgcugccguuccaccaaacuuuccaacugaaggauuaucaccuucucaaguuacaauguucccacacauaguaguugacguaagacaacuagaaccaguacuaauaccccuaccagauguacgaaauaacuuuuaucauuauaaucaaucaaaagauccaacaauaaaauuaauagcaauguuauauacucccuuaagagcuaacaacgcaggagaagauguauucacaguaucauguagaguacucacucgaccaucaccagacuuugacuuuauauuucuaguaucaccuacaguagaaucaagaucuaaaccauucacuguaccaauacuaacuguagaagaaaugaccaacucuagauuuccaauaccauuagaaaaacuauucaccgguccaucuggagcauucguaguacaaccacaaaacggaagauguacaacagacggcguauuauuaggaacaacacaauuaucaccaguaaauauauguacauuuagaggagaccuuacacacuuuacaggaacaucugaauaugcuaugaaucuagcaucccaaaauuggaauaauuaugauccaacugaagaaauaccugccccauuaggagcgccugacuuuguuggaaaaauacgcggaaugcucacacaaacaacuagacgagacggaucaacaagaggucaucgagcaacacucucaacaggaucagcacauuuuacuccaaaauuaggcaauaucagauucucaacagauacaaauaaugacuuugaagcuggacaaaauacaaaauuuacaccaguaggugucuuucaagaaggugacaaucaucaaaacgaaccacaacaauggguucuaccaaauuacuccggagccacagcacauaauguacacuuagcaccagcaguagcaccugcauuuccaggcgaacaauuauuauuuuuuagaagcacuaugcccggauguggugguuacccaaacaugaauuuagacugucuucuaccccaagaauggguacaacacuuuuaucaagaagcggcaccagcacaauccgaugucgcacuacuaagauucguaaacccagauacaucacgaguuuuauuugaauguaaauuacacaaaucaggcuauguaacugucgcccacacuggacaacaugauuuaguaauuccaccuaacggauauuucagauucgauucauggguaaaccaauucuauaccuuagcacccaugggaaauggaacaggacgacgaagagcacuauaa

SEQ ID NO: 31696 - RNA, 1620 nt, Artificial Sequence
  derived and/or modified sequence opt6 from VP1__Norovirus__AHH44902
augaaaauggcuucaaaugaugcaucuccaagugacgguucagcagcaaauuuagucccugaaguaaauaaugaaguaauggcacuagaaccuguaguaggagcugccauugcagcaccaguagcuggacaacaaaauguaauagacccuuggauaagaaacaauuucguucaagcaccaggaggagaauuuacaguaucaccacgaaacgcaccuggggaaauccuauggucagcaccauuaggaccagacuuaaauccauauuuaucacaucuagcaagaauguauaauggauacgcagguggauuugaaguacaaguuauacuagccggaaaugccuuuaccgcuggcaaaauaauauuugcugcuguuccaccuaacuuuccaacagaaggacuaucaccaucacaaguaacuauguucccacauauaguaguugacguacgacaacuagaaccaguauuaaucccucuuccggauguucguaauaauuuuuaccauuauaaccaauccaaagauccaacaauuaaacuaauagcuauguuauacacaccacuuagagcaaauaacgcaggagaagauguauuuacuguuuccugucgaguauuaacacgaccuucuccagauuuugacuucauauuuuuaguaccuccaacuguagaaucucguucaaaaccuuucacaguaccaauuuuaacagucgaagaaaugaccaacucaagauuuccaauaccauuagaaaaauuauuuacaggaccaucaggagccuuugucguacaaccucaaaacggcagaugcacaacagacggaguccuccuaggcacuacacaauuaucaccaguuaacauauguacauuuagaggagaucuaacacauuucacuggaacaagugaauacgcaaugaaucuagcaucccaaaacuggaauaauuaugauccaacagaggagauaccagcaccauuaggagcaccagauuuuguaggaaaaauuagaggaaugcuaacacaaacuaccagaagagauggaaguacaagaggccauagagccaccuuaucaaccggcucugcacauuuuaccccaaaacuagguaauauuagauuuucaacagauaccaauaaugauuuugaagcgggacaaaauacuaaauucacaccaguaggcgucuuccaagaaggagauaaucaucaaaacgaaccucaacaauggguucuaccaaauuacucaggagcaacagcacauaacguccaccuagcaccagcaguagccccagcauuccccggugaacaacuauuauucuuuagaucaaccaugccaggcuguggcgguuauccuaauaugaaccuagauugucuauuaccacaagaauggguacaacauuuuuaucaagaagcagcacccgcacaaucggauguagcauuauuacgauuuguuaacccugauaccagucgaguauuauucgaauguaaacuccauaaaucuggauauguaacugucgcgcauacaggacaacaugacuuaguuauaccaccaaauggauauuuucguuucgauucauggguaaaucaauuuuauacccuggccccaaugggaaauggaacagguagaagaagagccuuauaa

SEQ ID NO: 31697 - RNA, 1620 nt, Artificial Sequence
  derived and/or modified sequence opt6 from VP1__Norovirus__AHH44904
augaaaauggcuucaaaugaugcuucaccuucagauggaucagccgccaauuuaguaccagaaguaaauaacgaaguaauggcucuagaaccaguuguuggagcagccauagcagcuccaguugccggucaacaaaaugucauagauccauggauacgaaauaauuuuguacaagcuccuggaggagaauuuacaguuaguccaagaaacgcucccggagaaauacuuugguccgcuccauuaggcccagaucucaacccauacuuaucacaucuugcaagaauguauaaugguuacgcugguggauuugaaguacaaguaauuuuagcuggaaaugcauuuacagcugguaaaauaauauuugcagcugucccuccaaacuuuccaacagaaggauuaucaccaucacaagugacaauguucccacacauaguaguagauguacgacaacuagaaccaguacuaauaccccuaccagauguucgcaauaacuuuuaccauuauaaucaaucuaaagacccaacaauuaaauuaaucgcaaugcuuuauacaccucuaagagcaaacaacgcaggagaagauguuuuuacugucucauguagaguacuaacuagaccaucacccgauuucgacuucauauuuuuaguuucaccaacaguugaaucaagaaguaaaccauuuaccguaccuauacuuaccguagaagaaaugacuaauuccagauucccaauaccauuagaaaaauuauuuacaggcccaucuggagcauuuguaguacaaccucaaaacggaagauguacaacagacggaguucuauuaggaacuacacaauuauccccugucaacauauguacauucagaggagaccucacucacuuuacagguacaucagaauaugcuaugaaucucgcaucucaaaauuggaauaacuacgauccaacagaagaaauaccagcuccauuaggagcaccagauuuuguaggaaaaaucagaggaauguuaacacaaacaacccguagagaugguaguacacgaggccauagagcuacauuauccacugguucagcacauuucaccccaaaacuaggaaauauaagauucucaacugauacaaauaaugacuuugaagccggccaaaauacuaaauucacgccaguaggaguauuccaagaaggugauaaccaucaaaacgaaccacaacaauggguacuaccaaauuauuccggagcaacugcacacaacguucauuuagcaccagcaguagcaccagcauucccaggagaacaauuauuauucuuucgaucuacaaugcccgguuguggcggcuauccaaauaugaaucuagauugucuacuaccacaagaauggguacaacacuuuuaucaagaagcagcuccugcacaauccgaugucgcucuuuuacgcuuuguuaacccugacaccucucgaguacuauucgaaugcaaacuccauaaaucagguuauguaacaguagcacauacuggucaacacgauuuagucauaccacccaauggcuacuucagauuugauuccuggguuaaucaauuuuauaccuuagcuccuaugggaaauggaacugguaggagaagagcacuauaa

SEQ ID NO: 31698 - RNA, 1620 nt, Artificial Sequence
  derived and/or modified sequence opt6 from VP1__Norovirus__AHH44905
augaaaauggcaucaaacgacgcuucuccauccgauggauccgcagcaaacuuaguacccgaaguuaacaaugaaguuauggcuuuagaaccaguaguaggcgcugcaauagcagcaccaguagcaggacaacaaaauguaauugauccuuggauuagaaauaacuucguacaagccccuggaggugaauuuacuguaucaccccgaaaugcuccaggcgaaauuuuauggagugcaccauuagggccagaccuaaauccauaucuaucacaccuagcaagaauguacaacgguuacgcuggaggauuugaaguacaaguaauacuagcaggaaacgcauuuacagcaggaaaaauaauuuuugccgcagucccaccaaacuuccccaccgaaggccucucucccucccaaguuacaauguucccccauauaguaguugacguuagacaacuagaaccaguacuaauaccauuaccagacguaagaaauaacuuuuaucacuauaaucaaucuaaagacccaacaaucaaauuaauagcuauguuauauacuccauuaagagcaaauaacgccggugaagauguauucacuguuucauguagaguuuuaacccguccauccccagacuuugauuuuauauuuuuaguuccaccaacaguugaaucacgaucaaaacccuucacagucccaauauuaacagucgaagaaaugaccaacucuagauucccuauaccauuagaaaaacuauucacaggucccucuggagcauucguaguacaaccacaaaacggucgauguacuacagacggaguauuauuaggcacaacacaauuaucaccaguuaauauaugcacauuuagaggagaccuaacacauuucaccggaacaucagaauaugcuaugaaucuagcaagucaaaacuggaacaauuacgaccccacagaagaaauaccagcaccacuaggagcaccagacuuuguaggaaaaaucagaggcaugcuaacucaaaccacaagacgcgacggcucaaccagaggacaucgagcaacccuauccacaggaucagcacauuuuacuccuaaacuuggaaauauuagauucucaaccgacacaaauaaugauuuugaagcuggacaaaauacaaaauuuacaccaguuggaguauuucaagaaggagacaaucaccaaaaugaaccccaacaauggguauuaccuaauuacuccggagccacugcucacaacguucaucuagccccagcaguagcaccagcauuuccaggagaacaacuauuauuuuuucgaucaacaaugccaggaugcggaggauacccaaauaugaaucucgacugucuauuaccccaagaauggguacaacacuuuuaucaagaagcagcaccugcacaaucugacguagcacuacuacgauuuguaaacccugacacauccagaguccuauuugaauguaaauuacauaaaucaggcuauguaacgguagcucacacaggacaacacgaucucguaauaccaccaaacggcuauuuuagauuugacuccuggguaaaccaauuuuauacauuagcaccaauggguaacggaacuggaagacgaagagccuuauaa

SEQ ID NO: 31699 - RNA, 1620 nt, Artificial Sequence
  derived and/or modified sequence opt6 from VP1__Norovirus__AHH44906
augaaaauggcaucuaacgaugcaucaccaucagauggaagcgcagcaaaccucguaccugaaguaaacaaugaaguuauggccuuagaaccaguaguuggagcagcaauagcugcaccagucgcaggccaacaaaauguuauugauccauggauuagaaauaacuuuguacaagcaccaggaggagaauuuaccguuaguccacguaaugcaccuggcgaaauacuuuggagugcacccuuaggacccgauuuaaacccauacuuaucacacuuagcacgaauguacaacggcuaugcaggaggauuugaaguacaaguaauacuagcaggaaaugcauuuaccgcaggaaagauaauauucgcugccguaccuccaaacuuuccaacagaagguuuaucuccaucacaagucacaauguucccacauauaguaguagacguaaggcaauuagaacccguuuuaauaccauuaccagacguaagaaauaauuuuuaucauuacaaccaaucuaaagaucccacaauuaaacuaauagcuauguuauacaccccauuacgugcaaauaacgcuggugaagauguauuuacaguaucauguagaguuuuaacaagaccaucuccugauuucgacuucauauuuuuaguaccuccuaccguagaaucaagaaguaaaccauucacaguaccuauauuaacaguagaagaaaugacauauucaagauuucccauaccacuagaaaaauuauucacaggaccaucaucagcauuuguuguccaaccucaaaacggaagauguacaacugacggcguacucuuaggcacaacacaauuaucaccuguuaauauauguacauuuagaggagauuuaacucauuuugcaggaacaucagaauaugcaaugaaccuugccagccaaaacuggacaaauuacgauccaacagaagaaauaccagccccauuaggagcaccagacuuuguagguaaaauaagaggaguacuaacucaaacaacacgaggcgacggaucaacacgcggacauagagcaacacucucgacagguucagcacauuuuacuccaaaauuaggcagugucagauucucuacagauacaaacaacgauuuugaagcaggacaaaacacaaaauucacuccaguagguguauuccaagacggagauaaucaccaaaacgaaccucagcaauggguacuaccuaauuacucuggagcaacagcucauaauguccauuuagccccugcaguagcacccgcuuuucccggagaacaacuacuauucuucagaucaacaaugccaggaugcucaggcuacccuaauaugaauuuagauugcuuauuaccacaagaauggguccaacacuuuuaucaagaagcagcuccagcacaaucagauguagcuuuauuaagauucguaaauccagauacaucccgcguuuuauucgaaugcaaacuucauaaaucaggauacguaacugucgcucacacaggacaacaugauuuaguaauaccccccaauggauacuuuagauuugauucauggguaaaucaauuuuauacacucgcaccaaugggcaauggaacuggaagaagacgagcacuauaa

SEQ ID NO: 31700 - RNA, 1620 nt, Artificial Sequence
  derived and/or modified sequence opt6 from VP1__Norovirus__AHH44907
augaaaauggcaucaaaugaugcuucaccaucugauggcucggcugcaaaccucguacccgaaguaaauaacgaaguaauggcauuagaaccaguaguaggugcagcaauagcugcuccaguagcuggccaacagaauguaauagaucccuggauacgcaauaaauuuguacaagcuccagguggagaauuuacaguaucaccucgaaaugcaccaggagaaauauuauggucagcaccauuaggaccagaucuaaauccauaccuuucccaucuagcaagaauguauaaugguuaugcaggaggauucgaaguacaaguaauacuagcaggaaacgcauuuaccgcugguaaaauaauauucgcagcaguaccaccaaauuuuccaacagaaggucuaucuccuucacaaguaacaauguuuccccauauagucguagaugucagacaacucgaaccaguauuaauaccacuaccagacgucagaaacaauuuuuaucauuauaaucaaucaaaagauccaacaauuaaacuaaucgcuauguuauauacaccacuaagagcaaauaaugcaggagaagauguauuuacaguaucaugucgaguucuaacucgaccuucaccagacuucgacuuuauauuuuuaguaccaccuacaguagaaucuagaucuaaaccuuucacaguaccaauauuaacuguugaagaaaugacuaauucacgauuuccaauaccacuugaaaaacuauucacuggaccauccggagcauuuguuguacaaccacaaaauggaagauguacaacagacggcguucuacuaggaacuacccaacuuucaccaguaaauauauguacuuuuagaggugacuuaacacacuucgcagguacacaugaauaugcuaugaaccuugcaucacaaaauuggaauaacuaugacccaacugaagaaauaccugcaccauuaggugcaccagauuuuguaggaaaaauucgcggaguacuaacacaaaccacucgccgugauggaucaacuagaggucaccgcgccacccuaucaacugguucagcucacuuuacaccaaaacuuggaucaauuagauucagcacagacacaaacaacgacuuugaagcaggacaaaacacaaaauuuacuccaguaggaguauuucaagauggagauaaucaccaaaaugagccucaacaauggguauuaccaaacuauaguggugcaacagcacacaauguacacuuagccccagcuguggcuccagcauuuccaggcgaacaacuacuauucuuuagaucuacaaugccaggaugcucaggauauccaaauaugaaucuugauugucuucuaccucaagaauggguacaacauuuuuaucaggaagcagcaccagcacaaucagauguagcccuuuuaagauuuguaaacccagauacaucccgaguauuauucgaauguaaauuacacaaaucaggauauguaacaguagcacauacaggucaacaugaccuaguaauuccaccaaauggauacuuucgauuugauaguuggguaaaccaauuuuauacauuagcacccaugggaaacggaacaggacgcagaugugcacucuaa

SEQ ID NO: 31701 - RNA, 1620 nt, Artificial Sequence
  derived and/or modified sequence opt6 from VP1__Norovirus__AHH44908
augaaaauggcaucuaaugaugcuucuccauccgauggaucagcagcaaauuuagucccagaaguaaauaacgaaguaauggcucuagaaccagucguaggcgcagcuauagcagcuccuguagcuggucaacaaaauguaauagauccauggauacgaaauaauuucguacaagcaccagguggcgaauuuacaguuucacccagaaaugcacccggagaaauacuauggucagcaccauuagguccagaucucaauccauaucucucucaucuagcucguauguauaauggauacgcaggaggauuugaaguacaaguaauccuugcuggaaaugcauuuacagcuggaaaaauaauuuuugcugcaguaccuccaaacuucccuacagaagguuuaucuccaucacaagucacaauguuuccacauauaguaguugaugucagacaauuagaaccuguccuaaucccacuaccagacguaagaaacaauuuuuaucauuacaaucaaucuaaagacccaacaauaaaacuaauagcaauguuauauacaccauuaagagcaaauaaugcuggagaagauguuuucacaguuucauguagaguauuaacaagacccucaccagacuuugauuucaucuuuuuaguaccuccaacaguagaaucccgcagcaaaccauucacagucccaauacuaacuguagaagaaaugacuaacucacgcuuuccaauuccuuuagaaaaacuauuuacuggucccaguucagcauuuguaguccaaccgcaaaacggaagauguacaacagacggaguauuauuaggaacuacucaauuaagcccugucaauaucuguacauuucgcggagauuuaacacauuuugcagguaccucagaauaugccaugaaccuugcuucgcaaaauuggacaaacuaugauccaacugaagaaauaccagccccauuaggagcccccgauuuuguaggcaaaauacgaggaguauuaacacaaacaacucgaggagaugguucaacacgaggucauagagcaacauuaucaacagguucagcacauuuuacuccaaaauuagguucuguuagauuuucaacagauacaaacaacgauuuugaagcuggacaaaauacaaaauucacaccaguaggaguauuccaagacggagauaaccaucaaaacgaaccacaacaauggguacuacccaauuauucaggagcaacagcucauaacguacaucuagcaccagcuguagcuccagccuuucccggagaacaauuauuauuuuuuagaucaacaaugccuggauguagcggauaucccaauaugaauuuagacuguuuacuaccacaagaauggguucaacacuucuaccaagaagcagcaccagcacaaucugacguagcauuacuaagauucguaaacccugacacaucuagaguacuauucgaauguaaacuacauaaaagcgguuacguaacugucgcacacacaggccaacaugaucuuguaaucccuccaaacggauacuuuagauuugauagcugggucaaucaauuuuacacacuagccccuaugggaaacggcacaggaagaagacgcgcauuauaa

SEQ ID NO: 31702 - RNA, 1620 nt, Artificial Sequence
  derived and/or modified sequence opt6 from VP1__Norovirus__AHH44909
augaaaauggccucaaaugaugcaucaccaagcgauggauccgcagcaaaucuuguuccagaaguaaacaacgaaguuauggcacuagaaccuguaguuggagcugcaauagcagcucccguagccggccaacaaaauguaauagacccauggauacgcaauaauuuuguucaagcaccaggaggagaauuuacaguaucaccacgaaacgcacccggagaaauuuuauggucagcuccacuaggucccgaucuaaauccauauuuaagccaccuagcacgaauguauaacggauaugcuggaggauuugaaguacaaguaauauuagcagguaaugcauuuacagcagguaaaauaauuuuugcugcaguaccaccaaauuucccaacugaaggccuaucaccaucucaaguaacuauguuuccacauauuguuguagauguaagacaacuugaaccagucuuaauaccacuaccagauguccguaacaauuuuuaccauuacaaucaaucaaaagauccaacuauaaaacuaauugcaauguuauacacuccuuuaagagcuaauaaugcaugggaagauguuuuuacagucaguuguagaguauuaacaagaccaucacccgauuuugacuuuauuuuucuuguucccccuacaguagaaucaagaucuaaaccauuuacaguacccauacuaacuguagaagaaaugacuaacagccgauuuccaauaccauuagaaaaauuauuuacagggccuucuggagcauucgucguacaaccacaaaauggaagaugcacaaccgauggaguauuauuaggcacaacccaacuaagcccaguaaauauuuguaccuuuagaggugaucucacccacuucgcaggcacacacgaauaugcuaugaauuuagcaucacaaaacuggaauaauuaugauccuacugaagaaauuccagcuccauuaggagcaccagauuucguuggcaaaauaagaggaguacuaacacaaacuacacgaagagacggaucaacucguggccaccgagcuacacuaucaacaggcucagcacacuucacaccaaaauuaggaucaauaagauuuucuacugauacuaauaaugacuucgaagcaggacaaaauacaaaauuuacaccugucgguguauuucaagauggagauaaucaucagaacgaaccacaacaauggguauugccaaacuauucaggagcaaccgcucauaauguacaucuugccccugcagucgcaccagccuucccaggcgaacaacuacuauucuuuagaucaacaaugccaggauguuccggcuaccccaauaugaaucuagauugucuacuuccacaagaauggguacaacauuuuuaccaagaagcagcaccagcacaauccgauguagccuuacuacgauuuguaaauccagauacuucuaggguacucuuugaauguaaauuacauaaaucuggcuacguaacaguugcacauacaggacaacaugauuuaguuaucccaccaaacgguuacuucagauucgauucauggguaaaucaauucuacacacuagccccaaugggaaauggaacaggcagaagaagagcacuuuaa

SEQ ID NO: 31703 - RNA, 1620 nt, Artificial Sequence
  derived and/or modified sequence opt6 from VP1__Norovirus__AHH44911
augaaaauggcaucaaaugaugcaucucccagugacggaucagcagcaaacuuaguacccgaaguaaauaaugaaguaauggcucucgaacccgucgucggagcagcaauagcagcaccaguagcaggacaacaaaauguaaucgaccccuggauuagaaauaauuuuguucaagcaccuggaggcgaauuuacaguaucaccucgaaacgcaccaggagaaaucuuauggucagcaccauuaggacccgauuuaaauccauauuuaucacauuuagcacgaauguauaauggauacgcaggaggauuugaaguacaaguuauucuagcaggaaaugcauucacugcagguaaaauaauauuugcagcagucccuccuaacuuuccaacagaaggcuuaucaccaucacaaguaacaauguucccacauaucguaguagauguacgacaauuagaaccaguccuaauuccuuuaccugauguuagaaauaauuuuuaucacuacaaccaaucaaaagaccccaccauaaaacuaauagcuauguuauauacuccacuaagagcaaacaaugcuggagaagauguuuuuacaguaagcuguagaguacuaaccagaccuucuccugacuuugauuuuauuuuucuaguaccaccaacaguugaaucacguuccaaaccauuuacaguaccaauccuuacuguugaagaaaugaccaauucuagauuuccuauuccacuugaaaaauuauuuaccgguccaucaggagcauuuguuguacaaccacaaaauggcagauguaccacugaugguguacuacuaggaacaacucagcuauccccaguaaacauauguacauuuagaggagaucuaacacacuuugcaggaacacaugaguaugccaugaauuuagcaucucaaaauuggaauaacuacgauccaacagaagaaauucccgcuccauuaggagcaccugauuuuguaggaaaaaucagaggaguacuuacccaaacuacuagacgagacggaucaacaagaggacauagagcaacacucagcacaggaucagcacauuuuacaccuaaacuaggaucaauacgauuuucuacagacacaaacaacgauuuugaagcaggacaaaacacuaaauuuacaccagucggcguauuucaagauggugauaaccaccaaaaugaaccucaacaauggguucuaccuaauuauucaggugcuacagcacauaauguacacuuagcucccgcaguugcaccagccuuuccuggggaacaacuauuauuuuuuagaucaacuaugccuggauguucaggauauccuaauaugaaucuagauugucuauuaccacaagaauggguccaacauuucuaucaagaagcagcaccagcacaaucagacguggcuuuacucagauuuguaaauccagacacaucaagaguauuauuugaaugcaaauuacauaaaucaggauauguuacaguagcgcauaccggacaacacgaccuaguaauaccuccaaauggauauuucagauuugauuccuggguaaaucaauuuuauacacuagcaccaaugggaaaugggacaggccgaagaagagcuuuauaa

SEQ ID NO: 31704 - RNA, 1620 nt, Artificial Sequence
  derived and/or modified sequence opt6 from VP1__Norovirus__AHH44912
augaaaauggcaucaaaugaugcaucuccuucagauggaucagcagccaaucuaguaccagaaguuaauaaugaaguaauggcucuagaaccaguaguaggcgcagccaucgcagccccaguugcaggacaacaaaacguaaucgauccuuggaucagaaacaacuuuguacaagcacccggaggcgaauuuacaguaagccccagaaaugcaccaggagaaauacuuuggucagcuccacuaggaccagauuuaaauccauauuuaucacaccuagcccgaauguacaacggauaugcaggcggauuugaaguacaaguaauacuagcaggcaaugcauuuacagcaggaaaaauaauuuuugcugcuguaccaccaaacuuuccuacagaaggauuaucacccucccaaguaacaauguuuccacacauagucguugacguccgacaauuagaaccaguacuaauaccauuaccagauguacguaauaauuucuaucauuauaaucaaagcaaagacccaacaauaaaacuaauugcuaugcuauauacaccauugagggccaauaaugcaggagaagauguuuuuaccguuucaugucgaguacuaacaagaccuucaccagacuucgacuuuauuuuuuuaguaccaccaaccguagaaagucgaucaaaaccauuuacuguaccaauuuuaacaguagaagaaaugacaaacucaagauuuccaauaccacuagaaaaacuauuuacaggaccaucgggagccuuuguuguacaaccucaaaauggccgcuguacaaccgauggaguacuucuaggaacuacacaauuaucaccaguaaacauauguacauuuagaggagauuuaacacauuucgcaggaacacaugaauacgcuaugaaucuagcuucacaaaacuggucaaacuacgacccaacagaagaaauuccugcaccacuaggagcaccagacuuugucgguaaaaucagaggaguacuaacacagacaacuagaggagacggauccacaagaggacacagagcaacauuaucuacaggaucugcccacuuuaccccaaaacuuggaucaauacgcuucucuacagauacaaauaacgauuucgaagccggucaaaacacaaaauuuaccccaguagguguauuucaagacggagacaaucaccaaaacgaaccccaacaauggguacuuccaaauuacucaggcgcaacagcacauaauguacaucuagcaccagccguagcucccgccuuuccuggcgaacaauuacuauuuuuucgaucaacaaugccagguuguucaggauauccagauaugaaccuugacuguuuauuaccacaagaauggguacaacauuuuuaccaagaagcagcuccagcacaaagugacgucgcacuuuuaagauucguaaacccagauacaaguagaguacuuuuugaauguaaguuacauaagucaggauacguaacaguugcacacaccggacaacaugacuuaguuauaccaccaaauggcuacuuucgauuugacuccuggguaaaucaauucuauacccucgcacccaugggaaacggaacagguagacgaagagcacuauaa

SEQ ID NO: 31705 - RNA, 1620 nt, Artificial Sequence
  derived and/or modified sequence opt6 from VP1__Norovirus__AHH44913
augaaaauggcuucuaacgaugcaucuccuucagauggauccgcagcaaacuuaguuccagaaguaaacaacgaaguaauggcauuagaaccaguaguaggugcagcaauagcagcaccuguugcaggccaacaaaauguaauagacccuuggauaagaaauaacuucguacaagcuccaggcggagaauuuaccguuucacccagaaaugcaccaggcgaaauauuaugguccgcaccccucggaccagaucucaaucccuaccuaucacaccuagcacgaauguauaacggauacgcaggaggauuugaaguacaaguaauacuggcugguaaugcauucacagcagguaaaauaauauuugcagcagucccaccaaauuuuccuacugaaggauuaucaccaucccaaguaacaauguucccucacauaguaguagacguuagacaacuagaaccaguauuaaucccacucccagacguaagaaacaacuuuuaucauuauaaccaaucaaaagauccuacgauaaaauuaauagcuaugcuuuauaccccauuaagagcaaauaaugcaggagaagacguauuuacuguuucaugccgagucuuaacucgaccaaguccagacuucgacuuuaucuuucuaguacccccaaccguugaaucuagaucaaaaccguuuaccguaccaauacuaacaguagaagaaaugacaaauaguagauuuccaaucccguuagaaaaacuauucacaggaccauccucugcauucguaguucaaccacaaaauggaagauguacaacagacggaguacuacuaggaacaacccaauuaaguccugucaacauuugcacauuuagaggagaccuuacacauuucgcuggcacuuccgaauacgcaaugaaucuugcaagccaaaauuggacaaauuacgauccaacagaagaaauaccagccccacuaggagcacccgacuuuguaggaaaaauaagaggaguauuaacacaaacaacaagacgugacggaaguacacgaggucauagagcaaccuuaucaacaggaucagcucacuuuacacccaaauuaggaucaauuagauucucaacagacacaaacaacgauuuugaagcaggacaaaauacaaaauuuacacccguaggcguauuucaagacggagacaaucaucaaaaugaaccacaacaauggguacuacccaauuacagcggagcaaccgcacauaacguacaccuagcaccugccguagcaccagcauuccccggugaacaauuacuauucuuuagauccacaaugccugguuguucaggauaccccaacaugaacuuagacuguuuauuaacacaagaauggguacaacacuucuaucaagaagcagcuccagcacaauccgacguagcacuacucagguucguaaauccagauacaucaagaguccuauucgaauguaaacuccauaaaucaggauauguaacaguagcacauacagggcaacaugauuuaguaauaccaccaaauggauauuucagauuugauucaugggucaaccaauucuacacucucgcaccaaugggaaauggaacaggacgaagaagagcucuauaa

SEQ ID NO: 31706 - RNA, 1620 nt, Artificial Sequence
  derived and/or modified sequence opt6 from VP1__Norovirus__AHH44914
augaaaauggcaucaaaugacgcaucuccaucagacgguucagcagcaaaccuaguaccagagguaaauaaugaaguaauggcauuagaaccuguaguuggagcagcaauugccgcaccaguggccggacaacaaaauguaauagauccuuggauaagaaauaauuucguacaagcuccagguggagaauucacaguaucaccaagaaacgcaccaggagaaauauuauggagugcaccauuaggcccagaccuaaauccauaucuaagccaccuagccagaauguacaauggauaugcuggaggauucgaaguacaaguaauacucgcuggaaaugcauucaccgcuggaaaaauaauuuuugcagcaguucccccaaauuucccuacagaggguuuaucuccaucacaaguuacaauguuuccucauauaguuguagacguaagacaacuagaaccaguauuaauaccauuaccagauguacguaauaauuuuuaucacuacaaccaaucuaaagauccuacaauuaaauuaauugccaugcuauauacuccacuacgagccaacaaugccggagaagacguauuuacaguuaguuguagaguacuuacuagaccauccccugauuucgauuuuauauuuuuaguaccuccaaccguagaaucaagaucaaaaccuuuuacuguaccaauauuaacuguagaagagaugacaaacucacguuuccccauaccacuagaaaaauuauuuacagguccaucaucagcauucguuguacaaccacaaaacggacgauguacuacagauggaguauuacuugguacuacacaacuaucuccaguuaacauuugcacauuccggggagauuuaacacacuuugcuggaacucaugaauaugccaugaaccuagcaucucaaaauuggacuaacuaugacccuacagaagaaauuccagcuccauuaggugcaccagauuuuguaggaaaaauaagaggaguauuaacacaaacaacaagaggagacgguuccacaagaggacauagagcaacacuaucaacaggcucugcacauuucacucccaaauuaggaucaguuagauucucaacugauacuaauaaugauuuugaagcuggacaaaauacaaaauuuaccccagucggugucuuucaagauggugacaaucaucaaaacgaaccacaacaauggguuuuaccaaauuauucuggagcaacagcacauaauguucaucuagcuccagccguugccccagccuuuccaggugaacaacucuuauucuucagaucaacaaugccuggaugcaguggcuauccaaacaugaauuuagauugccuauuaccgcaagaauggguacaacauuucuaucaagaagcagcaccagcacaaucagauguugcucuuuuaagauuugucaauccugauacaucaagaguacuauuugaauguaaacuacacaaaucaggauauguaaccguagcacauacaggucaacacgaucuuguuaucccuccuaacggcuacuucagauuugauuccuggguaaaccaauuuuauacuuuagcaccuauggguaauggaacuggacgaagaagagcacuuuga

SEQ ID NO: 31707 - RNA, 1620 nt, Artificial Sequence
  derived and/or modified sequence opt6 from VP1__Norovirus__AHH44915
augaaaauggcaucaaacgacgcuucaccaucagaugguucagcagcaaacuuaguuccagaaguaaacaaugaaguaauggcauuagaaccaguaguaggagcagcaauagcagcaccagucgcaggacaacaaaauguaauagauccauggauaagaaauaacuuuguucaagcaccaggaggagaauuuacaguauccccgagaaaugccccaggagaaauccuuuggagugcuccauuaggaccagauuuaaaucccuaccucucacaucucgcaagaauguauaacggauaugccggugguuuugaaguucaaguaauucuugcaggcaaugcauuuacugcaggcaaaauaauuuuugcagcuguucccccuaauuuuccaacagaaggauuaucaccuucacaaguuacaauguucccccauauuguuguagacguacgucaacuugaaccuguauuaaucccauuaccugaugucagaaauaauuucuaccauuauaaccaaaguaaagacccaacaauuaaauuaauagcuauguuauauacuccacucagagcaaauaaugcaggcgaagauguuuuuacaguaucaugcagagucuuaacuagaccuucaccagauuucgacuuuaucuuccuaguaccaccaacaguagaaucaagaucuaaaccauuuacuguaccaauauuaacaguagaagaaaugacuaacucucgauuuccaauaccauuagaaaaauuauucacaggaccuucaagugcuuucguaguacaaccacaaaauggucgaugcacaacagaugguguguuauuaggcacaacacaacuaucaccagucaacauauguacuuuuagaggugauuuaacucauuuugccggcacaucugaauacgcaaugaaucucgcaucacaaaauuggacaaauuaugaucccacugaagaaauaccugcaccucuaggagcuccagauuucguaggaaaaauacguggaguuuuaacucaaacuacaagacgagauggcucaacacguggacacagagccaccuuaucaacaggaucugcacauuuuacaccaaaacuugguucuauaagauuuucaacagacaccaauaacgauuuugaagcuggacaaaauacaaaauuuacacccgucggaguuuuucaagauggagauaaccaucaaaaugaaccucaacaauggguacuaccaaauuauucuggugcuacagcacauaacguucauuuagcaccagcaguugcuccagcauucccuggagaacaacuauuguucuuuagaucuacaaugccaggaugcucaggauauccaaauaugaaccucgauuguuuauuaccucaagaauggguacaacauuucuaccaagaagcagcaccugcacaaucagauguagcccuucuaagauuuguaaaucccgauacauccagaguucuauuugaauguaaauuacacaaaucaggauauguaacaguugcacauacaggacaacaugaucuaguaauucccccaaacggcuauuuuagauuugacuccugggucaaccaauuuuacacuuuagcaccaauggguaaugguacaggaagaagaagagcauuauaa

SEQ ID NO: 31708 - RNA, 1623 nt, Artificial Sequence
  derived and/or modified sequence opt6 from VP1__Norovirus__AID60853
augaaaauggcuucauccgacgccaaucccucagauggauccgcugcaaauuuaguaccagaaguaaacaaugaaguuauggcauuagaaccaguuguaggugcugcaauugcagcaccaguagcaggacaacaaaauguaauagauccauggauccgaaauaauuucguucaagccccaggaggagaauuuacaguaucuccacgaaaugccccaggcgaaaucuuauggucugccccacucggaccagauuuaaauccuuaucuuucacacuuagcaagaauguacaaugguuaugcagguggcuuugaaguccaaguuauacuagcaggaaacgcauuuaccgcaggaaaaguuauauuugcugcagucccaccaaauuuuccaacagaaggauuaucuccaagucaaguuacaauguuuccucacauagucgucgauguaagacaauuagaaccuguacuaauaccacuaccugacguucgaaauaauuuuuaucauuauaaccaaucuaacgauccaacuauuaaauuaauugcaauguuauacaccccucuaagagcaaauaaugcgggugacgauguauucacaguaucuuguagaguauuaacaagaccuucuccagauuuugacuucauauuucuaguaccuccuacaguugaaucacgcaccaaaccauuuuccguuccuguacuaacuguagaagaaaugacaaauucaagguuuccaauaccacuugaaaaacucuuuaccgguccaucauccgcauuuguaguacaaccccaaaacggacgaugcacaacagauggcguacuauuaggaacaacacaauuaucaccaguuaacauaugcacauuuagaggagauguuacacauaucacugguuccagaaauuauacaaugaacuuagcaucacaaaauuggucuaauuaugaucccaccgaagaaauaccagcaccauuaggaacuccagauuuuguuggaaaaauacaagguguauuaacacaaacaacucgaaccgauggaaguacacgaggacauaaagcaacaguauacacagguucagcagauuuugcaccaaaauuaggacgaguucaguuugaaacagacacagaucgagauuuugaagcaaaucaaaauacaaaauuuacaccagucgguguaauacaagauggaucaacaacacacagaaacgaaccccaacaauggguacucccaucauacucagguagaaauacuccaaauguacauuuagcacccgcaguagcuccuacuuuuccaggagaacaacuacuauuuuuuagaucaacuaugccaggauguucagguuauccuaauauggaucuagauugucuacuuccccaggaauggguacaauauuuuuaucaagaagcagcaccugcacaaucugacguagcacuucuuagauuuguuaauccugauacuggcagaguucuuuuugaaugcaaacuacauaaaucuggauaugucacaguagcacauacaggacaacaugaucuuguaauaccuccaaauggauauuuuagauucgauucauggguaaaucaauuuuauacacuagcaccaaugggaaaugguacaggacguagaagagcauuauaa

SEQ ID NO: 31709 - RNA, 1623 nt, Artificial Sequence
  derived and/or modified sequence opt6 from VP1__Norovirus__AID60855
augaaaauggcuuccucagaugcaaacccaucugacgguucagcagcaaaccuaguuccagaaguaaauaacgaaguuauggcacucgaaccaguaguaggagcagcaauagcagcaccaguugcuggacaacaaaauguaauagauccauggauaagaaauaacuuuguacaagcuccagguggcgaauucacaguuucaccuagaaaugcaccaggagaaauucuuuggucugcuccccucggaccagacuuaaauccauaucucagccaccuagcacgaauguauaacggcuaugcaggaggauuugaaguacaaguaauacuugcugguaaugcauucacagcagguaaaguuauuuuugcagcaguaccaccaaauuuuccaacagaaggauuaucaccaucccaaguuaccauguucccucauauaguagucgacguacgacaacuugaacccguacuaauuccauuaccagaugucagaaauaauuuuuaccauuauaaccaaucaaaugacccaacaauaaaacuaauagcaauguuauacacaccauuaagagcuaacaacgcaggcgaugauguuuuuacaguaucauguagaguauuaacacgaccgucuccagauuucgauuuuauauuccuagucccaccaacaguagaaucaagaacaaaaccauuuucaguaccuguucuaaccguugaagaaaugacaaauucccguuuuccaauaccuuuagaaaaacuauucacugguccaucuucugcuuucguaguucaaccucaaaacggacguuguacaacugauggaguauuacuagguacaacucaguuaucccccguuaauauauguaccuuccguggagauguaacacacauaacaggaucaagaaauuauacaaugaaucuagcuucccaaaauuggucuaacuacgaucccacugaagagauaccagcaccacuaggaacacccgauuuuguagguaaaauacaaggaguacucacucaaacaacacguaccgacgguucaaccagaggacacaaagcuacaguuuacacagguucagcagauuuugcacccaaauuaggaaggguacaauucgaaacagacacagaucaugacuuugaagcaaaucaaaauacaaaauuuacuccuguaggagucauacaagacggaucaacaacacauagaaaugaaccccaacaauggguuuuaccaucauacaguggacguaauacuccaaacguacaccucgcaccagcaguagcaccaacuuuuccaggugaacaacuccuguucuucagaucaacaaugccaggcuguucuggcuacccaaauauggaucuagacugcuuauuaccacaagaauggguacaguauuucuaccaagaagcagcaccagcacaaucagacguugcacuuuuaagauuuguuaacccugauacaggacguguacuauuugaaugcaaacuacauaaaucagguuauguuacuguagcucauacaggacaacaugaucuuguaauacccccaaaugguuauuucagauuugauucauggguaaaccaauuuuauacccuagcaccaaugggcaauggaacagguagaagacgagcacuauaa

SEQ ID NO: 31710 - RNA, 1623 nt, Artificial Sequence
  derived and/or modified sequence opt6 from VP1__Norovirus__AID60857
augaaaauggcaucaucagaugcaaaccccuccgauggaucagccgcaaaucuaguaccagaaguaaacaacgaaguuauggcccuagaaccaguuguaggagccgcuauagcagcaccaguagcaggacaacaaaacguuaucgauccuuggauacgaaauaacuuuguacaggccccaggaggagaauuuacaguaucuccacgaaacgcaccaggagaaauacuauggucugcacccuuaggaccagaccuaaauccauaccuaucacaucuagcaaggauguauaauggauaugcagguggauucgaaguacaaguuauuuuagcaggaaacgcauucacagcugguaaaguuauauuugcagcaguaccuccaaauuuuccaacagaaggacuaucuccaucacaaguaaccauguucccccacauaguaguugauguucgacaauuagaaccaguauuaaucccuuuaccagauguaagaaauaauuuuuaucacuauaaccaaucuaacgauccaacgauuaaacuaauagcaaugcuauauacaccucuacgagcaaauaacgccggagaugauguauucacuguaucauguagaguucuuacuagacccucaccagauuucgacuuuauauuucuaguacccccgacaguugaaucaagaacaaaaccauuuucuguaccaguauuaacaguagaagaaaugacaaauagcagauucccaauacccuuagaaaaauuauuuacaggaccaucaucagccuuuguuguacaaccucaaaacggaagauguaccacagacggaguacuacuaggaacaacacaacuuagcccagucaauauaugcaccuucagaggagauguaacacauauaacugguaguagaaacuauacaaugaaucuagcuucgcaaaacuggaguaauuaugaucccacagaagaaaucccagcuccucuuggcacaccugauuuuguuggcaaaauacaaggaguauuaacccaaacaaccagaacugacggcagcacacgaggucacaaagcaacaguauauacaggauccgcugacuuugcaccaaaauuaggcaggguucaauuugaaacagauacugaucacgauuucgaagcaaaucaaaacacuaaauuuacccccguaggaguaauacaagauggaucaacaacacaucgaaaugaaccacaacaauggguuuuaccaucauauucaggaagaaauacaccaaacguacacuuagcaccggcaguagcaccaaccuuucccggcgaacaacuauuauuuuuuagaucaacaaugccagguuguucagguuaccccaauauggauuuagauugcuuacuaccucaagaauggguccaauauuuuuaucaagaagcagcaccagcccaaucugauguagcauuauuaagauuuguaaacccagauacagguagaguacuauuugaaugcaaauuacauaaaucuggauauguuacgguugcucauacaggacaacaugauuuaguaauaccaccuaauggauauuuccguuuugauucuuggguaaaucaauuuuauacauuagccccuaugggaaaugguacagggagaagaagagcacucuaa

SEQ ID NO: 31711 - RNA, 1623 nt, Artificial Sequence
  derived and/or modified sequence opt6 from VP1__Norovirus__AID60859
augaaaauggcauccucagaugcuaaccccucagauggaucagcagcgaacuuaguacccgaagucaauaacgaaguaauggcucuagaaccaguaguaggagccgcaauagcagcaccaguagcaggucaacaaaacguaauagacccauggauacgaaauaacuuuguacaagcaccaggaggagaauucacaguuucaccaagaaaugcaccaggagaaauacuaugguccgcaccauuagguccugacuuaaaccccuaccuaucucaucuagccagaauguacaauggcuaugcaggcgguuucgaaguucaagucaucuuagcaggaaacgcauuuacagcugguaaaguaauauucgcugcaguaccaccuaacuucccaacagaaggacuaagcccaucacaaguaaccauguuuccccauauaguaguagacguaagacaauuagaaccaguucucauaccauuacccgauguuagaaauaacuucuaucacuacaaucagucaaacgauccaacaauaaaauugaucgcaauguuauauacaccacuacgagcaaauaacgcaggagaugaugucuuuacagucuccugcagaguacuaacuagaccaaguccugacuuugauuuuauuuuccuaguaccacccacaguugaaucacgaacaaaaccauuuagcguaccaguauuaacagucgaagaaaugacaaauucaagauuuccaauacccuuagaaaaauuauuuacuggaccaucaucugcauuuguuguucaaccucaaaacgguagauguacaacugaugggguacuauuaggaaccacacaacuaagcccaguuaauauauguacuuuccgaggcgacgucacacauauaacgggaucaagaaacuacacaaugaauuuagcaucccaaaacuggucuaauuacgacccaacugaagaaauaccagcuccauuaggaacuccagacuucguaggaaaaauucaaggaguauuaacucaaacaacacgaacagacggaucuacaagaggacauaaagcaacuguauauacaggaagcgcugauuuugccccuaaacuagguagaguacaauucgaaacagauacagaucaugauuuugaagcaaaucaaaauacaaaauuuacaccaguaggcguaauacaagauggauccacaacucauagaaacgaaccccaacaauggguacucccaucuuauucaggcagaaacaccccuaacguacacuuagcaccagcagucgcuccaacauuuccaggagaacaacuauuauucuuccgaucaacuaugcccggauguucaggauacccuaacauggaucucgacugucuacugccacaagaauggguacaauacuucuaucaagaagcagcuccagcacaaagugacgucgcauuacuaagauuuguaaacccagauacugguagagucuuauucgaaugcaaauuacauaaaucaggauacguaacaguggcacauacuggacaacaugaucuaguuauaccaccaaacggauauuuccgauuugauagcugggucaaucaauucuauacauuagcaccaauggguaauggcacuggaagaagaagagcucuauaa

SEQ ID NO: 31712 - RNA, 1623 nt, Artificial Sequence
  derived and/or modified sequence opt6 from VP1__Norovirus__AID60861
augaaaauggcaucuucagaugccaacccaucagacggaucagcagcaucacuaguaccagaaguaaauaacgaaguaauggcucuagaaccugucgucggagcagcaauagcagccccaguagcaggacaacaaaauguaauagauccauggauaagaaacaauuucguucaagcaccaggaggagaauucacaguauccccaagaaacgccccuggcgaaauucuuuggucagcuccacuuggaccagacuuaaauccauacuuaucacauuuagcaagaauguacaacggauaugccggaggauuugaaguacaaguuauacuugcuggaaaugccuuuacugcuggcaaaguaaucuuugcagccgucccucccaauuuuccuaccgaaggccuuucucccucacaaguaacaauguucccacauauuguaguagauguucgacaacuagaaccugucuuaauaccuuuaccugaugucagaaauaauuucuaccacuacaaucaaucuaaugaucccacuauaaaauuaauagcaauguuauacacaccccuaagagcuaacaaugcaggagaugauguuuuuacaguaucaugcagaguucuaacuagacccucuccagauuuugacuuuauauuccuuguacccccaaccguagaaucaagaacaaaaccuuuuucaguccccguacuaacaguugaagaaaugacaaauucuagauucccaaucccucuagaaaaacuuuuuacaggaccauccucagcauuuguaguccaaccacaaaacgguagaugcacuacagauggaguacuacuaggcacaacacaacuaucuccuguaaauauauguacauuucgcggagauguaacucauauaacaggaagucguaauuacacaaugaauuuagcaucccaaaauuggucaaauuaugacccaacagaagaaauaccagcacccuuaggaacaccagacuuugucggaaaaauucaaggaguacuuacccaaacuacaagaacagauggaaguaccagaggacauaaagccacaguuuauaucggaucagcagauuuugcuccaaaacuaggacgcguacaauuugaaaccgauaccgaccaugacuucgaagcaaaccaaaacaccaaauucacaccaguaggaguuauucaagaugguagcacaacucaucgaaaugaaccacaacaauggguacuaccaucauauucuggaagaaacacuccaaauguacaucuagcaccugcaguagcaccuacauucccaggugaacaacuacuauuuuuuagaagcacaaugccuggauguucaggauauccaaauauggauuuagauuguuuauuaccacaagaauggguucaauauuucuaucaagaagccgcaccugcccaaucugauguagcauuauuaagauucguuaauccugauacaggccgaguucuauucgaauguaaacuucacaaaucaggcuauguuaccguugcacauacuggacaacacgauuuagucauaccgccaaauggcuacuuuagauuugauaguuggguuaaucaauucuauacacuagcaccuauggguaauggaacaggaagacgaagagcacuauaa

SEQ ID NO: 31713 - RNA, 1623 nt, Artificial Sequence
  derived and/or modified sequence opt6 from VP1__Norovirus__AID60863
augaaaauggcaucauccgaugcaaacccauccgauggcucugcagcaucauuaguaccagaaguaaauaaugaaguaauggcacuagaaccagucgucggugcugcaauugcagccccaguagcaggccaacaaaacguaauagaccccuggauaagaaacaauuuuguacaagcucccggaggagaauuuacaguaucaccacgaaacgcucccggcgaaauauuauggucagcuccacuaggaccagauuugaauccuuaucuaucccauuuagcuagaauguauaacggauacgcaggaggauucgaaguucaaguaauauuagccggcaaugcuuuuacugcaggaaaaguaaucuucgcugcuguacccccaaauuucccaaccgaaggauuauccccaucccaaguaacaauguuuccacacauaguaguugacguucgucaauuagaaccaguuuuaaucccacuuccagacguaagaaauaauuucuaucacuauaaccaaucaaaugauccaacaauaaaauuaauagcaauguuauacacaccacuucgugcuaauaaugcuggagacgauguauucacuguaucaugcagaguauuaacacgaccaucaccagacuuugauuuuauauuuuuagucccuccaacaguagaaaguagaaccaaaccauuuuccguucccgucuuaacaguugaagaaaugacaaauuccagauuuccaauuccacuagaaaaauuauuuaccggaccaucaagcgcuuucguaguucaaccacaaaauggacgauguacaacagaugguguacucuuaggaacuacacaauuaucaccuguaaauauaugcaccuuuagaggagauguaacacauauaacaggaucccgaaauuacacaaugaaucuagcaucccaaaacuggucaaauuacgacccaacagaagaaauccccgcaccauuaggaacaccagacuuuguaggaaaaauacaaggaguucuaacacaaacuacuagaacugauggaucaacaagaggucauaaagcuacaguauacacagguuccgcagauuuugccccaaagcuaggccguguacaauuugaaaccgauacagaucaugauuuugaagcuaaucaaaauaccaaauucacaccaguaggaguuauacaagauggaagcacuacccacagaaaugaaccacaacaauggguauuaccuucauauuccggaagaaacacaccuaauguacauuuagcaccagcaguagcaccuacauucccuggugaacaacugcuauucuuucguucaacaaugccuggauguucaggauaucccaauauggaucuugauugcuuacuaccacaagaauggguacaauacuuuuaccaagaagccgcaccagcacaaucagauguagcacuacuuagauucguuaaucccgauacagguagagucuuauuugaaugcaaacuacacaaaucaggauacguaaccguugcacauacaggccaacacgaucuuguaauacccccaaauggauauuuuagauuugauucauggguaaaucaauuuuauacacuagcaccaaugggaaauggaacaggccgcagacgagcauuauaa

SEQ ID NO: 31714 - RNA, 1623 nt, Artificial Sequence
  derived and/or modified sequence opt6 from VP1__Norovirus__AID60865
augaaaauggcaucuucagaugcaaauccaucagacggaucagcugcaucacuuguuccagaagucaauaaugaaguaauggcacuagaaccaguagucggcgcagcaauagcagcaccaguugcaggacaacaaaauguaauagauccuuggauaagaaauaauuuuguacaagcuccaggaggagaauuuacagucucuccucgaaaugcaccuggugaaauacuuuggagugcuccacuagguccagaccuaaauccauaccuaagucacuuagcaagaauguauaacggcuaugcaggaggcuucgaaguucaaguaauacuagcaggaaaugcauuuacggcagguaaaguaaucuuugcagcuguaccuccaaacuuuccaaccgaaggacuaagcccaucacaaguuacaauguuuccucauguaguuauagacguaagacaauuagaaccaguucuuauaccacuaccagaugugcgaaacaauuuuuaucacuacaaucaaucaaacgacccaacuauuaaacuaauagcaaugcuuuacacaccacuaagagcaaauaaugcuggagacgacguuuuuacagucagcuguagaguacucacaagaccuucacccgacuuugacuuuauauuucuaguaccaccgacuguagaaucaagaacuaaaccauucucaguaccuguucucacaguagaagaaaugaccaauucacgauuuccaauaccacuagaaaaauuauuuacaggcccaucaucagcauucguaguacaaccacaaaaugguagauguacaacagacggaguacuauuaggcacaacacaauuaucccccgucaauaucuguacauucagaggcgauguaacacauauaacuggaucaagaaauuacacaaugaauuuagccucacaaaauuggucaaauuacgauccaacagaagaaauaccagcuccauuagguacaccugauuuuguaggcaaaauacaagguguauuaacacaaacaacuagaaccgacgguucaacaaggggucauaaagcaacaguauauacaggaagugcagacuuugcacccaaauuaggucgaguacaauucgaaacugacacagaccaugauuuugaaaccaaucaaaacacaaaauucacaccaguaggaguaauucaagauggaggcacaacccaccgaaacgagccucaacaauggguccuaccuucuuacucuggaagaaacacuccaaauguacauuuagcucccgcaguugcacccacuuucccaggagaacaacuacucuuuuucagaucaacuaugccugguugcucuggauacccaaauauggaccuagauugucuauuaccacaagaauggguccaauauuuuuaucaagaagcagccccagcacaaucagacguagcacuauuaagauuuguuaacccagauacaggaagaguauuauuugaauguaaacuucauaaaucaggcuauguaacaguagcacacaccggucaacacgaucucguaaucccccccaacggauauuuucguuucgauuccugggucaaucaauuuuauacauuagcaccuauggguaacggaacuggaagacgacgcgcccuauaa

SEQ ID NO: 31715 - RNA, 1623 nt, Artificial Sequence
  derived and/or modified sequence opt6 from VP1__Norovirus__AID60869
augaaaauggcaucaagcgacgcaaauccaucugaugggucagccgcaucacugguuccagaagucaauaaugaaguaauggcacucgaaccaguaguaggagcagcaauagcagcaccuguagcaggccaacaaaauguaauagaccccuggauuagaaauaacuucguucaagcacccggaggagaauuuaccguuucaccacgaaaugccccaggagaaauauuauggagcgcaccuuuaggaccugaucuaaacccuuacuuaucucauuuagcaagaauguacaacggcuaugcaggaggauuugaaguacaaguaauacuugccggcaaugcauuuacagccggaaaaguaauauucgcagcaguaccaccuaauuuuccaacugaaggauuaaguccaucccaaguaacuauguuuccccauauuguuguugauguccgacaacuagaaccaguuuuaauaccacuaccagacguacgcaacaauuuuuaucauuacaaucaaaguaaugacccuacaauaaaacuaauagcaaugcuauauacaccguuaagagcaaauaaugcaggagacgacguuuuuacaguaucaugcagaguuuuaacacgaccaucaccagacuuugacuuuauauuucuagucccgccaaccguagaaucaagaacaaaaccauucucaguaccaguuuuaaccguugaagaaaugacuaacucccgcuuuccuauaccacucgaaaaauuauuuacagguccuucaucugcauucgucguucaaccacaaaauggaagauguacuacagauggaguacuacucggcacuacacaauuaucucccguaaacauaugcacauuuagaggagacguaacacauauaacagguucacauaauuauacuaugaauuuagcaucccaaaauuggucgaacuacgaucccacagaagaaauucccgcaccauuaggaacaccagacuuuguaggaaaaauucaaggaguucuaacacaaacaacucguacuaauggcucaacaagaggacacaaagccacaguuuacgccggcucugcuaauuuugccccuaaacuuggaagaguacaauuugaaacugacacugaucaugaucucgaagcaaaucaaaacacaaaauuuacaccaguaggaguaauacaagacggaaacacaacucauagaaaugaaccacaacaauggguauuaccauccuauucaggaagaucuacccccaacguacaucuagccccagcaguagcaccaacauuccccggugaacaauuauuauucuuuagaucuaccaugccagggugcucaggauacccaaauauggaccuugauugcuuauuaccacaagaauggguacaauauuuuuaucaagaagcagcccccgcccaaucugaugucgcacuauuaagauuuguaaacccagauacuggaagaguauuauuugaauguaaauuacauaaaucaggcuacguaacaguagcacacacuggacaacacgauuuagucauaccaccaaacggauauuuuagguuugauucauggguaaaucaauucuauacccuagcucccaugggcaaugguacuggaagacguagagcccuuuaa

SEQ ID NO: 31716 - RNA, 1623 nt, Artificial Sequence
  derived and/or modified sequence opt6 from VP1__Norovirus__AID60871
augaaaauggcaagcucagaugcuaacccaucagacgguucagccgcaaaccuaguccccgaaguuaacaaugaaguaauggcuuuagaaccaguaguaggcgccgcaauagcagcucccguagccggucaacaaaacguaauagauccauggauaagaaauaauuuuguacaagcaccaggaggugaauuuaccguuucucccagaaaugcacccggugaaauauuauggucagcaccacucggacccgaccuaaauccuuaucuuucucacuuagcaagaauguauaacggauacgcaggaggauuugaaguacaaguaauacucgcuggcaacgcauuuacagcuggaaaaguaauauucgccgcaguaccaccaaauuuuccaacagaaggacucagcccaucccaaguaacuauguuuccacauauagucguagauguaagacaacuugaaccaguacuaaucccacuaccugauguaagaaacaacuucuaucacuauaaccaaucaaacgacccuacuauaaaacuuauagcaaugcuauauacgccccuacgagccaacaacgcaggagacgauguauuuaccguaucaugccgaguccucacaagaccaucaccagacuucgauuuuauauucuuaguaccuccaacaguggaaucacgaacaaaaccauuuucaguaccuguccuaacaguagaagaaaugacaaacucacgauucccaacccccuuagaaaaauuauucacaggaccauccagugcauuuguaguacaaccacaaaacggaagauguaccaccgacgguguauuauuagguacaacacaauuauccccuguaaacauaugcacauuuagaggagacguaacacauauaacaggcucuagaaauuacacaaugaaccucgcaagucaaaauuggucaaauuacgauccuacagaagaaauaccagcaccacucggaacaccugacuucgucggaaaaauacaaggcguauuaacacaaacaacuagaaccgacggaucaacuagaggacauaaagcaacaguauacacaggaucagcugauuucgcaccuaaauuagguagaguccaauuugaaacagacaccgaucacgacuuugaagcaaaucaaaacacaaaauucacacccguaggagucauacaagauggaucuacaacacaccguaaugaaccacaacaauggguacucccaucauauucaggaagaaacacaccuaauguacauuuagccccagccgucgcaccaacauucccaggugaacaauuacuauuuuucagguccacaaugcccggaugcucaggauauccaaauauggauuuagauugccuauuaccucaagaauggguucaauauuuuuaucaagaagccgcucccgcacaaucagacgucgcucuuuuaagauuuguaaacccagacacaggaagaguuuuauucgaauguaaauuacauaaaucaggauauguaacaguagcucacacuggacaacaugaucuaguaauaccuccaaauggauauuuuagauucgacucauggguaaaccaauuuuacacccuagcaccaauggguaacggaacaggcagaagacgcgcauuauaa

SEQ ID NO: 31717 - RNA, 1623 nt, Artificial Sequence
  derived and/or modified sequence opt6 from VP1__Norovirus__AID60875
augaaaauggcaucuucggacgcaaauccaucagacggaucagcagcaaauuuaguccccgaaguaaacaacgaaguuauggcucuugaaccagucguaggagcagcuauagcugcaccagucgcaggucaacaaaauguaauagaccccuggauaagaaacaacuucguccaagcaccuggcggugaauuuacuguaucaccuagaaacgccccaggagaaauauuauggucagcaccacuaggaccugaucuaaauccauaucuaucacaucuagcaagaauguauaacggcuacgcagguggauuugaaguacaaguaauucuagcaggaaacgcuuucacugcaggcaaaguaauauucgccgcaguaccuccuaauuucccaacagaaggucuuucaccaucccaaguuacaauguuuccacacauaguaguagacguucgacaauuagaaccuguuuuaauaccauuaccugacguuagaaauaauuucuaucauuauaaucaaucaaaugacucuacuauaaaauuaauagcuaugcuauauaccccauuaagagcaaacaacgcaggagaugacgucuucacaguuucaugcagaguauuaacaagaccaucuccugauuuugacuuuauauuucuagucccacccacugucgaaucaagaacaaaacccuuuagcguaccaguacuuacaguagaagaaaugacaaacagccgauuuccaaccccacuagaaaaacuuuucacaggaccuagcucagcauucguaguacaaccacaaaacggaagauguacaacagacggaguucuauuaggcacaacacaacuuucaccaguaaacauaugcaccuuucgaggugauguaacacauauaacuggcucccgaaauuacacuaugaaccuagcuucacaaaauuggucaaauuacgacccaacugaagaaauaccagccccucuaggaacaccagacuuuguuggaaaaauucaaggugucuuaacacaaacuacaagaaccgauggaucaacaagaggacacaaagcaacaguuuacacaggaucugcagauuucgccccuaaauuaggcagaguacaauuugaaacagacacagaccacgacuucgaaacuaaucaaaauacuaaauucacuccuguaggcguuauacaagauggauccacaacacaccguaacgaaccacaacaauggguauuaccaucuuauucaggaagaaacacuccaaauguacacuuagcacccgcuguugcaccuacuuuuccaggugaacaacuacuauucuucagaucaacaaugcccggaugcagugguuauccaaauauggauuuagauugcuuacuaccucaagaauggguacaauauuuuuaccaagaagcagcaccagcccaaucagacguagcacuacuaagauuuguuaacccagauaccgguagaguauuauuugaauguaaauuacauaaaucagguuauguaacagucgcacacacaggacaacaugaucucguuauaccaccaaacggauauuucagauuugaaagcugggucaaccaauuuuauaccuuagccccaaugggaaaugguacuggacgacgacgagcuuuauaa

SEQ ID NO: 31718 - RNA, 1623 nt, Artificial Sequence
  derived and/or modified sequence opt6 from VP1__Norovirus__AID60877
augaaaauggccucaucagaugcuaacccaagugauggaucagcagcuaaucuaguaccagaaguuaacaaugaaguaauggcccuagaaccagucguaggugcugcuauugcagccccaguagcuggacaacaaaaugucauagauccauggauuagaaacaacuuuguacaagcucccggaggagaauuuacaguuucuccaagaaaugcaccaggcgaaauauuauggucagcaccucuaggcccugacuuaaauccuuacuuaucacaccuugcaagaauguauaauggauacgcaggugguuuugaaguacaaguuauucuagcaggcaaugcauuuaccgcaggaaaagucauauucgcugcaguuccaccaaauuuucccacagaagguuuaucaccuucacaagucacaauguuuccacacauagucguugacguacgacaacucgaaccaguacucauuccacucccagacguacgaaauaauuuuuaucauuacaaucaaucaaacgacucuacaauaaaacuaauagcaaugcuauacacuccacucagggcuaauaaugcaggugacgacguauucacaguaucauguagaguuuuaaccagacccucaccagauuuugacuuuauauuucuaguuccaccaacaguagaaucacguaccaaaccuuucucuguaccaguucuaacaguagaagaaaugaccaacucuagauuuccgaccccucuagaaaaacuuuuuacaggaccaucuucugcauucguaguacaaccacaaaauggaagaugcacaacagacgguguauuacuaggaacaacacaauuaucaccaguaaacauauguacauuucgaggagacguaacacauauaacaggaucaagaaacuacacuaugaauuuagcuucacaaaauuggucaaacuacgauccuacagaagaaauaccagccccacuuggcaccccagacuucgucggaaaaauccaaggaguauuaacucaaacgacacgaacagacggaaguaccagaggucacaaagcuacaguauauacaggcuccgcagacuucgcaccaaaacuagguagaguacaauucgaaacagauacugaucaugauuucgaaacaaaccaaaauacaaaauucacaccaguaggaguuauacaagaugguuccaccacacaucgaaacgaaccucaacaauggguacuuccuucauauuccggaagaaauacaccuaacguacaccucgcaccagcuguugcacccacauuuccaggcgaacaacucuuauuuuuucgauccacuaugccaggaugcucaggauacccaaauauggaucuugauugcuuauuaccacaagaauggguacaauacuuuuaccaagaagcagcaccagcucaaucagauguagcauuacuuagauuugugaaucccgauacuggaagaguauuauucgaauguaaauuacacaaaucagguuauguaacaguagcacauacuggccaacaugaccuaguaauaccaccuaauggauauuuuagauucgauaguuggguaaaucaauucuacacacuugcacccaugggaaauggaacaggaagacgaagagcacuauaa

SEQ ID NO: 31719 - RNA, 1623 nt, Artificial Sequence
  derived and/or modified sequence opt6 from VP1__Norovirus__AID60879
augaaaauggcaucaucagacgcaaauccaucagauggaucugcagcaaaccuaguaccagaaguaaauaaugaaguaauggcacuugaacccguaguuggagcagcaaucgcagccccuguagcaggacaacaaaauguaauagauccauggauaaggaauaacuucguacaagcuccaggaggagaauuuacaguauccccaagaaaugcaccaggagaaauucuuuggagugcaccacucggaccugaucuaaaucccuauuuaucacacuuagcuagaauguacaauggcuaugcaggaggauuugaaguccaaguaauucuagcaggcaacgcguucacagcaggcaaaguaauuuuugccgccguaccaccaaauuuuccuaccgaaggacuuucacccucacaaguaacuauguuuccacauauaguaguagauguaagacaauuagaaccuguacuaauaccucuacccgacguucgaaauaauuucuaucauuauaaccaaagcaaugauucuacaauaaaauuaauagcaauguuauacacaccauuacgagcaaacaacgccggagaugacguauucacuguaucauguagaguucucacaagaccaucaccagauuuugauuuuauauuccucguaccuccuacagucgaaucccgaacuaaaccuuucucagucccaguacuuacaguagaagaaaugaccaauucaagauuucccacaccucuugaaaaauuauuuacagguccaucgagugcauuuguaguacaaccacaaaacggacgauguacuacagacggaguauuauuaggaacuacacaacuaucaccaguaaacauauguacauuccgaggagacguaacccauaucacuggcucaagaaacuauacaaugaaccucgccucacaaaacuggucaaauuaugacccaacugaagaaauacccgcaccacuuggaacaccagacuucguaggaaaaauacaagguguacuuacacaaacaacaagaacagauggauccacaagaggacacaaagcaacuguauacacaggaucagcugacuucgcccccaaacuaggcagaguacaauuugaaacugacacugaucaugauuucgaaacaaaccaaaauacaaaauucacaccuguuggcguaauucaagauggcuccacaacacaucgaaaugaaccucaacaauggguccuuccaucauauucuggccgaaacacaccaaauguacaucucgcaccagcaguagcaccaacauuuccaggagaacaauuacuauuuuuuagaucaacaaugccuggauguucaggauacccuaacauggaccuagauuguuuauuaccacaagaauggguucaauauuuuuaucaagaagcagcuccugcacaaucagacguagcacuucuaagauuuguaaaucccgauacuggccgcguacuauuugaauguaaauuacauaaaaguggauacguaacaguagcacacacaggacaacaugauuuaguaaucccacccaacggauacuucagauuugauucuuggguuaaucaauuuuacacauuagcaccuaugggaaauggaacaggaagaagaagagcauuauaa

SEQ ID NO: 31720 - RNA, 1623 nt, Artificial Sequence
  derived and/or modified sequence opt6 from VP1__Norovirus__AID60881
augaaaauggcaucaagcgacgcaaauccaucagacggaucagcagcaaacuuagucccagaagucaacaaugaaguaauggcucuagaaccaguaguaggugcugcuauagcugcaccaguugcuggacaacaaaacguaauagauccauggauaagaaauaauuucguccaagcaccagguggugaauuuacaguuucaccuagaaaugcuccaggagaaauccuuuggucugcaccucuagguccagaccuaaauccuuacuuaucacacuuagcacguauguacaauggauaugccgguggcuucgaaguccaagucauacucgccggaaaugcuuucacagcaggaaaaguaauauuugcagcagucccaccaaacuucccaaccgaaggauuaucccccucucaaguaaccauguucccacauaucguaguagauguaagacaacuagaaccaguauuaauaccauuaccagacguaagaaauaacuucuaccauuauaaucaaucaaacgacuccacaauuaaauuaauugcaauguuauauacuccacuaagagcaaauaacgcaggcgacgauguauuuacaguaucuugucgaguacucacacgaccuucaccagauuucgacuuuauauuuuuaguacccccaaccguagaaagucgaacuaaaccauucucaguaccaguacuaacaguugaagaaaugacuaauucaagauucccaacuccauuagaaaaacuauuuacaggaccuuccucagcauuuguuguccaaccccaaaacggucgauguacuacugacggaguauuacuuggaacuacucaacuaucaccaguaaauauaugcacauuuagaggagauguaacccauauaacaggaagcagaaacuacacaaugaaucuagccucacaaaacuggucuaauuacgauccaacagaagaaauaccagcuccauuaggaacaccagacuuuguuggaaaaauccaaggaguucuaacccaaacaacuagaacagaugguucaacaagaggacauaaagcaaccguauauacuggaucagccgauuuugccccaaaauuagguagaguacaauuugaaacagauacugaccaugacuuugaaacuaaucaaaauacaaaauuuacuccagucggaguaauccaggauggaucaacaacacacagaaaugaaccacaacaauggguauuaccaucauauucaggucguaacaccccaaacguacaccuagcaccagcuguugcuccaacuuucccaggagaacaauuacuauucuucagauccaccauuccaggaugcucuggauauccaaauauggaucucgauugcuuauuaccacaagaauggguccaauauuucuaucaagaagcagcuccagcacaaucugacguugcacuucuaagauucguuaacccugauacaggacgaguauuguuugaaugcaaacuacauaaaucaggauacguaacuguagcccacacaggacaacacgauuuaguaauaccaccuaauggauauuucagauuugauuccuggguaaaucaauucuauacauuagcuccaaugggcaacggaacaggacguaggagagcauuauaa

SEQ ID NO: 31721 - RNA, 1623 nt, Artificial Sequence
  derived and/or modified sequence opt6 from VP1__Norovirus__AID60883
augaaaauggcuucauccgacgcaaaucccucagauggcucugcugcuaaccuaguuccagaaguaaacaaugaaguaauggcauuagaaccaguaguuggagcagcuauagcagcuccugucgcuggccaacaaaacguaauugauccauggauaagaaauaacuuuguacaagcuccaggaggagaauuuacaauaucaccaagaaacgcaccaggagaaauucuauggagugcaccauuaggaccagauuuaaacccauaucuuucucaucuugcucgaauguauaauggauaugcagguggauucgaaguacaaguaauuuuagcaggaaaugcauuuaccgcagguaaaguaauauucgcagcaguaccaccaaauuuccccacugaaggauuauccccaucucaagucacaauguuuccucacauaguuguagacguaagacaacucgaacccguacuaauaccacuaccugacguaagaaauaacuucuaccacuauaaucaaucaaaugauucaacaauaaaacuaauagcaaugcuauauacaccccuaagagcaaauaaugcaggagacgauguuuucacaguuucauguagaguacuaaccagaccaucaccagauuucgaucuaauuuuuuuaguaccaccaacaguagaaucuagaacaaaaccuuuuucugucccgguucuaacuguugaagaaaugacaaauucacgauuuccaacaccacuagaaaaacuauuuacagggcccucaagugcauucguuguacaaccacaaaauggaagauguacaacugacggaguucuacuaggaacaacacaacuaucaccaguuaauaucugcacauuucgaggcgacguuacacauauaacaggaucaagaaauuacacaaugaaucucgcaucacagaacuggucuaauuaugacccaacugaagaaauuccagcaccacuaggaacaccagauuucgucggaaaaauacaaggcguucuaacacaaacaacaagaacugauggaucaacaagaggccauaaagcaacaguuuacacaggauccgcagacuuugcaccaaaacuagggagaguacaauuugaaacugauacugaccacgauuucgaaacaaaucaaaauacaaaauuuacuccaguaggcguaauucaagauggaucaacuacccaucguaaugaaccacaacaauggguauuaccaaguuauucaggucgaaauacaccaaacguacaucuagcaccggcaguagcaccaacauuuccaggugaacaacuucuuuuuuuccgaaguacuauaccugguuguucuggcuauccaaauauggaccuugauuguuuauuaccccaagaauggguucaauauuuuuaucaagaggccgcuccugcucaaucagauguagcucuuuuaagauucguaaauccagacacaggaagaguuuuauucgaaugcaaacuccauaaaagcgguuaugucacaguagcacacacaggacaacacgacuuaguuauucccccaaaugguuacuuuagauuugauucauggguaaaucaauucuauacucucgcacccauggguaauggaacugguaggagacgagcacuauaa

SEQ ID NO: 31722 - RNA, 1623 nt, Artificial Sequence
  derived and/or modified sequence opt6 from VP1__Norovirus__AID60885
augaaaauggccucuucagaugcaaauccuucggauggaucagccgcaaacuuagucccagaagucaacaaugaaguuauggcacucgaaccagucgucggagcagccauagcugcccccgucgccggccaacaaaauguaauagacccauggauuagaaauaacuuuguacaagccccaggaggugaauuuacaguauccccaagaaaugcaccaggagaaauuuuauggagugcaccacuaggaccugaucuaaacccauaucuaagucaccuagcuagaauguauaauggauaugcuggaggauucgaaguacaaguaauucuagcaggaaaugccuuuacugcuggcaaagucauauuugcagcaguaccaccuaacuucccaacagaaggacuaucaccaucccaagucacaauguucccacacaucguaguugacguacgacaauuagaaccuguuuuaauaccauuaccagauguacgaaacaacuuuuaucacuacaaccaaucaaacgacagcacuauaaaauuaauagcaaugcuauacacuccacucagagccaauaacgcaggagaugaugucuuuacaguaucaugccgaguuuuaacacgacccucaccagauuucgauuucauauuucuaguuccaccaaccguagaaucuagaacaaaaccauucucugucccaguucuuacaguagaagaaaugacaaacucaagauuuccaacaccauuggaaaaauuauucaccggacccucaucagcauucguuguacaaccacaaaacggcagauguacaacagauggugucuuacuaggaacuacucaacuaucaccuguaaacauauguacauucagaggagacguaacacacauaacuggaucuagaaauuauacuaugaauuuagcaucacaaaacuggucaaauuacgauccaacagaagaaauaccggcaccuuuaggaacaccagauuuuguaggaaaaauacaaggaguuuuaacccaaacuacuagaacagacggaucaacaagaggacauaaagcaacuguauauaccggaucagcagacuuugcaccaaaauuaggccgaguccaauucgaaacagauacugaucaugacuuugaaacaaaucaaaauacaaaauucacaccaguugguguaauacaggaugguuccacuacucacagaaaugaaccacaacaauggguuuuaccuucauauucuggaagaaauacaccuaauguacacuuagcaccagcaguagcaccuaccuucccgggcgaacaacuauuauucuucagaucuacaaugccuggaugcagcggauauccaaauauggaucuagacugcuuacuaccccaagaauggguacaauauuucuaccaagaagcagcuccugcccaaucugacguagcauuauuaagauucgucaauccugacacuggaagagucuuauucgaaugcaaacuacacaaaucuggcuacguaacaguagcacacacaggacaacacgaucuagucauaccaccaaacggauauuuuagauuugauucaugggucaaucaauuuuauaccuuagcaccaaugggaaacggaacaggaaggagaagagcauuauaa

SEQ ID NO: 31723 - RNA, 1623 nt, Artificial Sequence
  derived and/or modified sequence opt6 from VP1__Norovirus__AID60887
augaaaauggcaucaucagacgccaauccaucagauggaucagcugcaaaucuaguaccagaaguaaauaaugaaguaauggcacuagaaccaguuguaggagcugcuauagcagcaccaguagcaggacaacaaaauguuauagacccauggauaagaaauaauuuuguacaagcaccaggaggagaauucacugucucaccaagaaaugccccuggugaaauacuauggucggcucccuuagguccggaucuaaauccauacuuaucccacuuagcccgaauguauaauggauacgcuggggguuucgaaguacaaguaauauuagcaggcaaugcauuuacugcagguaaaguaauauuugcagcaguaccacccaacuuuccuacugaaggccuaucaccaagccaaguaaccauguucccacacauaguuguagauguuaggcaauuagaaccuguucuaauaccccuuccagacguaagaaacaauuucuaucauuauaaccaauccaaugacccaacaauaaaacuaauagcaauguuauacacacccuuaagagcgaacaaugcaggagacgaugucuuuacaguaucaugucgagucuuaacaagaccauccccagacuuugacuuuauauuccuaguaccuccaacaguagaaucucgaacaaaacccuucucaguaccaguacuaacaguagaggaaaugacaaacucaagauuuccaacaccauuagaaaaacuguucacagguccaucaagcgcauuuguaguacaaccucaaaacggucgauguacaacagauggaguacuuuuaggcacaacacaacuuucaccaguaaacauauguacauuuagaggagacguaacacauauaaccggauccagaaauuacaccaugaaucuagcaucccaaaauuggucaaauuaugacccaacugaagaaauaccagcaccauuaggcacaccagauuuuguaggaaaaauacaaggaguauuaacacaaacaacuagaacagauggauccacaagaggucauaaagccacugucuauacaggaucagcagauuuugcaccuaaauuaggacgaguucaauucgaaaccgacacagaucacgauuuugaaacgaaucaaaauacuaaauuuacaccuguaggaguaauacaagauggaucuacaacacauagaaaugaaccacaacaauggguccuaccaucauauucuggaagaaauacaccaaauguacaucuagcaccagcaguugccccgacauuuccaggagaacaauuauuauucuuuagaucaacaaugccaggauguucaggcuacccaaauauggauuuagacugccuacuaccccaagaauggguucaauauuucuaucaagaagcugcaccagcacaaucagauguagccuuacuacguuucguaaacccagacacaggaagaguauuauucgaaugcaaauuacauaaaucugguuacgucacaguagcucacaccggccaacaugauuuaguaauaccacccaauggcuacuucagauuugauucuuggguuaaccaauucuacacccuagcaccaaugggaaaugguacaggcaggagaagagcccuauaa

SEQ ID NO: 31724 - RNA, 1623 nt, Artificial Sequence
  derived and/or modified sequence opt6 from VP1__Norovirus__AID60889
augaaaauggcauccucagacgcaaacccaugcgaugguucugcagcuaauuuaguacccgaagucaauaaugaaguaauggcucuagaacccguaguaggagcagcaauagcugcaccaguaggaggacaacaaaauguaauagacccauggaucagaaauaacuucguacaagcuccaggaggugaauuuacaguaucaccaagaaacgcaccaggagaaauauuauggucagcaccacuaggaccagaucuaaauccauauuuaucccauuuagcaagaauguauaacggauaugcaggaggcuucgaaguacagguaauacuagccgguaacgcuuucacagcaggaaaaguaauuuucgccgcaguaccaccaaacuuccccacagaaggucuaucaccaucacaaguuaccauguuuccacauauaguaguagacguaaggcaacuagaaccaguacuaaucccacuuccagacguaaggaacaauuucuaccacuauaaccaauccaaugacucaaccauaaaacucauugccauguuauacacaccucuuagagcuaacaacgcaggagacgauguauuuacaguaucuuguagaguucuaacuagaccaagcccagacuuugacuuuauauucuuaguaccaccuacaguagaaucaagaacaaaaccauuuucuguaccaguauuaaccguagaagaaaugacaaauuccagauuccccacuccuuuagaaaaacuauuuacaggaccauccagugcauucguuguucaaccccaaaauggaagaugcacaacagauggagucuuacucggcacaacccaacuaucacccgucaauauauguacauuuagaggagacgucacacauauaacaggaucaagaaauuacacuaugaaucuagcaucacaaaauuggucuaauuacgauccaacagaagaaauaccugcaccacuuggcacaccugacuucgucggaaaaauacaaggaguccucacucaaacaacaagaacagacgguucaacuagaggacauaaagcuacuguauacauaggaucagccgacuuugcaccaaaacuuggccgcguacaauucgaaacagauacugaucacgauuuugaaacuaaucaaaacacaaaauucacaccuguaggaguaauacaagacgguucaacaacacauagaaaugaaccucaacaauggguacuacccucauacucaggaagaaauacacccaacguacaucuagcaccagcuguagcaccaacuuuuccuggugaacaauuacuuuucuuuagaucaacauuaccaggauguucaggcuacccaaauauggaucuugauuguuuauuaccacaagaauggguucaauauuucuaucaagaagcagcaccagcacaaagcgacguagccuuacuuagauucguaaauccagauacaggcagaguccuauucgaauguaaacuucauaaaucaggauauguuacaguagcacacaccggacaacacgaucuaguaauaccaccaaaugguuauuucagauuugauucauggguaaaucaauuuuacacgcuagcaccaaugggaaauggcacuggaagacgacgagcauuauaa

SEQ ID NO: 31725 - RNA, 1623 nt, Artificial Sequence
  derived and/or modified sequence opt6 from VP1__Norovirus__AID60893
augaaaauggcauccucagacgcaaauccaucugacggcucugcagcaaaucuaguaccagaaguaaacaacgaaguaauggcacuugaaccugucguaggagcagcaauagcagcaccaguagcaggacaacaaaaugucauagacccuuggauacgaaacaacuuuguacaagcaccaggcggagaauuuacaguauccccaagaaaugcaccaggagaaauacuauggucugcuccauuaggaccugauuuaaauccauauuuaucacaccuagcacguauguauaaugguuacgcaggugguuucgaaguccaaguaauauuagccggaaaugcuuuuacugcaggaaaaguuauauucgcugcaguaccaccaaacuucccaacagaaggauuaucaccaucacaaguaacaauguuuccacauauaguagucgacguaagacaacuagaaccuguuuuaauaccucuacccgauguaagaaacaacuuuuaucacuacaaucaaucaaacgacaguaccauaaaacuuaucgcaauguuauacacaccuuuacgugcaaacaacgccggcgaugacguauuuacaguaucuuguagaguuuuaacaagaccaucaccagauuuugacuucauauuucuuguaccaccaacuguugaauccagaacuaaaccauuuaguguaccaguacucacaguagaagaaaugaccaauucacgauucccaacuccauuagaaaaauuauucacaggaccaucaucagcauuuguaguucaaccucaaaacgguagauguacaacagauggaguacuauuagguacaacacaauuaaguccuguaaauauuuguaccuuuagaggugacguuacacauauaacaggaucaagaaacuauacuaugaaucuagcaucccaaaauuggucaaauuacgacccaacagaagaaauaccagcaccauuaggcacacccgauuuuguaggaaaaauacaaggaguacuaacacaaacuacaagaacugauggaucaacuagaggacacaaagcaacaguauacaucggaucagcugacuucgcacccaaacuugguagaguacaauucgaaacagauaccgaucacgauuucgaaacaaaccaaaauaccaaauucacgcccgucggcguuauucaagauggaaguacuacacauagaaacgaaccucaacaauggguacuaccuucauauucaggaagaaauacacccaauguacaccuugcaccagcaguugcaccuacauuuccaggagaacaauuauuauuuuucagaucaacauuaccagguugcucaggcuacccuaauauggaccuagacuguuuacuaccacaagaauggguacaauauuucuaucaagaagcagcuccagcacaauccgauguagcauuauuaagauuuguaaauccugauacugguagaguauuauuugaauguaaacuacauaaaucuggcuauguaaccgucgcacauacaggucaacaugaucuaguaauaccaccaaacggauauuuucgauucgauuccuggguaaaucaauuuuauacacuagcaccuaugggaaauggaacuggacgaagacgcgccuuauaa

SEQ ID NO: 31726 - RNA, 1623 nt, Artificial Sequence
  derived and/or modified sequence opt6 from VP1__Norovirus__AID68577
augaaaauggccucuagugaugcaaacccaagugaugguagugcagcaaauuuaguaccagaaguaaacaaugaaguaauggcacuagaaccuguaguaggagcagcaauagccgcaccaguagccggacaacaaaauguaauugauccauggauaagaaacaacuuuguacaagcaccaggaggcgaauuuacaguaucaccaagaaacgcaccaggagaaauauuauggagugcaccauuagguccagauuuaaaucccuaccucagccaccuagcacgaauguauaacggauaugcugggggauucgaaguccaagucauauuagcaggaaaugcauuuacagcaggaaaaguaauauucgcagcagucccaccaaacuuuccaaccgaaggucuuucaccaucucaaguaacuauguucccucacauaguaguagauguaagacaauuagaaccuguauuaauaccauuaccagaugucagaaauaacuucuaucauuauaaccaaucaaaugauccaacuauaaaacuaauagcaaugcuauauacacccuuaagagcaaacaaugcaggagaugauguauucacaguuuccugucgaguauuaacaagaccauccccagauuucgacuucauauuccuaguaccaccaacaguagaauccagaacaaaaccauuuucuguaccaguauuaacaguugaagaaaugacaaacuccagauuuccaauuccauuagaaaaacuauucacaggaccaucaucagcauucguaguccaaccucaaaauggaagguguacgacugacgguguacuacuagguaccacccaacuaucaccaguaaacauaugcacauuucgaggagacguaacccacauaacaggaucuagaaauuacacaaugaauuuagcaucacaaaacuggucaaacuaugauccuacagaagaaauaccagcaccacuaggaacaccugacuuuguaggaaaaauacaagggauguuaacacaaacaacucgaacagacggaucaacacguggacacaaagcaaccgucuauacugguucagcagacuuugccccaaaauuaggaagaguacaauucgaaacagacacagauagagauuucgaagcaaaucaaaauacuaaauucacaccaguaggaguuauccaagauggaucuacaacacacagaaacgaaccucaacaauggguauuaccaucauauagcggucgaaauacaccaaacguacauuuagcaccugccguagccccuacuuucccaggcgaacaacuacucuuuuuuagaucaacaaugccaggaugcaguggauacccuaauauggauuuagacugccucuuaccucaagaauggguccaauacuucuaucaagaagcagcuccagcacaaucagaugucgcauuacuaagauuuguuaauccagacacagguagaguauuauucgaauguaaacuacacaaaucagguuacguuacuguagcacacacaggacaacacgauuuaguaauaccaccuaacggauauuuuagauuugacucauggguaaaucaauuuuacacauuagccccaaugggaaaugguacaggacgaagaagagcucuauaa

SEQ ID NO: 31727 - RNA, 1623 nt, Artificial Sequence
  derived and/or modified sequence opt6 from VP1__Norovirus__AID68578
augaaaauggcaucaucugacgcaaacccaagugauggaucagcagcaaaccuaguaccagaaguaaacaaugaaguaauggcguuagaaccaguaguaggugccgcuauugccgccccaguagcuggacaacaaaauguuauagaucccuggauaagaaacaauuuuguacaagcaccaggaggagaauucacaguaucaccucgaaaugccccaggagaaauacuauggucagcaccauuaggacccgaucuaaaucccuacuuaucacaucuagcaagaauguacaacggauacgcagguggcuucgaaguacaaguaauauuagcaggcaacgcauucacagcaggaaaaguaauauuugcagccguacccccuaacuuuccaacugaaggucucuccccaucccaagucacaauguucccucacauaguuguugauguacgacaacuagaacccguucucauuccucuaccagauguaaggaacaauuucuaucauuacaaucaaucuaaugacccaacaauaaaauuaauugcaauguuguacacaccauuaagagcuaacaaugcaggagacgauguauuuacaguaucuuguagaguucuaacuagaccaucaccagacuuugauuucauauuucuuguaccccccacaguugaaucacgaacaaaacccuucuccguaccagucuuaaccguagaagaaaugacaaacucaagauucccaauaccacuagaaaaacuauuuacaggaccauccagugcuuucguaguacaaccucaaaacggaagaugcacaacagauggaguacuauuaggaacaacacaacuaucuccaguaaacauaugcacauuuagaggagacguaacucacauaacaggaagucacaacuauacaaugaaucuugcaucacaaaacuggaacaauuacgauccaacagaagaaauaccugcuccccuaggaacuccagauuucgucggaaaaauucaaggaguauuaacucaaacaacuagaacugacggcaguacaagaggacauaaagcuacuguauauaccggaucagcagacuuuucaccaaaauuaggaagaauccaauuugaaaccgauacuaaccacgauuucgaagccaaucaaaauacaaaauucacaccugucggaguaauacaagacggaggcacuacacaccgaaacgaaccacaacaauggguccuaccuucauauuccggaagaaauacacccaacguccaucucgcaccagcaguagccccaacauucccaggugaacaacuucuuuuuuuucguucaacaaugccaggauguucaggauauccaaacauggaucuagauuguuuauuaccacaagaauggguacaauauuucuaucaagaagcagcuccagcucaaucagauguugccuuauuaagauuuguaaacccagauacaggaagaguauuauucgaauguaaacuacauaaaucuggauauguaacaguagcacacacuggacaacacgaucuaguaauaccucccaauggauacuucagauuugauucuuggguaaaccaauucuacacacuugcaccaaugggaaacggaacaggccgaagaagagcccuauaa

SEQ ID NO: 31728 - RNA, 1623 nt, Artificial Sequence
  derived and/or modified sequence opt6 from VP1__Norovirus__AID68579
augaaaauggcaucaagugacgcaaauccaucagacggaucugccgcuaauuuaguaccagaaguuaacaaugaaguacuugcauuagaaccaguaguaggagccgcuauagcagcaccagucgcuggccaacaaaauguaauugauccuuggauaagaaacaacuuuguacaagcaccaggaggcgaauuuacaguaucacccagaaaugcuccaggagaaauauuauggucugcaccacucggacccgaccuaaacccauaucuuagucaccuagcaaggauguauaauggcuaugcaggaggauucgaaguacaaguaaucuuagcaggaaacgcauuuacagcuggaaaaguuauuuucgccgcggucccaccaaauuuuccaacugaaggacuaucaccuucucaaguaacaauguuuccccauauaguaguagacguuagacaacuagaaccaguucucaucccuuuaccagauguaagaaacaauuuuuaccacuacaaucaauccaaugacccaacaauaaaguuaauugcaauguuauacacaccacucagagcuaacaaugcaggagacgaugucuuuacaguauccugucgaguuuuaacuagaccaucaccagauuuugacuuuauauuuuuagucccaccaacuguagaaucaagaacgaaaccuuucucaguaccaguguuaacaguagaagaaaugaccaauucucgauuuccaauacccuuagaaaaauuauuuacaggaccaucauccgcauucguaguccaaccacaaaaugguagaugcaccacagacggaguccuacuaggaacaacacaauuaucaccgguaaauauaugcacuuuucgaggagauguaacacauauaacagguucacauaacuauaccaugaaucuagcaucucaaaacuggaauaacuacgauccaacagaagaaauaccagcuccucuagguacaccagacuucguaggaaaaauacaaggaguacuaacucaaacaacuagaacagauggaucuacuagaggucacaaagcaacaguuuauacaggaucagccgauuuuucaccuaaauuaggaagaauacaauuugaaacagauacaaaccacgauuucgaagcaaaucaaaauacaaaauucacaccaguaggaguaauacaagacggaggaacaacacauagaaaugaaccucaacaauggguacuuccauccuauagugguagaaacacucccaauguacauuuagcaccagccguagcaccaacuuuuccaggagaacaacuauuauucuuucgcucaacaaugccuggauguucuggauaucccaacauggauuuagauuguuuacuaccacaagaauggguacaauauuuuuaccaagaagcugcuccagcacaaucugacgucgcucuuuuaagauucguaaauccagauacaggacgaguuuuauucgaaugcaaauuacacaaaucaggcuauguaacaguagcacacacuggacaacaugaucuaguaaucccuccuaacggauauuuucguuucgacucauggguaaaucaauuuuacacucuagcaccaauggguaauggaacaggaagacgaagagcacucuaa

SEQ ID NO: 31729 - RNA, 1623 nt, Artificial Sequence
  derived and/or modified sequence opt6 from VP1__Norovirus__AID68581
augaaaauggccucaucagacgcaaaucccucagauggaucagcagcaaaucuaguaccagaaguuaauaaugaaguuauggcauuagaaccagucguaggagcagcaauagcagccccaguugcaggacaacaaaauguaauagauccauggauaagaaauaauuuuguacaagcaccaggcggagaauuuaccgucagcccacgaaaugcaccaggagaaauauuguggucugcaccauuaggaccagaccuaaacccuuaucuaucacacuuagccagaauguacaauggauacgcaggaggauucgaaguccaaguaauucuagcaggaaaugcauuuacagcuggaaaaguuauauucgcagcagucccaccuaauuuccccacagaaggauuaucacccucacaagucaccauguucccccauauaguaguugauguuagacaacuagaaccaguacuaauaccacuaccagaugucagaaacaauuucuaccacuacaaccaauccaaugacccaacaauuaaauuaauagcaauguuauacacacccuuaagagcaaacaaugcaggugacgauguauuuacagucucuuguagaguuuuaacuagaccaucaccugacuucgacuuuauauuuuuaguuccaccaacagucgaaucaagaaccaaaccauucucagucccuguccuuacagucgaagaaaugacuaacucaagauuucccaucccuuuagaaaaauuauuuacaggaccaucuucagcauuuguaguacaaccacaaaauggaagaugcacuacagauggaguauuauuagggacaacucaauuauccccaguaaauauaugcacauuuagaggagaugucacccacaucacaggcucuagaaauuauacaaugaauuuagcaucacaaaacuggaauaacuacgauccuacagaagaaauacccgccccauuaggaacaccugacuucguuggaaaaauccaaggaguacuaacacaaacaacccgaacagacggaucuacacgaggacauaaagcaacuguauauacaggauccgcagauuucgcaccuaaacuaggaagaguccaauucgaaacagauacagaucacgauuuugaagcaaaucaaaauacuaaauucaccccuguagguguaauccaagauggcggcaccacacauagaaaugaaccacaacaauggguauuaccaucauauuccggacgaaauacaccaaauguacaucuagcaccagcaguggcaccaacauuuccaggcgaacaacuauuauucuuccgaucuacaaugccaggauguucagguuauccaaacauggaucuagacugccuacucccacaagaauggguacaauauuucuaucaagaagcagcaccagcucaauccgauguugcacuacuuagauucgugaacccagauacagguagaguacucuucgaaugcaaauuacacaaaucugguuauguaacugucgcucauacuggacaacacgauuuagugauaccaccaaacggauauuucagauuugacucauggguaaaucaauucuacacacuagcaccaaugggaaauggaacaggaagacguagagcauuauaa

SEQ ID NO: 31730 - RNA, 1623 nt, Artificial Sequence
  derived and/or modified sequence opt6 from VP1__Norovirus__AID69174
augagaauggcaucagaugacgcaaaaucagcuccaucagaucuagaaggugcaggauuaguaccagcaacagccgccccacuaccagucgcacccguagcuggagcucaagcagcagaacccuucgcaggacaaauuaauguaauagaucccuggauauauaccaauuuuguucaagcaccaacuggagaauuuacaguaaguccacgaaacacaccuggugaaguacuuguaaacuuagaaaucgguccaaaucuaaacccauaucuccaacauuuggcucaaauguauaacggauaugcaggagguguugaaguacaaguaauacuagcuggaaaugcauuuacagccggaaaauuauuaugugcuuuaguaccaccaggauucccaacaagcaguaucacaccagcacaauuaacaaugcuuccacauacaauaauugacguccguacuacagauccuguuguuguuccaaugccagauguaagaagaacuuuauggcaugaaguaagaucaacaacagaaccucuaaugagauuaguaauaaugcuauacacacccaugagagccaauaguggaucagaugaagcauucguuguauccggaagaguucuaucaagaccagcuccagauuucaacuuuuucuaucuaguuccaccuagaguagaagauacuguugaacccuuuucacuaccagaucuaagaguagaugaaaugucaagcucaagauggcaaaauccuguaguaaugcuacaagcagauccgaaucaaaauauagcugcacauuggcaaaacggaagauguacaauaaauggugaauuauuaggaacaacuccuagaaaccaaaguugguuacuacguaugagaggaucaguauuagcagcaccuggaggacaaaaagcuguaacaguaaauguagacuuaacagaaccugacggucaagcauucaguguuuuaucaggaaauccagguccugaaggagugccagacuuucaagcaauauauaauguuagaaugucaacagcaucaacaacagcuggacauacuguagcuacaaauggauacauagaacaaucaggguauacaccagcacuuggaacacuuguaauucaaggaguagaccuaucacaaguaccagcacuaggaucagaaguaacuaugcaaguaguaaguauagaucuaaaucauaauauggauccaacaagguuaccagauuauaauggagcaggauuugacgguucaguagcauuagcaccaccacuugucccuccauuaccaggcgaaguauuacuucgauucacaacacuuccaauaacaacaucacgaggaucaucaguaucagcuacuuuagauugcgcauuaccagccgaauggauaacaugguucuuaguccauaauuuuguuccacaaggagaugcagcacugcucagauacaggaaucguggcacaggacaaauacuauuugaauguaaauuauauaaagaaggauuuuuggcuguugccggaguuucaacaagaacaguauucccuacaucaggaguuuuugaauuuguaaguuggguaccagucuucuaccaauuaacuccuguaggcaguucaggagccagaaaaagacaaagauaa

SEQ ID NO: 31731 - RNA, 1623 nt, Artificial Sequence
  derived and/or modified sequence opt6 from VP1__Norovirus__AIG59994
augaaaauggcaucaagcgaugccaaucccucagauggaucagcagccaacuuaguaccagaagucaauaaugaaguaauggcacuagaaccaguaguaggagcugcaauagcugcuccaguagccggacaacaaaauguuauagauccuuggauacgcaauaauuuuguccaagcaccuggcggugaauuuacaguauccccuagaaaugcacccggcgaaauacucuggagcgcaccauuaggcccugacuuaaauccauacuuaucacaucucgcacgaauguauaacggauaugcaggaggauucgaaguccaaguaauuuuagcaggcaaugcauuuacagcugguaaaguaauauuugcugccguuccaccuaauuuuccaacugaaggacuaagcccaagucaaguaacuauguuuccacacauuguagucgauguucgacaauuagaacccguacuaauaccauuacccgauguuagaaacaacuuuuaccacuauaaucaaucaaaugauccaacaauaaaauuaaucgcaaugcuuuacacaccacucagagcuaacaaugccggagaugauguuuuuacaguaucauguagaguauuaacaagaccuucccccgauuuugacuucauauuccugguacccccuacaguugaaagucgaacaaagccauuuucagucccuguccuuacaguagaagaaaugacaaacucuagauuuccaauacccuuagaaaaacuauuuacagguccaucaucagcuuuuguaguccaaccccaaaaugguagauguacaacagacggaguauuacuugguacaacucaacuuucaccaguaaauauaugcacuuucagaggagaugugacacauaucacuggaucaagaaauuauacaaugaauuuagcaucacaaaauuggaauaauuacgauccuacugaagaaauaccagcaccauuagguacaccagacuuuguaggaaaaauacaagguguauuaacacaaacuacucgaacggauggaucaaccagaggucacaaagcaacagucuauauaggaucagcagauuuugcaccuaaauuaggaagaguacaauuugaaacugauacagaccacgauuucgaagcuaaucaaaauacaaaauuuacuccaguuggaguaauacaagacggugguaccacacauagaaacgaaccccaacaauggguucuacccucauauuccggaagaaauacucauaacguucaccuagcaccagcaguagcaccaacauucccaggagaacaacuauuauuuuucagaaguacuaugcccggauguucaggauacccaaauauggaccucgauuguuuacuuccacaagaauggguacaauauuuuuaccaagaagcugcaccagcacaaucugaugucgcauuauuaagauuuguaaacccagauacaggaagaguacuuuuugaauguaaauuacauaaaucaggauauguaacaguagcacacacaggacaacacgaucuuguuauaccuccaaacggauauuuuagauuugacucaugggucaaucaauucuauacauuagcuccaaugggaaaugguacaggaagaagaagagcaguauaa

SEQ ID NO: 31732 - RNA, 1623 nt, Artificial Sequence
  derived and/or modified sequence opt6 from VP1__Norovirus__AIG59996
augaaaauggcuucaagugacgccaauccaucagauggaucugcagcaaacuuaguaccagaagucaauaacgaaguuauggcccuagaacccguuguaggugcagcaauagcugcaccagucgcaggacaacaaaaugucauugaucccuggauaagaaauaacuucguacaagcaccagguggagaauuuacaguaucaccuagaaaugccccaggugaaauacuauggucagcaccacuagguccugaucucaaucccuaucuaucacauuuagcaagaauguacaauggguaugcaggagguuuugaaguacaaguaauauuagcuggaaacgcauuuacagccggaaaaguaauauucgcagcaguaccgccuaauuuuccaacagaaggauuauccccaucucaaguaacaauguuuccccacauaguaguugauguccgacaacuagaaccugucuuaauaccauuaccagauguaagaaacaauuuuuaucauuauaaucaaucaaaugauccuaccaucaaauuaauagcaauguuauauacaccauuaagagcuaacaaugcaggagacgauguauuuaccgucuccugcagaguauuaacaagaccaucaccugauuuugauuuuauuuuuuuaguaccaccaacuguagaaucucgaacaaaacccuucucaguuccaauauuaacaguugaagaaaugacuaacucaagauucccaauuccucuagaaaaauuauucacaggacccucaucugccuuuguaguccaaccacaaaauggaagguguacaacggacggaguacuacuaggaacaacccaauuaucuccuguaaauauauguacuuuuagaggugacguaacacauauaacaggcucaagaaauuauacaaugaaucuagcuucacaaaauuggaauaauuacgauccaacagaagaaauuccugcaccacucggaacaccagacuuuguaggaaaaauacaaggaguauuaacacaaacaacuagaacagacggaucuacacgcggacacaaagccaccguauauacuggauccgccgacuucgcacccaaauuaggaagaguacaauucgaaacagauacagaccaugauuucgaagcuaaccaaaauaccaaauuuacacccguaggcguaauacaagacggaggaacaacacacagaaaugaaccucaacaauggguucuaccaagcuauucuggaagaaauacucacaacguacaccuagcaccagcaguagcaccaacauucccaggcgaacaauuauuauuuuuuagaucaacaaugcccggaugcucaggauauccaaauauggaucucgauuguuuauuaccacaagaauggguucaauacuucuaccaagaagcagcuccagcucaaucugauguagcauuauuacguuucguaaacccagacaccggucgaguauuauuugaauguaaauuacauaaaucaggauacgucaccguggcccauacaggacaacaugauuuaguaauaccgccaaaugguuacuuuagauucgacucauggguaaaucaauuuuacacacuagcaccaaugggaaauggaaccgguagaagaagagcagucuag

SEQ ID NO: 31733 - RNA, 1623 nt, Artificial Sequence
  derived and/or modified sequence opt6 from VP1__Norovirus__AIG59998
augaaaauggcuucuucagaugcaaauccaucagauggaucagcagcaaauuuaguaccugaaguaaauaaugaaguaauggcauuagagcccguagucggagcagccauagccgcuccagucgcaggacaacaaaauguaaucgauccuuggauaagaaacaauuuuguacaagcaccaggaggugaauuuacuguauccccuagaaaugccccaggagaaauauuauggucugcaccucuaggaccggaucucaauccauaucucucucacuuagcaagaauguauaauggauaugcuggcggauucgaaguacaagucauacuugcaggaaaugccuuuacagcaggaaaaguaauuuuugcagccguaccaccaaacuuuccaacagaaggacuaucacccucccaaguaacaauguuuccucacauaguaguagauguaagacaacuugaaccugucuuaauaccacuaccugauguaagaaacaacuuuuaucacuauaaucaaucuaacgaccccaccauaaaacuaauugcaaugcuauauacuccauuacgagcaaacaaugcaggagacgauguauuuacaguaucaugucgaguuuuaacaagaccaagccccgauuucgacuucauauuccuaguaccaccaacaguagaaucucgaacuaaaccauucucaguuccaguauuaacuguagaagaaaugaccaauucaagauuuccaauuccauuagaaaaacucuuuaccggaccaucaucagcauuugucguucaaccacaaaauggacguugcacaacagaugguguccuacuaggaaccacccaauuaaguccuguaaacauaugcacuuuuagaggagauguaacacauauaacugguucuaggaacuauacaaugaauuuagcaucccaaaacuggucuaacuacgacccaacagaagaaauaccagcuccuuuagguaccccagacuucguaggcaaaauacaaggaguacuaacucaaaccacacguacagaugguucaacaagaggacauaaagcaacagucuacacagguucagcagauuuugccccaaaauuagguagaguacaauucgaaacagauacagauagggauuuugaagcaaaucaaaauacaaaauuuacaccuguaggaguaauacaagauggauccacuacacacagaaaugaaccucaacaauggguauuaccaucauacucaggaagaaauacaccaaacguacauuuagcaccugcaguagcaccaacauuuccuggagaacaacuacuauuuuuuagaucaacaaugccaggcuguagcggcuauccuaacauggaccuagauugccuacuaccacaagaauggguucaauauuucuaucaagaagcagccccugcacaauccgacgucgcacuauuaagauuuguaaacccagauacuggaagaguccuuuuugaaugcaaauuacacaaaucaggauauguaacugucgcccauacaggccaacacgauuuagucauuccaccaaauggcuauuuucguuuugacucauggguaaaccaauuuuacacucucgcaccaaugggaaacggaaccggacgaagaagagcauuauaa

SEQ ID NO: 31734 - RNA, 1623 nt, Artificial Sequence
  derived and/or modified sequence opt6 from VP1__Norovirus__AIG60000
augaaaauggcaucuucagaugcaaacccaucagauggaucagcagcuaaucuuguaccagaaguaaauaaugaaguaauggcuuuagaaccuguagucggagcugcaauagcagcaccagucgcaggacaacaaaacguaauagauccuuggauuagaaauaacuucguucaagcaccaggaggugaauucacaguaucucccagaaacgcaccaggagaaauacuauggucugcaccacuaggaccagacuuaaauccauaccuaagucaccuagcaagaauguauaacggacaugcaggaggauucgaaguucaaguaauauuagcugguaaugcauucacugcuggcaaaguuauuuuugccgccguaccaccaaauuuuccaacugaaggauuaucaccaucacaaguuacuauguucccccauauaguaguagacguacgacaauuagaacccguuuuaauaccccuaccagauguaagaaauaauuuuuaucauuauaaccaaucaaaugaucccacaaucaaacucauagcaauguuauauaccccacuacgagcaaauaaugcaggagaugacguauuuaccguaaguugcagaguauuaaccagaccaucuccagauuuugacuuuauauucuuaguaccacccacaguugagucuagaacaaaaccauuuucaguuccuguacucacaguagaagaaaugacaaacucaagauucccuauuccacuagaaaaauuauuuacaggcccaucuucugcuuucguaguacaaccacaaaauggcagaugcaccacugaugguguauuauuagguacaacucaacucucaccagucaauauauguacauuuagaggagauguaacccacauaacagguucaagaaacuacacaaugaaccuagcaucacaaaacuggaacaauuacgauccaacagaagaaauacccgcacccuuagguaccccagauuuuguaggaaaaauucaaggaguucuuacacaaaccacccguacugaugguucaacaagaggacacaaagcuacaguauauacaggaucugcagacuuugcaccaaaauuagguagaguccaauucgaaacggauacugaucaugacuucgaagcaaaccaaaacacaaaauucacaccaguagguguaauacaagaugguggcacaacacauagaaaugaaccucaacaauggguauuaccauccuacucuggaagaaacacacauaacguacacuuagcaccagcaguugcaccaacuuuuccaggagaacaacucuuauucuuuagaucaacuaugcccggcugcuccggcuauccuaauauggauuuagauuguuuacuaccucaagaauggguucaauauuucuaccaagaagcugcaccagcacaaucugacguagcauuauuacguuuugucaacccagacacuggacguguacucuucgaauguaaauuacauaaaucaggauauguaaccguagcucacacuggccaacacgaucuaguuauacccccaaauggcuacuuccgcuuugauucauggguaaaucaauuuuauacacuagcaccaauggguaacggaacagguagacguagagcaguauaa

SEQ ID NO: 31735 - RNA, 1623 nt, Artificial Sequence
  derived and/or modified sequence opt6 from VP1__Norovirus__AIG60002
augaaaauggcuucaucagaugcuaacccaucugacggcucugcagcaaaucuuguaccagaaguaaauaaugaaguaauggcacuugaaccaguaguaggugccgcuauagcugcaccaguagcaggucaacaaaacguaauagaccccuggauuagaaauaacuuuguacaagcaccuggaggugaauuuacaguaucuccuagaaaugcacccggagaaauacuauggucagcaccgcuagguccugacuuaaauccauaucucucccacuuagcaagaauguauaauggauacgcaggugguuucgaaguacaaguuauacuagcaggaaaugcauuuacagcaggaaaaguuauauucgcagccguaccaccaaacuuuccaacagagggucuauccccaucucaaguaacaauguuuccucauauaguuguggaugucagacaacuagaacccguauuaauaccauuaccagacgucagaaacaauuucuaccacuauaaucaaucuaaugaucccaccauaaaacuaauagcaaugcucuacacaccccuacgagcaaauaaugcaggugacgauguauuuaccgucucuugcagaguucuaacacgaccaucaccagacuuugauuuuauauuccuuguaccacccacaguagaaucacgaacaaaaccuuuuucaguaccuguauuaacaguagaagaaaugacaaacucaagauucccuauaccuuuagaaaaacuauucacagguccaucaagcgcauuuguaguacaaccacaaaacggcagauguacgacagauggaguacuauuaggaacaacacaauuaucuccaguaaacaucugcacauuuagaggagcugucacucauaucacaggcucuagaaauuauacaaugaauuuagcaucacaaaacugguccaacuaugauccaacagaagaaauucccgcaccacuagguacacccgacuucguaggaaaaauacagggaguauuaacccaaacaacaagaacagacggaucuacucgaggucacaaggcaacuguauauacaggaagugcagauuuugcacccaaacuaggaagaguacaauuugaaacugauacagaucgagacuucgaagcaaaccaaaauacaaaauucacacccgucggaguaauucaagauggaaguacaacacauagaaaugaaccacaacaauggguuuuaccuaguuauuccggcagaaauacuccaaacguacacuuagccccagccguagcaccuacauuuccuggagaacaauuauuauuuuuccggucaauaaugcccgguugcucaggauaucccaauauggacuuagauugucuuuuaccccaagaauggguacaauacuucuaucaagaagcagcacccgcacaaucugauguagcacuacuucguuucgucaacccugacacaggccgaguacuauucgaaugcaaacuacauaaaucuggauauguaacagucgcucacacaggacaacacgaucuaguaaucccaccaaacggauacuuccgcuucgauucauggguaaaucaauucuauacauuagcaccaaugggaaauggaacaggacgaagaagagcacuuuag

SEQ ID NO: 31736 - RNA, 1623 nt, Artificial Sequence
  derived and/or modified sequence opt6 from VP1__Norovirus__AIG60004
augaaaauggcuucaucugacgcuaacccaucugaugggucagccgcaaacuuaguaccagaaguaaacaaugaaguaauggcuuuagaacccguagucggagcagcaauagccgcaccuguagcaggacaacaaaacguaauagacccauggauacgaaauaauuuuguucaagcaccugguggagaauuuacaguauccccaagaaaugcaccuggagaaauacuauggagugcaccauuaggaccagacuuaaauccuuaucuaucucauuuagcccguauguauaacggauacgcaggaggauuugaaguacaaguaauucuagcaggaaaugcauuuaccgcaggaaaaguaauauuugcugccgucccaccaaauuucccaacagaaggucuaucucccagucagguaacuauguucccccacauaguaguugauguaagacaacucgaaccaguacuuauuccacuuccagauguaagaaacaauuuuuaucacuacaaucaaucuaacgacccuacaauaaaauuaaucgcaaugcuauauacaccauuacgcgcaaacaaugcuggugaugaugucuuuacuguaucaugucgaguacuaacaagaccaucaccugacuuugauuuuauauuucucguaccaccuacaguagaaagucgaacaaaaccauuuucaguacccguccuuacaguagaggaaaugaccaauucaagauucccaaucccauuagaaaaacuauuuacagguccaucaucugcauucguuguucaaccacaaaauggcagauguacaaccgauggaguacuauuaggaacaacccaauuauccccaguaaauauauguacauuuagaggagacgucacacauauaacaggaucaagaaauuacacaaugaaucuagcaucacagaacuggucuaacuaugacccaacugaagaaauaccagcaccacuuggcacucccgacuuuguuggaaaaauccaaggaguacucacacaaacuaccagaacagauggaucaacaagaggacauaaagcaacuguauacacaggaucagcagauuuugccccaaaacucggaagaguucaauuugaaacagauacagauagagauuucgaagcaaaucaaaauacaaaauuuacaccaguaggcguuauacaagacggcucaacuacacaucgaaaugaaccacaacaauggguacucccaucauauucaggaagaaacacaccaaauguucacuuagcaccugcaguugcuccaacuuuuccaggagaacaacuacuauuuuuccgaucaaccaugcccggauguucaggauacccaaauauggaucuagacugccucuuaccacaagaauggguccaauacuuuuaucaagaagcagcaccagcacaaagcgauguagcccuacucagauucguaaauccugauacuggccgaguacuuuuugaauguaaacuccauaaauccgguuauguaacaguagcccauacaggacaacacgauuuaguaauaccaccaaauggauauuuucgauuugacucauggguaaaucaauuuuacacccuugcaccaauggguaauggaacaggcagaagacgugcauuauag

SEQ ID NO: 31737 - RNA, 1623 nt, Artificial Sequence
  derived and/or modified sequence opt6 from VP1__Norovirus__AIG60006
augaaaauggcaagcucagaugcaaauccaagcgacggaucagcagcaaaccuaguuccugaaguaaauaaugaaguaauggcccuugaaccaguaguuggagcagcaauagcagcaccaguagcaggacaacaaaauguaaucgacccuuggaucagaaauaauuuuguacaagcaccuggaggagaauuuacaguauccccuagaaacgcuccgggagaaauauuauggagcgcuccauuaggaccagaucuaaauccauaccuaucacacuuagcuagaauguauaauggcuacgcuggcgguuucgaaguccaaguaauucuagcugguaaugcauuuaccgcuggcaaaguaauauucgcagcaguaccacccaacuuuccaacagaaggucuaucaccuucacaaguuacuauguucccacauauaguaguugacguaagacaacucgaaccaguacuaauuccacuaccagauguaagaaacaauuuuuaccacuauaaucaaaguaacgauccuacuauaaaacuaauugcaaugcuuuacacaccauuacgagcuaauaaugcaggagacgacguauuuacaguuaguuguagaguccuaacacgaccaucaccagauuuugacuuuaucuuucuuguacccccuacaguugaaucaagaacaaaaccauuuucuguaccaguacuaacaguagaggaaaugacaaacucacgauuuccaaucccauuagaaaaacuauuuacagguccaucuuccgcauucguaguccaaccacaaaaugguagauguacuaccgauggugucuuacuaggaacaacacaacuaucaccaguaaacauuugcaccuucagaggagauguaacacacauaacaggaucaagaaacuauacaaugaaucuagcaucccaaaacuggucaaauuacgaucccacagaagaaauucccgcaccauuaggaacuccugacuuuguaggaaaaauacaaggaguccuuacacaaacaaccagaaccgacggcucaacacgcggacacaaagcaacuguauauacaggaagcgcagauuuugcccccaaacuaggaagaguucaauuugaaacagauacugauagagacuucgaagcaaaucaaaauacaaaauucaccccaguagguguaauccaggauggaagcacaacacauagaaaugaaccucaacaauggguuuuaccaucauauucaggaagaaauacuccuaacguacaccuagcaccagcaguagcaccaacauuuccaggugaacaauuauuauuuuuccgcucuacaaugccaggauguucaggauaucccaauauggaucucgauuguuuauuaccacaagaauggguucaauauuucuaucaagaagccgcuccagcacaauccgauguagcauuauuaagauucguuaacccugacacaggaagaguauuauucgaaugcaaauuacauaaaucaggcuauguaacaguagcacacacaggacaacaugauuuaguuauucccccaaauggauauuuccgauucgauucauggguaaaccaauuuuauacacucgcaccaaugggaaauggcacuggaagaagaagagcauuauaa

SEQ ID NO: 31738 - RNA, 1623 nt, Artificial Sequence
  derived and/or modified sequence opt6 from VP1__Norovirus__AIG60008
augaaaauggcauccucugaugccaauccauccgacggaucagcagcaaaccuaguaccggaaguaaacaaugaaguaauggcuuuagaaccaguuguaggagcagcaauagcagcaccagucgcaggacaacaaaauguaauagacccuuggauuagaaauaacuuuguacaagcuccaggcggcgaauucacuguaucaccaagaaaugcaccaggagaaauuuuauggucagcacccuuaggaccagauuuaaauccuuaccuuucccaucuugcccgaauguauaauggauaugcaggaggauucgaaguacaaguaauacucgccgggaaugccuuuacagcaggaaaaguaauauuugcagcaguucccccaaacuuucccacagaaggucuuucuccuucccaaguuacuauguucccccauauuguaguagacguacgacaacuugaacccguauuaauuccacuaccagauguucgaaauaauuuuuaucauuauaaucaaucaaaugaccccacuauaaaacuaauugcaauguuauauacaccauuaagagcuaauaaugcaggugacgaugucuuuaccguauccuguagaguuuuaaccagaccuucaccagauuuugacuuuauauuuuuaguaccaccaacaguagaaaguagaacaaaacccuucuccguaccaguucuuacuguagaagaaaugacuaacucuagauucccaauaccauuagaaaaauuauuuacaggaccuucuucagcauucgucguccaaccccaaaauggaagaugcacuaccgauggcguauuacuugguacaacacaauuaaguccugucaauauauguacauuuagaggagacguaacacauauaacuggaucaagaaauuauacaaugaacuuagcuucucaaaacuggucaaauuaugauccaacagaagaaauaccagcaccauuagguacuccagauuucguaggaaaaauacaagguguauuaacacaaacaacacgaacagacggaucaacacgaggacauaaagcaacaguauauacagguucugcagacuucgcaccaaaauuaggccgcguacaauucgaaacagauacagaucaugacuucgaagccaaccaaaacacaaaauucacacccguuggaguaauacaagauggaggaacuacucauagaaacgaaccacaacaauggguauuaccaagcuauucgggaagaaauaccccuaauguacaucuagcuccagcuguagcacccacauuuccaggagaacaacuccucuuuuucagaucaacaaugccugguugcuccggcuacccaaauauggacuuagauugucuacuaccacaagaauggguacaauauuuuuaccaagaagcagcaccagcacaaucagauguagcuuuacucagauuuguaaauccagauacaggaagaguuuuauucgaauguaaacuacacaaaucaggauauguaacaguugcacauacaggacaacaugaucuuguuauuccaccaaaugguuauuucagauuugauucauggguaaaccaauucuauacacuagcacccaugggaaacggaacaggaagaagacgagcgcuuuga

SEQ ID NO: 31739 - RNA, 1623 nt, Artificial Sequence
  derived and/or modified sequence opt6 from VP1__Norovirus__AIG60010
augaaaauggcaucaucagacgcaaauccuagcgauggaagugcagcaaacuuaguaccugaaguaaacaaugaaguaauggcauuagaaccaguaguaggagcagcuauagcagccccaguagcgggacaacaaaaugucauagacccauggauaagaaauaauuuuguacaagcaccuggaggagaauucacaguaucccccagaaaugcaccaggagaaauauuaugguccgcucccuuaggaccagaucucaauccauaucucucacacuuagcaagaauguauaacgguuacgcaggcggcuucgagguacaaguaauauuagccggaaaugccuuuacagcuggaaaaguuauauuugcagcaguaccuccaaacuuuccaacugaaggauuaucuccaucccaaguaacaauguucccacacauagucguagacguuagacaacuagaacccguauuaauacccuugccagauguaagaaauaauuucuaucauuauaaccaaucaaaugauccuacaauuaaauuaaucgcaaugcuuuacaccccauuacgcgcaaacaaugcaggugacgauguauuuacaguaucuugccguguacuaacacgaccaucuccagauuuugacuucauauuuuuaguaccaccaacugucgaaucaagaacaaaaccauuuuccgucccaguacuaacaguagaagaaaugacaaacucaagauucccgauuccucuagaaaaacuuuucacaggaccaucaucagcuuuuguaguacaaccccaaaacggacgauguacaacugacggaguacuauuaggaacuacucaauuaucaccaguaaauauaugcacauuuagaggagaugucacacacauaacuggaucuagaaauuauacuaugaacuuagcaucacaaaacuggaauaacuaugauccuacugaagaaauaccagcaccauuaggaacaccugauuuuguaggaaaaauucaaggaguacucacacaaacaacaagaaccgacggaucaacaagaggacauaaagcuacaguauauacaggaucagcagauuuugcacccaaacuaggaagaguacaauucgaaaccgauacagaucacgauuucgaagcaaaucaaaauacaaaauuuacaccuguaggcguuauccaagacggaggaacuacccauagaaaugaaccucaacaauggguacuaccaucauacucaggaagaaauacacauaacguacacuuagcaccagccguagcaccuacuuucccaggugaacaauuauuauuuuuuagaucaaccaugccaggauguucaggguauccaaauauggaucuagauugucuuuuaccccaagaauggguucaauacuuuuaccaagaagcagcuccagcacaaucagauguagcucuuuuaagauucguuaacccagauacuggaagaguuuuauuugaauguaaauuacauaaaucagguuacguuacaguagcacacacugggcaacaugaucugguaauaccacccaacggcuauuuuagauuugauuccuggguaaaucaauuuuauacucuugcaccaaugggcaauggaacuggccgaagacgagcaguauaa

SEQ ID NO: 31740 - RNA, 1623 nt, Artificial Sequence
  derived and/or modified sequence opt6 from VP1__Norovirus__AIG60012
augaaaauggcaucuucagaugcaaacccuagcgaugguucugcagcaaaccucguaccugaaguaaacaaugaaguuauggccuuagaaccaguagucggagcagcaauagcagccccaguagcaggacaacaaaacguaauagacccauggauaagaaauaacuucguacaagcaccagguggagaauucacaguaucaccuagaaaugcaccaggagaaauccuauggucagcaccacucggaccagaccuuaauccauaccuaucccaucuagcaagaauguauaauggauaugcaggaggauucgaaguacaaguaauacuagccggcaaugccuucacugcaggcaaagucauauuugcagccguaccaccuaauuuuccaacagaaggacuaucaccaucacaaguaacuauguucccucacauaguaguagacguaagacaauuagaaccgguauuaauaccucugccagacguaagaaacaauuuuuaccacuauaaccaaucuaaugauccaacaauaaaacuaaucgcaaugcuauacacaccacuuagagcaaacaaugcaggagaugacguauuuacaguaaguugcagagucuuaacaagaccaucaccagauuuugauuuuauauuccucguaccaccaaccguugagucacgcacaaaaccuuucucaguaccuguacuaacaguagaagaaaugaccaauagucgcuucccaauaccacuagaaaaacucuuuacaggacccucaagugccuuuguuguccaaccacaaaauggcagauguacaacugacgguguacuauuaggaacaacacaauuaucaccugucaacauauguacauuuagaggagacguuacacauauaacaggaucuagaaauuauacuaugaacuuagcaucacaaaauuggucaaauuaugacccuacagaagaaauaccagcaccacuaggcaccccagacuuuguaggaaaaauucaaggaguuuuaacccaaaccacaaggacagauggaucuacacgaggacauaaagccacagucuauacaggaagcgcagacuuugcuccaaaacuaggaagaguccaauucgaaacagauacagacagagauuucgaagccaaccaaaacacaaaauucacaccaguagguguaauccaagacggauccacuacucauagaaaugaaccccaacaauggguacuacccucauacucagguagaaauacaccaaauguacaucuagccccugcaguagcaccaacuuuuccaggagaacaauuacucuucuuuagaaguacaaugcccgguugcuccggauauccaaauauggauuuagacugcuuauuaccucaagaauggguccaauauuuuuaucaagaagcagcaccagcacaaucugaugucgccuuauuaagauucguaaaccccgacacagguagagucuuauucgaaugcaaacuccauaaaucaggauauguaacaguugcucauacaggacaacacgaccuagucauaccgcccaaugguuauuuucguuuugacucaugggucaaccaauucuauacacuagcuccuaugggaaaugguacaggaagaagacgagcucuuuaa

SEQ ID NO: 31741 - RNA, 1623 nt, Artificial Sequence
  derived and/or modified sequence opt6 from VP1__Norovirus__AIG60014
augaaaauggcaucaucagaugcuaauccaucugacgguuccgccgcaaauuuagucccagaaguaaauaaugaaguaauggcacuagaacccgucguaggagcagcuauagcagccccuguugccggacaacaaaaugucauugaccccuggauacgaaacaacuuuguacaagcaccagguggagaauuuacaguuucaccaagaaacgcaccaggugaaauauuauggucugcuccucuaggcccagaccucaacccauaucuaagucaccuagcaagaauguauaacggcuacgcuggcgguuucgaaguccaaguaauucuugcaggcaaugcauuuaccgcaggaaaaguaaucuucgcagcaguaccuccaaacuucccuacugaaggauuaucacccucacaaguaacaauguucccacacauagucguagauguucgacaauuagaaccaguacuaauaccccucccagauguccgcaauaacuucuaucacuauaaccaaucaaaugacccaacaauuaaauuaauagcaauguuauacaccccccuuagagcaaacaaugcaggagaugauguauuuacaguaucuuguagaguacuaacuagaccaucccccgauuucgacuuuaucuucuuaguccccccaacagucgaaucaagaacaaagccauuuucaguacccguauuaacaguagaagaaaugacuaauucaagauuuccaauaccauuagaaaaacuauuuacagguccaucuucagcauucguuguucaaccucaaaacgguagguguacaacugauggcguacuacuaggaacaacucaacuaucaccagucaauauaugcacauuuaggggagauguuacacauauuacugguucuagaaauuauacaaugaauuuagcaucucaaaacuggaacaacuacgauccaacagaagaaauacccgcaccuuuaggaacaccagacuucguaggaaaaauacaaggaguucucacacaaacaacaagaacagacgguucaacaagaggacacaaagcaacaguauauacaggcucagcagauuuugccccuaaacuaggucgaguacaauuugaaacagacacagaucaugacuucgaagccaaucaaaauaccaaauuuacaccuguaggaguuauacaagauggaucaacaacacacagaaaugaaccacaacaaugggucuuaccuucauauucaggaagaaauacucacaacguacaucucgcaccagcaguagcaccaacauuuccuggugaacaacucuuauucuuuagaucaacaaugccaggauguucuggauauccaaauauggaucuagacuguuuacuaccucaagaauggguacaauauuucuaucaagaagcagcaccagcacaaagugacguagcccuacuaagauucguuaauccugacacaggacgaguauuauucgaauguaaacuacauaaaucaggauacguaacgguugcucauacuggacaacacgacuuagucaucccaccaaacggauauuuuagauuugacucauggguaaaucaauucuacacauuagccccaaugggaaauggaacaggcagacgucgagcaguauaa

SEQ ID NO: 31742 - RNA, 1623 nt, Artificial Sequence
  derived and/or modified sequence opt6 from VP1__Norovirus__AIG60016
augaaaauggcaucaucagacgcaaauccuuccgacggaucugccgcuaacuuaguaccugaaguaaacaacgaagucauggcucuagaaccuguuguaggagcagcaauagcugcuccaguagccggacaacaaaaugucauugauccauggauaagaaauaauuucguccaagcaccuggaggcgaauucacaguuucucccagaaaugcccccggagaaauauuauggucagcaccauuagguccagaccuuaacccauaccuaucacaccuugcaagaauguauaacggauacgcaggaggauucgaaguacaagucauccuagcaggaaacgcauucacugcuggaaaaguaaucuucgcagcaguuccaccuaacuuuccaacagaaggauuaucucccucacaaguaacaauguucccacacauaguaguugaugucagacaacuagaaccaguuuuaaucccauuaccagauguaagaaauaauuuuuaccauuauaaccaaaguaaugacccaacaauuaaauuaauagcaauguuauacaccccauuaagagcaaacaaugcaggugacgauguauuuaccguuucuuguagaguucucacacgacccuccccagacuuugacuucauauuccuaguaccuccaacaguugaaucucgaacaaaaccauuuucaguaccuguauuaacaguagaagaaaugacaaacucgagauucccuauuccauuagaaaaauuauuuacaggaccuucuucagcuuucguaguacaaccacaaaauggaagauguacaacugacggaguauuacuagguacaacacaauuaagcccugucaauauaugcacauuuagaggagauguuacacauauaacaggcucacgaaacuauacaaugaaccucgcaucucaaaauuggaguaauuacgauccaacagaagaaauuccagcuccacucggaacaccagacuuuguaggaaaaauucaagguguucuuacacaaacaacucgaaccgacggaucaacaagaggacauaaagcaaccguauacacaggcagcgcugacuuugcuccaaaacuagggagaguacaauucgaaacugauaccgaccaugacuucgaagcaaaccaaaacacuaaauucacucccguaggagucauacaagauggauccacaacacaccgaaacgaaccacaacaauggguacucccuuccuacucaggaagaaauacaccuaacguucacuuagccccugcuguagcaccaacuuuuccaggagaacaacuauuauuuuuuagaaguacaaugccuggaugcucagguuacccaaacauggauuuagauugcuuacucccacaagaauggguucaauacuucuaucaagaagcagccccugcacaaucagacguagcucucuuaagauucguaaauccugacacaggaagaguauuauuugaaugcaaacuacauaaaucaggauaugucacaguugcucacacuggacaacacgauuuaguaaucccuccaaacggauauuucagauuugauucauggguaaaccaauuuuacacauuagcaccaaugggaaauggaaccgguagaagaagagcuuuauaa

SEQ ID NO: 31743 - RNA, 1623 nt, Artificial Sequence
  derived and/or modified sequence opt6 from VP1__Norovirus__AIG60018
augaaaauggccucaucagaugcuaacccaagcgauggauccgccgcaaaucuaguaccugaaguaaauaaugaaguaauggcacucgaaccaguaguaggagcagccauugcagcuccugucgcaggacaacaaaacguuauagacccuuggauuagaaauaacuucguacaagcaccaggaggugaauuuacaguaucaccaagaaaugcaccaggagaaaucuuauggucagcuccuuuaggaccagaccucaaucccuaccuaucacauuuagcccgcauguacaacggauacgcaggaggauucgaaguccaaguuauacuagccggaaacgcauuuacagccggcaaaguaauuuuugcagcagucccuccaaacuucccaacagaaggucuaagcccaucgcaaguaaccauguuuccacacauaguaguugauguaagacaauuagaaccaguuuuaauaccauuacccgauguaagaaacaauuucuaucacuauaaucaaucuaaugauccuacaauuaaauuaauagcaaugcuauauaccccauuaagagcuaacaaugcaggagacgauguauuuacaguaucauguagaguccuaacaagaccuucaccagacuuugacuuuauauuuuuaguuccaccuacagucgaaucuagaacuaaaccauuuagcguuccuguccuaacagucgaagaaaugacaaacucuagauuuccuaucccauuagaaaaauuauuuacaggaccauccagugcauuuguuguacaaccucaaaacggucgauguaccacagacggaguauuauuagguacaacucaacuuucaccaguaaacauuuguacauucagaggcgacguaacacauauaacaggaucaagaaacuauacaaugaauuuagcuucacaaaacuggucuaauuacgauccaacagaagaaauaccagcaccuuuaggaacacccgauuucguuggaaaaauacaaggaguauuaacacaaaccaccagaacugauggcucaacccgaggucacaaagcaacaguauauacaggauccgcugacuucgcaccaaaauuaggaagaguccaauuugaaacagacacagacagagauuucgaggcaaaucaaaacacaaaauucacacccguugggguaauacaagauggaucaaccacccauagaaacgaaccucaacaauggguacuaccuucuuauucaggaagaaauacucccaauguacacuuagccccagcaguagcaccaacauuuccaggugaacaauuauuauucuuuagaucaacaaugccaggaugcucaggcuaucccaauauggaccuagauugcuuauuaccacaagaauggguacaauauuucuaccaagaagcagcaccagcacaaucugauguagccuuacuaagauuuguaaauccagauacaggaagggucuuauucgaauguaaauuacauaaauccggauauguuacaguugcacacacuggacaacaugauuuaguaauuccccccaauggauauuucagauuugauucauggguaaaccaauuuuacaccuuagcuccaaugggaaauggaacaggacgaagaagagcauuauaa

SEQ ID NO: 31744 - RNA, 1623 nt, Artificial Sequence
  derived and/or modified sequence opt6 from VP1__Norovirus__AIG60020
augaaaauggcuucaucagaugcuaauccauccgaugggagcgcugcaaacuuaguaccagaaguaaauaaugaaguuauggcucuagaaccuguaguuggagcugcaauugccgcaccaguagccggacaacaaaauguaauagaucccuggauacgcaauaauuuuguacaagcaccuggcggagaauuuacaguauccccacgaaaugccccaggugaaauauuauggucagcacccuuaggaccugaucuaaacccuuaucuaagucaucuagcaagaauguauaauggauacgcugguggauucgaaguacaagucauacuagcugguaaugccuuuacagcagguaaaguuauauuugccgcugucccuccaaacuuucccacugaagguuuaucaccaucucaaguaacuauguuuccacauaucguagucgauguuagacaacucgaaccaguauuaauaccauuaccagacguaagaaacaauuuuuaucauuauaaucaaagcaacgaucccacaauaaaauuaauagcaaugcuauauaccccauuaagagcuaacaaugccggugaugauguauuuacaguuuccugucgaguauuaacaagaccuucccccgauuuugacuuuauuuucuuaguaccuccaacaguagaaucaagaacuaaaccuuuuucaguaccuguauuaaccguagaagaaaugacaaauucacgauuuccaauaccacuagaaaaacuauuuacaggaccauccucagcauuuguaguacaaccacaaaauggacgauguacaacagacggaguucuacuuggaacaacacaacuuucaccuguaaauauaugcacauuucgcggugauguaacccauauaacuggaucgagaaauuauacaaugaaccuagccucacaaaauuggucaaauuaugaccccacugaagaaauuccagcaccucuaggaacuccagacuuugucggaaaaauacaagguguccucacacaaacuacaagaacagacggaucaacaagaggacacaaagcuacaguauauacugguuccgcugauuuugcaccuaaauuaggcauaguacaauuugaaacagauacagaccaugauuuugaagcaaaucaaaacacaaaauuuacaccaguaggaguaauacaagacggaucuacaacacacagaaacgaaccucaacaauggguacuaccaagcuauagcgguagaaauacacccaacguucauuuagcaccugcaguagcuccaacauuuccaggugaacaauuacuauuuuuuagaucuacaaugccaggauguuccgguuauccaaacauggacuuagauuguuuauuaccacaggaauggguacaauauuuuuaucaagaagcagcaccagcucaaucagauguagcauuauugcgauuugucaauccagauacaggacgaguguuauuugaauguaaacuccauaaaucaggauacguuacaguagcacacacuggacaacaugaccuugucauaccaccaaauggauacuuuagauuugauuccuggguaaaccaauucuauacccucgcuccaaugggaaaugguaccgguagaagacgagcccuauaa

SEQ ID NO: 31745 - RNA, 1623 nt, Artificial Sequence
  derived and/or modified sequence opt6 from VP1__Norovirus__AIG60022
augaaaauggcaucaucagaugcaaacccuucagauggaucagccgcuaaccucguaccagaaguuaacaaugaagucauggcucuagaacccguaguaggugccgcaauugcagcaccuguagcaggacaacaaaacguaauagaccccuggauuagaaacaauuuuguccaagccccaggaggugaauuuacaguuucaccaagaaacgcaccaggagaaauauuauggucagcaccuuuaggaccagaucucaauccauacuuaucacaccuugcacgaauguauaacggauacgcaggaggauucgaaguucaaguaauuuuagcaggcaaugcauuuacagcaggaaaaguaauauuugcagcaguuccacccaacuuuccuacggaaggcuuaucacccucccaaguaacuauguuuccucauauaguuguagauguaagacaauuagaacccguauuaauaccuuuaccagauguaagaaauaacuucuaucauuauaaccaaucaaaugauccaacaauuaaauuaauagcaauguuauauacaccacuaagagcaaauaaugcaggagacgacguauucaccguaucauguagaguauuaacuagaccaucuccugauuucgauuucauauuucugguaccaccaaccguugaaucuagaacaaaacccuucucaguaccuguauuaacaguagaagaaaugaccaacagucgauuuccaauaccauuagaaaaacuauuuaccggucccucaucagcauucguaguccaaccacaaaacggaagaugcaccacagacggaguauuacuaggcacaacccaauuaucaccaguaaauaucugcacauuuagaggagacguaacacacauuaccgguucacgaaacuacacgaugaaucuagcaucccagaauuggagcaauuacgacccaacugaagaaauaccagccccgcuaggaacaccagauuuuguagguaaaauucaagguguacucacacaaacaacuagaacagaugguucaacaagaggacauaaagcaacaguauauaccgguucagcagacuucgcaccuaaacuaggacgaguccaauucgaaacagacacugacagagacuucgaagcaaaucaaaauaccaaauuuacaccaguagguguaauacaagacgggucuacaacacaucgcaaugaaccucaacaauggguacuacccucauacucaggacguaauacaccaaauguacaucuggcaccugcaguagcaccaacauuuccaggugaacaauuacuuuucuucagaucaacgaugcccggaugcucuggauacccuaauauggaucuagauuguuuauuaccucaagaauggguucaauacuucuaccaagaagcagcacccgcacaaagcgauguagcauuauuaagauuuguuaauccugacacagguagaguacuauucgaaugcaaauuacacaaauccggauauguaacaguagcacacaccggacaacaugaccucguaaucccacccaacggauauuuuagauucgauagcuggguaaaucaauuuuacacacuugcaccaaugggaaacggaacaggaagaagacgagcacuauaa

SEQ ID NO: 31746 - RNA, 1623 nt, Artificial Sequence
  derived and/or modified sequence opt6 from VP1__Norovirus__AIG60024
augaaaauggcaucaucagacgcaaauccaagugacggaagcgcagcuaacuuaguaccagaaguuaauaacgaaguaauggcacuagaaccaguuguaggggcugccauagcagcaccaguagcaggacaacaaaacguuauagacccauggauuagaaacaacuuuguacaagcaccaggaggagaauuuacaguauccccuagaaacgcgcccggagaaaucuuaugguccgccccccuagggccagacuuaaauccuuacuuaucacacuuagcaagaauguauaauggauacgcuggcggcuuugaaguacaaguaauacuagcuggaaaugcauuuacagcaggcaaaguaauauucgcagcaguaccaccaaauuuuccaacagaaggauuaucaccaagucaaguaacaauguuuccccauauaguaguagauguaagacaacuagaaccaguuuuaauaccauuaccagauguacguaacaauuuuuaucauuauaaccaauccaaugacccaacaauaaaauuaauagcaaugcuauauacuccucuaagagcaaacaaugcaggagaugauguauuuacaguaucauguagaguacuuacucgcccaucaccagauuuugauuucauauuuuuaguaccuccaacaguugaaaguagaacuaaaccauucaguguaccuguccuaacagucgaagagaugacaaacuccagauuuccaauuccuuuagaaaaacuauucacagguccaucaagugcauuuguaguacaaccacaaaacggacgaugcaccacugauggaguacucuuaggaacaacgcaauuaucacccguaaauauaugcacuuuuagaggagauguaacacacauaaccggaucuagaaauuauacaaugaaucuugcaucacaaaacuggaacaauuaugacccaacagaagaaauaccagccccucuaggaacaccagauuuuguggguaaaauucaaggcguuuuaacacaaaccacaagaacagauggcuccacacgaggacauaaagcaacgguauauacuggauccgcugauuuugcaccaaaacuaggcagaguacaauucgaaacugacacagaucaugauuucgaagcaaaucaaaauacaaaauuuacaccuguaggaguaauucaagacggcggaacaacacauagaaaugaaccacaacaauggguccuaccaucauauucaggacguaacacacacaauguucacuuagcacccgcaguagcacccacuuuuccaggagaacaauuauuauucuuuagaucaacuaugccaggaugcuccggcuauccaaauauggauuuagacugucuacuaccacaagaauggguacaauacuucuaucaagaagcagcaccggcacaauccgacguagcauuacuacgauucguuaacccugauaccggcagaguacuuuuugaauguaaacuacauaaaucuggcuauguaacaguugcacacacaggacaacacgaucucgucauuccaccaaacggauacuucagauucgauucauggguaaaucaauucuacacccuugcuccaauggguaaugguacaggacgaaggagagccguauaa

SEQ ID NO: 31747 - RNA, 1629 nt, Artificial Sequence
  derived and/or modified sequence opt6 from VP1__Norovirus__AII73717
augaaaauggcaagcaacgacgcugcuccauccaacgacggagcagcgaguuuaguccccgaaggaauaaaugaaaccaugcccuuagaacccguugcaggugcaucuauagcagcaccaguagcaggacaaacaaacauaauagacccauggauacgaacaaacuuuguacaagccccaaauggagaauuuacuguaucaccuagaaauucaccaggagaaauauuacuaaaccuagaauuaggcccagaucuaaacccauaucuagcacaccuuucuagaauguauaaugguuaugcagguggagucgaaguacaaguucuuuuagcaggaaacgccuuuaccgcaggaaaaauuuuauuugccgcaauaccaccaaacuucccagucgacaugauaaguccagcacaaaucacaaugcuuccucaccucaucguagauguaagaacucuagaaccuaucaugauucccuuaccagacguaagaaauguuuucuaucauuuuaacaaccaaccccaaccacgaaugagauuaguagcaaugcuuuacacuccauuaagauccaauggaucaggagacgauguauucacagucuccuguagaguacuaacacgcccuacaccagacuuugaauuuauauaccuaguuccaccauccguugaaucaaaaacuaaaccuuucacccuacccauacucacuaucagugaauuaaccaacucacguuuuccaauaccaauagaacaacuauauacagcuccaaacgaaacaaauguuguacaaugucaaaauggaagauguacuuuagacggugaauuacaagguacaacacaacuacuaucaucugcaguaugcucauaccgaggaagaaccgucgcaaacaacggagauaacugggaccaaaaucuacuacaacuaaccuacccaaauggugccucauaugauccaacagacgaagucccagccccauuaggaacacaagacuuuuccggaaugcuauacgguguacuaacucaagacaacgucaauguaucaacuggugaagcaaaaaacgccaaaggaauuuauauaucaacuacaucaggaaaauucaccccaaaaauagguucaauuggcuuacauuccauaacagaacauguacauccaaaucaacaaucucgcuucacuccuguaggaguugccguaaaugagaacacaccauuccaacaauggguucuaccccauuacgcaggaucacuugccuuaaacacaaauuuagcaccagcagucgcaccaaccuuuccuggagaacaacuacuuuuuuuccguagucguguaccaugcguccaaggacuucaaggccaagacgcauuuauagauugccuccuaccacaagaauggguaaaccacuuuuaucaagaagcagcacccucacaagcagaugucgcacuaauacgauauguaaacccagacacaggccgaacacuuuucgaagcaaaacuacaccgaucuggauucauaacaguaucacacacuggcgcauauccauuaguuguaccaccaaauggacacuucagauuugacucauggguaaaucaauucuauucacuagcaccaaugggaaccggcaacggacgacgaagaauacaauaa

SEQ ID NO: 31748 - RNA, 1623 nt, Artificial Sequence
  derived and/or modified sequence opt6 from VP1__Norovirus__AII73720
augaaaauggcaagcaacgacgcaacacccucaaaugauggagcagcugguuuaguaccagaaucaaauaaugaagcuauggcauuagaaccaguuguaggugcaucacuugcagcacccguaacaggccaaacuaacauaauagauccuuggauaagaacaaacuuuguucaagcaccaaauggagaauuuacagucucuccacguaauuccccuggagaaauacuaguuaaccuagaacuaggaccagaauuaaauccauacuuagcccaccuugccagaauguauaacgguuaugcaggaggaauggaaguacaagucaugcuagcuggaaaugcguuuacugcuggaaaaauaauauucgcagcgguaccaccauauuuccccgucgaaaaucuaucuccgucacaaauaacaauguucccacauguaauaguagauguaagaacauuagaaccaguacuauuaccuaugccagauguaagaucuacauuauuucauuuuaaucaaaaagacgaaccaaaaaugagauuaguagcaauguuauauacaccacucagaucaaacggaucaggagacgauguauuuacagucaguugucgcauacuaacuagaccaagccccgaauuugacuuuacauauuuaguaccaccaacaguagaaucaaaaacaaaaccauuuacccuaccuguccuaacacucggugaauuaucaaauucaagauuccccuuaucaauugaugaaaugguuacaagcccaaaugaaucaauaguaguacaaccucaaaacggcagaguaacauuagauggagaauuacuaggaacaacacaacuacaagcauguaauauaugcucaauaagaggaaaaguaacuggacaaguacccaaugaacaacacauguggaaucuugaaauaacuaacuuaaacggaacacaauucgacccaacagacgacguacccgcuccacuaggagucccagacuucgcaggugaaguuuuuggaguauuaucccaaagaaauagaggugaaucaaaccccgcaaaucgagcacacgaugcaguaguagcaacauauucagauaaauacacaccuaaauuaggacucguacaaauuggaacauggaauacaaaugauguugaaaaccaaccaacuaaauuuacacccauaggucuaaacgaaguagcaaauggacacagauuugaacaguggacccuacccagauauucaggugcccuaaccuuaaauaugaauuuagcaccagccguagcaccacuauuuccaggugaaagacucuuauucuucagaaguuauguucccuuaaaagguggauucggaaauccagcaauagauugcuuagucccucaagaauggguucaacauuuuuaucaagaaucagcuccuucauuaggugacguagcuuuaguaagauacguaaaccccgacacaggaagaguauuauuugaagcaaagcuacauaaagguggauuuuuaacuguaucaucaacaucaacaggcccuguaguaguacccgcaaacggauacuuuagauucgauaguuggguaaaucaauuuuacucauuagcaccaauggggacaggaaacggaagaagaagauuccaauaa

SEQ ID NO: 31749 - RNA, 1611 nt, Artificial Sequence
  derived and/or modified sequence opt6 from VP1__Norovirus__AII73723
augaaaauggcaucaaaugaugcaacaccuucagacgacggagccgcuggauuaguacccgaaauaaauagugaaguaauggcacuagaaccagucgccggcgcaaguaucgcugccccaguaguuggacaacaaaauauaauugacccauggauaagaaauaauuuuguucaagcaccagcuggagaguucaccguuuccccgagaaacucaccaggagaauuauuacuugaccuagaauuaggaccagaacuaaacccauauuuagcucacuuagcaagaauguauaauggacacgccggcggaauggaaguccaaauaguacuagcaggaaacgcauuuacugcuggaaaaauccuuuuugcugcuauuccuccauccuuuccauaugaaaaucucucaccagcccaauuaacaauguguccucacguaauaguagauguacgacaacuagaaccaguacuacuuccaaugccagacauaagaaauguauuuuaccauuauaaccagaacaauucaccaaaguuaagauuagucgcuauguuauauacaccacuuagagccaacaacucaggugacgacguauucaccguaucuugcagaguucuaacuagaccaucaccagauuuucaauuuacauuuuuaguaccucccacaguugaaucuaaaacuaaaaacuuuacauuaccaguauuaagaguauccgaaaugacaaacucaagauuuccagucguauuagaccaaauguauacuuccagaaaugaaaauauaauaguacaaccucaaaauggaagauguacaacagauggagaauuauuagguacuacuauacuucaaucaguaucaaucuguaacuuuaaagguacaaugcaagcaaaauuaaacgaagaaccaagauaucaauuacaacuaacaaauuuagauggaucaccuauagacccaacagacgacaugccagcaccauuaggcacuccagacuuccaagcugucuuauauggaguagcaucucaaagaucaucacgagauaaugcuacccgagcacaugaugcacaaauugacacagcaggagauacauucgcaccaaaaauaggccaaguaagauuuaaaucuagcucaaacgacuuugaucuacaugauccaacaaaauuuacuccaauaggcguuaacguugacgaucaacacccuuucagacaauggucauuaccaaauuauggaggucacuuagcacuuaacaaucacuuagcucccgcaguuaccccacuauucccaggagaacaaauacucuuuuuuagaagcuauauaccaucagcaggaggacauacagauggugcuauggauugccuacuaccccaagaauggguagaacauuucuaucaagaagcagcuccaucacaaucugacauugcauuaguaagauuuauuaauccugacacugguagaguuuuauucgaagcaaaacuucacaaacaaggauuccuuacuauagcugcaucuggagaucacccaauaguaaugccaacaaacggcuacuuuagauuugaagcauggguaaaccccuuuuacacacuagcgccagucggaacaggaucaggccgacgaagaauacaauaa

SEQ ID NO: 31750 - RNA, 1623 nt, Artificial Sequence
  derived and/or modified sequence opt6 from VP1__Norovirus__AII73726
augaaaauggcaucaucagacgcaaacccuucagauggaucugcagcuaaucuaguaccagaaguuaacaaugaaguaauggcacucgaaccaguaguaggagcagcaauagcagcaccaguagcuggacaacaaaacguuauugauccauggauaagaaauaacuuuguacaagcaccagguggagaauuuacaguuucaccuagaaaugcaccaggagaaauauuauggucagccccucuuggaccagauuuaaauccauaccucagucauuuagcaagaauguauaacggauaugcaggcgguuucgaaguacaaguuauacuagcaggaaaugcauucacagcaggaaaaguaauuuuugccgcaguaccaccuaacuuuccaacugaaggauuaagcccuucccaagucacaauguucccacacauaguaguagacguacgccaacucgaaccaguacuaauuccauuaccagacguacgcaauaacuuuuaucacuauaaucaaucaaacgauccaacuauaaaacuaauagcuauguuauauacuccauuaagagcaaacaaugcaggagaugaugucuucaccguaucuuguagaguuuuaacacgaccaucacccgauuuugauuuuauuuuucuaguuccaccaacagucgaaucaagaacaaaaccauucucaguaccaguacucacuguugaagaaaugacuaauucaagauucccaauaccauuagaaaaacuauucaccggaccaucuucagcauucguuguacaaccccaaaacgguagauguacuacagacggaguauuauuaggaacaacccaacugucaccaguaaauauauguaccuuuagaggugacguuacacauauuaccggaucucgaaauuacacaaugaaccuagcaucacaaaacugguccaauuacgacccaacugaagaaauaccagcaccauuaggaacuccggacuuuguagguaaaauacaaggaguuuuaacacaaacaacaagaacugacggaucaacaagaggccauaaagcaacagucuauacaggaucagcagacuuugcaccaaaacucggacguguacaauuugaaaccgacacagacagagauuuugaagccaaucaaaauacaaaauucacuccaguagguguaauacaagacggaucaacuacacaucgaaaugaaccacaacaauggguacuaccaucauacagugguagaaauaccccaaauguacaccuagcacccgcagucgcaccuacauuuccaggagaacaauuauuauucuuccgcucaacuaugccaggauguagcggauacccaaauauggauuuagauugcuuauuaccucaagaauggguacaauauuucuaucaagaagcagcaccagcccaaucagacguagcauuacuacgauuuguaaacccagauacaggaagaguacuauuugaaugcaaacuacauaaaucaggauacguuacagucgcacauacaggucaacacgaucucguuauaccuccaaauggauauuuuagauucgauucauggguaaaccaauucuauaccuuagcaccaauggguaauggaacaggaagacguagagcauuauaa

SEQ ID NO: 31751 - RNA, 1623 nt, Artificial Sequence
  derived and/or modified sequence opt6 from VP1__Norovirus__AII73729
augaaaauggcaucuucagacgcaaaccccucagauggauccgcagccaacuuaguuccagaaguaaacaaugaaguuauggcauuagaaccaguuguaggagccgcaauagcagcacccguugcaggacaacaaaauguaaucgacccauggauaagaaauaauuucguacaagcaccaggaggagaauucacaguaucaccaagaaaugcaccaggugaaauacuaugguccgcaccauuaggaccagaucuaaauccauaucuuucacacuuagcaagaauguauaacggcuacgcaggaggcuuugaaguacaaguuauacuagccggaaacgcuuuuacagccgguaaaguuauauuugcagcuguaccaccaaacuucccaacagagggucuaucuccaucacaaguaacaauguuuccucacauaguagucgacguacgacaacuagaaccaguuuuaaucccccuaccagauguaagaaauaauuuuuaccacuauaaccaaucaaaugauccaacaauaaaacuaauagcaaugcuauacacaccauuaagagcaaacaaugccggugaugauguauuuacaguuucauguagaguacuaacaagaccuucacccgauuuugauuucauauucuuagucccaccuacuguagaaucaagaacaaaaccuuucucuguaccagucuuaacaguugaagaaaugacaaacucaagauuuccaauaccccuugaaaaauuauucaccgguccaucuucagccuucguaguccaaccacaaaauggaagauguacaacagauggaguacuacuaggaacaacacaauuaucuccaguaaauauauguacuuuuagaggagacguaacacacauaacaggcucacgaaauuacacaaugaaccuugcaucccaaaacuggucaaauuaugaccccacagaagaaauaccagcuccacuaggcaccccagauuuuguaggaaaaauucaagguguauuaacucaaacaacuagaacagacggaucaacacgaggucauaaagcaacuguauauacagguucagcagauuucgcccccaaacucggccgaguucaguuugaaacagauacagauagagauuucgaagcaaaucaaaauaccaaauuuacuccagucggcguaauacaagauggaucaacuacccauagaaaugaaccacaacaauggguacuaccuuccuauuccgguaggaacacaccaaauguucauuuagcaccagcaguagcaccaaccuuuccaggugaacaauuacuauucuucagaucaacaaugccaggcugcucuggauauccuaauauggaucuagauugucuccuuccccaagaguggguucaauauuucuaucaagaagcugcuccggcucaaucagauguugcauuacuaagauucguaaauccagacacaggcagaguauuauucgaaugcaaacuucacaaauccggauacguaacagucgcacacaccggccaacaugauuuaguuauaccuccaaauggauauuuccgauuugauaguuggguaaaccaauuuuauacacuagcaccaauggguaacgguacaggaagaagaagagcccuauaa

SEQ ID NO: 31752 - RNA, 1623 nt, Artificial Sequence
  derived and/or modified sequence opt6 from VP1__Norovirus__AII73732
augaaaauggcaucuuccgacgccaacccuucugacggaucagcagcuaacuuaguaccagaaguuaauaaugaaguaauggcuuuagaaccaguaguaggugcagcaauagccgcaccaguagcuggacaacaaaauguaauagacccuuggauaagaaauaacuuuguacaagcacccggaggugaauucacaguaucaccacgaaacgcaccaggagaaauacuauggucagcuccacuaggaccagacuuaaaucccuacuuaucccacuuagcaagaauguauaacggcuacgccggcgguuuugaaguacaaguaauauuagcaggaaaugcauuuacagccggaaaaguuauauucgcagcaguucccccaaauuuuccaacugaaggauuaucuccaucacaaguaacaauguuuccacauauaguuguagauguaagacaauuagaaccaguuuuaauaccauuaccagaugucagaaauaacuucuaucacuauaaccaaucaaaugauccaacuauuaaacuaauagcuaugcucuacacaccuuuaagagcaaacaaugcaggagaugauguauucaccgucucauguagaguuuuaacaagacccucuccagauuucgacuucauauuuuuaguaccuccuacuguagaaucaagaacaaaaccauucucaguaccuguacucacaguagaagaaaugacaaacucuagauucccaauaccucuagaaaaacuauuuaccggaccaucaucagcauuuguaguccaaccucaaaacggacguuguacaacugacggaguucuauuaggaacaacacaacucucaccaguuaauauuugcacauuucgaggagauguuacacacauaacuggaucacguaacuacacaaugaaucuagcaucucaaaauugguccaauuacgauccaaccgaagaaauaccagcucccuuaggaacaccugauuuuguaggaaaaauucaaggaguacuaacacaaaccacucgaacugauggaucaacaagaggucauaaagcuacaguauauacugguucagcugauuucgcaccuaaauuaggacgaguacaauuugaaacugacacugauagagauuuugaagcaaaucaaaauacaaaauucacaccuguuggaguuauucaagauggaucuaccacacauagaaacgaaccccagcaauggguauuaccaucauauucuggaagaaacacaccaaacguacacuuagccccagcaguagccccaacauuuccaggagaacaauuauuauucuuuagaaguacaaugccagguuguucaggauauccuaauauggaucuagauuguuuauuaccacaagaauggguacaauacuuuuaccaagaagccgccccagcucaaucugaugucgcacuacuuagauucguaaauccugacacaggaagaguauuauuugaaugcaaacuacauaaaucuggauaugucaccguagcacauaccggccaacaugaccuaguuauaccaccaaauggauauuuuagauuugacagcuggguaaaccaauucuacacuuuagccccaaugggcaacgguacuggccgcagaagagccuuauaa

SEQ ID NO: 31753 - RNA, 1608 nt, Artificial Sequence
  derived and/or modified sequence opt6 from VP1__Norovirus__AII73735
augaaaauggcuucuucagaugcagcacccucuaaugacggagccgcaggucuagucccagaagcaaauaaugaaacaauggcacuagaaccuguagcaggugcaucaauagcugcaccacucacaggucaaaauaacauaauagauccauggauccgacuuaacuucguucaggccccaaauggagaauuuacugucucuccacgcaacucaccaggugaaguacuacuaaacuuagaacucggcccagaacuuaacccuuacuuagcacauuuaagcaggauguacaauggcuaugcagguggaguugaaguacaaguauuauuagcaggaaacgcauucacugcaggaaaacuugucuuugcagccguaccaccacacuuuccauuagaaaacauaucuccaggacaaauaacaauguucccacauguuauaauagauguaagaacuuuagaaccaguacuucuaccacuaccugacguaagaaauaacuuuuuccauuauaaccaacaaaaugaaccaagaaugagacucgucgcaaugcuuuauacuccuuuacgcucaaacggauccggagaugacguauucacaguuucaugcagagucuuaacaagaccaucaccagauuuugacuuuaauuauuuaguaccuccaaccguugaaucaaaaacuaaaccauuuacccuaccaauacuaacuauaggagaacuaacuaauuccagauuuccaguaccaaucgacgaacuauauacaucuccuaaugaaucauuaguaguacaaccacaaaauggaagaugugcauuagauggugaauuacaagguacaacacaauuacuaccuacagccauauguucauuuagaggucgaauaaaccaaaaaguauccggugaaaaucauguauggaacaugcaaguaacaaauauuaauggaacaccauucgauccaacagaagacguaccagcuccucuaggaacccccgacuucucaggcaaacucuuuggaguauuaucacccagagaccaugacaaugcaugccgaucacaugaugcagucauugcaacaaacucagcaaaauucaccccaaaauuaggugcaauacaaaucggaacaugggaagaaaaugacguacauauuaaccaaccuaccaaauuuacaccuguaggacuauuugaagaugaaggauuuaaucaauggacauuaccaaacuauucaggagccuuaaccuuaaacaugggauuagccccaccaguagcaccaaccuuucccggugaacagauacuauuuuuccgaucacacauuccauuaaaaggcggaguagccgacccagucauagauugucuauuaccacaagaauggauacaacacuuauaccaagaaucagcaccgucccaaucagauguugcacucauuagauuuacuaacccagacacaggaagaguacuuuucgaagcuaaacuacaccggucaggauacaucacaguagccaauacuggaucaagaccuauaguagucccagcaaauggauauuucagauuugacucauggguuaaucaauuuuacucacuagcaccuauggguacugguaauggacgccguagaguacaauaa

SEQ ID NO: 31754 - RNA, 1623 nt, Artificial Sequence
  derived and/or modified sequence opt6 from VP1__Norovirus__AII73738
augaaaauggcaagcucagaugcaaauccuucagacgguucagccgcaaaccuaguacccgaagucaauaaugaaguuauggcacucgaaccagucguaggugcagcaauagcugcaccaguagcaggacaacaaaacguuauagacccauggauaagaaauaauuuuguacaagccccgggaggugaauuuacaguuuccccaagaaaugcaccaggagaaauucuuuggucagcaccauuaggaccugaucuaaauccuuauuuaucacacuuagcaagaauguacaacggauaugcaggaggauuugaaguccaaguuauacuagcaggaaaugcauuuaccgcaggaaaaguaauauucgcagcuguucccccuaauuuucccaccgaaggauuaucaccaucacaaguaacaauguucccacacauagucguagacguuagacaacuugaaccaguuuuaauaccuuuacccgacgucagaaauaauuucuaccacuacaaccaaucaaaugaccccacuauaaaacuaauagcaaugcuauacacaccauuaagggcaaacaaugcaggagaugaugucuuuacaguuucaugcagagucuuaacacgaccuagcccagauuucgacuuuauauuuuuaguaccaccaaccguugaauccagaacgaaaccauucucaguuccuguacucacaguagaagaaaugacaaacucaagauuuccaauaccauuagaaaaauuauuuacaggaccaucaucagcauuuguaguccaaccucaaaauggacgauguacaacagacggaguauuauuagguacaacacaauuaucaccaguuaauauaugcacauuucgaggugacguaacccacauaacuggaucacguaacuauacuaugaauuuagccucccaaaacuggaauaauuaugauccaacagaagaaauacccgcaccacuaggaacgccagacuuuguaggaaaaauacaaggaguacuuacacaaacaacacgaacagauggaucaaccagaggucacaaagcuaccguauacacaggaagugcagacuuugcuccaaaacucggaagaguucaauuugaaacagauacagaccacgauuuugaagcaaaucaaaauacaaaauuuacaccagucggaguaauacaagauggagguacuacucauagaaaugaaccacaacaauggguauuaccaaguuauucuggaagaaacacacacaauguacauuuagcaccagccguagccccaaccuuuccaggugaacagcuauuguucuuccgaucaacaaugccuggauguucaggauaccccaacauggaucucgauugucuucuaccacaagaauggguacaauauuucuaccaagaagcugcacccgcacaaucugacguugcauuacuaagauucguaaacccagacacaggacguguauuauuugaauguaaacuccauaaaucaggauacguaacaguagcucauacaggacaacaugaucuuguuauuccaccuaauggauauuucagauucgauucuuggguaaaucaauuuuacacacucgcaccaauggguaauggaacuggccgaagaagagcugucuaa

SEQ ID NO: 31755 - RNA, 1620 nt, Artificial Sequence
  derived and/or modified sequence opt6 from VP1__Norovirus__AII73741
augaaaauggcuucaaaugacgcugcaccaaguaaugacggagccacuggacuuguaccagaaauaaacacagaaacacucccucucgaaccaguagcaggagcugcaauugcagccccuguaacaggacaaaacaauauaaucgacccuuggauuagaaacaacuuuguacaagccccaaauggcgaauuuacaguaucuccaagaaacucccccggcgaaauacuaaugaauuuagaacuuggaccagaucuaaaucccuauuuagcucauuuauccagaauguauaacggauacgcaggaggaguagaaguacaaguacuuuuagcagguaacgcuuuuacagccgguaaaauauuauucgccgcagucccuccuaauuucccuguagacaugcuaucccccgcacaaauaacaauguuaccccauuuaauaguugacguaagaaccuuagaaccaauaaugauacccuuaccagacguaagaaacguauucuaucacuuuaacaaucaacccgcacccagaaugcgacuaguagcuauguuauacacaccucuaagaucuaacggcucaggcgaugacguauuuacaguaucauguagaguacuuacaagaccaacuccugacuuugaauuuacauaucucguaccaccaagcguagaaucuaaaacaaaaccuuucacauuaccuaucuuaacaauaggagaacuaacaaacucaagauuuccagcaccaauagaccaacucuauacauccccaaacgcagauauaguaguccaaccacaaaacggacgauguacauuagacggcgaauuacaaggaacaacucaauuauuaaccacugcuauauguuccuauagaggaaugaccucaaauccaaccuccgacuacugggacgaucauuuacuacaccuuguacacccuaacggcgcaacauacgaccccacagaagauguaccagcaccauuuggcacacaagacuucagaggaauccuauauggcauguuaacacaaaacccuagaacaucaggagaugaagcagcaaacucucacggaauauacaucucaagcacaucugaaaaauucacuccuaaauuaggaacuauaggacuccaucaaguucaaggagacauugcaucaaaccaacaauccaaauuuacaccaguaggaauagcaguaaacggaaauacaccauuccgacaaugggaacuaccuaauuauucaggugcacucaccuuaaacacaaaucucgcuccagcuguaggaccaaacuuucccggcgaacaaauacucuuuuuccgaucaaauguuccaucaguacaagguggucaaccaaucgaaaucgacugcuuaauaccacaagaauggguaucccacuucuaccaagaaucugcaccuagucaaucugauguagcauuaguuagauauguaaauccugauacuggacgcacaauauucgaagcaaaacuacaccgacaaggauucaucacuauugcagccacaggaucaaauccaguaguagucccaccaaacggauacuuccgauucgacuccuggguaaaccaauucuacgccuuagccccgaugggaacaggcaauggacgccgcagaguacaauaa

SEQ ID NO: 31756 - RNA, 1623 nt, Artificial Sequence
  derived and/or modified sequence opt6 from VP1__Norovirus__AII73744
augaaaauggccucaucagacgcaaauccuagcgauggaucaacugcaaacuuagucccagaagucaacaacgaaguaauggcauuagaaccagucguaggugcagcuaucgcagccccagucgcaggacaacaaaauguaauagauccuuggauacgaaauaacuucguacaagcaccaggaggugaauuuacaguaucaccuagaaaugcaccaggagaaauucuauggucagccccucucggcccagauuuaaacccauauuuaucucauuuagccagaauguauaaugguuacgcaggaggauuugaaguccaagucauacuagcuggaaacgccuuuacugcagguaaaauaauuuucgcugcaguuccaccaaacuucccaacugaaggacucucaccaucacaaguaaccauguucccacauauaauuguugacguaagacaacuagaaccaguauuaauaccacucccagaugucagaaacaauuuuuaccauuauaaucaaagcaaugacucaacaauuaaauuaaucgccaugcuuuauacaccacuaagagcaaacaaugcaggagacgauguuuuuacuguaagcugcagaguucuaacaagacccaguccagacuucgauuucauauuccuaguaccuccaacaguagaaucccgaacaaaaccauuuucaguaccaguacuuacaguagaagaaaugacuaauucucgauuuccaauaccacucgaaaaacuauucacagguccaucaucagcauuuguaguacaaccacaaaacggccgcuguaccacagacggaguauuacuaggaacuacacaauuaucaccaguaaauauuuguaccuucagaggagacguaacacauauccccggaucacgaaauuacacaaugaaucucgccucacaaaacuggaauaguuacgaucccacagaagaaauuccagccccauuaggcacacccgacuuuguaggaaaaauacaaggcguacuuacucaaacaacaagaacaaacggaucaacaagaggucacaaagcaacaguauauacuggauccgcagacuuuucaccaaaacuaggccgcguccaauucgcaacagauaccgauaacgauuucgaaaccaaucaaaauacuaaauuuacuccagucggaguaauacaagacgguagcaccacaccaagaaacgaaccacaacaguggguauuacccucauauaguggacgaaauauacauaauguacaccuagcaccagcaguugcuccaaccuuccccggagaacaauuauuauucuuuagaucaacaaugccagguuguucagguuauccaaauauggauuuagauugccuccucccacaagaauggguacaauauuuuuaucaagaagccgcacccgcacaaucagacguugcccuauuaagauucguuaacccagacacaggaagaguuuuauuugaaugcaaauuacauaaaucaggauauguaacaguagcacacacaggccagcacgaucuaguuauaccacccaauggauauuucagauuugacucauggguaaaucaauuuuacacacucgcaccaaugggaaauggaacuggucguagaagagcauuauaa

SEQ ID NO: 31757 - RNA, 1623 nt, Artificial Sequence
  derived and/or modified sequence opt6 from VP1__Norovirus__AII73747
augaaaauggcaucaaacgacgcggcucccucaaaugacggagcuacaggacuaguacccgaaauaaauaacgaaacauuaccacuagaaccaguagccggagcagcuaucgcagcaccaguaacaggacaaaacaauauaauagacccauggauaagaacaaacuucguacaagcaccaaauggagaauucacaguauccccaagaaacucaccaggugaaauauuacuuaaccuagaacuaggaccagacuuaaaccccuacuuagcacacuuaucacgaauguacaacggauaugcaggggguguagaaguacaaguucuacuagccggaaaugcauucacagcugguaaaauacuuuuugcagcaguaccaccaaacuucccuguagaauuucucucaccagcacaaauaacaaugcuaccacaucuaauaguagacguaagaacuuuagaaccuauuaugauaccacuaccagauguaagaaauacauucuuucacuacaacaaccaaccagcaaacagaaugagauuagucgcuauguuauauacacccuuacgcucaaacggaucuggcgacgauguauucaccguaucauguagaguacuaacaagaccuacaccagauuucgaauucacuuaccuagucccaccaaguguagaaucaaaaacaaaaccuuucucauuaccaauauuaacaauaucugaacuaacaaauagucgauuuccagccccuauagacucacuuuuuacagcucaaaacaacaaccuuaacguacaaugucaaaauggcagaugcacucucgacggagaauuacaaggcaccacccaacuauuaccaagcggaaucugugcauucagaggaagacuuacagcagacguagauggcucucacgacgaccgauggcacaugcaauuaacaaacuuaaacggaaccccuuuugacccaacagaagacguacccgcaccccucgguacaccagacuucacaggucuacuauuuggaguagccucacaaagaaauguaggcuccaacccaaacacaacuagagcacacgaagcaguuauaucaacaaccucaucacaauucguacccaaacuaggaucaguaaauuuuggcuccacuucaacagauuuccaacuccaacaaccaaccaaauucacaccaguugggauaaaaauagaauccggccacgaauucgaucaaugggcacucccaagauacucaggacaccuaacuuuaaacaugaaccuagcuccgccuaucgcaccuaacuuuccaggcgaacaacuauuauuuuuccguucaaauguaccaugcgcaggaggaguuucagauggaguuaucgauugccuucucccacaagaauggauacaacacuucuaucaagaaucggcacccucacaaucagacguagcauuaaucagguaugucaaucccgauaccggaagaacuuuauucgaagcaaaacuccacagaacagguuauauaacaguagcucacucaggagacuacccauuagucguaccaucaaacggcuacuuucgauuugacucaugggucaaccaauucuacucacuagcaccaaugggcacaggaaauggaagaagaagaguacaauaa

SEQ ID NO: 31758 - RNA, 1623 nt, Artificial Sequence
  derived and/or modified sequence opt6 from VP1__Norovirus__AII73750
augaaaauggcauccucagacgcaaacccaucagaugguucuacagcaaauuuaguaccugagguaaacaaugaaguuauggcacucgaaccaguaguaggagcagcuauagcagccccagucgcuggacaacaaaauguuauugauccauggauucgaaauaauuucguucaagcaccuggaggcgaauuuacagucucucccagaaaugcuccaggagaaauuuuauggucagcaccauuaggaccagacuuaaauccauacuuaucccaucuagcaagaauguacaauggucaugcagguggauuugaaguccaaguuauucuggccggaaaugcauuuacagcuggaaaaauaauuuuugcggcaguuccuccuaauuuuccaaccgaaggcuuaaguccaucccaaguuacuauguucccacauauaauaguagauguaagacaacuagaaccaguauuaauaccccuaccagauguacgaaauaauuucuaucacuacaaccaaucaaaugauucaacuauaaaacuaauagcaauguuauacacaccauuacgagcaaauaaugcuggagaagacguuuuuacagucucauguagaguucuaacaagaccuucaccugauuucgacuucauauuucuaguacccccaaccguagaaucacgaacuaaaccauuuacaguaccaauacuaacaguagaagaaaugacaaacucaagauuuccuauuccauuagaaaaacuauuuacaggcccuuccuccgcauucguaguacaaccccaaaacggacgauguacuacagacgguguauuacuaggaacaacucaauuaucacccguaaauauuugcacauuuagaggugaugucacacauauagccggaucaagaaauuauacuaugaaucuagcaucacuuaacuggaauaauuaugauccaaccgaagaaauaccagcaccuuuaggaacaccugacuuuguagguaaaauucaaggaguacuaacacaaacaaccaaaggugauggaagcacacgaggucacaaagccacaguauauacaggcucagcuccauucacaccaaaacuuggaucaguccaauucucaacagacaccgaaaacgauuucgaaacacaucaaaacacuaaauucacaccaguaggaguaauacaagacgguggaacaacacaucguaaugaaccacaacaauggguauuaccuucauauucaggaagaaauguacauaauguacaucuagcaccagcaguagccccuacauuucccggagaacaacuccucuucuuuagaucuacaaugcccggauguucagguuacccaaauauggaccuagauugcuuacuaccucaagaauggguacaacauuucuaucaagaagcagcacccgcacaaucagaugucgcccuacuaagauucguuaaucccgacacaggacgaguauuauuugaaugcaaauuacauaaaucuggauacguaacaguagcacacaccggacaacaugaucuaguaauaccaccaaauggauauuuuagauucgauucaugggucaaucaauuuuacacacuagccccuaugggaaacggaacaggaagacgcagagcacuuuaa

SEQ ID NO: 31759 - RNA, 1623 nt, Artificial Sequence
  derived and/or modified sequence opt6 from VP1__Norovirus__AII73753
augaaaauggcuuccaaugacgccacaccaucaaaugacggagcagccggucucguaccagaaucaaauaaugaagcaauggcccuagaaccagucguaggagcuucauuagcagcuccagucacaggacaaacaaauauaauugauccauggauaagaacaaacuucguacaagcaccuaacggugaauuuacuguaucaccaagaaacucaccaggagaaauauuaguaaauuuggaacuaggaccagaacuaaacccauauuuagcacacuuagccagaauguauaacggauaugcaggcggaauggaaguucaaguaauguuagcaggaaacgcuuuuacagcuggaaaaauaauauucgcagccguuccaccauacuuuccagucgaaaaucuaucaccaucucaaauaaccauguuuccacacguaauaauagauguaagaacuuuagaaccaguacuacucccaaugccagauguaagaucaacuuuauuucacuucaaucaaaaagaugaaccaaaaaugcgauuaguggcaauguuauacacaccucucagaucuaacggaucaggcgaugauguauucacagucuccuguagaauuuuaacacgacccucgccagaauuugauuucacauaccuuguuccaccuacaguagaaucaaagacaaaaccauucacucuuccuguacuuacucuaggagaacuuucaaacucuagguucccucucucuauagacgaaaugguaacaucaccaaacgaaucuauuguuguucaaccacaaaauggaagaguaacacuagacggugaauuacuaggaacaacacaauuacaagcauguaauauauguaguauaagaggaaaaguaacuggccaaguaccuaacgaacaacacauguggaaucuacaaauuacaaauuuaaauggaacucaauuugauccaacagacgauguaccagccccgcuaggaguaccagacuuugcaggcgaaguauucggaguauuaagucaaagaaauagaggagaaucaaauccugcuaauagagcacacgaugcaguaguagcaaccuauucagauaaauauacaccaaaauuaggacuuguacaaauaggcacauggaauacaaaugauguagaaaaucaaccaacaaaauuuacuccaauaggucuaaaugaaguggcaaauggucaucgauucgaacaauggacacuaccacguuauucaggcgcauuaacauuaaacaugaaucuugcaccggcaguugccccacuauuuccaggagaaagauuacucuucuuuagaucauauguucccuuaaaaggaggauuuggaaauccagcaauugauugcuuagucccucaggaauggguacaacauuuuuaucaagaaagugcacccucacuaggugacguagcuuuaguaagauacguaaauccagauacuggaagaguuuuauucgaagccaaauuacacaaaggaggauuuuuaacuguaucuaguacgaguacaggaccaguaguaguaccagcaaauggauacuuuagauuugauagcuggguuaaccaauucuauuccuuagcuccaauggguacagguaauggacgaagaagauuucaauga

SEQ ID NO: 31760 - RNA, 1623 nt, Artificial Sequence
  derived and/or modified sequence opt6 from VP1__Norovirus__AII73756
augaaaauggcauccucugacgcaaacccuucagauggaucaacugcaaauuuaguaccugaaguaaacaaugaaguaauggcccuagaaccaguaguaggugcagcaauugcagcaccagucgcaggacaacaaaaugucauugacccauggauaagaaacaauuucguucaagcaccaggcggagaauuuacuguaucaccaagaaaugcuccuggagaaaucuuaugguccgcaccucuaggcccagaucuaaacccauaccuaucucaucuagcucguauguauaauggcuacgcaggaggauucgaaguacaaguaauacuagcuggaaaugcauuuacagccgguaaaauaauauuugcugcuguuccaccaaacuuucccacugaaggacuaagcccaucucaaguaacaauguucccacauaucauaguagacguccgacaauuagaaccaguauuaauaccauuacccgauguacguaacaauuuuuaucauuauaaccaguccaaugacucaacaauaaaauuaauagcuaugcuauacacaccacuaagagcuaauaaugcaggagacgaugucuuuacaguaucaugcagagucuuaacaagaccuucaccagacuuugacuuuauauuccuagucccuccaacuguugaaucacgaacaaaacccuuuuccguacccgucuuaaccguagaagaaaugacaaauucacgauuuccaauaccauuagaaaaacuauuuacaggacccucaucagccuucguuguacaaccacaaaauggacgauguacaacagacgguguccuacuuggaacaacacaacuaucaccuguaaacauauguaccuuucgaggagacgucacacacauaccaggaucaagaaacuacacaaugaaucuugcaucacaaaacuggaacuccuacgacccaacagaagaaauacccgcaccucuaggaacaccagauuucguaggaaaaauccaagguguacuaacucaaacuacacgaacaaauggaucaacacgcggacacaaagcuaccguauauacuggaucagcagauuuuagcccaaaauuaggccgaguccaauucgcaacagauacugauaacgauuucgaaaccaaucaaaauacaaaauucacucccguaggaguuauacaagacggcuccacaacaccaagaaacgaaccacaacaauggguauuaccaucauauucuggaagaaacauacauaauguacaucuagcaccagcuguagcaccuacauuuccaggcgaacaacuuuuauucuuuagauccacaaugcccggaugcucaggauacccaaauauggaccuagauugucuccucccacaagaauggguccaauauuucuaucaagaagcagcuccagcucaaucagacguagcauuacucagauucguaaacccugacacuggacgagucuuauuugaauguaaguuacauaaauccgguuauguaacagucgcacacacuggacaacacgaucuaguaauaccaccuaauggcuauuuccgauuugacucauggguuaaccaguucuauacucuagcacccaugggaaauggcacaggaagaagacgagcauuauaa

SEQ ID NO: 31761 - RNA, 1668 nt, Artificial Sequence
  derived and/or modified sequence opt6 from VP1__Norovirus__AII73759
augagaauggcaucuuccgacgcaccaguaagugguacagauggagcagcaggauuaguaccagaaucacaacaagaaguauuaccucuagaaccagucgcaggaguacaacuagcggccccuguugcaggacaaucuaauauuauagacccauggauaagaaugaauuuuguccaagcaccugcaggagaauucacaguuucuccaagaaacgcuccaggagaaguacuaauugaucuugaacugggaccagaacuaaauccauaccuaaaucauuuagcuagaauguauaacggcuacguagguggaauggaaguagaaguaguauuagcagguaacgcauuuacagcaggcaaaauauuauuugccgcuguaccuccaaguuuuccaacacacgguauaagcgcugcacaagcaacaaugcuaccacacguuauaguagauguacgucaauuagaaccaguucgauuaccacuuccagauguaagaaacguaauguuucauuuuugccaagaaaauaaagaaccaagaaugagaauaguagcaauuuuauauacaccauugagagccaauggagcaggugaugacguauuuacaguaagcuguagaguauuaacaagaccaucaccagauuuugacuuuaucuuucuuguaccaccaucaguagaaucaaaauuaaaacaauucacauuaccaaauuuacaaccaaaugaaaugacaaauucaagauuuccaacuggcauaacucaacuauauacuucaccaaacacaaaucuaguuguccaguuccaaaacggaagaugcuuacuugauggaacacuacuagguacaacaccuguacgagcagccgauauuuguuccuuuagaggaguaacaagcacagaaguugaugcaacagacaguccacgaguugcuggaucacaucguauaaugguacaacuacgugaaccagauggugaagaauuuucucccacaggaccaaauccagcuccuguaggaacuccagauuuucaagcugcaauauucggcacccuuucucaacgaaauacaggaggcgcaggacaaaauaguaaucgcgcucauuuugcuuauuuuuauacacguaauccaacauuugcuccugguauaggaacaguuguauuuucauucgauacaacagauuuccaaaacagacaacccacuaaauuuucaccauccgggguauuugacgaugauuccucugaaccuuuuaaucaauuuuccuuaccauauuacaauggaucacucggugccguugaugcagguaaauuagcaccaccaguagcaccaaacuacccaggagaacaaaucuuauacuuucguggaaguguaccauuuaaaggaggcuauggcgaaggagaaauugacuccuuacucccucaagaauggauaacacacuuuuaugcagaacaagcuccgacacaaggugacgcagcauuacuacguuauuacaauccagacacaggaaggguucuauucgaaugcaaauuacauagagaaggauuuauaacaauaaacuauacaggaucaaaugcauuagcaguuccaguaaacggcguuuucagauuugaaggauggguaaauaaauuuuauacacucacaccaaugggaaauggaaauggucgaagaggaagaagacgugaauuauaa

SEQ ID NO: 31762 - RNA, 1668 nt, Artificial Sequence
  derived and/or modified sequence opt6 from VP1__Norovirus__AII73762
augaaaauggcuucaaaagacgcaucacccuccacagauggaaccgccaaccuaguaccagaaucacaacaagaaguacuagcacuacaacccguagcaggugcacaaauagcagccccaguagcaggacaauucaauguaauugauccuuggauauaccaaaauuucguucaagcaccagaaggagaauuuacaguuucaccacgaaacuccacuggagaaauacuaaugaaucuagaacuaggaccacagcuuaaccccuaucucgcacaccuggcaagaauguauaacgcauacgcugguggcuucgaaguccaaguacuauuagcaggaaaugcauucacagcuggcaaaauaauaguaugugcaguacccccaaauuuccccuuacaaaacauaucagcagcccaagccacccaacuaccacacguaguaguagauguaagacaauuagaaccaguaguucuacccuuaccagauguaagagcaggauucuaccauuauaaucaaguagaagaaucacgaaugcgauuaguagccauauuauauacaccccucagaacaaauucagcaggagaugacgcauuuaccguaucuuguagaauccuaacccgacccgcaccugauuucucguuuuuuuuucuaaucccaccaacuauagaaucaaaaacuacaccauucacacuaccccguuuacccauauccgaaaugacaaacucaagauuucccuuagucauaaaaggaauggucguugauccaaauuuaccuuuacaagcaaacuuucaaaacggacgaauaacacuagauggcgaacuacaagguacuacucuaccaacaucaaccuccauaggaagaauaucaggcacacauauguccucuacaccaucucgaauaauacaacacgaagacucuggagacucaacccaaccuagaguauuuaauccaguuuggauggaccuuacagaaaacaacuggacagaauuucaaccauucaaugaccaaccggcuccacucggauguccagauuuuaaagcaaaaauccuuggaacauuaauuagacaaccuaacaaugguucauauuacuuugacgcauauuuggacacaagacaacauggaaccuuugcuccauauacuggccaugcggcuguacauucagaucaacaagcaggacacuuagcacaaggauauaaaauccaauuuagcccaaccggcauagaaucagaucaaaauacagaucuaaaucaauuaccugauuacgguggagcaaugaccguaucuaaaggacuagcaccagcugcagcaccugacuuccccggugaaaugauauuauauuucguuucagacaugccaguaagaaacccaaacggagaacgacgagacacagaaauacuaugucuucuaccacaagaaaugguaacacacuucuaugaacaacaagcaccaucacaaggagacguagccuuaguaagauauauaaacgccgaaacaggacgaguaauguucgaaggaaaacuacaucgaaauggauuuuuuacgguaucagcaacagcaaggacauuaauagucccagacggcuauuuuagauucgacucauggguaaauagguucuauacacuaucuccaaugggaaccggaaauggacgucgacgagcacgaauguuagaauaa

SEQ ID NO: 31763 - RNA, 1638 nt, Artificial Sequence
  derived and/or modified sequence opt6 from VP1__Norovirus__AII73765
augaugauggcuucuaaagaugcaccaacaaauauggauggcaccucuggagcuggacaacuggucccagaagcaaauacugcagaaccaauaagcauggaaccaguagcaggagcagcaacagccgcagcaacagccggucaaguaaauaugauagauccuuggauaaugaauaacuacguacaagcaccacaaggagaauuuacaauaucaccaaauaauaccccuggagacauauuauucgauuuacaacucggaccacauuuaaauccauuuuuaagccauuuagcacaaauguauaauggauggguugguaacaugaaaguaaaagucuuauuagccggaaaugcauuuacagcuggaaaaauaauaaucuccuguauacccccaggauuuguagcucaaaauguaucuauagcacaagcaacaauguuuccacauguuauugcugaugucagaguacucgaaccgauagaagucccauuagaagauguuagaaacguuuuauuccacaauaaugauaauacuccaaccaugagacucgucuguauguuauauacaccucuacgcgcuucaggaucaucaucugguacugauccauucguuauagcaggucgcguauuaacauguccaucccccgacuuuucauuuuuauuucuaguuccuccaaacguagaacaaaaaacaaaaccauuuucaguaccaaaccuaccucuaaauacauuaucaaacucaagaguacccucacuaauaaaaucaaugaugguuucuagagaucacggccaaaugguucaauuucaaaauggcagaguaacauuagauggccaacuacaaggaacaacacccacaagcgcuucucaacuaugcaaaauacgggguuccguauuccaugcaaacggcgguaauggauauaauuuaaccgaacucgacggaucaccauaccaugcuuucgaaucaccagcaccaauagguuucccugauuuaggcgaaugcgauuggcauauggaagcaucaccuacuacacaauucaauacaggagaugucauaaaacaaauaaacguuaaacaagaaucagcauucgcuccucaucucggaacuauacaagcagacggauuauccgacguuucaguaaacacuaauaugauagcaaaauuaggauggguuucaccuguaucagauggacauaaaggcgauguagauccauggguaaucccacgauaugguucaacacuuacagaagcugcacaauuagcacccccaauauaucccccaggauucggagaagcaauuguauuuuuuaugucagacuucccaauugcacauggaacaaauggucuaucuguaccauguacaauaccgcaagaauuuguaacacacuuuguaaaugaacaagcaccuacucguggagaagcagcucuauuacacuaccucgauccagauacacauagaaacuuaggcgaauucaaacuguauccagacgguuuuaugacaugcguaccuaauucuucaggaacggguccucaaacauuaccaauaaauggaguuuuuguauucgugucauggguuuccagauuuuaccaacucaagccaguagguacagcaggaccagcacgaagacuaggaauuaggcgaucauaa

SEQ ID NO: 31764 - RNA, 1623 nt, Artificial Sequence
  derived and/or modified sequence opt6 from VP1__Norovirus__AII73768
augaaaauggcuucaucugacgcaaaucccucagauggaucagcugcaaaccuagucccugaaguaaauaaugaaguaauggcacuugaaccuguaguaggagcagcaauagcagccccagucgcaggacaacaaaauguaauugauccauggauaagaaauaacuucguacaagcaccuggaggugaauucacaguaagcccacgcaacgcuccaggugaaauacuauggucggcaccauuagguccggaucuuaauccauaucuaucccaucuagcaagaauguauaacggauacgcagguggcuucgaaguacaaguaauuuuagcaggaaaugccuuuacugcagguaaaguaauuuuugccgcaguaccaccuaacuucccaacagaaggauuaucaccuucacaaguaacaauguucccacacauaguuguagacguaagacaacuugaaccaguucuaauaccuuuacccgauguaagaaacaauuuuuaucauuacaaccaaucaaaugacccaacuauaaaauuaauagcaauguuauacacucccuuaagagcaaauaaugcaggagacgauguuuuuacaguaucaugcagagucuuaaccagaccaucacccgauuuugacuuuauauuucuaguucccccaacaguugaaucacgcacaaaaccauuuucaguaccaguucuaacaguagaagaaaugaccaauucacguuuuccaauaccuuuagaaaaauuauucacuggaccaucuucugccuucguaguccaaccacaaaauggucgaugcacaaccgauggcguuuuauuaggaacaacacaauuaucaccugucaauauauguaccuuuagaggugacguaacacauauuacaggcucucgaaauuacacgaugaaccuagcaucacaaaauuggaguaacuaugauccaacagaagaaauaccagcgccacuaggaacaccagauuuuguaggaaaaauacaagguguacucacccaaacaacacgcacagauggauccacaagaggacauaaagcuacagucuauacagguucagcagacuucgcaccaaaauuaggaagaguacaauucgaaacugauacagacagagauuuugaagcaaaucaaaauacaaaauucaccccaguaggaguuauucaagauggaucaacaacucaucgaaacgaaccccaacaauggguucuaccaucuuacucaggaagaaauacaccaaacguacauuuagccccagcaguagcaccaacauucccaggagaacaacuuuuauuuuucagaaguacaaugccaggaugcucaggauacccaaauauggaucuagauuguuuacuaccucaagaauggguccaauacuuuuaucaagaagcagcuccagcacaaucagacguugcacuacuaagauuuguuaauccagacacaggaagaguccucuucgaauguaaacuucauaaaucaggauacguaaccguagcacauacaggacaacaugaucuaguaauaccaccaaaugguuacuucagauucgacagcuggguuaaucaauuuuacacacuagcaccaaugggaaauggcacaggaaggcgacgcgcuuuauaa

SEQ ID NO: 31765 - RNA, 1608 nt, Artificial Sequence
  derived and/or modified sequence opt6 from VP1__Norovirus__AII73771
augaaaauggcaucaucagacgcugcaccaaguaaugauggugcagcaggccuuguacccgaagccaauaaugaaacuauggcuuuagaaccagucgcaggugcauccauagcagccccacucacaggacaaaauaacauaauagauccauggauucgacuaaacuuuguacaagcaccuaauggugaauuuacaguaucaccacguaacucaccaggcgaaguacuacuaaaccuugaacucggaccagaauuaaauccauaccuugcacaccuaucaagaauguacaacgguuaugccggaggaguagaaguacaaguccucuuagcaggaaacgcuuuuacagccggaauauuaguauucgcagcagucccaccucacuucccacuugaaaauaucucuccaggacaaauaacaauguuuccacauguuauaauagauguaagaacuuuagaaccaguacuauuaccacuucccgacguaagaaauaauuucuuccauuauaaccaacagaaugaaccaagaaugagacuaguugcaauguuauauaccccccuuagauccaauggaucaggagacgacguauuuacuguaucaugcagaguauuaacaagaccaagucccgacuuugacuuuaacuauuuaguaccaccaacaguagaaaguaaaacaaaaccauuuacauuaccaauauuaacaauaggagaauuaacuaauuccagauuuccaguaccuauagacgaauuauacacaaguccuaacgaaagucuaguaguccaaccacaaaauggaagaugcgcacuugacggagaacuacaagguacaacacaauuacuaccaacugcaauaugcucauuucgaggccgcauaaaccaaaaaguaucaggagaaaaccacguauggaacaugcaaguaacaaacauaaauggaacaccauucgacccaacugaagacguaccagccccacuaggaacaccugacuuuucaggcaagcuauucggcguacuaucucaaagagaccacgacaacgcaugccgaucacaugacgccguaauagcaacaaauucagcaaaauucacaccaaaauuaggagcaauccaaauaggaacaugggaacaagaugauguucauaucaaucagccuacuaaauucacuccuguaggacucuuugaaaacgaagguuuuaaucaauggacacuacccaacuacucaggagcacuaacauuaaacaugggacuagccccuccaguugcuccaaccuuuccaggagaacaaauucucuucuuucgaucccacauaccuuuaaaaggcggcgucgcagaccccguaauagauugcuuacuaccacaagaauggauacaacaccuauaccaggaaagcgcaccaucccaaucagauguagcucuaauaagauuuacaaaccccgauacaggaagaguacuauuugaagcuaaauuacacagaucagguuauaucacaguagcaaacacaggaucaagaccaauaguaguaccagccaauggauauuucagauuugauucauggguaaaucaauucuacagucucgccccaaugggcaccggaaauggaagaagaagaguacaauaa

SEQ ID NO: 31766 - RNA, 1623 nt, Artificial Sequence
  derived and/or modified sequence opt6 from VP1__Norovirus__AII73774
augaaaauggcaucaaaugacgcagccccaaguaaugacggagcagcgggacuagucccagaaauaaacaacgaaguaaugccucuagaaccaguagcaggagccucauuagccacaccuguaguaggucaacaaaauauaauugacccuuggauacgaaacaacuuuguacaagcaccagcaggagaauuuaccguuucaccuagaaauucaccaggagaaauacuucuagacuuagaauuaggucccgaacuaaauccauaccuagcacaccuagcaagaauguauaauggacaugcuggcgguauggaaguacaaauaguacuagcuggcaaugcauuuacagccggaaaaauuaucuuugccgcaauaccaccaggcuuucccuaugaaaauuuaucccccucacaaauuacaaugugcccucacguuauuauagacguacgacaauuggaaccaguacuccuaccaaugccagacauaagaaauaauuucuuccauuauaaccaaggaaaugacccaaaacuccgauuaauagcaauguuauauacaccauuaagagcaaacaacagcggagacgauguauuuacaguaucauguagaguacuaacaaaaccaucuccagacuuugaauuuacauuccuagucccacccacaguagaaucaaaaacaaaacaauucacauuaccaauuuuaaaaauaucagaaaugacaaacucucgauucccaguuccaguagaaaugauguauacugcccgaaacgaaaaucaaguaguacaaccacaaaacggacgcguaacacuagacggcgaauuacuuggaacaacaccacuacuagcaguaaauauaugcaaauuuaaaggagaaguuauagcuaaaaacggagauguccgcucauacagaauggacauggaaauaacaaauaccgauggaacaccaauagauccaacugaagacacacccggacccauugguucuccagauuuucaaggcauacuauuuggcguugcaucacaacgaaauaaaaaugaacaaaauccagcaacuagagcucaugaagcaaauauaaauacaggcggagaccaauaugcaccaaaacuugcucaaguaaaauuuuuuucagaaucacaagauuuugaaguacaucaaccuacagucuucacaccaguaggagucgcaggagacacaucacacccauuuagacaauggguauuaccaagauauggaggccacuuaacaaauaacacucaccuugcacccgcagucgcaccacuauuuccaggagaacaaauacuauuuuuuagaagucaaauaccaucaucaggaggacacgaacuaggauauauggacugccuaguaccacaagaauggguacaacacuucuaccaagaagccgcaacagcacaauccgaaguggcacuaauaagauucauuaauccagauacaggccgaguauuauuugaagcaaaacuacauaaacaagguuucaucacagucgcucauacaggagauaauccuauugucaugccgccaaauggauauuuuagauuugaagcuuggguaaaucaauuuuauucacuugcaccuguuggaacaggaaauggucgaagaagaauacaauaa

SEQ ID NO: 31767 - RNA, 1623 nt, Artificial Sequence
  derived and/or modified sequence opt6 from VP1__Norovirus__AII73777
augaaaauggcaucuucugaugcuaauccaucagauggauccgcagcuaauuuagucccagaaguuaauaaugaaguuauggcauuagaaccaguaguaggugcagcaauugcugcaccaguagccggacaacaaaaugucaucgacccauggauaagaaauaauuuuguacaagcaccaggaggcgaauuuacaguaucaccgagaaaugcacccggugagauauuauggucagcaccauugggacccgauuuaaauccauaucuaagucauuuagcaagaauguacaacggauaugcaggaggauuugaaguacaaguaauauuagcaggaaaugcauuuacagccggaaaaguaauauuugcugcuguaccaccaaacuuuccaacugaaggauuaucuccuagccaaguuaccauguuuccacacauaguuguagacguaagacaauuagaaccaguauuaauaccauuaccagauguuagaaauaauuuuuaucacuauaaccaaucaaacgauccaacgaucaaauuaauagcaaugcuauauacaccucuacgagcuaacaaugcaggagacgauguauuuacuguuaguugcagaguacuuacuagaccaucacccgacuuugauuuuauauuuuuaguuccaccaacagucgaaucaagaaccaaaccauuuucuguuccaguauuaacaguugaagaaaugacaaacaguagauuuccaauuccauuagaaaaacucuuuacaggaccuucaucagccuuuguaguacaaccucaaaaugguagauguacaacggacggcguacuacuaggaaccacacaauuaucaccuguaaauauauguacuuucagaggugauguaacacauauaacaggaucaagaaauuacacaaugaaucuagcaucccaaaauuggaauaauuacgauccuacagaagaaaucccagcaccccucgguacaccagacuuuguuggaaaaauacaaggaguguuaacucaaacaacuagaaccgacggaucaacacgaggacauaaagcaacuguauauacugguucagcagacuuugcacccaaacuaggaagaguacaauucgaaaccgacacugaucaugacuucgaagcuaaucaaaacacaaaauucaccccaguaggaguuauacaagauggagguacuacucauagaaaugaaccucaacaguggguuuuaccuaguuacucaggaagaaauacacauaacguacacuuagcaccagcuguagcuccaacauucccaggcgaacaauuauuauucuucagaucaacuaugccugguuguucaggauauccaaacauggaucuagauuguuuacuaccucaagaauggguucaauauuuuuaucaagaagcagcaccugcacaaucugacguugcacuacucagauuuguaaauccugacacaggaagaguuuuauucgaauguaaacuacauaaaucugguuauguaacuguagcacauacaggucaauaugaucuaguaauaccaccaaauggcuauuuuagauucgauuccuggguaaaucaauuuuauacacuagcaccaaugggaaacgguacuggaagaagacgggcaguuuaa

SEQ ID NO: 31768 - RNA, 1611 nt, Artificial Sequence
  derived and/or modified sequence opt6 from VP1__Norovirus__AII73780
augaaaauggcaucuaaugacgcaacucccuccgaugacggugcagcaggacuaguaccugaaauaaacucagaaguaauggcacuagaaccaguugcaggagccucuauagccgcuccugucguaggccaacaaaauauaauagacccauggauacgcaacaacuuuguacaagccccagcaggagaauuuacaguuagcccacgaaauuccccaggagaacucuuacuagauuuagaacuaggcccugaacuuaacccauaccuugcccauuuagcacgaauguauaacggacacgcaggcggaauggaaguacaaauaguacuagcuggaaaugcauuuacugcagguaaaauauuauucgccgcaauaccaccaucauuuccuuaugaaaaccuauccccagcacaacuuacaaugugcccacacguaauaguagacguacgacaacuugaacccguacuacuuccgaugccagauauucguaauguauuuuaccauuauaaccaaaacaacucuccuaaacuaagauuaguugcaaugcuauauacaccauuaagagcaaacaauaguggagaugauguauuuacagucuccugccgcguacuaacuagaccaucaccugauuuucaauucaccuuuuuaguaccaccaacagucgaaucaaaaacuaaaaauuucacacuuccaguauuacgaguaucagaaaugacaaauucaagauuuccaguaguauuggaccaaauguauaccucaagaaacgaaaacacuauaguacaaccacaaaauggaagaugcacaacggauggagaauugcuagguacaaccauauuacaaucaguaucaauuuguaauuuuaaaggaacaaugcaagcaaaauuaaacgaggaaccacguuaucaauuacaauuaaccaauuuagacggcucuccaauagacccaacagaugacaugccagcaccccuaggaacaccagacuuccaagcaguauuauauggugucgcaucacaacguucuucaagagauaaugcaacaagggcccaugacgcacaaauugauacugcaggugacacauuugcaccaaaaauaggacaaguacgauuuaaaucaucaucuaacgacuucgauuuacacgacccgacaaaauuuacuccaauuggaguaaauguagacgaucaacauccauucagacaauggucauuaccaaacuauggaggacauuuagcucuaaacaaucauuuagcgccagccguuacaccacuauucccaggagaacaaauauuauuuuuucgcucauacauuccaucagccggaggucauacagauggagcaauggauugucuacuaccucaagaauggguagaacacuuuuaucaagaagcagcuccaucucaaucagacauagcauuaguaagauucauaaauccagacacuggacgaguauuauuugaagccaaacuccauaaacaagguuuuuuaacaauagcagcuucaggugaucacccaauuguaaugccaacaaauggauauuuccgauucgaagccuggguaaacccauuuuacacauuagcaccaguaggcacaggcuccggaagaagaagaauccaauaa

SEQ ID NO: 31769 - RNA, 1632 nt, Artificial Sequence
  derived and/or modified sequence opt6 from VP1__Norovirus__AII73783
augaugauggcaaguaaagacgcaccaacuaacauggauggaacaucaggugcaggacaacuaguuccagaagcaaauacagcagaaccauuaccaauaaagccaguugcuggcgcagcuacagcaguagccacagcuggucaagugaauaugauagauccuuggauaaugaacaauuuuguucaagccccacaaggagaauuuacaauaucacccaacaauacaccaggagacauauuauuugauuuacaauuaggcccacaucuaaauccauuucuagcucacuuaucccgaauguauaacggaugggucgguaauaugcaaguaagaauuaugcuugcaggaaaugcauucuccgcuggaaaaauaauaguuuguuguauacccccaggauucucaagucaaucuauaucuauagcccaagcaacaauguucccacauguuauagcagauguaagaguucuagaaccaauugacguaccacuugacgacguuagaaauguacuauuucauaauaacgacaauccacaaacuaugcgacucuuaugcaugcuauacacaccucuccgaucagguggaacuaguucaggcaccgacccauucguaauugccggaagaguauuaacuuguccaacaccugauuuuucauucuuauuuuuagucccuccagauaucgaacaaagaacuaaacccuuuucuguaccaaacauaccaaugaaucuaaugucaaauucaagaguaagcauguuaaucgauggaaugaugguuucuaaugaccaaaaucaagucccacaauuccaaaacgguagaguuacauuagauggacaacuacaagguacuacaacaguaucagcagcauguguagcuagaaugagaggacgaauauucaacaauaacggcaauuacggaguaaauuuaacugaauuagacggaaauccauaucaugccuuugacucaccggcaccauuaggauuuccugauuuuggcaauugugaucuacauaugacguuuguaaaaaucaauccaaaugaacuaucaucaggagaucccucaggaaaaguaguaauacauucauaugaugcaacuuuugcaccacauuuaggcacaguuaagcuugaaaaugacgacgaauuagcaagauucguaggaaaagaaguagucuuagaacuaacauggguuucaaaucgagaaggagcaacauuaaauuuaugggcaguuccaaauuacggcucaucuuuaacacaagcaucacaacuagcuccaccaauauauccaccuggauuuggugaagcaaucguauauuucacaucaacauuccccacaguaucaaauccaaaaguaccaugcacuuuaccacaagaauuuguaucacauuuugucaaugaacaagcacccacacguggagaugcagcacuacuacauuauguugauccagacacacaccgaaaccuaggagaauucaaaauguauccagaaggauacaugacauguguuccaaacgcaggcggcggaccacaaacauuaccuauaaacggcguauuuguauuuauaucauggguaucaagauacuaucaacucaaaccaguaggaaccgcaggagcugccagaagauuaggauuacgaagaaguuaa

SEQ ID NO: 31770 - RNA, 1608 nt, Artificial Sequence
  derived and/or modified sequence opt6 from VP1__Norovirus__AII73786
augaaaauggccucaucagacgcagcaccaucaaaugacggcgcagcaggccuaguuccagaagcaaauaaugaaacaauggcuuuagaaccaguugcaggagcaucuauugcugcuccauuaaccggacaaaacaauauaauugacccuuggauaagacuaaacuucguacaagcaccaaacggcgaauuuacaguuucaccuagaaauucaccaggagaaguacuauuaaaucuagaacuagguccagaauuaaauccauauuuagcucaccuaucaagaauguauaauggauaugcaggcggaguagaaguacaaguacuuuuagcuggcaaugcauucaccgcaggaaaacuaguauucgcagcaguuccuccccacuuuccauuagaaaauauaucuccaggccaaauaacaauguuuccacacgucauaauagacguacguacauuagaaccaguuuuauuaccuuuaccagaugucagaaacaauuucuuucacuauaaucaacaaaacgaaccaagaaugcgucuugucgccauguuauauacaccacuaagauccaauggcagcggggaugacgucuuuacaguaucaugcagaguacuuacuagaccaagccccgauuucgacuuuaauuauuuagucccaccuacuguugaaucaaaaacaaaaccauuuacccuuccaauacuaacaauuggagaacugacaaacucucgauuuccaguaccaauagacgaauuauauacauccccaaacgaaucacuaguaguccaaccucaaaacggaagaugcgcauuagauggagaauuacaaggcacaacccaacuacuaccaacugcuauauguucauuucgaggacguaucaaccaaaaaguaucaggagaaaaccacguauggaauaugcaagucacaaacaucaauggaacaccuuuugauccuacagaagacguacccgcaccgcuaggaacacccgauuuuucaggaaaauuauucggaguuuuaucccaaagagaccacgauaaugccugcagaucacaugaugcuguaauagcaacaaacucugcaaaauucacaccuaaacuaggugcaauucaaauaggaacaugggaagaaaaugacguacacauaaaucaaccaacuaaauucacaccuguaggucuauucgaagacgaaggauuuaaccaauggaccuuacccaauuauucaggagcacucacauuaaacauggggcuagcaccaccuguugccccaacauuuccuggcgaacaaauacucuucuucagaucacauauuccuuuaaaaggaggaguagccgacccuguaauagacugcuuauuaccacaagaauggauucaacacuuauaccaagaaucagcaccuucacaauccgacguagccuuaauuagauuuacaaauccagacaccggucgaguacuauuugaagcuaaacuccacagauccgguuacauaacaguagcaaauacaggaagucgaccaauaguaguuccagcuaacggauauuuucgauucgacucauggguuaaucaauuuuauucacuagcaccuaugggaacagguaaugguagacgacggguucaauaa

SEQ ID NO: 31771 - RNA, 1623 nt, Artificial Sequence
  derived and/or modified sequence opt6 from VP1__Norovirus__AIS40019
augaaaauggcuuccucagaugcaaauccuucagauggauccgcagcaaauuuagucccugaaguaaacaaugaaguaauggcuuuagaaccaguuguaggugcagcaauugcagcaccaguugcaggacaacaaaauguaauagacccauggauacgaaauaauuucguaccagcaccaggcggagaauuuacugucucaccacguaaugccccaggugaaauauuaugguccgcaccacuagguccagauuuaaauccauaccuuucacacuuagcuagaauguauaaugguuaugcuggaggcuucgaaguccaaguaauacuagcaggaaaugcauuuacugcaggaaaaguaauauuugcugcaguaccuccaaacuuuccaacagaaggacuaucaccuucccaaguaacaauguuuccacacauagucguagaugucagacaauuagaaccaguauuaauaccauuaccagauguaagaaacaauuuuuaucauuauaaccaaucaaaugacccaacaauaaaacuaauagcaaugcuauauacacccuuaagagcaaacaaugcaggagaugauguuuuuaccguaucauguagaguauuaacacgaccaucacccgacuuugacuuuauuuuuuuaguaccaccuaccguagaaucacgcacuaaaccuuucucagucccaguacuaacaguagaagaaaugacaaacucaagauuucccauaccauuagaaaaauuauuuaccggcccaucuucagcauuuguuguacaaccacaaaauggacgauguaccacagacggaguauuauuaggagcaacacaacuuucacccguaaacauaugcacauucagaggagauguaacucauauuacuggaucaagaaauuacacaaugaaucuugcuagccaaaacuggucuaauuaugaucccacagaagaaauacccgcuccucuagguacaccagacuuuguaggaaaaauacaaggcguacuaacacaaacaacacgaaccgauggauccacaagaggucauaaagcuacaguuuacaccggauccgcagauuucgcaccaaaacuaggacgaguccaauuugaaacagacacagaccgcgacuuugaagcaaaucaaaauaccaaauuuacacccguaggaguaauucaagauggaucaacgacccaccgaaacgagccucaacaauggguuuuaccaucauauucaggaagaaauacaccaaauguacacuuagcaccugcaguggcuccuacuuuuccaggagaacaacuacuuuucuuucgcucaacuaugccaggcugcucaggauaccccaauauggauuuagauugcuuacuaccacaagaauggguccaauacuucuaucaagaagcugccccagcacaaucagaugucgcucuuuuaagauuuguaaaucccgacacaggaagaguauuauuugaauguaaacuacauaaaucuggauauguaacaguugcacacacaggacaacaugacuuaguuauaccuccuaacggauacuuuagauuugauucauggguaaaucaauuuuacacauuagcaccaauggguaacggaacaggaagaagaagagcauuauaa

SEQ ID NO: 31772 - RNA, 1623 nt, Artificial Sequence
  derived and/or modified sequence opt6 from VP1__Norovirus__AIV43147
augaaaauggcauccucagaugcaaauccauccgauggaucagccgcaaacuuaguaccagaaguuaacaacgaagucauggcauuagaaccaguagucggagcugccaucgcagcaccuguagcaggacaacaaaauguaauagacccauggauaagaaauaauuucguucaagcaccuggcggagaauuuacugugucaccuaggaacgccccaggagagauacuuugguccgcaccauuaggaccagaucuaaauccauaccuaucacauuuagccagaauguauaauggauaugcuggaggauucgaaguacaaguaauauuagcuggaaaugcauuuacagccggcaaaguaauauuugcagccguucccccaaacuuuccaacagaaggauuauccccaucccaaguaacaauguuuccacauauaguaguagauguaagacaacucgaacccguauuaauaccacuaccagacguucguaacaacuuuuaucacuauaaucaaucaaaugacccaacaaucaaauuaauagccaugcuauauacaccacuacgagcaaauaaugccggugaugacguauucacaguuucaugcagaguauuaacuagaccaucaccagacuuugauuuuauauuuuuagugcccccaacuguagaaucacgaacaaaaccauucagugucccaguacucaccguagaagaaaugaccaauucacgauuuccaauaccauuagaaaaauuauuuacaggacccucauccgcauuuguuguacaaccacaaaauggacgcuguacaacagaugguguacuuuuaggaacaacccaacuaucucccgucaauauaugcacauuuagaggagacguaacacacauaacaggaucucguaacuacacaaugaauuuagccucccaaaauuggaguaauuaugauccuacagaagaaauuccagcaccauuagguacaccagauuuuguaggaaaaauacaagguguacuaacucaaaccacaagaacagacggaucaaccagaggacauaaagcaacugucuauacagguucugcugacuuugcaccaaaauuaggcagaguacaauuugaaacagauacugaucacgacuucgaagcaaaccaaaauacuaaauucacaccaguaggaguaauccaagacgguuccaccacacauagaaacgaaccacaacaauggguauuaccaucauauucuggaagaaacacaccaaauguucaccuugcuccagcaguagcaccaacauucccaggugaacaauuauuauucuuccgaucuacaaugccaggaugcucaggcuaccccaauauggacuuagacugucucuuaccacaagaauggguacaguauuucuaucaagaagcagcaccagcacaaucugacguagcacuacuaagauucguaaauccagacacaggacgaguauuauucgaauguaaauuacacaaaagugguuauguaacaguagcacacacaggacaacaugaccucguaauaccaccaaauggauacuucagauuugauucauggguaaaucaauuuuacacuuuagcucccaugggaaacggaacuggaagacguagagcauuauaa

SEQ ID NO: 31773 - RNA, 1623 nt, Artificial Sequence
  derived and/or modified sequence opt6 from VP1__Norovirus__AIV43148
augaaaauggcgucaucagacgcaaacccaucagaugguucugcagcgaaucuaguuccagaaguaaauaacgaagucauggcuuuagaaccgguaguaggugcagcuauagcagcaccaguagcuggacaacaaaacguaauagacccauggauacgaaauaauuucguacaagcuccaggaggcgaauucacaguaucaccacgaaaugcaccaggagaaauccuauggucagcaccuuuaggaccagaucucaauccauaucuaucucacuuagcaagaauguauaauggauacgcagguggauuugaaguacaaguaauacuagcuggaaaugcauuuacagcaggaaaaguaauauuugcugcuguaccaccaaacuucccaacagaaggauuaucaccuucacaaguaacaauguucccacauauaguaguagacguaagacaauuagaacccguuuuaauaccacuaccagacguuagaaauaauuuuuaucacuauaaucaaaguaaugacccuacaauaaaauuaauugcaaugcuuuauaccccauuaagagcaaauaaugcaggagacgacguauucaccguuaguugucgaguacuaacaagaccuuccccagauuuugauuucauauuucuaguaccaccaaccguagaauccaggacuaaaccauucucaguaccaguucuaacaguugaagaaaugacaaauagccgauucccaauaccauuagaaaaauuauucacagguccaucgucagcuuucguaguacaaccccaaaacggcagauguacaacagacggugucuuauuaggcacaacacaauuaucacccguuaauauuuguacuuuuagaggagacguaacacauauaacaggaucuagaaauuacaccaugaaucuugcaucacaaaacuggaguaauuacgaucccacagaagaaauaccugcuccacucggaacaccagacuuuguaggcaaaauacaaggcguuuuaacacaaaccacucgaacagacgguucaacaagaggucauaaggcaacaguauauacaggaucagcagauuucgcaccaaaacuuggaagaguacaauuugaaacagauacagacagagauuucgaagcaaaucaaaacaccaaauuuacaccagucgggguaauacaagacggaggaacaacacaucgaaaugaaccacaacaguggguauuaccuucuuauucaggucguaauacaccaaauguacacuuagcaccagcaguagccccuacuuucccuggugaacaacuacuuuucuuccgcucaaccaugccaggaugcucagguuacccuaacauggauuuagauugccuuuuaccacaagaauggguucaauauuucuaucaagaagcagcaccagcacaaagugauguugcauuauuaagauucguaaauccggauaccggcagagugcuuuuugaaugcaaauuacauaaaucuggcuaugucacagucgcacauacaggacaacaugaccuaguaauaccaccuaauggauacuucagauuugauuccuggguaaaccaauuuuacacacuagcaccaaugggaaauggcaccggacgacgacgagcauuauaa

SEQ ID NO: 31774 - RNA, 1623 nt, Artificial Sequence
  derived and/or modified sequence opt6 from VP1__Norovirus__AIV43149
augaaaauggcaucaucagaugcaaauccaucagaugguucagcagcaaaccuaguuccagaaguaaauaaugaagucauggcacuagaaccaguaguaggugcagcaaucgcagcaccaguagcuggacaacaaaacguuauagacccuuggauaagaaacaacuuuguucaagcaccuggaggagaauucacaguaucaccuagaaaugcaccaggagaaauuuuauggucagcaccauuaggacccgaccucaauccuuaucuaucacauuuagcacgcauguacaacgguuacgcuggcggcuucgaaguucaaguaauacuagcaggaaaugcauuuacagcaggaaaaguaauauuugcagcaguaccaccaaacuuuccaacagaaggccuauccccaucucaaguuacaauguucccacauauaguaguagauguaaggcaacuagaaccaguacuuauaccacuaccagauguaagaaauaauuucuaucauuacaaccaaucaaaugauccaacaauuaaacuaauagcaauguuauacacuccauuaagagcaaauaacgcuggagacgauguauuuacagucucauguagaguauuaacaagacccucacccgacuuugacuucauauuuuuagucccgccaacaguugaaucaagaacuaaaccuuuuucuguaccaguauuaaccguugaagaaaugaccaacucaagauuuccaauaccccucgaaaaacucuucaccggaccaucaucagcauuuguaguacaaccccaaaacggcagaugcacaacugauggaguacuacuaggaaccacacaacuaucaccaguuaacauaugcacauuuagaggagacguaacccauauaacaggaaguagaaauuauacaaugaacuuagcaucacaaaacuggaguaauuacgaccccacagaagaaauaccagcccccuuagguacuccagacuucguaggaaaaauucaaggaguauuaacucaaacaacaagaacugacggaucaacaagaggacauaaagcaacuguuuauacaggcucugccgauuucgcaccaaaacucggacgaguucaauuugaaacagauacagauagagacuuugaagcaaaucaaaauacuaaauuuacacccguaggaguaauucaagacgguggaacuacucauagaaaugaaccccaacaauggguacucccuucauacuccggacgaaauacaccaaauguacaccuagcuccagcuguagcaccaacuuuucccggcgaacaauuacuuuuuuuucgaucaacaaugccaggauguucaggauauccaaacauggaucuagacugccuacuaccucaagaauggguucaauacuucuaucaagaagcagcccccgcccaaucagacguagcucuuuuaagauuuguaaacccagauacuggaagaguauuauuugaaugcaaacugcauaaaucagguuacguaacuguagcacauacuggacaacacgacuuaguaauaccaccaaacggauauuuucgauucgacucauggguaaaucaauucuacacucuagcuccaaugggcaacggaacaggucgaagacgagcucuauaa

SEQ ID NO: 31775 - RNA, 1623 nt, Artificial Sequence
  derived and/or modified sequence opt6 from VP1__Norovirus__AIV43150
augaaaauggcaucuagcgacgcaaaccccagugauggcuccgcagcaaacuuagucccagaagucaauaacgaaguuauggcucuagaacccguaguaggagcagcuauagcagccccuguagcuggacaacaaaacguuauagacccauggauaagaaauaauuucguacaagcaccuggaggagaauuuacaguaucaccucgaaacgcaccaggugaaauacuauggucagcaccacuaggaccugacuuaaauccuuaucucucacauuuagcacguauguauaauggcuacgcaggaggauuugaaguacaaguaaucuuagccggaaaugcauuuacagcaggcaaaguaauauucgcagcaguuccaccaaauuuuccuacagaagguuuaucacccagccaaguaacuauguuuccucauauagucguagacgucagacaacucgaaccaguacuaauaccauuacccgacguaagaaacaauuucuaucacuauaaucaaaguaaugacucaacaauaaaacuuauagcaauguuauauacaccacuccgugcaaacaacgcaggagacgauguuuucacaguaucaugcagaguucuaacucgaccauccccagauuuugauuuuauauuuuuaguuccaccuacaguugaaucacguacaaaacccuucucagucccaguucuaacaguagaagaaaugacaaacucaagauuuccaauaccacuugaaaaauuauuuacagguccaucaucugcauucguuguacaaccacaaaauggaagaugcacaacagauggugucuuacuaggaacaacacaacuuagccccgucaacauaugcacauucagaggagaugucacacauauaacuggaucuagaaacuauacuaugaaucucgcuucacaaaacuggucaaauuacgacccaaccgaagaaauacccgcaccauuaggaacaccagauuucguaggaaaaauucaaggaguacucacacaaacaacacgaacagacgguuccacaagaggacacaaagcaacugucuauacaggaucagccgauuuugcaccaaaacuaggacgaguacaauucgaaacagauacagaccaugauuucgaagcaaaucaaaauacaaaauucacaccuguaggaguuauacaagacggaggaacaacccacagaaaugaaccacaacaauggguuuuaccaucauauucaggaagaaauacaccaaauguccauuuagcaccagcaguagcuccaacauuucccggagaacaguuacuauuuuucagaucaacuaugccagguugcucaggauauccaaauauggauuuagauugcuuacuaccccaagaauggguucaauauuuuuaucaagaagcagcaccagcucaaucagacguagcuuuacuaagauuuguaaacccagauacaggaagaguacuauucgaauguaaacuacauaaaucagguuaugucacaguugcacacacaggacaacacgaucuaguaauaccacccaacggauauuucagauucgacucauggguuaaucaauuuuauacauuagcgccaaugggaaauggaacuggaagaagacgagcauuauaa

SEQ ID NO: 31776 - RNA, 1623 nt, Artificial Sequence
  derived and/or modified sequence opt6 from VP1__Norovirus__AIV43151
augaaaauggcaucaucagacgcuaacccaucugauggaucugcagcuaaucuuguaccugaaguuaacaacgaaguaauggccuuagaaccagucguuggcgccgcaauagcagccccaguagcuggacaacaaaauguaauagauccauggauaagaaauaauuuuguccaagcaccaggaggcgaauuuaccguaagcccaagaaaugcuccaggagaaauauuauggagcgcuccccuaggaccugaucuuaauccguauuuaucacaucucgcccgaauguauaacggauaugcagguggcuucgaaguacaagucauuuuagcaggaaaugcauuuacagccggaaaaauaauauucgcagcaguacccccaaauuuuccaacugaaggacuauccccaucccaaguaacaauguucccacacauaguaguagauguacgucaacuagaaccaguucuaauacccuuaccagacguaagaaauaacuuuuaucauuauaaucaaucuaaugacccaaccauuaaauuaauagccaugcuauauacaccauuaagagcaaauaaugcaggagaugauguauucaccgucaguugcagaguacuaacaagacccagucccgacuuugacuuuaucuuuuuaguaccaccuacuguagaaucacgaacaaaaccauucucaguaccuguauuaacaguagaagaaaugacaaacucuagauucccgauaccauuagaaaaacuuuucacaggaccaagcuccgcauucguaguacaaccacaaaauggaagauguacaaccgacggaguacuacuugguacaacacaacucucaccaguaaacaucuguacauuccgaggagauguaacacauauaacaggaucaagaaauuauacaaugaaccuagcaucacaaaauuggucaaauuacgaucccacagaagaaauuccagcaccauuagguacaccagacuuuguaggaaaaauacaagguguacuuacacaaacaacaagaacugacggcucuacuagaggucauaaagcaacaguauacacaggaagugcugacuucgccccaaaacuuggaagaguacaauuugaaacagacacugaucacgauuuugaagccaaucaaaauacaaaauucacaccaguaggaguaauacaagacggaggaacaacucacagaaacgaaccucaacaauggguauuaccaagcuauucaggaagaaacacccccaauguacacuuagcuccugcaguagcaccaacauucccaggagaacaacuauuauuuuuuagaagcacaaugccaggauguuccgguuauccaaacauggauuuagauuguuuauuaccacaagaauggguacaauauuucuaucaagaagcagcaccugcgcaaucagacguagcacuuuuacgauuuguuaauccagauaccggcagaguauuauuugaauguaaacuccauaaauccggauauguuacuguagcccacacuggccaacacgacuuaguaauaccaccaaauggauacuucagauuugauucauggguaaaucaauuuuacacucuagcaccaaugggaaacggaacaggaagaagacgagcacuauaa

SEQ ID NO: 31777 - RNA, 1623 nt, Artificial Sequence
  derived and/or modified sequence opt6 from VP1__Norovirus__AIV43152
augaaaauggcuuccagcgacgcaaaccccagcgauggaucagcagcaaauuuaguaccugaagucaauaacgaaguuauggcacuagagccaguaguaggugcagcaauugccgcuccaguugcaggacaacaaaauguaauugaucccuggaucagaaauaauuuuguccaagcuccaggcggcgaauuuaccguauccccucguaaugcaccaggagaaauccuauggucagcaccuuuaggcccagaccuaaauccguaucuuucacauuuagcccgaauguauaauggauacgccgguggauucgaaguccaagucauacuagcaggaaaugcauucacagcuggaaaagucauauucgccgcaguuccaccaaauuucccaacagaaggacuaucuccaucucaaguaacaauguucccccauauaguaguugacguacgacaauuagaaccuguacuuauaccauuacccgacguuagaaacaauuucuaucacuacaaucaauccaaugacccaacaauaaaauuaauagcaauguuauacaccccacucagagcuaauaaugcuggagaugauguauucacaguaucaugucgaguauuaacacgaccaucaccagauuucgacuuuauauuucuuguuccacccacaguagaaucaagaacuaaaccuuucucuguaccaguauuaacaguagaagaaaugacaaauucacgauuuccaauaccacuagaaaaauuauuuacaggaccaucaucugcauucguuguacaaccacaaaacggaagaugcacaaccgauggaguacuauuaggaacaacacaauuaucaccagucaauauauguacauuuagaggugacguaacacauauuacuggauccagaaauuauacaaugaaccuggcuucccaaaauuggaguaauuacgauccaacagaagaaauaccugcaccacuuggcacaccagacuuuguaggaaaaauacaagguguacuaacacaaacaaccagaacagauggaucaacaagaggucacaaagcaacaguauauacaggcucugcugacuuugcuccaaaacucggaagaguucaauuugaaacagauacagaccaugacuucgaagcaaaccaaaauacaaaguucacaccaguaggcguaauacaagauggaucaacuacacauagaaaugaaccccaacaauggguauuaccauccuacucuggaagaaauacuccaaacguacaccuagcaccugcuguugcaccuaccuuuccaggugaacaauuacuauuuuuuagaucaacaaugccugguuguucaggauaucccaauauggauuuagacugccuacuaccucaagaauggguacaauauuucuaucaagaagccgccccugcucaaucagauguagcauuacuacgauuuguaaauccagauacaggucgaguauuauucgaauguaaauuacauaaaucuggcuacguuacaguagcacauacuggacaacacgaccuagucauaccacccaauggauauuuuagauuugacucauggguaaaucaauucuacacacuagcacccaugggaaacgggaccggaagaagaagagcauuauaa

SEQ ID NO: 31778 - RNA, 1623 nt, Artificial Sequence
  derived and/or modified sequence opt6 from VP1__Norovirus__AIV43153
augaaaauggccuccuccgacgcuaacccuucagacgguuccgcagcaaauuuaguaccagaaguaaauaaugaaguuauggcucucgaaccagugguuggagcagcaauagccgcuccaguagcuggucaacaaaaugucauagauccuuggauuagaaauaauuuuguacaagcaccuggaggagaauuuacugucucacccagaaaugcaccuggagaaauuuuauggucagcaccacuuggcccagauuuaaauccauaucuaucacaucuagcccgaauguacaacggauaugcaggaggcuuugaaguacaaguaauacuagccggaaaugcauuuaccgcuggaaaagucauauucgcagcaguaccuccaaauuuuccaacagaagguuuaaguccaucacaaguaacaauguuuccacacauaguaguagacguccgacaauuagaaccaguacucauacccuuaccagacguaagaaauaauuuuuaccauuacaaucaaucuaaugacccuacuauaaaauuaauagcgaugcucuauacuccacuaagagcaaacaacgcaggagacgacguauucacaguaucauguagaguucuuacaagacccucaccagacuuugauuuuauauuccuaguuccaccaacaguagaaucaagaacaaaacccuucucuguaccaguauuaacaguugaagaaaugacaaacucucguuuuccuauaccccuagaaaaacuauuuacaggacccucuagcgcuuucguaguacaaccacaaaauggaagauguacaacugauggcguccuucuuggaaccacacaacuaucaccaguaaauauuuguacuuuuagaggagauguuacucacauaacuggaucacgaaacuacacgaugaaccuugcaucacaaaauugguccaauuaugauccaacugaagaaauaccagcaccauuaggaaccccagauuuuguugguaaaauacaaggaguucuaacacaaacaaccagaaccgauggaucaacaagaggccauaaagcuacaguauauaccggaucagcugauuuugccccaaaauuaggaagaguucaauuugaaacagauacagaccaugauuuugaagccaaucaaaauacuaaauuuacaccaguuggcguuauacaagacggcucaacaacucaccgcaaugaaccacaacaauggguauuaccaucuuacuccggaagaaauacuccuaacguucaucuugcaccagccguagcuccaaccuuucccggcgaacaauuacuuuucuuuagauccacaaugccuggauguucuggcuacccaaauauggaucuagauugccuacuaccucaagaauggguacaguacuuuuaucaagaagccgcuccagcacaauccgauguugcucuacuaagauuugucaauccugacacagguagaguacuauucgaauguaaauuacauaaaucugguuaugucacaguagcucacacaggacaacaugaucuaguaauaccacccaauggauauuucagauuugauuccuggguaaaucaauuuuacacgcuugcacccaugggaaauggaaccgguagaagaagagcccuuuaa

SEQ ID NO: 31779 - RNA, 1623 nt, Artificial Sequence
  derived and/or modified sequence opt6 from VP1__Norovirus__AIV43154
augaaaauggcaucaucagaugcaaaccccucugauggaucugcagccaacuuaguaccagaaguaaacaacgaaguaauggccuuagaacccguaguaggcgcugccauagcagccccuguagcaggacaacaaaaugucauagacccauggauacgaaauaacuuuguacaagcaccaggaggcgaauuuaccguaucccccagaaaugcaccaggagaaauacuauggucugcaccacuuggacccgaccuaaauccuuaucuaucucaucuagcaagaauguauaacggauaugccggaggauuugaaguccaaguuauacuagcaggaaacgcuuucacugcugguaaaguaauuuucgcagccguacccccaaacuuccccacagaaggccucagccccucacaaguuacaauguucccucacauuguaguagauguacgacaauuagaacccguacuuauaccccuacccgacgucagaaacaacuucuaucacuacaaccaauccaaugacccaacaauaaaacuuauagcaaugcuauauacuccauuacgagcaaauaaugccggugaugauguauucacagucucauguagaguacuaacaagaccaagccccgauuuugacuuuaucuuuuuaguuccaccaacagucgaaucaagaacgaaaccauuuucuguacccguuuuaacaguugaagaaaugacaaacucccgauuccccauuccccuagaaaaacuauuuacaggaccaucaagugccuucgucguacaaccccaaaacggacgauguaccacagauggaguauuacuaggaaccacacaauuaucuccagucaacauauguacauucagaggagacguaacacauauaacuggaucuagaaauuacacuaugaauuuagcuucucaaaauuggucaaauuacgauccaacagaagaaauaccagccccucuaggaacaccagacuuuguagguaaaauacaaggaguuuuaacacaaacaacaagaacagacggaucaacuaggggucacaaagcaacuguauacacaggaagcgcugacuuugccccaaaauuaggacgcguacaauucgaaacagauacagaucacgauuuugaagcaaaucaaaauacaaaauucaccccagucggagucauccaagauggaucaacaacacauagaaacgaaccucaacaauggguacucccaucauacucaggaagaaauacccccaauguacauuuagcaccagcaguagcuccaacuuuuccaggugaacaacuuuuauucuucagaucaacaaugccuggauguucaggauaccccaauauggauuuagauuguuuacuuccccaagaaugggugcaauacuucuaucaagaagcagcaccagcacaaucugacguagcauuacucagauucgucaauccugacacaggacgaguacuauucgaaugcaaacuacauaaaucaggauacguaacaguagcacacacuggacaacaugauuuagucauuccuccaaacggauauuuucgcuuugauuccuggguaaaucaauuuuacaccuuagcucccaugggaaauggaacaggaagaagacgagcacuauaa

SEQ ID NO: 31780 - RNA, 1623 nt, Artificial Sequence
  derived and/or modified sequence opt6 from VP1__Norovirus__AIV43155
augaaaauggcuucuuccgaugcuaacccuucagauggaucagcagcaaaucuuguaccagaaguaaauaacgaaguaauggcccuagaaccaguaguaggagcagcaauagcagcuccgguugcaggacaacaaaauguaaucgacccauggauucgaaauaacuuuguccaagcaccaggcggugaauuuacagucucuccaagaaacgcaccuggagaaauacuauggucugcuccacuuggaccagaucucaaucccuacuuaucacaccuagcaagaauguauaaugguuacgcaggcggauuugaaguacaaguaauacuagcuggaaacgcuuuuacagcaggaaaaguaauauucgccgcaguuccuccaaacuuuccaacagaaggccuaucuccaucacaaguaaccauguuuccucauaucguuguugacguaagacaacucgaaccaguacucauuccccuuccugauguacgaaauaacuucuaucacuauaaucaauccaaugacccaacaauaaaacuaauagcaauguuauauacaccauuaagagcaaacaacgccggagaugauguauuuaccguaucauguagaguacuaacucgcccauccccagacuuugacuuuaucuuucuaguaccaccaacuguugaaucaagaaccaaaccauucucaguuccuguauuaacaguagaggaaaugacuaauucacgauuuccaauaccccuagaaaaacuauuuaccgguccaucaucugcauuugucguacaaccacaaaacggacgauguaccacugacggagucuuacuaggaaccacccaauuaucaccaguaaauauauguacauuuagaggcgacguaacucacauaacaggcucacgaaauuauaccaugaauuuagcaucacaaaacuggucaaauuaugauccaacagaagaaaucccagccccacuaggaaccccagauuuuguaggaaaaauacaaggaguccuaacccaaacaacacgaacagauggauccaccagaggccacaaagcaacaguauauacaggaagcgcagacuuugcaccuaaauuaggcagaguucaauuugaaaccgacacagacagagauuuugaagcaaaucaaaauacaaaauuuacuccaguaggcguaauacaagacggcucaacgacucacagaaacgaaccacaacaauggguacuaccaucuuacagcggaagaaacacaccaaauguacacuuagcaccagcaguagcuccuacauuccccggggaacaacuacucuucuuuagaucuacaaugccaggauguucaggauauccaaacauggaucuagauugucuauuaccacaagaauggguacaauauuucuaucaagaagcugcaccagcucaaucagauguagcacuacuacgcuuugucaauccagacacuggucgcguacucuuugaaugcaaacuacauaaaucaggauauguaacagucgcacacaccggacaacaugaucuaguaauaccaccaaauggauacuuuagauuugauucauggguaaaucaauuuuacaccuuagcucccaugggcaaugguacuggaagaagaagagcacuauaa

SEQ ID NO: 31781 - RNA, 1623 nt, Artificial Sequence
  derived and/or modified sequence opt6 from VP1__Norovirus__AIV43156
augaaaauggcaucuuccgacgcuaauccuucagacggaucugccgcaaauuuaguaccagaaguuaacaacgaagucauggcuuuagaaccaguaguaggagccgcaauagcagccccaguagcaggacaacaaaacguuauugacccauggauaagaaauaacuuuguacaagcaccaggaggagaauuuacuguaucaccacguaaugcucccggagaaauacuauggucagcaccauuaggaccagaucuaaauccauauuuaucccaucuagcaagaauguacaacgguuaugcaggagguuuugaaguacaaguuauacuagcaggaaacgcauuuacagcaggaaaaguaauauuugcugcaguaccaccaaauuucccaacugagggacuaucaccaucucaaguaacuauguucccucauauaguagucgaugucagacaauuagaaccagucuuaauaccuuuacccgauguuagaaacaauuucuaucacuauaaucaaucaaaugaucccaccauaaaacuaauagcaaugcuauauacaccacuacgagcaaauaaugcaggagacgacguauucacuguaucaugcagaguauuagcacguccaucaccagacuuugauuuuauauuuuuaguuccaccaacaguagaaucacgaacuaaaccauucucaguacccgugcuuacuguagaagaaaugacaaauagcagauucccaauaccauuagaaaaauuauuuacaggaccaucaucugcauuuguaguacaaccacaaaauggaagauguacaacagauggaguauuacuaggaacaacacaacuaucacccguaaacauauguacauuuagaggugacguaacacacauuacagguucccguaacuauacaaugaaccuagccucccaaaauuggucuaauuaugacccuacagaggaaauaccagcuccuuuaggaacaccagacuucguaggcaaaauacaaggaguucuaacacaaacuacaaaaacagauggaucaacacgaggacacaaagcaacuguauacacaggaucugcagauuuugcuccuaaacuaggccgaguacaauucgaaacagacacagaccaugauuucgaagcaaaucaaaauacaaaauuuacaccagucggaguaauacaagauggcucaacuacacaucgaaacgaaccacaacaauggguauuaccaucauauuccggaagaaauacaccaaauguacacuuagcaccagcaguagcccccacuuucccuggugaacaacuauuauuuuuccguucaacaaugccaggauguucaggauaccccaauauggacuuagauugccuacuaccacaagaauggguccaauacuuuuaucaagaagcagcaccagcacaauccgaugucgcauuauuacgauuuguaaauccagauaccggaagaguacuauucgaauguaaauuacacaaaucaggauacgucaccguagcucauacaggacaacacgacuuaguaauaccaccaaacggauauuuuagguucgacucauggguuaaucaguucuacacacuagcaccaauggguaacggaacaggaagaagaagagcacuauaa

SEQ ID NO: 31782 - RNA, 1623 nt, Artificial Sequence
  derived and/or modified sequence opt6 from VP1__Norovirus__AIV43159
augaaaauggccucauccgaugcaaacccaucagaugguuccgcagcaaaccuaguacccgaaguaaauaacgaaguaauggcucuagaaccuguaguaggugcagcaauugcugcuccaguagcaggacaacaaaauguaauugauccuuggauaagaaacaacuuuguacaagcaccaggaggagaauuuaccguuucuccacguaacgcaccuggagaaauauuauggucugcaccccuagguccagauuuaaauccauauuuaucucaccuagcaagaauguacaaugguuaugcaggaggauuugaaguucaaguaauauuagcugguaaugcuuucacugcagguaaaguuauuuucgcagcagucccccccaacuuuccaacagaaggucuaucaccaucacaaguaacaauguucccucacauaguugucgauguucgacaacuagaaccaguauuaauaccccuaccagacguaagaaauaacuucuaucauuauaaccaaucaaaugacccaacaauuaaacuaauagcuauguuauacacaccccuacgagccaauaaugcaggugacgauguauucacaguaucaugccgaguacuagcacgaccaagcccagacuuugacuucauauuuuuaguuccaccaacaguagaaucuagaacaaaaccauuuucaguaccaguccuaacagucgaagaaaugacaaacucaagauuuccaauuccauuagaaaaacuauucacagguccaucuucagcuuucguaguacaaccacagaacggaagaugcacaacagauggaguauuacucggaacgacccaauuaucaccuguaaauaucuguacauuucgaggcgauguaacacacauuacuggaucucgcaacuacacaaugaaucuagcaagccaaaauuggucaaauuacgauccaacagaagaaauaccagcaccacuaggaacaccugauuuuguaggaaaaauacaaggcguacucacccaaacuacaagaacagacggcagcacacgaggacacaaagcaacagucuacacagguucagcagauuuugcaccaaaauuaggacgaguacaauuugaaaccgacacagaucaugacuucgaagccaaucaaaacacuaaauucacaccaguugguguaauacaagacggaucgacuacacaccgaaacgaaccccaacaauggguauuaccaucauauucaggccgcaauacaccaaauguucacuuagccccugcuguagcaccuacauuuccgggagaacaacuucuuuucuucagaucuacaaugcccggauguuccggauauccaaacauggauuuagacugccuuuuaccacaagaauggguacaauacuucuaccaagaagcugcaccagcucaaucagaugucgcuuuauuaagauucgucaacccagacacuggaagaguauuauuugaauguaaacuccauaaaucuggauacguaacaguagcacacaccggucaacacgaucuaguaauacccccaaauggauacuuucgauuugauucauggguaaaucaauuuuauacauuagcuccuaugggaaauggcacaggacguagacgugcacuuuaa

SEQ ID NO: 31783 - RNA, 1623 nt, Artificial Sequence
  derived and/or modified sequence opt6 from VP1__Norovirus__AIV43160
augaaaauggcaucaucagacgcaaacccaucagacgguucagccgcuaaccuaguaccagaaguuaacaaugaaguaauggcacuagaaccugucguaggugcugccauagcugcuccuguagcaggucaacaaaacgucauugauccauggauuagaaacaacuuuguacaagcccccggaggcgaauuuacagucucacccagaaacgcaccaggugaaauccuauggucagcaccccuuggaccagaucuaaauccauaccucucccaucucgcacgaauguacaacggauacgcaggaggauucgaaguacaaguaauauuagccggaaaugcauuuacagcagguaaaguaauauuugcagcaguaccaccaaacuuuccuacugaaggacuaucacccagucaaguuacaauguucccucacauaguuguagacguaagacaauuagaaccaguacuaauuccacuaccagauguaagaaacaauuucuaccauuauaaccaauccaaugacccaacaauaaaauuaauagcaaugcuauauacaccccuuagagccaauaaugcaggagacgauguauucacaguuucaugcagaguucuaacuagaccaucaccagacuuugacuucauauuucuaguaccaccuacaguagaaucucgcacaaaaccauucucaguaccaguucuaacagucgaagaaaugacaaacucaagauuuccaauaccuuuagaaaaauuauuuacaggaccaucuucagcauuuguaguucaaccacaaaacggacgauguacaacagauggaguacucuuaggaaccacacaauuaucuccagucaauauuugcacuuuucgaggagacguaauacauauuacaggaagccgcaacuauaccaugaacuuagcaucccaaaacuggucaaacuaugauccaacagaagaaauuccagcaccucuagguacaccagauuuuguaggaaaaauacaagguguacuuacccaaacaaccagaacugacggaucaacaagaggacacaaagcaacaguauauacaggauccgcugacuucgcaccaaaacuaggaagaguucaauuugaaacagauacagaucaugauuuugaagcuaaucaaaauaccaaauuuacaccaguaggugucauacaagacggaucaacaacacaucgaaaugaaccacaacaauggguuuuaccuucauauagcggaagaaauacaccaaauguccaucucgcaccagcaguagcaccaacauucccaggagaacaacuuuuauucuuuagaucaacaaugccuggauguaguggauauccaaauauggauuuagauugccuccuuccacaagaauggguacaauauuuuuaucaagaagcagcaccugcacaaagcgacguagcauuacuuagauuuguaaauccagacacuggaagaguacuuuuugaauguaaauuacacaaaucuggauauguuacaguugcacauacuggacaacacgacuuaguaauaccaccaaacggguauuucagauuugauucuuggguaaaucaauuuuauacacuagcaccuaugggaaauggcacuggaagaagacgcgcucuauaa

SEQ ID NO: 31784 - RNA, 1623 nt, Artificial Sequence
  derived and/or modified sequence opt6 from VP1__Norovirus__AIV43161
augaaaauggcuucuucagaugcaaauccaucagauggcucagcagcaaacuuagucccagaaguaaacaacgaaguuauggcucuagaaccaguagucggagcagcaauugcagcaccaguagcaggacaacaaaacgucauagauccuuggauuagaaauaauuuuguacaagcaccagguggagaauuuacagucucaccaagaaaugcuccaggagaaauucucuggucagcuccauuaggccccgaucuaaacccauaucuuucucaucuagccagaauguacaacggauacgcagguggauuugaaguucaaguaauacuagcaggaaacgcauuuaccgcaggaaaagucaucuuugcagcaguuccaccaaauuuuccaacugaagguuuaucaccuucacaaguuacaauguuuccucacauuguuguagacguacgacagcuagaaccagucuuaauaccauuacccgauguuagaaauaauuucuaucacuauaaucaguccaaugaccccacaauaaaauuaauagcaaugcucuacacaccauuaagagcaaauaaugcaggagacgauguuuuuacaguauccugucgaguauuaacucgacccucaccagauuuugacuuuauauuccucguaccaccaacagucgaaucaagaacuaaaccauucaguguuccaguacucacaguagaagaaaugacaaauucaagauuuccaauaccauuagaaaaacucuuuacagguccuucaucagcauucgucguacaaccccaaaacgguagauguacaacugauggaguccuacuagguacuacacaacuaaguccaguaaauauaugcacauuuagaggagauguuauacauaucacaggauccagaaacuacacaaugaaucucgcaucucaaaacuggucuaauuaugauccaacagaagaaauaccagcaccucuaggaacaccagacuucgucgguaaaauucaaggaguauuaacucaaacaacacguacagauggaucaaccagaggacauaaagcaaccguauauacaggaucagccgauuuugcacccaaauuaggaagaguacaauucgaaacagacacagaucaugauuuugaagcaaaccaaaacacaaaauuuaccccuguaggaguuauccaagacgguucaacaacacauagaaacgaaccucaacaauggguauuacccucauauagcggacguaauacaccuaauguacacuuagcaccagccguagcaccuacauuccccggagaacaacuacuuuuuuuucgaucuacuaugccuggauguuccggauauccuaacauggaccucgauugucuuuuaccacaagaauggguacaauauuuuuaucaagaagcugcaccugcacaaucugacguagcuuuacuccguuucguuaauccagacacuggaagaguauuauucgaaugcaaauuacauaaaucaggauauguaaccguagcacauacaggucaacacgaucuaguaaucccacccaacgguuauuuuagauuugacucauggguuaaucaauuuuauacucuugccccaaugggaaaugguaccgguagaaggcgagcacuauaa

SEQ ID NO: 31785 - RNA, 1623 nt, Artificial Sequence
  derived and/or modified sequence opt6 from VP1__Norovirus__AIV43162
augaaaauggcaaguucagacgcuaaucccucggacggaucagcugcaaacuuaguaccagaagucaauaacgaagucauggcuuuagaaccuguaguaggagcagcaauagcagcaccaguagcaggacaacaaaacguuauagauccauggauaagaaacaacuuuguacaagcacccggaggugaauuuacuguauccccucgaaaugcaccaggagaaauacuauggucagcaccuuuaggaccagauuuaaauccauaccuaucacacuuagcaagaauguauaacgguuacgcaggaggcuuugaaguccaaguaauacuagcuggaaaugcauucacagcuggaaaaguaauuuucgcagcaguucccccaaacuuuccaacugaaggauuaucuccaucccaaguaaccauguucccucacauaguaguagauguccgacaacuagaaccaguacuuauaccacuaccagacguaagaaacaauuuuuaucacuauaaucaaucaaaugacccaacaauaaaauuaauagcaauguuauauacaccucuaagagcaaacaaugcaggagacgacguauucacaguaucaugucguguauuaacccgaccuucacccgacuuugauuucauauuccuaguaccccccaccguagaaaguagaacaaaacccuucucaguaccuguucuuacaguagaagaaaugacaaacucaagauuuccaaucccacuagaaaaauuauuuaccggccccuccucagcauuuguuguacaaccacaaaacgguagaugcacaaccgacggaguauuacuuggaacaacucaauuaucaccuguaaauauauguacuuuuagaggugauguuacacauauaacuggaucaagaaauuauacaaugaaucucgccucacaaaacuggucaaacuaugauccaacugaagaaauacccgcaccuuuagguacaccagauuuuguagguaaaauacaaggaguauuaacacaaacaacuagaacagacggcuccacucgcggccacaaagcuacuguuuacacaggauccgcagauuucgccccuaaacucggacgcguccaauucgaaaccgacacagaucaugauuucgaagccaaucaaaacacaaaauuuacaccugucgguguaauacaagauggauccaccacccauagaaaugaaccacaacaauggguucuaccuucauacucaggaagaaauacacccaauguucaccuagcaccagcaguagcaccaacauucccaggugaacaacuauuauuuuuuagaaguacaaugcccggauguucaggauauccaaacauggauuuagauugucuccuaccucaagaauggguacaauauuucuaccaagaagcugcaccugcucaaucagaugucgcacuauuaagauuuguaaauccugacacaggaagaguauuauucgaauguaaacuacauaaaucaggauacgucacuguugcccauaccggccaacacgaucuaguuaucccaccaaaugguuacuuccgcuucgacucauggguaaaucaauuuuauacucuagcuccaaugggaaauggaacaggaagaagacgagcacucuaa

SEQ ID NO: 31786 - RNA, 1623 nt, Artificial Sequence
  derived and/or modified sequence opt6 from VP1__Norovirus__AIV43163
augaaaauggcauccuccgaugccaauccaucugauggaagugcagccaauuuaguuccagaaguaaacaaugaaguaauggcauuagaaccaguuguuggagcagcuauagcugcaccuguagcaggccaacaaaauguuauagaucccuggauuagaaauaauuucguacaagccccuggaggagaauuuacaguaucaccacguaaugcaccaggcgaaauacuaugguccgcaccucuaggacccgaucuaaacccauaucucucacaccuagcaagaauguacaacggauacgcagguggcuuugaaguacaagucauauuagcuggaaaugcauucacagcagguaaaguaauauucgcugccgucccaccuaauuuucccaccgaaggccucucaccaucacaaguaacaauguuuccacauauuguuguagacguaagacaguuagaaccaguauuaauaccucuuccagauguaagaaauaauuucuaccauuauaaucaaucaaaugacccaaccauaaaauuaauagcaaugcucuacacaccauuaagagcaaauaacgcaggugacgacgucuuuacaguuuccuguagaguacugacaagaccaucaccagauuuugacuuuauuuuuuuaguuccaccaacaguugaaucuagaacaaaaccauuuucaguaccaguacuaacuguagaagaaaugacuaauucucgauuuccaauuccacuagagaaauuauuuacaggcccuucauccgcauuuguuguacaaccucaaaacgguagauguacuacagacggaguacuacuaggaacaacacaauuaaguccuguaaauauuuguacauuucgaggagacguaacccauauaacuggauccagaaauuauacuaugaaccuagcaucacaaaacuggucaaauuaugaccccaccgaagaaaucccugcaccacuuggaacaccagauuuuguaggaaaaauucaagguguuuuaacacaaaccacaagaacugacggaucaacacgcggccauaaagcaacaguauauacaggaucagcagacuuugcucccaaauuaggaagaguucaauucgaaacugauacagaccacgacuucgaagcuaaccaaaauacaaaauuuacacccguuggaguaauucaagacgguaguacaacccacagaaaugaaccacaacaauggguauuaccaucauauucaggcagaaauacaccuaacguacacuuagcuccugcaguugccccaacauuucccggcgaacaauuacuauucuuuagaucuacuaugccagguugcucaggauauccaaauauggauuuagauugcuuauuaccucaagaauggguccaauauuucuaucaagaagcagcaccagcacaaucugauguugcauuauuaagauucguuaacccagacaccggaagaguauuauuugaaugcaaacuacauaaauccggauauguaacuguagcacauacaggacaacacgaucuaguaauaccaccaaacggcuacuuccgauuugacuccuggguuaaccaauucuauacacuagcaccaaugggcaauggaacaggaagacgaagagccuuauaa

SEQ ID NO: 31787 - RNA, 1623 nt, Artificial Sequence
  derived and/or modified sequence opt6 from VP1__Norovirus__AIV43164
augaaaauggcaucaagcgaugcuaacccaucugauggaucagcagcaaacuuaguuccagaaguaaacaacgaaguaauggcacuagaacccguaguaggagccgcuauagcugccccugucgcaggacaacaaaauguaaucgacccauggauacgaaacaacuuuguccaagcaccugguggagaauucacaguaucaccaagaaaugcuccuggcgaaauucuauggucagcacccuuaggaccugaucuaaauccauaccuaagccaccuagcccgaauguacaacgguuaugcaggaggauucgaaguucaaguaaucuuagcagguaaugcauuuaccgcugguaaagucauuuucgcggcaguaccaccuaacuucccaacugaaggauuauccccaucucaaguuacaauguucccacauauaguuguugacguuagacaauuagaaccaguucuaauaccacucccagauguacgcaacaacuucuaucacuauaaucaaucaaaugauccaacaauaaaacucauagcaaugcuauacacuccccuaagagcuaauaaugcaggagacgauguauuuacaguuaguuguagaguacuuacuagaccaagcccagacuucgauuuuaucuuucuaguaccaccaacaguagaaucacgaacuaaaccauucucaguaccaguauuaacuguugaagaaaugacaaauucaagauucccaauaccacucgaaaaauuauuuacaggcccaucuucagcauuuguaguacaaccacaaaauggaagauguacaacagacggaguauuauuaggaaccacucaacuuucaccagucaauauauguaccuucagaggagauguaauacauaucacuggcucaagaaauuauacaaugaauuuagccagccaaaacuggucaaauuacgacccaacagaagaaauaccagcaccgcuagguacaccagauuuuguaggcaaaauacaaggaguauuaacccaaacaacuagaacagacggaaguacaagaggccauaaagcaacuguauauaccggaucugcagauuuugcacccaaauuaggacgaguacaauuugaaacagacacugaccacgauuucgaagcaaaucaaaacacaaaauuuacacccguaggaguuauccaagacggcucuacuacucauagaaaugaaccccaacaauggguacuaccuucauauuccggacgaaauacaccaaacguacaccuagccccagcaguagcaccuaccuuccccggagaacaacuacuauucuuuagaucaacaaugccugguugcucaggcuauccaaauauggauuuagacugccuauuaccacaagaauggguucaauauuuuuaucaagaggccgcuccagcucaaucagacguagcauuacuucgauuuguaaacccagacacaggaagaguauuauucgaaugcaaacuacauaaauccggauauguaacuguagcacauacaggacaacacgauuuaguaaucccaccaaacggauauuuccguuucgauucuuggguaaaucaauuuuacacacuagcccccaugggaaauggaacaggaagacgaagagcacuauaa

SEQ ID NO: 31788 - RNA, 1623 nt, Artificial Sequence
  derived and/or modified sequence opt6 from VP1__Norovirus__AIV43165
augaaaauggcaucaucagacgcaaauccaucagacggaucagccgccaauuuaguaccugaaguaaauaaugaaguuauggcauuagaaccaguaguaggcgcagccauagcugcaccaguagcaggacaacaaaaugucauagauccuuggauucgcucuaacuuuguacaagcaccuggaggugaauucaccgucagcccaagaaaugcacccggagaaauccuauggucugcaccacuagguccugauuuaaacccauacuuaucacacuuagcacgaauguacaauggauaugcaggaggauucgaaguccaaguaauucuagcaggaaaugcauuuacagcaggcaaaguaauauuugcagcaguucccccaaauuuuccaacagaaggacucucacccucacaaguaacaauguucccucauauaguagucgauguaagacaacuagaacccguacuaauaccacuaccagauguaagaaacaacuucuaucauuacaaucaaaguaaugacccaaccauaaaauuaauagcaaugcuauacacaccauuacgagcuaauaaugccggagaugacguauuuacaguaucaugucgaguuuuaacacgaccaaguccagauuucgacuuuauauuccuaguaccaccaaccguugaaucaagaacgaaaccauucucaguacccguuuuaacagucgaagaaaugacaaauucaagauuuccaauaccauuagaaaaauuauucacaggaccaaguagcgcauucguaguacaaccacaaaacggucgauguacaacugauggcguacuccuuggaacaacccaacucucaccuguaaacauauguacauuuaggggagacguuacacacauaaccggaucaagaaacuauacaaugaaccuagcaucucaaaauuggucaaauuacgauccuacagaagaaauaccagcaccacuaggaacuccagauuucgucggaaaaauccaaggaguauuaacacagacaacuagaacugacggauccacuagaggucauaaagcaacaguauauacagguagcgccgacuucgccccaaaacuaggcagaguacaauucgaaacagacacagaucacgauuucgaagcaaaucaaaauacaaaauuuacaccaguaggcguaauacaagacggaggaacuacacaucgaaaugaaccacaacaauggguacuuccaucauauuccggacgcaacacuccuaauguccaucucgcacccgcaguagccccuacuuucccaggugaacaacuacuuuuuuuucgaucaacaaugccagguugcucaggauauccaaauauggacuuagacugccucuuaccacaagaauggguacaauacuuuuaccaagaagcagcaccagcacaaagugacguagcacuucuacgauucguuaauccagacacuggaagaguauuauucgaauguaaacuacauaaaucaggauauguaacuguagcacacacaggccaacaugauuuaguaauaccacccaauggauauuuccgauucgacagcuggguuaaucaauuuuauacuuuagcaccuauggguaacggaacaggaagacgaagagcauuauaa

SEQ ID NO: 31789 - RNA, 1623 nt, Artificial Sequence
  derived and/or modified sequence opt6 from VP1__Norovirus__AIV43166
augaaaauggcuucaucagacgcaaacccuucagauggaagcgcagcaaaucuugucccugaaguaaauaaugaaguuauggcacuagagccaguaguaggagccgccauugccgcaccaguugccggacaacaaaauguaaucgauccauggauacgaaacaacuuuguacaagcaccuggaggugaauuuaccguuuccccaagaaacgcaccaggagaaauuuuauggucugcaccacuagguccagaucuaaauccauaucuaucacaucuugcaagaauguauaacggauaugcaggagguuuugaaguccaagucauuuuagcuggaaaugcauuuacagcugguaaaguaauauucgcagcaguaccaccaaauuuuccuacagaaggacuaucacccucacaaguaacaauguucccacacauaguaguagacguaagacaauuagaacccguucuaauuccauuaccugacguaagaaacaacuuuuaccacuauaaucaaucaaacgacccaacaauaaaacuuauagcaauguuauauacuccccuacgagcaaauaaugcaggugacgauguauuuacuguaucauguagaguccuaacaagaccauccccugacuuugacuucauauuuuuagucccaccaacaguagaaucuagaacaaaacccuucucugucccaauacuaacaguugaagaaaugacaaacuccagauucccaaucccauuagaaaaauuauuuacaggaccaucauccgccuucguuguucaaccucaaaauggacgcuguacaacagacggaguauuacuagguacuacucaacuaucuccagucaauauauguacauucagaggagacguaacacacauaacaggcucaagaaauuacacaaugaaucuagcaucacagaauuggagcaauuaugacccaacagaagaaauaccagcaccucuaggaacaccugacuuuguagguaaaauccaagguguauuaacccaaacaacacgaacagacggaucaacccgaggacacaaagccacaguauauacaggaucagcugacuucgcaccaaaauuaggaagaguccaauuugaaacagauaccgaccacgauuucgaggcaaaucaaaacaccaaauuuacacccguuggcguaauacaagacggaucaacaacacauagaaacgaaccucaacaauggguauuacccuccuacucaggaagaaauacuccaaacguucacuuagccccugcagucgcuccaacauuuccuggagaacaauuauuauuuuuccgauccacaaugccuggaugcucaggauacccaaauauggauuuagacugccuuuuaccacaagaauggguucaauacuuuuaucaagaagcagcaccagcacaaucagacgucgcauuacuaagauuuguaaacccugacacaggcagaguucuauuugaaugcaaacuucauaaaaguggauauguaacuguagcucacaccggacaacacgaucuagucauaccaccaaauggauauuucagauucgauucuuggguuaaccaauuuuauacauuagcacccaugggaaauggaacuggaagaagaagagcauuauaa

SEQ ID NO: 31790 - RNA, 1623 nt, Artificial Sequence
  derived and/or modified sequence opt6 from VP1__Norovirus__AIV43167
augaaaauggcaaguucagaugcuaacccaucagauggauccgcagcaaauuuaguaccugaaguaaauaaugaaguaauggcauuagaaccaguuguaggagcagcuauugcagcaccaguagcuggccaacaaaauguuauagaucccuggaucagaaacaacuuuguacaagcaccagguggagaauuuacuguaucaccucguaacgccccuggcgaaaucuuauggucagcaccuuuaggcccagaucuaaacccauauuuaagccacuuagccagaauguauaacggauaugcaggugguuucgaaguucaagucauacuagcagguaaugcauucaccgccggaaaaguaaucuucgcagcaguuccaccaaacuuuccaacugagggauuauccccaagucaagucacaauguuuccacacauuguaguagacgucagacaacuugaaccaguccuuauuccauuaccagauguaagaaauaauuuuuaucacuauaaccaaucaaaugacccaacaauaaaauuaauugcaaugcuauauacaccacuacgugccaauaacgcaggagacgauguuuuuacaguuagcugcagaguuuuaacaagaccaucaccagacuucgacuuuauauuuuuaguaccaccaacaguagaauccagaacaaaaccauucucaguacccguuuuaacaguggaagaaaugacaaacucaagauuuccaauaccuuuagaaaaauuauuuacuggacccucaucagcauucguaguacaaccacaaaauggaagaugcaccacugacggaguguuacuaggaacaacacaauuaagcccaguaaauaucuguacauuuagaggugacguaacacacaucacagguucacgcaauuacacaaugaauuuggcuucacaaaauuggaguaauuaugacccaacagaagaaauaccugcaccucuaggaacaccagacuucguagguaaaauccaaggaguauuaacacaaacaacaagaaccgacgguucuaccagaggacacaaagcaacaguauauacuggauccgcagacuuugcaccaaaauuagguagaguacaauucgaaacagauacagaucacgauuucgaaacaaaucaaaauacaaaauuuacucccguagguguaauccaagauggcucuaccacucauagaaacgaaccacaacaauggguucuaccuucauacucaggacguaauaccccuaauguccauuuagcaccagcuguagcaccuacauuuccaggagaacaauuacuauuuuuuagaucuacaaugccaggauguucuggauauccaaacauggaccucgacugcuuauuaccccaagaauggguacaauacuucuaccaagaagcugcacccgcccaaucagacguagcacuacuacgauucguaaauccugacacaggaagaguauuauuugaauguaaacuacacaaaucaggauaugucacaguagcacauacaggacaacaugacuuagucaucccucccaacggauauuuucgcuuugacucaugggucaaucaauuuuacacacuagcaccaaugggaaauggaacaggaagacgcagagcacuauaa

SEQ ID NO: 31791 - RNA, 1623 nt, Artificial Sequence
  derived and/or modified sequence opt6 from VP1__Norovirus__AIV43171
augaaaauggcaucaucagaugcaaacccauccgauggcucugcugcaaaccucguaccggaaguaaacaaugaaguaauggcacuagaaccaguaguaggugcagcgauagccgcaccuguagcuggucaacaaaacguaauugauccauggauaagaaauaacuuuguacaagcaccaggaggagaauuuacaguauccccaagaaaugcaccaggcgaaauauuauggucagcaccacuaggacccgauuuaaauccauaccuaucacaucuugcacggauguauaacggauaugcaggagguuuugaaguccaagucauucuagcaggaaaugcuuuuaccgcaggcaaaguaauuuucgcugcaguacccccaaacuuccccacugaaggacuauccccaucacaagucacaauguuuccucauaucguaguagauguacgacaacuugaaccaguauuaauucccuuaccagacguaagaaacaauuucuaucacuauaaccaaucuaaugaucccacaauaaaauuaauagcaaugcuauacacuccacuacgagcuaacaacgcuggagaugauguauuuacaguaucaugcagaguacuaacaagaccaucuccugacuucgacuucauauuccucgucccaccaacaguagaaucaagaacaaaaccuuuuucuguaccuguauuaacaguagaagaaaugaccaauucacgauucccaauuccacucgaaaaacuuuucacagguccaucuucagcauucguaguacaaccacaaaacggaagauguacaacugacggaguauuauuaggaaccacccaacuaucaccuguuaacauaugcacauucagaggagauguaacacauaucacagguucacacaauuacacuaugaaucuagcaucacaaaauuggaauaauuacgauccaacugaagaaauaccagcaccauuaggaacaccagacuuuguuggaaaaauucaaggaguauuaacacaaaccacaagaaccgacggaucaacacguggacauaaagccaccguauauacaggauccgccgauuucgccccaaaauuaggcagaguacaauuugaaacagacacaaaucacgacuucgaagccaaucaaaacacaaaguuuacaccaguuggaguuauucaagacggcggaacaacacaucgaaacgaaccacaacaauggguauuaccaucauacucaggcagaaauacaccuaauguacauuuagcaccagcaguagcaccaacauuuccaggagaacaauuauuauuuuucagaaguacuaugccugguugcucaggauauccaaacauggacuuagauuguuuacucccacaagaguggguacaauacuuuuaucaagaagcagcaccagcacaaucagauguagcacuucucagauuuguaaauccagauacaggacgugucuuauucgaaugcaaacuacauaaaucaggcuauguaaccguagcucacacuggacaacacgaucuaguaaucccacccaauggauacuuccgauucgacucauggguaaaucaauuuuauacacuagcuccuaugggcaauggaaccggucgacgaagagcacucuaa

SEQ ID NO: 31792 - RNA, 1623 nt, Artificial Sequence
  derived and/or modified sequence opt6 from VP1__Norovirus__AIV43172
augaaaauggcaucaagcgaugcaaaccccucagauggauccgcagcaaacuuaguucccgaaguaaauaacgaaguuauggcacuagaaccaguaguaggagcugcaauugcagcuccuguagcuggucaacaaaauguuauugacccauggauaaggaacaacuucguucaagcaccaggaggagaauucacuguaucuccaagaaacgcaccaggcgaaauauuauggucagcaccacuaggacccgauuuaaauccauauuuaucucauuuagccagaauguauaauggauaugcaggaggauuugaaguacaaguaauauuagcuggcaaugcguuuacagcaggcaaaguaaucuuugcagcaguuccuccaaauuucccuacugaaggacucagcccaucacaaguaacuauguuuccacauauaguaguagauguaagacaacuagaaccgguauuaauaccucuaccagauguacguaauaauuuuuaccauuauaaucaaucaaaugacccaacaauuaaauuaauagcaaugcucuauaccccucuaagagcaaauaaugccggugacgauguauuuaccguaucauguagaguucuaacacgaccuaguccagauuuugauuuuauuuuucuaguaccacccacuguugaaagucgaacaaaacccuuuucagugccuguuuuaacagucgaagaaaugacaaacucaagauuuccaauaccauuagaaaaacuauuuacuggcccaucauccgcuuuuguaguacaaccacaaaauggaagauguacaacagacggaguccuauuaggaacaacucaauuaucaccaguaaacauauguacuuuuagaggagacguaacacacauaacagguuccagaaauuacaccaugaauuuagcaucacaaaauuggucaaauuaugauccaacagaagaaauaccagcaccacuaggaacaccugacuuuguaggcaaaauacaaggcaugcuaacacaaacuacuagaacagacggauccaccagaggacacaaagcaacaguauauacagguucagcagauuuugcaccuaaauuaggaagaguccaauuugaaaccgauacugaccaugauuucgaagcaaaccaaaauacaaaauuuacaccaguaggcguaauacaagauggaucaacaacacauagaaaugaaccacaacaauggguauuacccucauauuccggacguaauacuccuaauguccaucuagcaccugccgucgcaccaaccuuuccaggagaacaauuacuauucuuuagauccacaaugccagguugcagcggauacccuaauauggauuuagacugucuucuuccccaagaauggguucaauauuuuuaucaagaagcagcaccagcacaaucagauguagcauuacuacgauucguaaacccugacaccggcagaguacuuuuugaauguaaacuucacaaaucaggauaugucacaguagcacauacuggacaacaugauuuaguaauacccccaaauggauacuuccgauuugauucauggguaaaucaauuuuauacacuagccccaaugggaaauggaacaggaagaagacgagcacuauag

SEQ ID NO: 31793 - RNA, 1623 nt, Artificial Sequence
  derived and/or modified sequence opt6 from VP1__Norovirus__AIV43173
augaaaauggcaagcagcgacgcaaacccaucagacggcucagcagcuaaccuuguaccagaaguaaauaaugaaguaauggccuuagaaccaguaguaggugcagcuauagcagccccuguagcaggucaacaaaacgugauugauccauggauacgcaauaauuuuguacaagcaccaggcggagaauucacaguaucaccaagaaaugcaccaggagaaauacuauggucagcacccuuaggaccagaucuuaauccauaccuaucacacuuagcaagaauguauaauggcuacgcaggaggauuugaaguacaaguaauccuagcuggaaaugcauuuacagcaggcaaaguaaucuucgcagcagucccaccaaauuucccaacagaaggacuaucacccucucaaguaacuauguuuccacauauaguaguagauguuagacaacuagaaccaguauuaauuccacuacccgacguucguaacaauuuuuaucauuacaaccaaucaaaugauccaacaauaaaauuaauagccaugcuauauacuccauuaagagcaaacaaugccggugacgauguuuucacaguaucuugccgaguacuaacacgaccuucuccagauuucgacuuuaucuuucuaguaccaccuaccguagaaucuagaacaaaaccauucuccguaccaguuuuaacuguugaagaaaugacaaauucaagauucccaauaccccucgaaaaauuauuuacaggucccucaucagcauuuguaguacaaccacaaaauggaagauguacaacagauggaguacuauuaggcacuacucagcuaucaccuguaaacauauguaccuucagaggagauguuacccauauaacaggcagucacaauuacacaaugaaucuugcaucucaaaauuggaacaauuaugauccuacagaagaaauaccagcaccccuaggcacacccgacuucguaggaaaaauacaaggaguccuaacucaaaccacaagaacugacggaucaacaagaggacauaaagccacaguauacacaggaucagcagacuucgcaccaaaauuaggaagaauacaauuugaaaccgauaccaaccacgauuuugaagcaaaucaaaauacaaaauuuacaccaguaggcguaauacaagauggaggaaccacacacagaaaugaaccucaacaauggguacuaccuucauacucaggaagaaauaccccaaauguacacuuagccccagcaguagcuccaacauuuccuggagaacaauuauuauucuuuagaucuacaaugccaggcugcucaggauacccaaauauggauuuagauugccuucuaccacaagaauggguacaauauuuuuaucaagaagcagccccagcucaaucagacguagccuuauuaagauucguaaauccagacaccgguagaguacuuuucgaaugcaaacuacauaaaucaggauauguaaccguagcacacaccggccaacacgauuuaguaauuccaccaaaugguuacuuuagauucgauagcuggguaaaucaauucuauaccuuagcaccaauggguaauggaacgggacgaagacgagcacuauaa

SEQ ID NO: 31794 - RNA, 1623 nt, Artificial Sequence
  derived and/or modified sequence opt6 from VP1__Norovirus__AIV43174
augaagauggccucaagcgacgcaaaucccagugacggaucagcagcaaacuuaguaccagaagucaauaaugaaguaauggcauuagaaccuguuguaggagcagccauagcagcaccagucgcaggccaacaaaacguaauagacccuuggauaagaaauaauuuuguacaagcaccaggaggugaauuuacuguaagcccaagaaaugccccuggagaaauacuauggucagcaccacuuggaccugauuuaaacccauaucuaucacacuuagcaagaauguacaacggauaugccggaggauuugaaguacaaguaauacuagcuggaaacgccuuuaccgcaggaaaaguaauauucgccgcaguuccaccuaacuucccaacagaagguuuaucaccaucucaaguuaccauguucccccacaucguagucgacgucagacaacuagaaccuguacuuauaccacuuccagauguacgaaacaauuucuaucauuauaaccaauccaaugacccaacaauaaaacuaauagcaaugcuauauacaccauuacgagcuaauaaugcaggagacgauguauucacagucaguuguagaguauuaacuagacccucaccugacuucgauuuuaucuucuuaguaccaccaacuguagaaucacgcaccaaaccauuuuccguaccuguacuaacaguagaagaaaugacaaacucacguuuuccaaucccacuugaaaaacuuuuuacaggaccaucaucugccuuuguaguucaaccccaaaacggacgcuguacaacagaugguguacuauuaggaacaacucaauuaucaccaguaaauauauguacauucagaggagacguaacucacauaacaggaucaaggaauuauacaaugaaucuagccucacaaaacuggaauaacuacgauccaacagaagaaaucccugcacccuuaggaaccccagacuucguaggaaaaauacaaggaguacuuacacaaacuacaagaacagaugguucaacaagaggacauaaagccaccguauacacagguagcgcugauuucuccccaaaauuagguagaguacaauucgaaacagauacagaucacgauuuugaagcuaaucaaaacaccaaauuuaccccaguaggcguaauacaagacgguggaacaacucauagaaaugaaccacaacaauggguacuaccaucuuauucuggaagaaauacaccaaacguacaucuugcaccugccguugcaccuacauuucccggagaacaacuauuguuuuucagaucaacaaugccaggaugcucggguuauccaaauauggacuuagauugccuccuaccacaagaauggguacaauacuuuuaccaagaagcagcaccagcccaauccgacguagcauuacuacgauuuguuaauccugauacaggaagaguuuuauucgaauguaaauuacauaaaucaggcuacguaacaguagcacauacaggacaacacgaucuaguaauaccaccaaaugguuauuucagauuugauucauggguaaaucaauuuuacacacuagcacccaugggaaaugguacaggaagacgaagagcucuuuaa

SEQ ID NO: 31795 - RNA, 1623 nt, Artificial Sequence
  derived and/or modified sequence opt6 from VP1__Norovirus__AIV43175
augaaaauggcaucaucagaugcuaauccaucagauggaucagcagccaaucuaguaccagaaguuaacaaugaaguaauggcuuuagaacccguagucggagcagcaauagccgcuccaguagccggucaacaaaauguaauugauccauggauaagaaauaauuuuguacaagccccuggaggcgaauucaccguuucaccacgcaaugcaccaggagaaauacuauggucagcaccuuuaggaccagaccuaaauccauaucuuucacaccuagcuagaauguacaauggauacgcaggagguuuugaaguucaaguaauacucgcaggaaaugccuuuacugcuggaaaagucauuuucgcagcaguacccccaaauuuuccuacagaaggacuaucucccucacaagucacaauguuuccacauaucguaguagacguaagacaauuagaaccaguauuaauuccauuaccagauguaagaaauaauuuuuaucauuauaaucaaucaaacgauccaacaauaaaauuaauagcaaugcuauauaccccccuacgagcaaacaaugcaggagacgaugucuuuaccguaaguugcagaguacuaacaagaccuucuccagauuucgauuucaucuuucuagucccaccaacuguagaaucaagaacaaaaccuuucucaguaccuguauuaaccguagaagaaaugacaaacucacgauucccaauaccccuagaaaaauuauuuacaggaccaucaucagcauucguaguccaaccacaaaacggacguuguacaacugaugguguccuuuuaggaacaacacaacucuccccaguaaauauauguaccuuccgaggagauguuacccauauaacaggaucccgaaauuacacaaugaaucuagcaucacaaaacuggaauaauuaugauccaacagaagaaauaccagcacccuuagguacuccagacuuugucgguaaaauacaaggaguacucacucaaaccacuagaacugacggaucaacuagaggacacaaagcgacaguauauacagguuccgcagacuuuucccccaaauuaggaagaguccaauuugaaacugauacagaucaugauuucgaagcaaaucaaaauaccaaauuuacuccaguuggaguaauacaagauggcggcacaacccauagaaaugaaccacaacaauggguacuaccaucauacucaggaagaaauacaccaaauguacaucuugcaccagcaguugcccccacauuucccggugaacaauuacuauucuucagaucaacaaugccaggauguucaggauacccaaauauggauuuagacuguuuacuaccacaagaauggguucaauauuucuaccaagaagcagcccccgcacaauccgacguagcacuauuaagauuuguaaauccagauacaggaagaguauuauuugaauguaaauuacacaaaagcgguuauguaacuguugcacacacuggccaacaugauuuaguuauaccacccaauggauauuucagauucgacucauggguaaaucaauuuuauacauuagcuccaauggguaauggcacaggacgacgaagagccuuauaa

SEQ ID NO: 31796 - RNA, 1623 nt, Artificial Sequence
  derived and/or modified sequence opt6 from VP1__Norovirus__AIV43176
augaaaauggcaagcucagacgccaacccauccgacggaucagccgcaaaccuaguaccagaaguuaacaaugaaguaauggcacuagaaccaguuguaggugcagcuauagcagcuccaguagcaggccaacaaaacguuauagacccauggauaagaaauaauuucguccaagccccaggaggugaauucacaguuucaccaagaaaugcaccaggcgaaauacuauggucagcaccauuagguccagaccuaaaucccuaccuaucucaucuagccagaauguauaauggauacgcaggcggauucgaaguacaaguaauacuugcuggaaaugccuuuacugcaggaaaaguaauauucgcagcaguuccaccaaacuuuccaacagagggauuaucuccaucacaaguaacaauguucccacauauaguagucgacguacgacaacuagaaccaguauuaauuccauuaccagauguaagaaauaauuuuuaccauuauaaccaauccaaugauccaacaauaaaauuaauagcaaugcucuacacaccauuacgagcuaacaaugcaggagaugacguauuuacaguuucaugcagaguccuaaccagacccucaccugacuuugacuuuauauuucucguuccaccuacaguugaaucaagaaccaaaccguucucugucccaguauuaacugucgaagaaaugacuaacucuagauuuccaaucccuuuagaaaaacucuuuaccggaccaucgucagcuuucguaguacaaccacaaaacgguagaugcacaacagacggaguacuccuaggaacaacacaauuaaguccuguaaauauaugcacauuucgaggagaugucacucauaucacaggaucacguaauuacacaaugaaccuagcaucacaaaacuggucaaacuacgacccaaccgaagaaauaccagccccacuuggaacaccagacuuuguaggaaaaauacaaggagucuuaacucaaacaacaagaaccgaugguucuacaagaggacacaaagcaacagucuauacagguucagcagacuucgcaccaaaacuaggacgaguacaauucgaaacagacacugaccacgauuuugaagcuaaucaaaauacaaaauuuacuccaguaggaguaauacaagacggaucuacuacacauagaaaugaaccucaacaaugggucuuaccuucauauucaggaagaaacacaccaaacguacaucuagcaccggcagucgcaccaaccuuucccggagaacaauuauuauuuuuuagaucaacaaugccaggaugcuccggauaccccaacauggaccuagacugucuauuaccucaagaauggguacaauacuucuaccaagaagccgcuccagcacaaucugacguagcauuacuaagauucguaaacccagacaccggaaggguuuuauucgaaugcaaauuacauaaaucaggauacguaacaguagcucacacaggacaacaugaucuaguaauaccaccaaauggcuauuuuagauucgauucuugggucaaccaauuuuauacacuagcucccauggguaaugguacaggacgaagaagagcccuauaa

SEQ ID NO: 31797 - RNA, 1623 nt, Artificial Sequence
  derived and/or modified sequence opt6 from VP1__Norovirus__AIV43177
augaaaauggcuucaucagacgcaaacccuucagauggaagugcagcaaaucuaguaccagaagucaauaaugaaguaauggcacuagaaccaguuguaggugcugcaauagcagccccuguagcaggacaacaaaauguaauagacccuuggauaagaaauaacuuuguacaagcaccaggaggagaauuuacaguaucaccuagaaaugcaccaggagaaauacuuuggucugccccacuaggaccagauuuaaauccauauuuaucacaccuagcuagaauguauaauggauaugcaggcggauucgaggugcaaguaauacucgcagguaaugcauucacagcagguaaaguaaucuuugcugcuguuccaccaaacuuuccuaccgaaggccuuucuccaucucaagucacaauguucccacacaucguaguugacguccgacaacuagaaccaguauuaauaccacuaccagauguuagaaacaacuuuuaucacuauaaccaaucaaaugacccaacaauuaaauuaauagcaauguuauacacaccuuuaagagcaaauaaugcaggagacgacguauucacaguaagcuguagagucuuaacuagaccaucaccugacuuugauuucauauuucuaguaccaccaacaguugaauccagaacuaaaccauucucuguaccugucuuaacaguugaagaaaugacaaacucacgauuuccaauaccucucgaaaaauuauuuacuggccccucgagugccuucguaguacaaccucaaaauggaagauguacaacagacgguguucuucuuggaaccacccaacuuuccccaguuaauauauguacauuucgaggagauguaacacauauuaccggaagucguaauuauacaaugaauuuagccucacaaaacuggucaaauuacgacccaacagaagaaauaccugcaccucucggaacaccagacuucguagguaaaauacaaggaguacuaacacaaacaacaagaacagaugguucaacaagaggacacaaagcaacuguauauacuggaagcgccgacuuugcgccaaaauuaggaaggguacaauucgaaacugauaccgaucaugauuuugaagcuaaucaaaauacaaaauucaccccuguaggagucauacaagacggaggaaccacacauagaaaugaaccacaacaauggguacuacccucauacucaggcagaaacacaccaaauguacauuuagcuccagcaguagcacccacuuuuccaggugaacaauuacuauucuucaggucaacaaugcccggauguucaggauacccuaacauggaccuugauugcuuacuaccacaagaauggguucaauauuucuaccaagaagcagcaccggcacaaagugacguugcauuacuaagauucguaaauccagauaccgguagaguauuauuugaaugcaaacuacauaaaucaggauauguaacaguagcucacacuggucaacacgaucuagucauaccccccaauggauauuuccgcuuugacucaugggucaaucaauuuuacacauuagcaccaauggggaauggaacaggacgcagaagagcacuuuaa

SEQ ID NO: 31798 - RNA, 1623 nt, Artificial Sequence
  derived and/or modified sequence opt6 from VP1__Norovirus__AIV43178
augaaaauggcuucaucagaugcaaaucccucagauggcucagccgcaaacuuaguaccugaaguuaacaaugaaguaauggcccuagaaccaguuguaggcgcugcuauagcugcccccguagcaggacaacaaaacguaauagauccauggauucgaaauaacuuuguacaagcacccggaggugaauuuacaguauccccaagaaacgccccaggagaaauauuauggucagcaccucuugguccagaucuaaauccauaucuaucacaccuagcaagaauguauaauggcuacgcaggagguuuugaaguacaaguaauacuagcaggaaaugcauuuacagcaggaaaaguaauauuugcugccguaccuccaaauuuuccuacagaaggauuaucaccaucacaaguaacaauguuuccacauauaguaguagauguacgccaacuagaaccaguccucauuccauuaccugacguacgaaauaacuuuuaccauuauaaucaaagcaaugacccuacgauaaaacucauagcaauguuauacacuccacucagagcuaacaacgcaggagacgauguuuuuacaguaucauguagaguauuaacucgcccaucucccgauuuugauuucauuuuuuuaguaccaccaacgguagaaucacguacaaaaccuuuuucaguaccaguacuuacuguagaagaaaugacaaacucaagauuccccauuccauuagaaaaauuauucacaggaccuucaucagcuuuuguaguacaaccccaaaacggucgaugcacaaccgauggaguuuuauuaggcacaacacaauugucuccagucaauauauguaccuuucgaggugauguaacacauauaacugguagcagaaauuauacuaugaaccuagcaucacaaaauuggucaaauuacgacccaacagaagaaauaccagcaccacucggaacaccagacuucguagggaaaauacagggaaugcuaacacaaacaacaagaacagacgguucuaccagaggucacaaagcuacagucuacacuggcucagcugauuuugcuccaaaauugggacguguucaauuugaaacagauacugaccacgauuucgaagcaaaccaaaacacgaaauuuaccccaguaggaguaauacaagauggauccacaacacacagaaacgaaccccaacaauggguauuacccuccuacucaggaagaaauacaccaaauguacauuuagcaccugcaguagcaccaaccuuuccaggagaacaauuacucuuuuucagauccacaaugccaggguguucagguuauccuaacauggaccuagacuguuuauuaccccaagaauggguccaauacuuuuaucaagaagcagcaccagcacaaucagauguagcuuuacuaagauuuguaaauccagauacaggaagagucuuauuugaauguaaauuacacaaaagcggauaugucacaguugcccacacaggacaacaugaucuaguuauaccaccaaauggcuacuuucgauucgauucauggguaaaccaauucuauacauuagccccaaugggcaauggcacgggaagacguagagcacuauag

SEQ ID NO: 31799 - RNA, 1623 nt, Artificial Sequence
  derived and/or modified sequence opt6 from VP1__Norovirus__AIV43179
augaaaauggcaucaagugacgcuaauccauccgaugguucagcagcaaauuuagucccagaaguaaacaaugaaguaauggcauuagaaccaguaguaggagcagccauagcugcacccguugcaggacaacaaaauguuauagauccauggauacguaauaacuuuguacaagcaccaggaggagaauuuacaguuucaccaagaaaugcaccaggagaaauauuauggucagcuccacuagguccagauuuaaauccauacuuaucacauuuagcaagaauguauaauggauacgcuggaggauucgaaguacaaguaauacuugcgggcaacgcauuuacagccggaaaaguaauauuugcagccguacccccaaacuucccaaccgaaggacuaaguccaucacaaguaaccauguuuccccacauuguaguagacguaagacaauuagaaccaguuuuaauaccauuaccagaugucagaaauaacuuuuaucauuauaaccaauccaaugacccaacaauaaaacuaauagcaauguuauauacaccucuuagagcaaacaaugcaggagaugacgucuuuacaguaucauguagaguucuaacaagaccuucccccgacuuugacuucauuuuuuuaguuccaccaacuguagaaucuagaaccaaacccuucuccguaccaguuuuaacaguagaagaaaugacuaacaguagauuuccaauaccacuagaaaaacuuuuuacagguccaucaucagcuuuuguuguucaaccacaaaauggaagauguaccaccgacgguguccucuuaggaacaacacaacuaucuccaguaaauauauguaccuucagaggcgaugucacacacaucacugguucacgaaauuauacaaugaauuuagcaucucaaaacugguccaauuacgauccaacugaagauauaccugcuccauuaggaacaccagauuuugucgguaaaauucaaggugucuuaacacaaacaacaagaacugacgguucaacaagaggacacaaagcaacaguauauacaggaucugcugacuuugcaccaaaacuagguagaguacaauuugaaaccgauaccgaucacgauuucgaagcaaaccaaaauacaaaauucacuccuguaggaguaauacaagacggcggaacaacccaccguaaugaaccucaacaaugggucuuacccucauacucagguagaaauacaccaaauguucaccuugcaccugcaguagcaccaacauucccuggagaacaauuacuauucuuccgaucaacaaugccaggguguucugguuauccaaauauggaccuagacugucuacuaccucaagaguggguacaauauuucuaucaagaagcagcaccugcacaaucagacguagcccuauuaagauuuguuaauccagacacaggaagaguacuauuugaaugcaaauuacacaaaucaggauauguaacaguagcucacacaggacaacacgaucuaguaauaccaccaaauggauauuucagauuugauucauggguaaaccaauuuuacacccuugcacccaugggaaauggcacuggaagaagacgcgcauuauaa

SEQ ID NO: 31800 - RNA, 1623 nt, Artificial Sequence
  derived and/or modified sequence opt6 from VP1__Norovirus__AIY27747
augaaaauggcauccaacgaugccaaucccucugaugguagugcagcaaauuuaguacccgaaguaaauaaugaaguaauggccuuggaaccaguaguaggagcagcuauagcagcaccuguugcaggccaacaaaauguaauagacccuuggauaagaaacaauuuuguccaagccccaggaggcgaauuuacuguaucaccaagaaaugcaccaggagaaauacuauggucagcaccuuuaggaccugacuuaaauccuuauuuaucacauuuagcaagaauguauaauggcuaugcaggagguuucgagguccaaguaauauuagcuggcaaugccuuuacugcuggcaaaguaauauuugcagcaguaccaccaaacuuuccaacugaaggccucucacccucacaaguaacaauguuuccacauauaguuguagauguaagacaauuagaacccguucuaauuccacucccagacguacguaauaauuuuuaccauuacaaccaauccaaugacccaacaauaaaauuaauagcaaugcuauauaccccuuuaagagcaaauaaugcuggugaugauguauuuacugucagcuguagaguacuuacaagaccaucaccagacuuugauuuuauuuuucuaguaccuccaacuguagaaaguagaacaaaaccauucucuguuccaguacucaccguagaagaaaugacaaauucaagauucccuauaccacucgaaaaauuauucaccggaccaucaucagcauuuguaguucaaccacaaaacggacgauguacaacagacggaguacuauuaggaacuacacaacuaucaccuguaaacauauguacauuucgcggagacgucacacauauaacaggauccagaaauuauacaaugaaccuagcaagccaaaacuggaauaauuaugauccuacagaagaaauaccagcaccccucggaacaccagacuucguaggaaaaauccaagguguuuuaacucagacaacacgaacagacggaucaacuagaggacauaaagcaacuguauacacaggcucagcagacuuugcaccuaaauuaggaagaguacaauuugaaacagacaccgaccaugacuuugaagcaaaucaaaauacaaaauuuacucccgucgguguaauacaagacggaucaacaacacaucgaaacgaaccacaacaauggguauuaccaucuuauuccggaagaaauacaccaaauguucauuuagcaccugcaguugccccuacauucccaggcgaacaauuauuauucuuuagaucuacaaugccuggaugcucaggauauccuaauauggauuuagauugucuauuaccucaagaauggguucaauacuucuaucaagaagcagcuccugcacaaucugauguugcuuuauuacguuuuguaaauccagauacaggacguguauuauucgaauguaaacuccacaaaagcggauauguaacagucgcccauaccggccaacaugaucuaguaauaccaccaaacggcuauuuccgauucgacuccuggguaaaucaauuuuauacucuagcaccaaugggcaauggcacaggaagaagacgcgcacuauaa

SEQ ID NO: 31801 - RNA, 1623 nt, Artificial Sequence
  derived and/or modified sequence opt6 from VP1__Norovirus__AJA71387
augaaaauggccucaagcgaugcaaacccaucagauggaucagcugcaaaucuuguaccagaagucaacaaugaaguaauggcacuagaaccaguaguuggugcugcuauagcugcaccaguagcaggacaacaaaaugucauagauccauggauaagaaacaacuucguccaagcaccaggaggugaauucacaguaucaccaagaaaugcuccaggagaaauauuauggucggcaccauuaggaccagauuuaaacccauaccuaucacaccuagcaagaauguauaauggauacgcaggaggauucgagguucaaguuauacuugcaggaaaugcauuuacagcuggcaaaguuauauucgcugcaguaccaccuaacuucccaacugaaggccuaucuccaucccaaguaacaauguucccacacauuguaguagacguuagacaacuagaacccguauuaauaccccuaccagauguaagaaauaauuuuuaucacuacaaccaaucaaaugacccuacaauaaaauugauugcaaugcuauacacaccacuaagagcuaauaaugcaggagacgauguuuuuacaguauccugcagaguacuaacaaggccauccccugauuuugauuucauauuccuaguaccaccuacuguugaaucaagaacaaaaccauucucagucccaguuuuaaccguagaagaaaugacaaacucaagauuuccaaucccuuuagaaaaacuauuuaccggaccuucaucagcauuuguaguacaaccacaaaauggcagaugcacaaccgauggaguauuauuaggaacaacacaauuauccccaguuaauauaugcacauuucgaggcgauguuacccauaucaccggaagcagaaauuauacaaugaauuuagcaucucaaaauuggaauaacuaugauccaacugaagaaauaccugccccacuagguacaccagauuuuguaggaaaaauacaaggcguccuaacacaaacaaccagaacugacggaucaacaagaggacacaaagcaacaguauauacuggcucagcagacuucucuccaaaacuaggcagaguacaauuugaaacagauacagaucacgacuuugaagcaaaucaaaauacaaaauucacaccaguuggcguaauacaagacggagguacaacacauaggaacgaaccccaacaauggguucuuccaucauauucaggucgaaauacaccaaacguacauuuagcaccugcaguugcaccaacauuuccaggugaacaacuauuauuuuuuagaucaaccaugccaggaugcucaggauauccaaacauggauuuagauugcuuacuuccucaagaauggguacaauauuuuuaucaagaagcagcuccugcccaauccgauguugccuuauuaagauucguuaacccugauacugguagaguauuauuugaaugcaaacuacauaaauccgguuacguaacaguugcacacacaggacaacaugaucuaguuauacccccuaauggcuauuucagauucgauagcuggguuaaccaauucuauacucuugcaccaaugggaaauggaacaggcagaagaagagcacuauaa

SEQ ID NO: 31802 - RNA, 1623 nt, Artificial Sequence
  derived and/or modified sequence opt6 from VP1__Norovirus__AJA71388
augaaaauggcuagcucugaugcaaacccuucugauggcucagcugcaaaccuaguaccagaaguaaacaaugaaguacuagcuuuagaaccaguaguaggcgcagcuauagcagcaccagucgcagggcaacaaaauguaauagacccauggauacgaaauaauuuuguacaagcacccggaggagaauuuacaguaucuccaagaaaugccccaggugaaauacuauggucagccccccuagguccagaccuaaauccauaucuuucucacuuagcaagaauguacaacgguuaugcaggcggauucgaaguacagguuauacuagcaggaaaugcauuuacagcuggaaaaguuauauucgcugcaguacccccaaauuuuccaacugaaggccucaguccuucucaaguaacuauguucccacacauaguaguagauguaagacaauuagaaccuguauuaauaccucucccagacguaagaaauaauuuuuaucacuauaaucaaucaaaugauccaacaaucaaauuaauagcaauguuauauacaccuuuacgagcaaacaaugccggagacgacguauucacagucucauguagaguauuaacaagaccaucuccugauuuugacuuuauuuuucuaguaccacccacuguagaaucaagaacaaaaccauucucaguaccaauacucacugucgaagaaaugacuaauucaagauucccuauaccccuugaaaaauuauuuacaggaccaucuucagcuuucguaguacaaccacaaaacggacguugcacaacugacggaguacuacuaggaacaacacaacuuucaccuguaaacauaugcacauuuagaggagacguuacacauauaacagguucacacaauuacacaaugaaucuugcuagucaaaauuggucuaauuaugauccuacagaagaaaucccagcaccacuaggaacaccagauuucgucggcaaaauacaaggcguacuaacucaaaccacaagaacugacgguucaacacgaggucauaaagccacaguauauacaggaagcgccgauuucgccccaaaguuaggaagaguacaauucgaaacagacacagauagagauuucgaagcaaaucaaaauaccaaauuuacacccguagguguaauccaagacggaggaacaacacaccgaaaugaaccacaacaauggguacuaccaucauauuccggaagaaacacaccaaauguacacuuagcaccagcaguagcccccacauuuccaggugaacaacuauuauuuuuucgaucaacaaugccugguugcucugguuauccuaauauggacuuagauuguuuauuaccccaagaauggguacaauauuuuuaucaagaagcagcgcccgcacaaucagauguggcucuauuaagguucguuaauccagacacaggacgaguauuauucgaauguaaacuucacaaaucaggauauguuaccguagcucacacaggccaacaugaucuaguaauaccaccuaacggauacuucagauuugauuccuggguaaaucaauucuacacauuagcccccaugggaaaugguacaggaagaagaagagcacuuuaa

SEQ ID NO: 31803 - RNA, 1623 nt, Artificial Sequence
  derived and/or modified sequence opt6 from VP1__Norovirus__AJA71389
augaaaauggcaucaucagaugcuaauccauccgauggaucugcagcaaaucuaguaccagaaguaaauaaugaaguaauggcauuagaaccuguagucggagccgcuauagcugcuccaguugcuggacaacaaaacguaauagaccccuggauaagaaauaauuuuguucaagcaccaggcggagaauuuacaguuucaccaagaaaugcuccaggcgaaauacuauggucugcacccuuaggaccagaucuaaauccauauuuaagccaucuugcaagaauguacaacggauaugcuggcggauucgaaguacaaguaauacuagcugguaaugcauuuacagcaggaaaaguaauauuugcugcaguaccucccaacuuucccacagaaggacucaguccuucacaaguaacaauguuuccucauauagucgucgacguaagacaacuagagccaguauuaauaccauuaccugauguacgaaauaauuuuuaucacuauaaccaaagcaaugacccaacaauaaagcuuauagcaauguuauacaccccacuaagagcaaacaaugcaggcgacgauguuuuuacaguuucuugucgaguacuuacgagaccaaguccagauuuugacuuuauauuucuagucccaccaacaguagaguccagaaccaaaccuuucucaguaccuguauuaacaguagaagaaaugaccaauucccguuuuccaauaccauuagaaaaacuauuuacaggaccaucaucagcauucguuguucaaccacaaaaugguagaugcacaacagacgguguacuauuaggcacaacacaacuuucaccaguaaauauaugcacauuuagaggagauguaacacauauaaccggaucacgaaauuacacaaugaaccuagccucacaaaacuggagcaauuaugauccaacagaagaaauaccugccccauuaggcaccccagacuuuguaggcaaaauacaaggaauguuaacacaaaccacaagaacagaugguucaacaagaggacauaaagcaacugucuacacgggaucagcugacuuugcuccaaaacuaggaagaguacaauucgaaaccgacacugaucacgauuuugaagcaaaucaaaauacaaaauuuacaccuguuggcguaauacaagauggauccaccacacacagaaacgaaccacaacaaugggucuuaccuucauauucuggcagaaauaccccuaauguacauuuagcaccugcaguagcaccaacauuucccggagaacaacuacuauuuuucagaucaacaaugccaggauguucaggauaucccaacauggaucuagacugucuauuaccacaagaauggguacaauauuucuaucaagaagcagcuccugcucaaucagauguagcuuuauuaagauuuguaaauccagauacaggcagaguacuuuucgaauguaaacuccauaaaagcggcuauguuaccguagcacauacuggacaacacgacuuaguaauaccucccaaugguuauuuuagauuugauucauggguuaaucaauuuuacacucuagcaccaaugggaaacggaaccggacgaagaagagcauuauaa

SEQ ID NO: 31804 - RNA, 1623 nt, Artificial Sequence
  derived and/or modified sequence opt6 from VP1__Norovirus__AJA71390
augaaaauggcaucaagugaugcaaauccuucugacgguucagcagcuaaucuugucccagaaguaaauaaugaaguaauggccuuagaacccguugucggugcagcaauugcagcccccguagcaggacaacaaaauguuaucgaccccuggauaagaaauaauuuuguucaagcaccuggaggcgaauuuaccguaucuccaagaaacgcaccuggcgaaauacuauggucagcuccauuaggacccgaccuaaacccauacuuaagucaccuugcacgaauguacaacgguuaugcugguggauuugaaguacaaguaauacuagcaggaaacgcauuuaccgcugguaaaguaauauuugccgcaguaccaccaaacuucccaacagaaggucuaaguccaucacaaguaacaauguuuccccacauaguaguagacgucagacaacuugaaccuguacuaauaccacucccagacgucagaaacaauuuuuaccauuacaaccaaucaaaugacccaacaauaaaacuaauugcuaugcuauauacaccauuaagagccaauaaugcaggagacgauguuuucacaguaucuuguagaguauuaacaagaccuucaccugacuuugacuuuauauuuuuaguaccaccaacugucgaauccagaacaaaaccuuucucuguaccaguacucacugucgaagaaaugacuaauucuagauuuccaauaccauuagaaaaauuauuuacaggaccaucaucugcuuucguaguucaaccacaaaacggacgauguacaacagauggacuauuacuaggaacaacucaauuaucuccagucaauauauguaccuuccgaggugacguaacacacauaacaggaagcagaaauuacaccaugaaccuugcuucacaaaacuggaguaacuaugauccaacagaagaaauuccugcaccacuagguacaccagauuucguuggaaaaauucaagguguucuaacacaaaccacaagaacugacggaucaacaagaggacacaaagcuacaguauauacaggaucagcagacuuugcaccaaaacuaggaagaguacaauucgaaacagauacagaucacgauuucgaagcuaaccaaaauacaaaauucacaccuguaggugucauacaagacggaggaacaacccauagaaaugaaccacaacaauggguuuuaccuucuuauucaggccgaaacacaccaaauguucacuuagcaccagcuguagcaccaacauucccuggagaacaauuauuauucuucagauccaccaugccagguuguaguggauauccaaauauggauuuagauugcuuauuaccacaagaauggguacaauauuuuuaucaagaagcugcaccugcacaaucagauguugcauuauuacguuucguaaaccccgacacuggccgaguacuauucgaauguaaacuacauaaauccggauauguaacaguagcacacacaggacaacacgacuuaguuauuccaccaaauggauauuuuagauucgauucauggguaaaucaauuuuauacuuuagcccccaugggaaauggcaccggacguagacgagcacuauaa

SEQ ID NO: 31805 - RNA, 1623 nt, Artificial Sequence
  derived and/or modified sequence opt6 from VP1__Norovirus__AJA71392
augaaaauggcaucaucagaugcaaauccaucugacggcucagcagcuaauuuaguaccagaaguuaauaacgaaguaauggcauuagaaccagucguaggagcagccauagcagcuccaguagcaggacaacaaaauguaauagauccauggauucgaaacaacuuuguacaagccccaggaggagaauucacaguuucaccuagaaaugcaccaggugaaauacucuggucagcaccucuaggaccagaucuaaacccauacuuaucucaccuugcccgaauguauaauggauaugcaggaggauuugaaguucaaguaauacuugcuggaaaugcuuuuaccgcuggaaaaguaauauucgcagcaguaccuccaaacuuuccaaccgaagguuuaucaccuucacaaguaaccauguucccucauauagucguagacguucgccaacucgaaccaguauuaauaccgcuaccagacguacgaaacaauuuuuaucacuauaaccaaucaaaugauccaacaauaaaacuaauagcaauguuauacaccccuuuaagagccaauaaugcuggcgaugacguuuuuacuguaucauguagagucuuaacacguccuucgccagacuucgauuuuauauuucuaguaccaccaacaguagaaucacgaacaaaaccauuuucaguaccaguccuuacaguugaagaaaugacuaauucuagauuuccuaucccucuagaaaaacuauuuacuggaccaaguucagcauucguaguacaaccacaaaacggaagaugcacaacugauggaguacuauuagguacaacacaauuaucaccaguuaauauauguaccuuuagaggagauguuacacauauaacugguucacgaaauuauaccaugaauuuagcaucacaaaauuggucuaacuaugacccuaccgaagaaauuccugccccuuuaggaacaccagauuuuguaggaaaaauacaaggaguacuaacucaaaccacaagaacagauggaucuacaagaggucauaaagccacuguauacacuggcucugccgauuuugcaccuaaacuuggaagaguacaauuugaaaccgauacagaucaugauuuugaagcuaaccaaaacacaaaauuuacuccaguagguguuauacaagauggcaguacaacacauagaaaugaaccacaacaauggguacucccaucauauuccggaagaaauacgccaaacguacacuuagcacccgccgucgcaccaacauuuccaggcgaacaacuauuauuuuuuagaucaacaaugccaggauguucaggcuacccuaauauggaccuagauugccuacuaccacaagaauggguucaauacuucuaucaagaagccgcuccagcacaauccgacguagcacuauuaagauucguaaauccagacaccggccgagucuuguuugaauguaaauuacauaaauccggauauguaacaguagcccacacaggacaacaugauuuaguaaucccacccaacggauauuuuagauuugacuccuggguuaaccaauuuuacacauuagcaccaaugggcaauggaaccggccguagaagagcucuauaa

SEQ ID NO: 31806 - RNA, 1623 nt, Artificial Sequence
  derived and/or modified sequence opt6 from VP1__Norovirus__AJA71393
augaaaauggcaucaucugaugcuaacccuucagauggaucagccgcuaacuuaguuccagaaguuaauaaugaaguuauggcauuagaaccaguagucggugccgcuauagcagcaccaguagcaggccaacaaaauguaauugauccuuggauaagaaauaauuuuguacaggcaccaggaggagaauuuacaguauccccacgaaacgcaccaggagaaauacuauggucagcacccuuaggcccagauuuaaauccauauuuaucacauuuagcacguauguauaauggauacgcaggagguuuugaaguacaaguaauacuagcaggaaaugcauucacagcaggaaaaguaauuuuugcagcaguacccccuaauuuuccaacagaaggacuaaguccaagucaagucacaauguucccucauauuguaguagacguaagacaauuagaacccguguuaauaccacuucccgauguaagaaauaauuucuaccauuauaaucaaucaaaugauccaaccauaaaauuaauagcaaugcuauauacuccauuaagagcaaacaaugcaggugacgacguauuuacaguaucuuguagaguacuaacaagaccaucaccugacuuugauuuuauauucuuaguaccucccacaguagaaucuagaacaaaaccuuucucuguacccguauuaacagucgaagaaaugacaaauaguagauuuccuauacccuuagagaaauuauuuacuggaccaucuucagcauucguaguucaaccccaaaacggaagaugcacaacagacgguguauuacuuggaacaacacaauuauccccagucaauauauguaccuucagaggugacguaacacauauaacaggcaguagaaauuacacaaugaauuuagcaucacaaaacugguccaacuaugauccaacagaagaaauaccagcaccucuagguacaccagacuucguaggaaaaauccaaggaguauuaacacaaacaacacgaacagacggcucaacuagaggccacaaagcaacgguuuauacaggguccgcugacuuugcaccuaaauuaggacguguacaauuugaaacagauacagaucgagauuucgaagcaaaucaaaauacaaaauuuacaccaguuggaguaauacaagauggcgguacaacacauagaaaugaaccacaacaauggguccucccuucuuacucuggacgaaacacuccaaauguccaccuagcaccugcagucgcaccgaccuuuccuggagaacaacuacuauucuucagaucaacaaugccagguuguucuggauauccaaauauggaucuagacugucuucuaccacaagaauggguccaauauuucuaccaggaagccgccccugcacaaucugacguagcucuauuaagauuugucaauccagacacaggcagagucuuauucgaaugcaaauuacacaaaaguggauauguuacaguagcucauacaggacaacaugaucuaguaauaccaccaaauggauauuucagauucgauucaugggucaaucaauucuacacccuagcacccaugggaaacggaacaggaagaagaagagcauuauaa

SEQ ID NO: 31807 - RNA, 1623 nt, Artificial Sequence
  derived and/or modified sequence opt6 from VP1__Norovirus__AJA71394
augaaaauggcauccucagacgcuaaccccagcgauggaagugcagcuaaccuugucccagaaguaaacaaugaaguaauggcuuuagaaccaguuguaggcgcagcaaucgcagcacccguagcaggucaacaaaacguaauagacccauggauacgcaacaacuuuguacaagcaccaggaggagaauuuacaguaucaccaagaaaugccccaggagaaauacuuugguccgcaccucuagguccagauuuaaacccauaccuaucacaucuugcucgaauguauaacggauacgcaggcggcuuugaagugcaaguuauucuagcaggaaaugcauuuacagcaggaaaaguaauauuugcagcuguaccaccaaacuuuccuacagaaggccuaaguccuucacaaguaacaauguuuccccauauuguaguagacguuagacagcuagaaccaguacuaauaccccuaccagacguccgaaauaacuucuaccauuauaaccagucaaaugacccaacaauaaaacuaauagcaaugcucuacacuccauuaagagcaaauaaugcaggcgaugacguauuuacaguauccuguagaguacuaaccagaccaucaccagacuucgacuucauauuuuuagucccaccuacugucgaaucaagaacaaaaccauucucaguaccuguccuaacagucgaggaaaugacaaacuccagauuuccaauuccauuagaaaaauuauuuacaggacccuccucagcauucguaguacaaccacaaaauggccgcuguacaacagacgguguauuauuaggaacaacucaacuaucuccaguuaauauauguacauuuagaggagauguaacacacauaaccggaagucauaacuauacaaugaauuuagcaucccaaaacuggaguaacuacgauccuaccgaagaaauacccgcaccuuuaggaacaccagacuuuguaggaaaaauucaaggaguacucacacaaacaacacgcacagauggaucuacaagaggacauaaagcuacaguauauaucggaucugcugauuuugcaccaaaacuaggacgaguacaauucgaaacagauacaaaccaugauuuugaagcaaaucaaaauacuaaauucacaccaguagguguaauacaagacggaggaacuacacaucgaaaugaaccccaacaauggguucuuccauccuauucaggaagaaauacaccuaacguucaucuugccccagccguagcccccacauuuccaggagaacaauuauuauucuuuagaucuacaaugccaggaugcucaggcuauccaaauauggaucuagauugcuuacucccucaagaauggguucaauauuuuuaucaagaagcagcacccgcacaaucagacguagcgcuuuuacgauuuguaaauccagacacaggacgaguacuauuugaauguaaguuacauaaauccgguuauguaacuguagcacauacaggacaacacgaucuaguaauaccaccaaauggcuauuuccguuucgacagccgaguuaaucaauucuauacauuagcuccaaugggcaauggaacuggaagacgaagagcauuauaa

SEQ ID NO: 31808 - RNA, 1623 nt, Artificial Sequence
  derived and/or modified sequence opt6 from VP1__Norovirus__AJA71395
augaaaauggcaucuucagacgcuaauccaucagauggaucugcagcaaaccuugucccagaaguuaacaaugaagucauggcauuagaacccgucguaggugcugcaauagcagcaccaguagcaggacaacaaaacguuauagacccuuggauaagaaauaacuuuguccaagcaccaggaggugaauuuaccguaucuccaagaaaugcaccaggagaaauauuaugguccgcaccucuaggacccgauuuaaacccauauuuaucucacuuagcccguauguauaauggcuacgcaggagguuucgaaguacaaguaauacuugcuggaaaugcauuuacagcuggaaaaguaauuuuugcagcuguaccaccuaacuuuccaacugaaggacuaucaccaucgcaagucacaauguucccacacauaguaguagauguaagacaacuagaaccuguauuaauaccauuacccgauguuagaaauaauuucuaucacuauaaccaaucaaaugacccaacuauaaaacugauagcuaugcuauauaccccacuacgagcuaacaacgcaggcgacgaugucuucacagucuccugccgaguucuaaccagaccuuccccagauuuugauuucauauuucuaguaccaccaacaguagaaucucgaacaaaaccauucucagucccagucuuaacaguugaagaaaugacaaauucacgauucccaauaccacuagaaaaacucuucacagguccaucaagugcauuuguuguacaaccucaaaacggaagauguacaacagacgguguacuacucggaacaacacaacucuccccaguaaauauauguacauuuagaggcgauguuacccauaucacuggaucaagaaauuauacaaugaaucuagcaucacaaaauuggagcaauuaugaucccacagaagaaauuccagcaccuuuagguacacccgauuuuguagguaaaauacaaggagucuuaacacaaacaacuagaacagauggcucuacucguggacacaaagcuacaguuuauaccggaagcgcagauuucgcccccaaacucggaagaguacaauuugaaacugauacagaucacgacuucgaagcuaaucaaaauacuaaauuuacaccaguaggaguaauacaagacggcggaacuacccauagaaaugaaccacaacaauggguucuaccaucauauucuggaagaaauacaccaaauguacauuuagcaccagcuguagcgccuacauuuccaggugaacaacuacuauucuucagaucaacaaugcccggcuguucaggauauccaaauauggaccuagauuguuuacuaccacaagaauggguucaauauuuuuaccaagaagcagcaccagcacaaucagauguugcauuauuacguuucguaaauccagauacaggcagaguacuauucgaauguaaacuacauaaaucuggauauguaacuguagcacauacaggacaacacgaucuaguaauuccaccaaauggauacuucagauucgauagcuggguaaaucaauuuuacacacuagcaccaaugggcaauggaacuggacgcagaagagcuuuauga

SEQ ID NO: 31809 - RNA, 1623 nt, Artificial Sequence
  derived and/or modified sequence opt6 from VP1__Norovirus__AJA71396
augaaaauggccucaucagaugcaaacccuuccgauggcucagccgcuaacuuaguaccugaaguaaauaacgaaguaauggcacuagaaccuguaguaggagcagcaauagcagcaccagucgcaggacaacaaaacguaauagauccauggauaagaaacaacuuuguacaagccccagguggugaauuuaccguaagcccaagaaaugcaccaggagaaauacucuggucagcuccacuagguccagaccuaaauccauauuuaucacaccuagcaagaauguacaaugguuacgcaggaggauucgaaguccaagucauuuuagcaggaaaugcauuuacagcaggaaaaguaauauucgcagcaguaccaccaaacuuuccaacugaaggccuaucaccuucccaaguaaccauguuuccacacauaguuguagacguucgucaacuagaaccaguucuaauaccucuuccagauguccgaaacaacuucuaccauuacaaccaaagcaacgauccaacaauaaaacucauagcaaugcucuacacaccacuuagagcaaacaaugcaggagaugauguauucacuguuucaugucgaguauugacuagaccauccccagauuuugauuucauauuuuuaguaccacccacaguagaaucucgaaccaaaccauucucaguccccguacuaacaguagaagaaaugaccaauucaagauuuccaauaccacuagaaaaacuauuuacagguccaucaucugcuuuuguuguccaaccacaaaaugguagauguacaacagauggcguacuacuaggaaccacucaauuaucuccagucaauaucuguacauucagaggagauguaacacacauaacaggaucuagaaauuacacaaugaaucuagcaucacaaaacuggucaaacuacgacccaacagaagaaauacccgcaccucuaggaacaccagacuuuguaggaaaaauacaaggcaugcuuacccaaacaacccgaacagauggaagcacaagaggacacaaagcaacaguauauacaggauccgcagacuuugcaccuaaacuuggucguguacaauucgaaaccgauacagaccaugauuucgaagcaaaucaaaauacaaaauuuacacccgucggaguaauacaagacggaucaacuacacauagaaacgaaccacaacaauggguauuaccaucauauucagguagaaauacaccaaauguacauuuagcacccgccguagcaccuacauucccaggagaacaauuacucuuuuuuagaucaacaaugccaggaugcuccggcuauccuaauauggauuuagauugcuuacucccacaagaauggguacaauacuuuuaucaagaagcagcacccgcacaaagcgauguagcauuacuaagauucguuaacccagauacaggaagaguacuauucgaauguaaacuccauaaaucugguuacguaacaguagcauacacaggucaacacgauuuaguaauaccccccaauggcuauuuuagauucgauucauggguaaaucaauuuuacacauuagcaccaauggguaacggaacaggcagaagacgugcacuuuaa

SEQ ID NO: 31810 - RNA, 1623 nt, Artificial Sequence
  derived and/or modified sequence opt6 from VP1__Norovirus__AJA71399
augaaaauggcaucaucagaugccaaccccucagauggaucagcagccaaccuaguaccagaaguaaacaaugaaguaauggcuuuagaacccguaguuggagcagcuauagcagcuccaguagcaggacaacaaaauguaauugacccauggauaagaaacaauuuuguacaagcaccagggggagaauuuaccguaucuccaagaaaugcaccaggagaaauauuauggucagcaccacuaggcccagauuuaaacccauaucuaucucaccucgcaagaauguauaauggauacgcuggaggcuuugaaguucaaguaauacuagcugguaaugcauuuacagcugggaaaguaauauuugcagcagucccaccaaauuucccaacagaaggacuuucaccaucccaaguuaccauguuuccacacauagcaguagaugucagacaacuagaaccuguuuuaauaccccuaccagauguccgaaauaauuuuuaccacuauaaccaaucaaaugaccccaccaucaaauuaauugccaugcucuacacaccacuaagagcaaacaaugcaggcgacgauguauuuacaguuuccugucgaguacuuacaagaccaucaccugacuuugauuuuauauuucuaguucccccaacuguugaaucaagaacaaaacccuuuucaguuccuguccucacagucgaagaaaugacaaauucuagauucccaauuccauuagaaaaacuauucaccggaccuucaagcgcuuucguaguacaaccacaaaacgguagauguacaacugauggaguacuauuaggaacuacccaauuaucuccaguaaauauaugcacauuuagaggagauguuacucauauaacagguucaagaaauuauacaaugaacuuagcuucccaaaauugguccaacuaugauccuacagaagaaauaccagcaccacucggaacaccugacuuuguaggcaaaauacaagguguucucacacaaacaacacgaacugacgguucuacaagaggacauaaagcaacaguuuauacagguucagcagacuuugcuccaaaauuaggucgaguucaauucgaaacagauacagaucaugacuuugaagccaaucaaaauacaaaauuuacaccaguaggaguaauacaagaugguggcacaacacauagaaaugaaccacaacaauggguacucccaucuuacagcggaagaaacacaccaaacguacauuuagccccagcaguagcaccaacauuuccaggagaacaacuacucuucuuccguuccacaaugccuggauguucagguuauccaaacauggacuuagauugccuucuaccucaagaguggguacaauauuucuaucaagaagcagcaccugcacaaucagacgucgcauuauuacguuuuguuaacccugacacaggaagaguacuauucgaauguaaacuacauaaaucaggauauguaaccguagcacacacaggacaacacgaccucguuauaccuccaaacggguacuuucgauucgauucauggguaaaucaauuuuacacauuagcaccuauggguaacggaacaggaagaagaagagccuuauaa

SEQ ID NO: 31811 - RNA, 1623 nt, Artificial Sequence
  derived and/or modified sequence opt6 from VP1__Norovirus__AJA71400
augaaaauggccucaucagacgcaaacccuucagacggaucagcagcuaauuuaguaccugaaguaaacaaugaagucauggcacuagaaccaguaguaggugcagcuauagcagcacccguagcaggucaacaaaauguaauagacccauggaucagaaacaauuuuguccaagcuccugguggcgaauuuacuguaucaccacgaaacgccccaggagaaauauuauggucagcaccauuaggacccgaucuaaauccauaccuaucacacuuagcaagaauguauaacggauacgcaggaggcuucgaaguccaaguaauauuagcagguaaugcauuuacagccggaaaaguaauuuucgcugcaguaccaccaaacuuuccuacagaaggguuaucccccucacaaguaacaauguuuccucauauagucguagauguuagacaacuagaacccgucuuaauaccacuccccgacguaagaaauaauuuuuaccacuacaaccaaucgaaugauccaacaauaaaacuaaucgccauguuauacacuccauuaagagcaaauaacgcuggagacgacguauuuacagucucaugucgcguuuuaacuagaccaucaccagacuuugauuucauauucuuaguacccccuaccguagaaaguagaacuaaaccauucucuguuccaguuuuaaccguugaagaaaugacuaacucaagauucccgauucccuuagaaaaacuauuuaccggucccuccucagcauucguaguccaaccacaaaacggccgcuguacaacagauggaguacuccuagguacaacucaacuaagcccaguuaacauauguaccuuccguggugaugucacccauauaacaggaucuagaaauuauacaaugaaucuagcaucacaaaacuggucaaauuaugauccaacagaagaaauaccagccccucuagggacaccagacuucguaggaaaaauucaaggaguacuaacacaaaccacaagaacagaugguagcacaagaggacacaaagccacaguuuauacaggauccgcagacuuugcaccuaaacuuggucgaguccaauucgaaacagauacagaccgagacuuugaaacaaaccaaaauaccaaauuuacuccaguaggcguaauccaagauggaggaacuacucauagaaacgaaccacaacaauggguacuaccaucuuauucaggucgaaauaccccaaacgugcacuuagcaccagcaguagcaccaacauuuccaggugaacaauuacuauuuuuccgaucuacaaugccaggaugcucagguuaucccaacauggaucucgauugcuuacucccacaagaauggguacaauauuucuaucaagaagcagcaccugcacaaucagacguagcauuacuaagauuuguaaauccagacacuggaagaguauuauucgaaugcaaauuacauaaaucugguuacguaacaguagcacauacaggacaacacgaucuagucauuccaccaaauggauauuuucgcuucgauuccuggguaaaccaauucuauacacuagcacccaugggaaauggaacagguagaagaagagcauuauaa

SEQ ID NO: 31812 - RNA, 1623 nt, Artificial Sequence
  derived and/or modified sequence opt6 from VP1__Norovirus__AJA71401
augaaaauggcuuccuccgaugcaaauccaucagauggaucagcagcuaaucuaguacccgaaguaaacaacgaaguaauggcuuuagaaccaguuguuggagcagcaaucgcagcuccuguagcaggacaacaaaacguaauugaccccuggauaagaaauaauuucguacaagccccaggaggugaauucacaguaucuccaagaaaugccccaggcgaaauuuuauggucagccccacuaggaccugauuuaaacccauaccucagucaucuagcaagaauguacaacggauaugccggcgguuuugaaguacaaguaauacuagcaggaaaugcauuuaccgcuggaaaaguaauuuucgcagcaguuccaccaaauuuucccacagaaggacuuucuccaucucaaguaacaauguuuccucauauaguaguagauguacgacaauuagaaccaguacuaauaccacuaccugacguaagaaacaauuuuuaucacuacaaucaauccaacgacccuaccauaaaacuuauagcaaugcuauauacaccacuucgagccaauaaugcaggugaugaugucuucacuguaagcuguagaguauuaacaagaccuucaccugauuuugauuuuauauuucuuguuccacccacaguagaaucaagaacuaaaccuuuuucaguaccaguucuaacaguagaagaaaugaccaacucacgauuuccuauaccauuagaaaaauuauuuacaggaccaucaucagcauuuguaguacaaccacaaaacggaagauguaccacagauggaguacuauuaggaacaacacaacuauccccaguaaauauuuguacauucagaggagacauaacacauauaacaggaucacgaaauuacaccaugaaccuagcaucacaaaauuggucaaacuacgauccaaccgaagaaauuccagccccacuaggaaccccagacuuuguuggaaaaauacaaggaguauuaacacaaacaacaagaacagacggaucuacuaggggacacaaagccacagucuauaccggauccgcugacuucgcaccuaaacuaggaagaguucaauucggaacagacacugaucaugacuuugaagcaaaucaaaacacaaaauuuacuccuguaggaguuauucaagaugguucuaccacucauagaaaugaaccacaacaauggguucuaccgucuuauucaggaagaaauacacccaacguacaucuagcaccagcaguagcuccaacauuucccggagaacaauugcuauuuuucagaucaaccaugccaggauguucaggauauccaaauauggauuuagacuguuuauuaccacaagaauggguacaauauuuuuaucaagaagcugccccagcacaaucagauguagcacuacuuagauuugucaauccugacacaggcagaguauuauucgaaugcaaauuacauaaauccggauacgucacaguagcacacacaggacaacacgacuuaguuauacccccaaauggauauuuccguuuugacucaugggugaaucaauuuuauacucuagcaccaaugggaaauggaacaggaagaagacgcgcacuauaa

SEQ ID NO: 31813 - RNA, 1623 nt, Artificial Sequence
  derived and/or modified sequence opt6 from VP1__Norovirus__AJA71402
augaaaauggcaagcucagacgcaaauccaucagacggcucggcugccaaucuaguuccagagguaaauaaugaaguaauggcauuagaaccaguaguaggugcugcuauugcugccccaguagcuggacaacaaaacguaauagauccuuggauacgaaauaacuuuguacaagcaccugguggagaauucacaguaucaccaagaaaugcaccaggugaaauacuauggucagcaccccucggaccagauuuaaaucccuauuuaagucaucuagcaagaauguauaacggauacgcuggaggauucgaaguacaaguaaucuuagccggcaacgcuuuuacagcaggaaaaguaauauucgccgcagucccaccaaacuucccaacagagggcuuaucuccaagccaaguaacaauguucccucauauaguuguugacguccgacaauuagaaccugucuuaauaccccuaccugacgucagaaauaauuuuuaucacuauaaccaauccaaugacccaacaauaaaauuaauugcaaugcuauacacaccacuacgcgcaaacaaugccggugacgacguauuuacaguaucauguagaguacuaacaagaccauccccagacuuugacuuuauauuuuuaguaccaccaaccguagaaucaagaacaaaaccauucucaguaccaguacuaacagucgaagaaaugacaaauucuagauuuccaauaccacuagaaaaauuauuuacugguccaucaucagccuuuguaguucaaccacaaaaugguagauguacaacugauggcguauuauuaggcacaacacaauuaagucccguaaauauauguacauucagaggugacguaacacacauaacaggaaguagaaauuauacaaugaaccuagcaucacaaaacuggucuaacuacgauccaacagaagaaauaccagccccacuaggaaccccagauuuuguaggaaaaauacaaggaguacuaacacaaacuacaagaacagauggauccacaagaggacacaaagcaacaguauauacagguucagcagacuuugccccaaaacuaggcagaguacaauuugaaacagauacagauagagauuucgaagcaaaucaaaauacaaaauuuacaccaguuggagucauacaagacggcggaacaacacaucgcaaugaaccucaacaauggguauuaccaucauacagcgguagaaacacaccaaauguucacuuagcacccgcaguagccccaacauuccccggcgaacaacuacuauuuuuucgaucuaccaugccaggauguuccggauacccaaacauggacuuagauugcuuauuaccacaagaauggguacaauauuuuuaucaggaagccgcaccagcacaaucagauguugcuuuacucagauucgucaauccagauaccggacgaguacucuuugaaugcaaauuacauaaaucaggauaugucacaguagcacacacaggacaacacgaccucguaaucccacccaauggauauuuucgauuugauucauggguaaaucaauuuuacacucuagccccaaugggcaauggaacaggccguagaagggcucuauaa

SEQ ID NO: 31814 - RNA, 1623 nt, Artificial Sequence
  derived and/or modified sequence opt6 from VP1__Norovirus__AJA71403
augaaaauggcaucaucagacgcaaaucccucagauggaucagcagcaaauuuaguaccagaaguuaauaaugaaguuauggcacuagaaccaguaguaggcgcagcaaucgcagcacccguagcaggacaacaaaaugucauagacccauggauuagaaauaacuucguccaagcaccuggaggagaauuuacugucucaccacgcaaugcacccggagaaaucuuauggucagcuccgcuuggaccagauuuaaauccauaucucucucaucuagcucgaauguacaacggcuaugcagguggauuugaaguacaaguaauacuagcaggaaaugcauuuacagcugguaaaguaauauucgcugcaguaccuccaaacuuuccuacagaaggucuaucacccucacaaguuacaauguucccacacauaguaguagauguacgucaacucgaacccguauuaauaccauuaccagauguaagaaauaauuucuaucacuacaaucaaagcaacgauccaacuauaaaacuaauagcaauguuauacacaccccuaagagcaaauaaugcaggagacgauguauuuacuguuucuuguagaguauuaacaagaccaucuccugauuuugacuuuauauucuuaguaccaccaacaauagaaucucgcacaaaaccauucucaguaccaguauuaacaguugaagaaaugacaaauucccguuuuccaauuccauuagaaaaauuauuuacaggcccuucaucagcauuuguuguccaaccacaaaaugguagaugcacgacagacggaguauuauuaggaacaacacaacuauccccaguaaauauaugcacuuuucgaggagacgucacacauauuacaggaucaagaaauuacacuaugaauuuagcaucacaaaacuggaauaacuacgacccaacagaagaaauaccagcaccauuaggaaccccagauuuuguaggaaaaauacaaggcguacucacacagacaacuagaacagaugguucaacuagaggccacaaagcuaccguauacacagguucagcugacuuuuccccaaaacuaggcagaguacaauuugaaaccgauacugaucacgauuuugaagccaaucaaaauaccaaauucacacccguaggaguaauacaagacgguggaaccacacauagaaaugaaccacaacaauggguuuuaccaucauauucagguagaaauacaccuaacguucauuuagccccugcuguagccccuacauuccccggagaacaacuauuauucuucagaucaacaaugccaggaugcucaggauaucccaauauggaucuagauuguuuacuaccacaagaauggguacaauauuuuuaucaagaagcagcaccagcacaaucagacguugcauuacuuagauuuguaaacccagauacaggaagaguauuauucgaauguaaauuacauaaaucaggauauguaacuguagcacauaccggucaacacgauuuaguuauaccuccaaaugguuauuuucgauuugauucauggguaaaucaauuuuacacacuugcaccaaugggcaaugguacaggaagacgaagagcccuauaa

SEQ ID NO: 31815 - RNA, 1623 nt, Artificial Sequence
  derived and/or modified sequence opt6 from VP1__Norovirus__AJA71404
augaaaauggccuccucggaugcaaauccaucugauggaucugcugcaaacuuaguaccagaagucaacaaugaaguaauggcacuagaaccaguuguuggagcagcaaucgcagcaccaguagcaggacaacaaaaugucauagacccauggauaagaaauaauuuuguacaagcccccgguggagaauuuacaguauccccaagaaaugcccccggagaaauacucuggucugcuccacuuggaccagauuuaaauccauaucuaucacaucuagcacgaauguacaacgguuaugccggcggauucgaaguacaaguuauuuuagcaggaaaugccuucacagcaggaaaaguaauauuugcagcuguacccccaaauuuucccacagaagguuuauccccaucucaagucaccauguucccucacauaguuguagacguaagacaacucgaacccguacuaauaccauuaccagacguaagaaacaauuuuuaccauuauaaccagagcaaugacccaacaauaaaauuaauagcaaugcuguacacuccauuaagagcaaacaacgcaggcgaugauguauuuacaguaagcugucgcguacuaacacgcccaucuccugacuuugauuucauauuucuuguaccaccaacagucgaaucaagaacuaaaccauucucaguaccaguauuaacaguagaagaaaugacaaauucaagauuuccuauaccacuagaaaaauuauuuacagguccaucauccgcuuucgucguccaaccucaaaacggaagaugcacaacagacggagucuuauuaggaacaacacaauuaucaccuguaaauaucuguacauuuagaggugacguuacacauauuacaggauccagaaauuauacaaugaauuuagcaagccaaaacuggaguaauuaugacccaacagaagaaauaccagcaccacuuggaacaccagacuuuguaggaaaaauacaagguguacuaacacaaacaacacgaacagacggaaguacaaggggacacaaagcaacaguauauaccggcucagccgacuuugcaccaaaauuaggaagaguccaauuugaaaccgacacagaucgcgauuucgagacaaaucaaaauacaaaauuuacaccaguaggaguaauacaagacggagguacaacacauagaaacgaaccucaacaauggguacuacccucauacaguggacgaaauacaccuaauguacacuuagccccagccguagcaccaacauuuccaggagaacaacuacucuucuuuagaucaaccaugccagguuguucaggauacccuaauauggaccuagacugcuuacuaccacaagaauggguucaauauuucuaucaagaagcagcucccgcucaaucagacguugcauuauuacgauuuguaaauccagacacuggaagaguacuauucgaauguaaauuacauaaaucaggcuaugucacuguagcacauaccggacaacacgaucuaguaaucccuccaaauggauauuuuagauucgauuccuggguaaaucaauuuuauacauuagcaccaaugggaaauggaacuggacgacgccgagcacucuaa

SEQ ID NO: 31816 - RNA, 1623 nt, Artificial Sequence
  derived and/or modified sequence opt6 from VP1__Norovirus__AJA71405
augaaaauggcaucaucagacgcaaacccaucagauggcucugcagcaaauuuagucccagaaguuaacaacgaaguaauggcacuugaaccaguaguuggagcagcaauagccgcaccugucgccggacaacaaaauguaauagacccauggauucguaauaacuucguacaagcaccaggaggagaauucaccguaucaccaagaaaugcaccuggugaaauauuauggucagcaccuuuagguccagaucuaaacccauaucuaucacaucuugcaagaauguacaacggauaugcuggcggauucgaaguacaaguaauucuagcagguaacgcauucacagccggaaaagucauauucgcagcaguuccaccaaacuuuccaacugaaggccuaucaccaucccaaguaacaauguuuccacauauuguuguagacguccgacaauuagaaccaguccucauaccauugccagauguacgaaauaauuucuaucacuauaaccaaaccaaugacccaacaauaaaauuaaucgcaaugcuauacacaccacuuagagcaaauaacgcaggcgaugauguauuuaccguuucauguagaguauuaacucguccuucaccagauuuugauuuuauauuucuaguaccaccuacaguagaaagcagaacaaaaccauuuucaguaccuguacuaacaguagaagaaaugacaaacucuagauucccaauuccucuugaaaaacuuuucacaggaccaucaucugcuuuuguuguacaaccacaaaauggaagaugcaccacugacggcguauuauuagguaccacacaauuaucaccuguuaacauaugcacauuuagaggagauguuacacacauuacugguagcagaaauuauacaaugaaucuagcuucacaaaauuggaacaauuacgauccuacagaagaaauaccagccccauuagguauaccagacuuuguagguaaaauacaagggaugcuuacacaaacaacaagaacagauggcucaacuagaggucauaaagcaacuguuuacacaggaucugucgacuuugcuccuaaauuaggucgcguacaauuugaaaccgauacagaucacgauuucgaagcaaaucaaaauacaaaauucacaccaguaggcguaauucaagacggaucaacaacacaucgaaaugaaccacaacaaugggugcuaccaucauacucaggucgaaauacaccaaauguucauuuagcaccugcaguagcaccaacauucccaggugaacaacuacuauuuuuucgaaguacuaugccagguuguagcggauauccaaacauggaucuagacugccuucuaccgcaagaauggguacaauauuucuaccaagaagccgcuccagcucaaagcgacguagcacuauuacgauuuguaaaucccgauacuggcagaguauuauuugaaugcaaacuacauaaaagcggauacguaaccgucgcacauaccggacaacaugacuuaguaauaccucccaauggauauuuucguuuugauagcugggucaaucaauucuauaccuuagcaccaaugggcaauggaacaggcagacgucgugcacucuaa

SEQ ID NO: 31817 - RNA, 1623 nt, Artificial Sequence
  derived and/or modified sequence opt6 from VP1__Norovirus__AJA71406
augaaaauggcuucuagcgaugcaaacccuucagacggaucagccgcuaaucucguuccagaaguuaauaacgaaguuauggcacuagaaccaguaguaggagcagccauagccgccccaguagcaggacaacaaaacguaauagacccuuggauacguaauaauuucguacaagccccagguggagaauuuaccguuucaccaagaaacgcaccaggagaaauacuauggucagcaccacuuggacccgaccucaauccauaucuaucacaucucgcuagaauguacaauggauaugccggagguuucgaaguacaaguaauccuagcuggaaaugcuuucacagcagguaaaguuauauucgcugcaguuccaccaaacuuucccacagaaggauuaucuccaucacaaguaacaauguucccacacauaguagucgacguuagacaauuagaaccaguuuuaauaccacuaccagaugucagaaauaauuucuaucauuauaaccaaucaaaugacccaacuauaaaauuaaucgcaauguuauacacaccauuaagagccaacaaugcaggagacgauguauucacaguuucaugcagagucuuaacucguccaucuccagacuuugauuuuauauuucuuguacccccuacuguagaaucucgaaccaaaccauucucaguaccugucuuaacaguagaagaaaugacaaauuccagauuuccaauuccacuagaaaaacuauucacaggaccauccagugcauuuguaguacaaccacaaaacggacgaugcacuacugauggcguccuuuuaggaacaacacaacuauccccaguaaauauuugcacauuuagaggagauguaacacauauaacaggaucaagaaauuacacaaugaauuuagccucacaaaacuggaacaauuacgauccaacugaagaaaucccugcaccauuaggaacuccagauuucguaggaaaaauacaagguguauuaacgcaaacaacuagaacagauggaucuaccagaggucacaaagcaacaguauauacaggaucugccgauuuugcaccaaaauuaggaagaguucaauucgaaacagauacugaccacgauuuugaagcaaaccaaaauacaaaauucacucccguaggaguaauucaagacggaucaacuacacauagaaaugaaccacaacaauggguauuaccaucuuauuccggacgaaauacaccaaacguacaccuagcaccugcaguagcaccaacauucccgggagaacaauuacuauucuucagaucuacaaugcccgggugcucaggauauccaaauauggaucucgacuguuuauuaccacaagaauggguucaauauuucuaucaagaagcugccccagcacaaucagaugucgcacuauugagauucguaaauccagauacaggcagaguacuuuuugaaugcaaauuacauaaaucagguuaugucacaguagcucacacaggacaacacgaucucguaauaccuccaaauggcuacuuuagauucgauucauggguaaaccaauucuauacuuuagccccuaugggaaacggaacaggcagaagaagagcacuuuaa

SEQ ID NO: 31818 - RNA, 1623 nt, Artificial Sequence
  derived and/or modified sequence opt6 from VP1__Norovirus__AJA71407
augaaaauggcaucaucugaugcaacaccaagugauggcuccgcagcaaaucuaguacccgaagucaacaaugaaguaauggccuuagaaccaguuguaggugccgcuauagcugcacccguagcaggucaacaaaacgucaucgaucccuggauacgaaauaauuuuguacaagcaccuggaggagaauucacugucuccccaagaaaugcacccggagaaauucucugguccgcuccucuaggaccagaucuaaauccauacuuaucacauuuagccagaauguacaacggauaugccggaggauucgaaguacaaguaauauuagccggaaaugcauuuacagcugguaaaguaauauuugcugcuguuccaccaaauuuuccaacagaaggccuaucaccaucucaaguaacaauguucccacauauaguuguugacguccgacaacuagaaccaguauuaauuccucuaccagacguaagaaacaacuuuuaucacuauaaucaauccaacgacccaacaauaaaacuaauagccaugcuuuauacaccuuuaagagcaaauaacgcaggagaugaugucuuuacaguaucuugccgaguucuaacaagaccuucaccugacuuugauuucauauuucuagucccaccaacaguugaaucaagaacuaaaccauuuucaguuccaguauuaacaguagaagaaaugacaaauucuagguuccccauaccauuagaaaaacuuuucacaggaccaucuucagcuuuuguuguucaaccacaaaacggacgcuguacaacagacgguguucuacuugguacaacucaacuaucaccaguaaacaucuguacuuucagaggagacguuacgcauauaaccgguucucauaauuauacuaugaaccuagccucacaaaauuggaauaacuaugaucccacagaagaaauaccagcccccuuaggaacuccagauuucguagguaaaauucaaggaguauuaacucaaacaacaagaacagacggaucaacaaggggacauaaagcuacaguauauaccgguucugcagacuuugcaccaaaacuaggacguguacaauuugaaaccgauacaaaucaugacuucgaagccaaucaaaauacaaaauucacaccuguaggcgucauccaagacggcucaacaacacacagaaaugaaccacaacaauggguauuaccaucauacucugguagaaacacacauaacguacaucucgcacccgcgguagcaccaacauucccaggagaacaacuacuuuuuuucagaucaacaaugccaggaugcagcggauaccccaauauggaccuagauugccuacuaccacaagaauggguucaauacuuuuaucaagaagcagcaccagcucaaagugauguagcacuauuacgauucguaaauccugauacaggacgaguucuauuugaaugcaaauuacacaaaagcggauauguaaccguagcacauacaggucaacaugaucuaguaauaccaccaaauggauauuuuagauuugauuccuggguuaaucaauuuuacacucucgccccaaugggcaacggaacuggaagaagacgugcaguauaa

SEQ ID NO: 31819 - RNA, 1623 nt, Artificial Sequence
  derived and/or modified sequence opt6 from VP1__Norovirus__AJA71408
augaaaauggcaucaucagacgcgaacccaagcgacgguucugcagcaaaccuaguaccagaaguaaacaaugaaguaauggcacuagaaccaguaguaggugcugcaaucgcugcaccagucgcuggacaacaaaacguaaucgauccuuggauacgaaauaacuuuguucaagcaccaggaggagaauuuacuguuuccccaagaaacgcuccaggagaaauacuauggucugcaccacuagguccagaucuaaacccauaucucucucauuuagcaagaauguauaauggauacgcaggaggauucgaaguacaaguuauacuagcaggaaacgcauuuacagcaggaaaagucauauucgccgcaguacccccaaacuuuccaacagaaggauuaucaccaagccaaguaaccauguuuccccauauaguuguagauguucgacaacuagaaccaguauuaauaccauuaccagauguacguaacaauuuuuaucacuauaaucagucaaaugacccaacaauaaaauuaauagcaaugcuauauacaccauuaagagcaaacaacgcaggagacgauguauucacuguaucaugucgcguacuaaccagacccucaccagacuuugauuucaucuucuuaguacccccaacaauagaaucaagaacaaaaccauucucaguuccaguacuaacaguagaagaaaugacaaacucaagauuuccaaucccauuagaaaaacuauuuacaggaccaucaucagcauuugucguacaaccacaaaacggucgcuguacaacagacggaguccuccuaggaacaacacaacuaucaccuguuaacauaugcacauuuagaggagacguaacacauauaaccgguucaagaaauuacacuaugaaccucgcaucacaaaacuggaacaacuaugauccaacagaagaaauaccagcaccccuaggcaccccugauuucguaggcaaaauucaagguguacuuacccaaacaaccagaacugauggaucaacaagaggccacaaagcaacaguauauaccggcucagcugacuucucaccuaaacuuggaagaguacaauuugaaacugauacagaucacgauuucgaagcaaaccaaaauacaaaauucacaccuguuggaguaauucaagacggaggaacaacacaucgcaaugaaccacaacaauggguccuaccaucauacucaggacguaacacaccaaacguacaccuagcaccagcaguagcacccacuuuuccaggugaacaacuauuauucuuuagaucaacaaugccagguugcuccggauauccaaauauggaccuagauuguuuauuaccacaagaauggguacaauauuucuaccaagaagcagccccagcacaaucagauguagcacuauuaagauucguaaaucccgacaccgguagaguacuauuugaaugcaaacuacauaaaucaggauacgucacugucgcacauacaggacaacaugaucucguaauaccuccaaacggauacuucagauuugauucauggguaaaccaauuuuacacccucgcaccaaugggaaauggcacaggaagaagacgagcacucuaa

SEQ ID NO: 31820 - RNA, 1623 nt, Artificial Sequence
  derived and/or modified sequence opt6 from VP1__Norovirus__AJA71409
augaaaauggcauccucagaugcaaacccauccgauggaucugcagcuaaucuaguaccagaaguaaacaaugaaguaauggcauuagaaccuguagucggugcugcuauagcagcaccuguagccggacaacaaaacguaauagacccauggauuagaaacaauuuuguucaagcaccaggaggugaauuuacuguaucaccacgcaacgccccaggagaaauccuauggucugcaccacucggccccgauuuaaauccauauuuaucucaucuagcaagaauguauaacggauacgcagguggauucgaaguacaaguaauacuagcuggaaaugcauuuacagcaggaaaaguaauuuuugcggcaguuccaccaaauuucccaacagaaggauuauccccuucacaaguaacaauguuuccacacauaguaguagauguuagacaacucgaaccaguauuaauuccauuaccagauguccgcaacaauuuuuaucauuauaaccaaucaaacgacccuacaauaaaauuaauagccaugcuauacacaccacuuagagcaaauaaugcaggagaugauguuuucacagucuccugucgaguauuaacaagaccauccccagauuucgacuuuauauuccuaguaccaccuacaguagaaucuagaacuaaacccuucuccguuccuguuuuaacagucgaagaaaugacaaauucacgauuuccaauaccucucgaaaaacucuuuacagguccaucgucagcauuuguaguccaaccacaaaacggacgauguacuaccgacggaguauuacuaggaacuacccaauuaucucccguaaacauauguacauuuagaggagacgucacucauauuacaggcucuagaaauuacacaaugaaucuugcaucccaaaauuggucaaacuaugaccccacagaagaaauacccgcaccacuagguaccccagauuuuguaggaaaaauacaaggaguauuaacccaaacaacaagaacagaugguucuacacgaggccauaaagcaacuguauauacaggcucagcagacuuugcuccaaaauuaggccgaguacaauuugaaacagacacagauagagacuucgaaacaaaccaaaauacuaaauucacuccaguaggaguuauacaagacggaggaacaacacaccguaaugaaccacaacaauggguacuaccaaguuauucaggacgaaauaccccaaacguacauuuagcaccugcuguugccccaacuuucccaggugaacaauuauuauucuucagaucaacaaugccagguugcucaggauaucccaacauggaccuagauugucuacuaccacaagaauggguacaauauuuuuaucaagaagccgcacccgcucaaucagauguugcacuccuaagauucguaaacccagacacuggcagaguccuauucgaauguaaacuacauaaaucaggauaugucacaguagcccauacuggacaacacgauuuaguaauaccaccaaauggauauuucagauuugauucauggguuaaucaauuuuauacucuugcuccaaugggaaaugguacaggcagacgacgagcauuauaa

SEQ ID NO: 31821 - RNA, 1623 nt, Artificial Sequence
  derived and/or modified sequence opt6 from VP1__Norovirus__AJA71410
augaagauggcaucaagugacgcaaacccaagugaugguucugcugcuaauuuagucccugaaguaaauaaugaaguaauggcucuugaaccaguaguaggagcagcuauugcagcaccaguugcaggacaacaaaaugucauagacccauggauaagaaacaauuucguucaagcuccaggcggagaauuuacaguaucaccaagaaaugcaccuggagaaauuuuauggucugcaccgcuuggaccagaucuaaaucccuaucucucacaccucgcacgaauguauaauggauacgcaggaggauucgaaguucaagucauacuagccgggaaugcauuuacugcuggaaaaguaaucuuugcagcaguaccaccaaauuuuccaacagaaggccuaucaccuucucaaguaaccauguucccacauauaguuguagauguaagacaauuagaaccaguacucauaccauuaccagauguaagaaauaauuucuaucacuacaaccaaucaaaugauccaacaauaaaacuaauagccaugcuauauacaccauuaagagccaauaaugcaggagaugaugucuuuacuguaucauguagaguacuaacaagaccaucaccugauuucgacuucaucuuucuaguuccuccaaccgucgaaucucgcacaaaaccauuuucuguaccuguccucacaguagaagaaaugaccaacucuagauuucccauaccacucgaaaaauuauuuacuggaccaucaucagcauuugucguucaaccacaaaacggaagaugcacaacagacggaguacuacuaggaacaacacaacucuccccaguaaauauaugcacguuucgaggagaugucacccauauaacagguucacauaacuauacuaugaauuuagcaucacaaaacuggagcaauuaugauccaacagaagaaauaccagcaccauuaggaacaccagauuuuguagguaaaauacaaggaguacuaacacaaacaacuagaacagacggaucuacaagaggucauaaagcaaccguauauacaggaucagcagacuuugcuccaaaauuaggaagaguacaauucgaaacagauacagacagagauuuugaagcuaaccaaaacacaaaauuuaccccaguaggaguaauacaagacggaggaaccacucauagaaaugaaccacaacaauggguauuaccuagcuauuccggacgaaauacaccuaacguucaucucgcuccagcagucgcccccacauucccuggagaacaacucuuauuuuuucgaucaacaaugccaggauguucaggauauccaaacauggaucuagacuguuuauugccucaagaauggguacaauauuuuuaccaagaagccgcaccagcacaaucagaugucgcacuauuaagauucguaaauccagacacagguagaguacuauucgaauguaaacuucacaaaucaggauauguaacaguagcacacacaggucaacaugacuuaguaauaccaccaaacgguuauuuuagauuugauucaugggucaaccaauuuuauacucuagccccaaugggaaacggaacaggaagaagacgugcacuuuaa

SEQ ID NO: 31822 - RNA, 1623 nt, Artificial Sequence
  derived and/or modified sequence opt6 from VP1__Norovirus__AJA71411
augaaaauggcaucaucugacgcuaauccaagcgauggaucagcagcuaauuuaguuccagaaguaaauaaugaaguuauggcauuagaaccaguaguaggagccgcaauagcagcacccgucgcaggacaacaaaacguuauagaccccuggauacgaaauaauuuuguacaagcuccaggcggcgaauucacaguaucaccaagaaaugcaccaggcgaaauauuauggucagcaccauuaggaccagacuuaaaucccuauuuaucacaucuagccagaauguauaacggauacgcaggaggauucgaaguacaaguaauauuagccggaaacgcuuuuacagcugguaaaguaauauuugcagccguaccaccaaacuuccccacagaagguuuaucuccaucacaaguaacaauguucccacauauaguuguugauguaagacaacucgaaccaguauuaaucccauuaccagacguacgaaacaauuuuuaucauuauaaucaaucuaaugacccaaccauaaaauuaaucgcaaugcuauacacuccauuacgcgcaaauaacgcaggugacgauguauuuacaguuucaugccgaguuuuaacacgaccaucaccagauuuugacuuuauuuuuuuagucccuccaaccguagaaucccgaacuaaaccauuuucaguuccuguuuuaacuguagaagaaaugacaaauucaagauuuccaauacccuuagaaaaauuauuuacaggcccaucaucagcuuuugucguccaaccacaaaacggaagaugcacaaccgauggaguccuacuaggaacaacucaacuuucgccaguaaauauauguacauuucgaggugauguaacacauauuacaggauccagaaauuacacuaugaaucuagcaucacaaaacuggaguaacuaugauccuacagaagaaauaccagcaccucuaggaacaccagauuuuguaggaaaaauacaaggaguuuuaacacaaacaacuagaacagauggaucaacaagaggacacaaagcuacaguauauacuggaucagcagacuucgcacccaaacuaggaagaguucaauucgaaaccgauacagaucaugacuuugaagcaaaccaaaauacaaaauuuacacccguaggugucauucaagacggaggaacaacacaucguaacgaaccacaacaauggguacucccaaguuauucaggaagaaacacacccaacguccaucuagcaccagccguugcaccuacauucccaggagaacaacuauuauuuuuccguucaacaaugccaggauguaguggcuauccaaauauggaccuagacugcuuacuaccacaagaauggguacaguacuuuuaucaagaagccgccccugcacaaucagaugucgcucuccuaagauuuguaaacccagacacaggacgcguacucuuugaauguaaacuacauaaauccggauauguaaccguagcucacacaggacaacacgauuuggugauaccaccaaacggauauuuucgauuugauucuuggguaaaccaauuuuauacucuagcaccaauggguaacggaacaggacgucgaagagcauuauaa

SEQ ID NO: 31823 - RNA, 1623 nt, Artificial Sequence
  derived and/or modified sequence opt6 from VP1__Norovirus__AJA71412
augaaaauggcaagcucagacgccaacccaagugauggaagugccgcaaacuuagucccugaaguuaacaaugaaguuauggcccuagaaccaguaguaggggcagcuauagcugcaccaguagccggacaacagaauguaauagauccauggauaagaaacaauuucguacaagccccaggcggugaauuuacaguuaguccaagaaaugcaccaggagaaauacuauggucggcaccacucggaccugauuuaaauccauacuuaagucacuuagccagaauguauaacggauacgcaggaggguucgaaguacaaguaauacuagcuggcaacgcauucacugcaggcaaaguaauauucgcugcaguacccccaaauuucccaacugaaggacuaucuccaucacaaguuacaauguuuccacauauuguaguugauguaagacaacuagaaccaguauuaauuccacucccagauguuagaaauaacuuuuaccacuauaaucaauccaaugauccaacaauuaaacuaauagcaauguuauacacacccuugcgcgcaaacaaugcaggugaugacguauuuacaguaucuugucgaguacuuacuagaccaucuccugauuuugacuuuaucuucuuaguaccccccacaguagaaucaagaacaaaaccuuucucaguaccaguccuuacaguagaagaaaugaccaauucaagauucccaaucccacuugaaaaauuauucacggguccaucuucagcauuuguaguacaaccacaaaacggcagauguaccacagacggaguauuauuaggaacuacacaacucuccccaguuaauauauguacauuucgaggagacguaacacacaucacaggaucccgaaauuacacaaugaacuuagcaucacaaaacugguccaacuaugacccuacagaagaaauacccgcaccacucgguacaccagacuuuguaggaaaaauucaagguguacucacacaaaccacaagaacugaugguucaaccagaggucauaaagcaaccguuuauacaggaagugcagacuuugccccaaaacuaggacguguacaauuugaaacagauacugaucaugauuucgaagcaaaccaaaauacaaaauucacaccagucggagucauacaagacggaggaacgacucauagaaaugaaccacaacaauggguauuaccaucauauucuggucgaaacacaccaaacguucacuuagcuccugccguagcuccaacauuuccaggcgaacaacuauuauucuuuagaucuacaaugccaggaugcucuggauacccaaauauggacuuagauugccuucuaccacaagaauggguacaauauuuuuaucaagaagccgcaccagcacaaucugacguugcauuacuacguuucguaaacccugauacaggaagaguauuauucgaaugcaaacuccacaaaacaggauauguuacagucgcacacacaggacaacaugacuuagucauaccacccaauggauauuucagauucgauucauggguaaaucaauuuuauacacuagccccaauggguaacggaacaggacgaagaagagcauuauaa

SEQ ID NO: 31824 - RNA, 1623 nt, Artificial Sequence
  derived and/or modified sequence opt6 from VP1__Norovirus__AJA71413
augaaaauggcauccucagacgcaaacccaucagacggaucugccgcuaaccuagucccagaagucaauaaugaaguuauggcacuagaaccaguagucggugcagcaaucgcagcuccaguagcaggucaacaaaauguaauagacccuuggauacgaaauaacuucguacaagcaccaggcggcgaauuuaccguaucaccucguaaugcaccaggcgaaauuuuauggucagcaccuuuaggccccgaucuaaauccuuacuuaucacaccuagcaagaauguauaauggauaugcaggaggauuugaaguacaaguaauccuagcuggcaaugcauucacagcaggaaaaguaauauucgccgcagucccacccaacuuuccaacagaaggacugucaccaucccaaguaacaauguucccccauauuguuguugauguacgacagcuagaaccaguacuaauaccucuaccagacguuagaaacaacuuuuaucacuacaaccaaucaaacgauccuacaauaaaauuaauagcaaugcucuauacaccuuuaagagcaaauaaugcuggagacgauguauuuacaguuucaugucgaguauuaacacgaccuucaccugauuuugacuucauauucuuaguacccccaacaguugaaucaagaaccaaaccuuuuuccguaccaguauuaacaguagaagaaaugacaaacucuagauuuccaauaccucuagaaaaauuauuuacugguccaucaucagcauucguaguacaaccacaaaaugguagauguaccacagacggaguauuacuaggaaccacacaauuaucuccaguaaauauaugcacauuuagaggugacguaacccauaucacggguucacgaaauuacacaaugaauuuagcuucccaaaacuggucaaauuacgaucccacagaagaaauaccugcaccacuaggaacaccagauuucguagguaaaauacaaggaguauuaacacaaacaacuagaacagauggaucaacacgaggacauaaagcaaccgucuauacagguucagccgacuuugcaccaaaacuuggaagaguacaauucgaaacagauaccgaucaugauuucgaagcuaaccaaaauacaaaauucacuccaguuggaguuauacaagacggaucuacaacccauagaaacgaaccccaacaauggguucuccccucauacucuggacgcaacacaccaaauguacacuuagccccagcaguagcgccuacauucccaggagaacaacuccuauucuuuagaucaacuaugccaggcugcucaggauacccaaacauggauuuagauugccuauuaccacaagaauggguacaguauuuuuaucaagaagcagcuccugcucaaucugacguagcauuacuaagauucguuaacccagacaccggaagaguauuauuugaaugcaaauuacauaaaucuggauauguaacuguagcacauacaggacaacacgacuuaguaauaccaccaaauggauacuuuagauuugacaguuggguaaaucaauuuuauacucuagcuccaaugggcaauggaacuggacgaagacgagcauuauaa

SEQ ID NO: 31825 - RNA, 1623 nt, Artificial Sequence
  derived and/or modified sequence opt6 from VP1__Norovirus__AJA71416
augaaaauggcauccucagaugcaaacccuucagacggaagugcagcaaacuuaguaccagagguuaauaaugaaguuauggcacuugaaccgguuguaggugcagcaauugcagcacccguagcuggacaacaaaauguaauugacccauggauaagaaacaauuuuguacaagcaccaggaggagaauuuacaguuuccccacguaaugcaccaggugaaaucuuauggucagcuccacuaggaccagaccuuaauccauauuuaucacacuuagcaagaauguauaaugguuaugcaggcgguuuugaaguacaaguaauauuagccggaaaugcauuuacugcagggaaagucauuuuugcagcuguuccaccaaacuuuccaacagaaggacucucaccaucacaaguaacaauguucccucacauagucguugauguaagacaacuagaaccuguauuaauaccccucccagacguuagaaauaauuuuuaucauuacaaucaaucuaaugacccuacuauaaaacuaauagcaaugcuuuauacaccauuaagagccaauaaugcaggagaugauguauucacaguaucauguagaguauuaaccagaccauccccugacuucgacuucauauuccuaguuccgccuacuguugaaucaagaacaaaaccuuuuagcguaccuguauuaacugucgaagaaaugacaaauucaagauuccccauuccacuagaaaaauuauuuacaggaccaucaucugcauuuguaguccaaccacaaaacggaagauguacaacagacggcguacuauuaggcacaacacaacucucaccuguaaauauauguacuuuucgaggagauguaacacauauuaccggaucacgaaacuauacaaugaaucuagcaucccaaaacuggucaaauuaugaucccacagaagaaauaccugcaccauuaggaacaccugauuucgucggaaaaauacaaggaguucuaacucaaacaacacguacagacggcucaaccagaggccacaaagcaacaguauacacaggaucagcugauuucgcacccaaauuaggucguguacaauucgaaacagacacagaucgcgauuuugaagccaaccagaauacaaaauuuacaccuguaggaguaauacaagacggaucuacaacacauagaaaugaaccacaacaauggguacuaccaucauauucuggaagaaacacacccaaugugcaucuagcaccagcaguugccccaaccuuuccuggagaacaauuacuauuuuuccguucuacuaugccaggcugcuccggauauccaaacauggauuuagacugcuuauuaccacaagaauggguacaauauuucuaucaagaagcagcucccgcacaaucugauguagcacuucuacgauucguaaacccagacaccggaagaguacuauuugaauguaaauuacauaaaucaggauacguaacaguagcucauacuggacaacaugaccuaguaauacccccaaauggauauuuuagauucgauaguuggguaaaccaauucuauacauuagcaccaauggguaacgguacaggaagacgaagagcacuauaa

SEQ ID NO: 31826 - RNA, 1623 nt, Artificial Sequence
  derived and/or modified sequence opt6 from VP1__Norovirus__AJA71417
augaaaauggcgucaucugacgcaaauccaucugauggaucagcagcaaacuuaguaccugaaguaaauaaugaaguaauggcauuagaaccaguaguaggagcagcuauagcagcaccagucgccggacaacaaaauguaauagacccauggauacguaauaauuuuguacaagcaccggggggagaauuuacaguaucuccaagaaacgcaccuggugaaaucuuauggucagcaccacuagguccugauuuaaauccauaccuuucacaccuagcaagaauguacaacgguuacgcaggcggauuugaaguacaaguaauacuugccgguaaugcauuuacagcuggaaaaguaauuuuugcugcagucccaccaaacuuucccacagaaggccuaagucccucucaaguaaccauguucccacauauagucguagauguaagacaacucgaaccaguacucauaccacuaccagauguaagaaauaauuuuuaccauuacaaccaauccaacgauccaaccauaaaauuaaucgcaauguuauacacaccacucagagcuaacaacgcuggagacgacguuuuuacaguaaguuguagaguacuuacaagacccagcccagauuucgacuuuauauucuuaguaccaccaaccguagaaucaagaacaaaaccauuuucaguuccagucuuaacagucgaagaaaugaccaauucaagauuuccaaucccacuagaaaaacuuuuuacaggcccaucaucugcuuucguaguacaaccacaaaacggaagauguacuacagacggaguacuuuuaggaacaacacagcuaucaccaguaaacauaugcacuuuccgaggagauguaacccauauaacuggaagucgaaauuauacgaugaaucuuacaucccaaaauuggucaaacuaugacccaacagaagaaauaccugcaccauuaggaacaccagacuuuguaggaaaaauucaagguaugcuaacacaaacaaccagaacugauggcuccacaagaggacacaaagccacaguuuauacaggcucagcugauuuugcaccaaaacuaggacgaguacaauuugaaaccgacaccgaccaugacuucgaagccaaccaaaauaccaaauuuacaccaguaggcguuauacaagacggaucaacaacacauagaaaugaaccacaacaauggguacuaccauccuacucaggaagaaauacaccgaauguacaucuagcaccagcaguagcaccuaccuucccaggugaacaauuauuauucuuuagaucaacaaugccaggauguucuggauaccccaauauggaucucgauugucuacuaccacaagaauggguacaauauuucuaucaagaagcagcaccagcacaaucagacguugcccuauuaagauuuguaaacccagauacuggacgaguucuuuucgaaugcaaauuacauaaaucaggauauguaacaguugcacauacagggcaacacgacuuaguaauaccccccaauggauauuuccgauuugacaguuggguaaaucaauuuuauacacuagcuccaaugggaaacggaacagguagaagaagagcacucuag

SEQ ID NO: 31827 - RNA, 1623 nt, Artificial Sequence
  derived and/or modified sequence opt6 from VP1__Norovirus__AJA71418
augaaaauggcaucaucugacgcuucaccaucugauggaucagcugcaaauuuaguaccugaaguaaacaaugaagucauggcacuagaaccuguaguaggagcagcuauagcagcaccuguagcaggacaacaaaauguaaucgauccauggauacgaaauaauuucguccaagcaccaggaggagaauucacaguaaguccaagaaacgcaccuggcgaaauauuauggucugcaccucuaggcccagaccucaacccauauuuaucucaucucgccagaauguauaauggauacgcaggagguuucgaaguccaaguaauccuagcuggaaacgcauucacagcaggaaaagucauuuuugcagcaguuccaccaaacuuuccaacagaagguuuaucacccucacaaguaacaauguucccacacauaguagucgacguuagacaacuagaaccuguucuaauuccacuaccugacgucagaaacaauuuuuaucauuacaaccaaucaaaugauccuacaaucaaauuaauagcaauguuauauacaccacuaagagcuaacaaugccggagacgacguauuuacaguuucuugccgaguucuaacuagaccuucaccagauuuugacuucauauuucucguucccccuacaguugaaucacguacaaaaccauucucuguaccaguacuaacagucgaggaaaugacuaacucaagauuuccaauaccacuugaaaaacuauuuacaggaccaucaucagcauucgucgugcaaccucaaaacggacgauguacaacagacggcguauuacuaggaacaacucaauuauccccaguaaauauaugcacauuuagaggagacguaacacauauuacagguucacgaaacuauacuaugaaucuagcaucacaaaacuggucaaauuacgaucccacagaagaaauaccagcucccuuaggaacaccugauuucguagguaaaauacaaggaguccuaacacaaacaacccgaacagacggcucaacaagaggacauaaagcaacuguuuauacuggauccgcagacuucgcaccaaaauuaggacgaguacaauucgaaacagacacagaucaugauuuugaagcaaaccaaaauacaaaauucacaccaguaggaguaauccaagauggcggaacaacacauagaaacgaaccacaacaauggguauuacccucauacucaggucgaaacacuccaaacguacaccuugccccagcagucgcucccacauucccuggagaacaacuauuauucuuuagaucuacaaugccaggauguucaggauaucccaauauggaucuagauugccuauuaccacaagaauggguacaauacuucuaucaagaagcagcacccgcacaaucagaugucgcacuauuaagauucguaaauccagacacaggcagaguucuuuucgagugcaaacuccauaaaucuggauauguaaccgucgcacauacuggacaacacgacuuagucauaccacccaauggauauuuuagauucgauucauggguaaaucaauuuuauaccuuagcaccaaugggcaauggaaccggaagaagaagagcauuauaa

SEQ ID NO: 31828 - RNA, 1623 nt, Artificial Sequence
  derived and/or modified sequence opt6 from VP1__Norovirus__AJA71419
augaaaauggcaucauccgacgcaucaccaucagacggaucugcagcaaaucugguuccagaaguaaacaacgaaguaauggcauuagaaccaguaguaggugcagccauagcagcuccaguagcuggacaacaaaauguaauugauccauggauccgcaacaauuuuguacaagccccuggcggugaauuuacuguaucaccaagaaacgcaccuggagaaauccuauggucagcacccuuagguccagaucuaaauccguaucuaucucaccuugcaagaauguauaauggauaugcaggcggcuuugaaguacaaguaauacucgcaggcaaugcauucacagccggaaaaguaauauuugcugcuguacccccaaacuuuccuacugagggauuaaguccaucacaaguuacaauguuuccacacauaguagucgacguaagacaauuagaaccuguauuaauaccauuaccugauguaagaaauaacuuuuaucauuacaaucaaucaaaugacccuacgauuaaacuuauagcuaugcuauacacaccccuacgagcuaacaaugcaggagacgauguauuuacaguaucuugucgaguauuaacacgaccaucaccagacuuugauuuuauauucuuaguacccccaacaguugaaucucgaacaaaaccauuuucaguaccaguacuuacaguugaagaaaugaccaacucacgauuuccaauucccuuagaaaaacuauucacaggaccaucaucugccuucguaguacaaccacaaaauggccgcuguacaacagaugguguauuauuaggaacgacgcaauuaucaccaguaaacauauguacauuuagaggagaugucacucauauuacaggaucacgaaauuauacaaugaaucuagccucucaaaacuggucaaauuacgauccaacugaagaaauaccagcaccccuaggcacaccagacuucguagguaaaauucaagguguuuuaacacaaacaacacgcacagacggcucaacucgaggacauaaagccacaguauauacuggaucagccgacuuugcaccuaaauuaggaaggguacaauucgaaacagauacagaucacgacuuugaagcuaaucaaaacacaaaauuuacaccaguaggcguaauacaagaugguggaacaacucauagaaaugaaccucaacaauggguacuaccaucauauucaggaaggaauacaccaaauguacacuuagccccagcuguagcaccaacauucccaggugaacaauuauuauuuuuucgaaguacaaugccgggauguucagguuacccuaauauggauuuagacugucuacuaccacaagaauggguacaauauuuuuaucaagaagcagcaccagcacaaucagauguagcucucuuaagguucgucaauccugacacuggaagaguacuauuugagugcaaauuacauaaaucagguuauguuacaguagcucacaccggucaacacgaucuaguaauaccaccaaacggauacuuucgauuugauucauggguuaaucaauuuuacacauuagcacccaugggaaacggaacaggcagaagaagagcuuuauaa

SEQ ID NO: 31829 - RNA, 1623 nt, Artificial Sequence
  derived and/or modified sequence opt6 from VP1__Norovirus__AJA71420
augaaaauggcuucuagugaugcuaauccaucagauggaucagcagcuaacuuaguaccagaaguaaauaaugaaguaauggcacuagaaccagucguaggagccgcuauagcagcaccaguagcuggacaacaaaauguaauugacccauggaucagaaauaacuuuguccaagcaccaggaggagaauucacaguaucaccaagaaaugcaccaggcgaaauccucuggucagcuccauuaggaccagaucucaauccauacuuaucacaccuagccagaauguauaauggauaugcaggaggcuuugaaguacaaguaauuuuagcaggcaacgcuuuuacagcaggaaaaguaauuuuugccgcaguaccaccaaacuuucccacugaaggauuaucaccaucucaaguuacaauguucccccauauaguaguugacguuagacaacuagaaccagucuuaauaccauuaccagauguaagaaacaauuucuaucauuauaaccaaucaaacgauccuacaauaaaacucauagcaaugcuauacacaccauuaagagcaaacaaugcaggagaugacguuuuuacaguaucaugucgaguacuuacacgaccaucaccugauuuugauuuuaucuuccuaguacccccaacuguagaaagucgcaccaaaccauuuaguguaccaguucuaacaguggaagaaaugaccaauuccagauuuccuauuccacuugaaaaauuauuuacgggcccauccucggcauuuguaguacaaccucaaaauggacguuguacuacugauggaguuuuacuagguaccacacaauuaucaccuguuaacauaugcacauucagaggagacguuacacauauaacaggcucucgaaauuauacaaugaaucuagcaucacaaaacuggucaaacuaugaccccacagaagaaauccccgcaccauuaggaacuccagauuuuguaggcaaaauacaaggcguacucacacaaacaacuagaacagaugguucaacacgaggacacaaagcaacaguauauacuggaucagcugauuucgcaccaaaauuaggcagaguacaauuugaaacagacacugaucaugacuuugaagccaaucaaaauacuaaauucacucccguaggaguaauacaagacggcucaacaacucacagaaacgaaccacaacaauggguacuaccuucauauucaggaagaaauacacccaauguucauuuagcaccagccguagccccaacauuucccggagaacaacuacuauuuuuuagaucuacaaugccugguugcuccgguuauccaaauauggaucuugauuguuuacuaccacaagaauggguacaauacuuuuaucaagaagcagccccagcacaaucagacguagcauuacuucgauucguuaacccugacacaggacguguacuauucgaauguaaauuacauaaaucuggauauguaacagucgcucauacaggacaacaugaucucguaauaccaccuaauggauauuucagauucgacucuuggguaaaucaauucuacaccuuagcaccaaugggaaauggcaccggaagaagacgagcauuauaa

SEQ ID NO: 31830 - RNA, 1623 nt, Artificial Sequence
  derived and/or modified sequence opt6 from VP1__Norovirus__AJA71421
augaaaauggcaucuuccgaugcuaauccuagcgacggcagugcagcuaaccuaguacccgaaguaaauaaugaaguaauggcauuagaaccaguuguaggagcagcuauagcugcaccaguggcaggacaacaaaacgucauagauccauggauaaggaauaacuuuguacaagcacccgguggagaauuuacaguaucaccaagaaaugcaccaggcgaaauuuuauggucagccccgcuaggaccugauuuaaacccauauuuaucucaucucgccagaauguauaaugguuacgcaggaggauuugaaguacaagucaucuuagcaggcaaugcauuuacagcaggaaaaguuauauuugcugccguaccaccuaauuuuccaacugaaggccuaucaccuucacaaguaaccauguuuccacauauaguaguagauguacgacaacuagaaccaguauuaauaccauuaccagauguacgcaacaauuuuuaucauuauaaucaaucaaaugauccaacaauaaaacuaauagcaauguuauauacaccacucagagcaaauaacgcaggggaugauguauuuaccguaucuuguagaguccuaacacgaccaagcccagacuuugauuuuauuuuucucgucccaccaaccgucgagucaagaacaaaaccauuuucaguaccaguacucaccguagaagaaaugacuaacucuagauuuccaauaccauuagaaaaacuuuuuacaggucccucuucugcauucgucguucaaccucaaaaugguagauguacaacagauggaguauuauuagguacaacucaauuaaguccaguuaauauaugcacauucagaggagauguaacccauauaacugguuccagaaacuauacaaugaauuuggccagccaaaauugguccaacuaugaucccacagaagaaauaccagcacccuuaggaacaccugacuucguagguaaaauacaaggaguacucacacaaacaacacgaacagauggaucaacacguggccacaaagcaacaguuuauacuggaagugcagacuuugcacccaaauuaggacgaguacaauuugaaacagacacagaccacgacuuugaagcaaaucaaaacacaaaauuuacaccuguuggaguaauccaagauggagguaccacacauagaaaugaaccccaacaauggguucuaccuuccuacucggguagaaauacaccaaacguacaccuugcaccagccguagcuccaacauuuccaggugaacaauuacuauuuuuuagaucaacaaugccaggaugcucagguuauccaaauauggauuuagauugucuucucccacaagaauggguccaauacuucuaucaagaagccgcaccagcucaaucagauguagcauuauuaagauucgucaauccagacacuggaagaguuuuauuugaauguaaauuacauaaaucaggauacguaacaguagcacauacaggacaacaugaucuaguuauaccaccaaacgguuauuuccguuucgacuccuggguuaaccaauucuauacauuagcaccuaugggaaacggaacuggaagaagaagagcauuauaa

SEQ ID NO: 31831 - RNA, 1623 nt, Artificial Sequence
  derived and/or modified sequence opt6 from VP1__Norovirus__AJA71422
augaaaauggcaucaucugaugcaaauccuucagauggauccgcagcuaauuuagucccagaaguaaacaaugaaguaauggcucuagaaccaguuguaggagccgcaauugcugcaccagucgcaggacaacaaaauguaauagacccauggauuagaaauaacuuuguacaagcaccuggaggagaauuuacaguaucaccaagaaaugcaccaggcgaaauauuauggucugcaccauuaggacccgaccucaaucccuauuuaucacaccuagcacgcauguauaauggauacgcaggagguuuugaaguacaaguaauacucgcugguaaugcauuuacagcagguaaagugauuuucgcagccguacccccaaacuuuccaaccgaaggacuaucacccucacaaguaaccauguucccccauauaguuguagacgugagacaacuagaacccguauuaauaccauuaccagacguaagaaacaauuucuaucacuauaaccaaucaaacgacccaacaaucaaacuaauagcaaugcuauauacaccacuacgagcaaauaaugcaggagacgacguauuuacaguuucaugccgaguacuaacaagaccaucaccagacuuugacuuuauauucuuaguaccaccaacaauagaaucucgaacaaaaccauuuucaguaccuguauuaacaguugaagaaaugacaaauucaagauucccuauaccucuagaaaaacuuuucacaggaccuagcucagcauucguuguccaaccucaaaacggaagauguacaaccgaugguguauuacucggaacaacucaacucucaccaguaaauauauguacauuuagaggcgacguaacacacauuacagguucaagaaauuacaccaugaaccuagcaucacaaaauuggaacaauuacgacccaacagaagaaauaccagccccauuaggcacaccagauuuuguaggaaaaauacaaggaguauuaacacaaacaacaagaaccgacggaagcacacgaggacacaaagcaacaguuuauacaggcucagcugacuucucaccaaaacucggacgaguacaauucgaaacagacacagaucaugauuuugaagcaaaucaaaauacaaaauucacaccaguaggaguaauacaagauggaggaacaacacaucgcaacgaaccacaacaauggguacuacccucauauaguggcagaaauacaccuaauguacacuuagccccagcuguagcacccacauucccaggagaacaacuucuauucuuuagaucaacaaugccaggcugcucuggauaucccaauauggacuuagauugcuuacuaccucaagaauggguacaauauuuuuaucaagaagcagcaccagcucaaucagacguagcacuucuaagauucguaaauccagauacaggaagaguacuauuugaaugcaaauuacacaaaucaggauacguaacaguugcacacacuggacaacaugacuuaguaauaccuccaaacggcuauuucagauucgauucauggguuaaccaauucuacacacucgcccccaugggaaauggcacaggaagacgaagagccuuauaa

SEQ ID NO: 31832 - RNA, 1623 nt, Artificial Sequence
  derived and/or modified sequence opt6 from VP1__Norovirus__AJA71423
augaaaauggccucaagcgacgcaaaucccucagauggaucagcagcaaaucuugucccagaaguuaacaaugaagucauggcucuagaaccuguugucggagcugcaauagcugcaccaguagcaggucaacaaaacgucauagacccauggauaagaaauaauuucguacaagcuccaggaggagaauuuacaguaucaccaagaaaugcaccaggugaaauauuauggagugcaccucuaggcccagauuuaaacccauaccuaucacacuuagcaagaauguauaauggauaugcugguggcuucgaaguacaagucauuuuggcaggcaaugcauucacugcaggaaaaguaauauuugcagcaguaccacccaacuucccaacugaaggcuuaucaccaucacaaguuacaauguuuccccacauaguaguagauguaagacaacuagaaccgguacucauaccacuuccugauguaagaaacaauuuuuaucauuacaaucaaucaaaugauccaacuauaaaacuaauagcaaugcuuuauacaccauuaagagcuaauaaugccggagacgacguauucacaguaucauguagagucuuaacaagaccaucuccagauuuugacuucauauucuuagucccaccaacaguagagucaagaacaaaacccuuuaguguaccagucuuaacuguagaagaaaugacaaacucaagauucccaaucccauuagaaaaauuauuuacaggcccgucaagugcauucgucguccaaccacaaaacggaagaugcacuacagacggcguauuacuuggaacuacacaacuuucuccuguuaauaucuguacauucagaggagauguaacacauauaacaggcucacgaaauuacaccaugaaucuagcaagucaaaacuggucaaacuacgaucccacagaagaaauaccugcaccucuuggaacaccugacuucguuggcaaaauccaaggaauguuaacucaaaccacuagaacagaugguucuacuagaggucauaaagcaacuguauauaucggcggagcagauuuugcaccuaaacuaggaagaguacaauuugaaacugauacagaucacgacuuugaagcaaaucaaaacaccaaauuuacaccaguagguguaauucaagauggaucaacaacacauagaaaugaaccccaacaauggguucucccaucauauuccggccgaaacacuccuaacguacaucuugcaccagcaguagcaccaaccuuuccaggcgaacaacuucuuuuuuuuagaaguacuaugccugguuguucaggauacccuaauauggaucuagauugcuuacuaccacaagaauggguacaauauuuuuaccaagaagcagcuccagcacaaucagauguugcucuacuaagauuuguaaauccagauacaggucgaguauuauuugaauguaaauuacauaaaucugguuacguaacaguagcacauaccggacaacacgauuuaguaauaccuccaaaugguuauuuucgauuugacucauggguuaaucaauucuauacucuagcacccauggguaacggaacaggaagaagaagagcuuuauaa

SEQ ID NO: 31833 - RNA, 1623 nt, Artificial Sequence
  derived and/or modified sequence opt6 from VP1__Norovirus__AJA71424
augaaaauggcaucaucugaugcaaauccaucagacggaucagcagcaaaccucguaccagaagucucaaaugaaguaauggcacucgaaccaguaguaggagcagcaauugcagcuccaguagcaggucaacaaaauguaauagacccauggauuagaaauaauuucguacaggcaccaggaggagaauuuacaguaucaccaagaaaugcaccuggugaaauauuauggucagcaccccuuggacccgacuuaaauccauauuuaucacauuuagcaagaauguauaauggauaugcugguggauuugaaguacaaguaauacuagcaggcaaugcauuuaccgcaggaaaagucauauucgcagcaguaccuccuaacuucccaaccgaaggucuaucacccucacaaguuacaauguuuccacacauuguaguugacguucgacaauuagaaccagucuuaauaccauuaccagauguaagaaacaauuuuuaucauuauaaucaaaguaaugacccaacaauaaaacuaauagcaauguuauacaccccuuuaagagcaaauaaugcaggagaugauguauuuacaguauccugcagaguacucacacgaccaucaccagacuucgacuuuauuuucuuaguaccccccacaguugagucaagaacuaaaccguuuaguguaccaguuuuaacgguagaagaaaugacaaacucaagauuuccuauaccucuagaaaaacuuuucacuggaccuucaagugcuuucguaguacaaccucaaaacggaagaugcacaaccgauggcguacuacucggcacuacacaacuaucuccaguaaauauaugcacauucagaggugacguuacacauauaacaggaucgcguaacuauacaaugaaccucgcaucacaaaauuggucaaauuaugauccuacagaagaaaucccugcaccauuaggaacuccugacuuuguaggaaaaauucaaggaaugcuaacgcaaacaacaagaacagacggcuccacaagaggccauaaagcaacaguauauacaggaucagcagacuuugcacccaaauuaggccgaguacaauuugaaacagauacagaccaugauuuugaagcuaaucaaaacacaaaauucacaccaguugguguaauacaagauggaucuacaacacauagaaaugaaccucaacaauggguacuuccaucuuauuccggcagaaacacuccaaauguucauuuagcuccugcuguagcccccaccuuuccaggagaacaacuauuauucuucagaucaacaaugccaggcuguaguggauaccccaauauggauuuagauuguuuguuaccucaagaauggguucaauacuuuuaucaagaagcagcaccagcacaaucagauguugcacuauuaagauuuguaaauccagacacagguagaguauuauuugaaugcaaacuccauaaaucuggauacguaaccgucgcucauacaggacaacacgaucuuguaauaccaccaaaugguuacuuucgauuugacucaugggucaaccaguucuacacuuuagccccaaugggaaauggaacaggacgaaaaagagccuuauaa

SEQ ID NO: 31834 - RNA, 1623 nt, Artificial Sequence
  derived and/or modified sequence opt6 from VP1__Norovirus__AJA71425
augaaaauggcaucaucagaugcuaauccaucugauggcucugcagccaauuuaguuccagaagucaauaaugaaguaauggcucuugaaccuguaguaggugcagcaauugcagcucccguagcuggucaacaaaauguaauagauccuuggauuagaaacaacuuuguacaagccccaggaggcgaauuuaccguaaguccaagaaaugccccaggagaaauauuaugguccgcuccacuaggcccagacuuaaauccuuaucuaucucauuuagcaagaauguauaaugguuacgcuggaggauucgaaguucaaguaauacucgcagguaacgcauuuacagcuggaaaaguaauauuugcugcugucccaccaaacuucccaacagagggacuuucuccaucccaaguaacaauguucccucauauaguaguagaugucaggcaacuugaaccaguacucauaccacuucccgauguacguaauaauuuuuaucauuacaaucaaucuaaugacccuaccauaaaauuaauagcaauguuauauacaccauuaagagcaaauaaugcuggagaugacguauucaccguuucauguagaguacuaaccagaccaucuccagauuuugauuuuauauuuuuaguacccccaacaguagaauccagaacuaaaccauucucuguaccaguauuaacagucgaagaaaugacaaauucucgauuuccaguaccauuagaaaaacuauuuacuggaccuucaucagcauuuguaguccaaccacaaaauggaagauguacaacagauggaguauuacuaggaacaacacaauuaucaccaguaaauauauguaccuuucgaggagauguaacccauaucacaggaucucauaacuauacuaugaauuuagcaucacaaaacuggucaaacuacgauccuaccgaagaaauaccugcaccauuaggaaccccagauuuuguagguaaaauccaaggaguucuaacacaaacaacccguacagauggaucuacaagaggacauaaagccacaguuuacacaggaucagccgacuuugccccaaaacucggacguguucaauucgaaacagauacugauagagauuucgaagcaaaccaaaacacaaaauucacuccagucggaguaauacaagacggaggaaccacucaucgaaacgaaccucaacaauggguacuucccucauacucuggucguaauaccccaaauguccaucuagcaccugcaguagcaccaacauucccaggagaacaauuauuauuuuuucguucaacaaugccuggauguucaggauauccaaauauggacuuagacugcuuauuaccucaagaauggguacaauauuuuuaccaagaagcggcaccugcacaaucugauguagcacuauuacguuucguaaauccugauacaggacgaguauuauuugaauguaaauugcauaaaucagguuauguuacuguagcacacacuggacaacaugaucuaguaauaccaccuaacgguuacuuuagauucgauucaugggucaaucaauuuuauacccuagcaccaauggguaacggaacagguagaagacgagcccuauaa

SEQ ID NO: 31835 - RNA, 1623 nt, Artificial Sequence
  derived and/or modified sequence opt6 from VP1__Norovirus__AJA71426
augaaaauggcaucaucugacgcaaaucccucagauggaucagcagcaaauuuaguaccagaaguaaauaaugaaguuauggcccucgaaccaguuguaggagcugcaauagcugcaccagucgccggucaacaaaaugucauugauccauggauuagaaauaacuucguccaagcaccaggcggugaauuuacagucucaccacgaaaugcaccaggugaaauacuauggucugccccacuagguccugaucuaaauccauaccuaucacacuuagcaagaauguacaaugguuacgcaggugguuuugaaguacaaguaauacucgccgguaaugcuuuuacagcugguaaaguaaucuuugcagcaguaccacccaauuucccaaccgaaggauuaucccccucacaaguaacaauguuuccccacauaguaguagacguaagacaacuagaaccaguucuaauuccauuaccggacguaagaaauaauuucuaucacuauaaccaauccaacgacccuaccaucaaauuaauagccauguuauauacuccccuaagagcaaacaacgcuggugacgauguauuuaccguaucuugucgugucuuaacaagacccucacccgauuuugacuuuauauuucuaguacccccaacaguagaaucacgaacaaaaccuuuuucaguaccaguacuaacaguagaagaaaugacaaauucaagauucccaauaccauuagagaaacuauucacaggaccauccucagcauucguaguucaaccccaaaacggucgauguacuaccgauggaguauuacucgguaccacacaacuaaguccaguuaauaucugcaccuuuagaggugauguuacucauauaacaggaucacgaaacuauacuaugaacuuagcaucucaaaauuggucaucauaugacccaacagaagaaauaccagcucccuuaggaacaccagauuuuguaggcaaaauacaaggaauguuaacacaaacaaccagaacagacgguucaaccagaggacacaaagcaacaguuuacacagguucagcugacuuugccccaaaacucggaagaguacaauuugaaacagacacugaccacgauuucgaagcaaaccaaaauacaaaauuuacuccagugggaguuauucaagauggaucaacaacacacagaaaugaaccucaacaauggguauuaccaucauauucaggcagaaacacuccaaauguucacuuagcgccagccguagcaccuacauucccaggagaacaauuacucuucuuccguucaaccaugccagguuguucuggcuauccaaacauggauuuagauugcuuacuaccucaagaauggguacaauacuucuaucaagaagcagcacccgcacaaucagauguagcccuuuuacgauuuguuaauccagacacaggaagaguacuauuugaauguaaacuccacaaauccggauauguaacuguugcacacacuggacaacacgacuuagucauaccuccuaauggauauuuccgauuugauucaugggucaaccaauucuauacauuagcaccaauggguaauggaacaggccgccgaagagcacuauaa

SEQ ID NO: 31836 - RNA, 1623 nt, Artificial Sequence
  derived and/or modified sequence opt6 from VP1__Norovirus__AJA71427
augaaaauggcaucaucugacgccaacccuagcgauggcucugccgcaaaucuaguaccagaaguaaacaacgaaguaauggcacucgaaccaguaguaggagccgcaauagcagccccaguagcuggacaacaaaacguaauagacccauggauccgaaauaauuuuguacaagcaccagguggugaauuuaccguaucaccaagaaacgcaccaggcgaaauauuauggucagcaccacuaggaccagauuuaaauccauaccuaucacauuuagcacgaauguacaacggauacgcuggcggcuuugaaguucaaguaauacuagccggcaaugcauuuacagccggaaaaguaauauuugcagcuguaccaccaaacuuuccuaccgaaggauuauccccuagccaaguaaccauguucccacacauaguaguagacguaagacaacuagaacccguacuaauaccuuuaccagacguacgaaacaauuuuuaucacuacaaucaaagcaacgauccaacaauaaaacuaauagcuaugcuauauacaccucuaagagcuaacaaugcaggcgaugacguuuucacaguuucaugcagaguacucacaagaccaucaccagacuuugacuuuauauuucuaguaccaccaacuguugaaagcagaacaaaaccauucucuguaccaguacuaacaguagaagaaaugacuaauucacgauuuccaauacccuuagaaaaauuauuuacuggaccauccucagcauucguuguacaaccacaaaauggaagauguacaacugauggaguacuacuggguacaacacaacuaucaccaguaaacauaugcacauuuagaggagauguaacacauauaacaggaucaagaaauuacacaaugaauuuagcuucucaaaauuggggaaacuaugaccccacugaagaaauaccagcaccacuaggcacaccagacuuuguaggaaaaauacaaggaguucuuacccaaacaacuagaacagaugguucaacucgaggacauaaagccaccguauauacaggaucugccgauuuugcaccaaaacuaggcagaguacaauuugaaacagauacagaucacgauuucgaagcaaaucaaaacacaaaauuuacaccaguaggaguaauacaagacggaucuacaacacacagaaaugaaccucaacaauggguauuacccucauacucuggaagaaauacaccaaauguacacuuagcaccagcaguagcaccuacuuucccaggugaacaacuuuuauuuuuuagaucaaccaugcccggauguuccggcuauccaaauauggauuuagauugcuuacucccucaagaauggguacaauauuucuaucaagaagcagccccugcucaaucagauguagcucuucuuagauucguaaauccugacacuggaagaguauuauucgaauguaaacuacauaaaucaggauauguaacaguagcucauacaggacaacaugaucuaguuauacccccaaauggcuacuuuagauucgauaguuggguaaaucaauuuuacacauuagcaccuaugggcaauggaacagguagaagaagagcauuauaa

SEQ ID NO: 31837 - RNA, 1623 nt, Artificial Sequence
  derived and/or modified sequence opt6 from VP1__Norovirus__AJA71428
augaaaauggcuucaucugaugcaaauccuagugaugggucugcagcaaaccuaguaccagaaguaaauaaugaaguaauggcacuugaaccaguuguaggcgcggcaauugcagcuccaguagcaggacaacaaaacguaaucgacccauggauaagaaacaacuucguacaagcaccaggaggugaauuuaccguaucaccaagaaacgcaccuggagaaauacuuuggucagccccauuagguccagaucuaaauccauacuuaucacacuuagcaagaauguauaauggauaugcaggcgguuucgaaguacaaguaauucuagcuggaaacgccuucacagcaggaaaaguaauuuucgccgcagucccaccaaauuuuccaacagaaggacuuagcccaucacaaguuacaauguucccacacauaguuguagacguuagacaauuagaaccaguauuaaucccauuaccagacguaagaaauaauuucuaucacuacaaccaaucuaaugauccuacaauaaaauuaauugcaauguuauacacaccauuaagagccaauaaugcaggagacgauguauucaccguauccugcagaguacuaacaagaccaucaccugacuuugacuuuauauuucuagucccuccaacaguagaaaguagaacaaaaccauucucaguacccgucuuaacagucgaagaaaugacaaacucccgcuuuccaauaccauuagaaaaauuauuuacaggaccuucaucagcauuuguaguucaaccucaaaauggacgcuguacaacagauggagucuuauuaggcacaacacaauuauccccaguaaauauuuguacauuucguggugauguaacacauauaacagguagccacaacuauacuaugaaucuagcaagucaaaacuggucaaacuaugauccaacugaagaaauuccagcaccauuagguacaccagauuuuguaggaaaaauacaaggcgugcuaacacaaacaacuagaacagauggcucaacaagaggccacaaagcaacaguauauacagguucagcagacuuugcaccaaaauuaggaagaguucaauuugaaacagacacugauagagauuucgaagcuaaucaaaauacaaaauuuacaccaguaggagucauacaggauggaggcacaacacacagaaaugaaccucaacaauggguacuaccaucauauaguggaagaaauacaccaaauguacaucuagcaccagcaguagcaccaacuuuccccggagaacaacuacuauucuuuagaucaacaaugccaggaugcucaggcuauccaaauauggaucuagauugccuauuaccacaagaauggguucaauauuucuaucaagaagcugccccugcacaaucagacguagcacuacuuagauucguuaacccagauacaggaagaguauuauucgaauguaaacuacauaaaucuggcuacguaacaguugcacauacaggacaacaugauuuaguaauuccucccaauggcuacuucagguuugacucaugggucaaucaauucuacacacucgccccaaugggaaauggcacaggaagaagacgagcucuauaa

SEQ ID NO: 31838 - RNA, 1623 nt, Artificial Sequence
  derived and/or modified sequence opt6 from VP1__Norovirus__AJA71429
augaaaauggcaagcucagaugcaaacccaucugauggcuccacagcaaaccucguacccgaaguuaacaaugaaguaauggcacuagaaccaguaguaggcgcagcaaucgcagcuccaguagccggccaacaaaauguaauagacccauggauacgaaacaacuuuguacaagccccaggaggagaauuuacaguauccccuagaaaugcaccaggcgaaauacuauggucagcaccccuaggacccgaucucaaccccuacuuaucacaccuagcaagaauguauaauggauaugccggaggcuucgaaguucaaguaauacuugccgguaacgcauuuacagcuggaaaaaucauauucgcagcaguacccccaaauuucccaacagaaggacuaucuccaucucaaguaaccauguucccacacauaauaguagacguaagacaacuugaacccguacuaauaccacuccccgacguaagaaacaacuucuaucauuauaaucaaucaaaugauccaacaauaaaauuaauagcaaugcucuacacaccucucagagccaacaaugcaggagacgauguauucacuguaucaugucgaguauuaacucgaccuucuccagauuucgacuucauuuuuuuaguaccaccaacaguugaauccagaacuaaacccuuuucagucccaguauuaacugucgaagaaaugacaaacagcagauuuccaauacccuuagaaaaacuuuuuacaggacccucaucugccuuuauaguacaaccacaaaauggaagaugcacaacagauggaguacuuuuagguaccacucaauuaucuccuguaaacauaugcacauuucgcggugacguaacccauauauccggcucaagaaacuacacaaugaaucuagcaagucaaaacuggaauuccuaugaccccaccgaagaaacaccagcaccacucggaacaccagauuuugucggaaaaauccaagguguacuuacacaaacuacaagaacagacggaucaacacgcggucacaaagccacuguauacacaggaucagcagauuuuucaccaaaauuaggaagaguacaauuugccacagacacagauaacgauuuuguaacaaaccaaaauacaaaauuuacuccaguuggaguaauacaagaugguucaacaacaccacguaaugaaccacaacaauggguacuaccauccuacuccggcagaaauacacauaauguccaccuagcaccagcaguagccccaacauuuccaggagaacaacuauuauucuuccgaucaacuaugccaggaugcucaggauacccuaauauggauuuagauuguuuacuaccacaagaauggguccaauauuucuaccaagaagcugcuccagcacaaucugacgucgccuuauuaagauucguuaacccagauacuggacgaguacucuucgaaugcaaacuccauaaaacaggauauguaacaguugcacauaccggacaacacgaucuuguaauaccacccaauggauacuuuagauuugauucaugggucaaccaauuuuacacacuagccccaaugggcaaugguacaggaagacgaagaguauuauaa

SEQ ID NO: 31839 - RNA, 1623 nt, Artificial Sequence
  derived and/or modified sequence opt6 from VP1__Norovirus__AJA71430
augaaaauggccucuucagacgcaaauccaucagacggaucagcagcaaauuuaguaccagaagucaacaaugaaguaauggcuuuagaaccaguuguuggugcagcgaucgcagcuccagucgcaggacaacaaaauguaauagacccuuggauaagaaauaauuucguacaagcacccggaggagaauuuacaguaucuccuagaaaugcaccaggugaaauauuaugguccgcaccucuuggcccagaucucaauccuuaucuaucccaccuugccagaauguauaacggauaugcaggaggauuugagguacaaguuauauuagcaggaaacgccuuuacagccgguaaaguaauauucgcagcaguaccaccaaauuucccaaccgaaggacuaucgcccucucaaguaacuauguucccacacauaguagucgacguaagacaacuagaacccguuuuaauaccacuaccagauguaagaaauaauuuuuaucacuacaaucaaucaaaugacccaacuauaaaauuaauagcuauguuauauacaccauuaagagcaaacaaugccggagaugaugucuuuacaguuucuuguagaguacuaacaagaccaucaccugauuuugauuuuauauuuuuaguacccccuacuguugaaucaagaacaaaaccuuucucaguuccaguauuaacaguagaagaaaugacaaacaguagauuuccaauaccauuagaaaaauuauucacaggacccuccuccgccuucguuguacaaccacaaaacggacguuguacaaccgauggaguauuacuagggacuacacaauuaucaccaguaaauauuuguacauuuagaggugacguaacucauauuacaggaucccauaauuauacuaugaaccuagcuucacaaaauuggucaaauuaugauccaacagaagaaauaccagcuccauuagguacuccagacuuuguaggaaaaauacaaggcguauuaacucaaacaacuagaacagaugguucaacuagaggacauaaagcaacaguuuacacuggcucagcugauuuugcuccuaaauuaggaagaguacaauucgaaacagauacuaaccacgacuucgaugcaaaucaaaauacaaaauuuacaccaguaggaguaauacaagauggagguacaacccacagaaaugaaccucaacaauggguacucccgucuuacucaggaagaaauaccccaaacguucaucuagcccccgcaguugcaccaacuuuuccaggugaacaacuauuauuuuuucgaucaacaaugccugguugcucugguuauccuaauauggaccuagacugcuuacuaccucaagaauggguacaauacuuuuaccaagaagcagcaccugcacaaucagaugucgcauuacuaagauucguuaacccagacaccggaagaguccuauuugaguguaaauuacauaaaucuggcuauguaaccguagcucacacaggccagcaugauuuaguaauaccccccaauggauauuuuagauucgauucauggguaaaccaauuuuacacucuagcaccaaugggaaauggaacagguagaagaagagcuuuauaa

SEQ ID NO: 31840 - RNA, 1623 nt, Artificial Sequence
  derived and/or modified sequence opt6 from VP1__Norovirus__AJA71456
augaaaauggcauccucagacgcaaauccauccgauggaucagcagcaaaccuaguaccggaagucaacaacgaagucauggcuuuagaaccuguaguaggcgcuacuauugcagcaccaguagcaggacaacaaaacguaauagauccauggauccgaaauaacuucguacaagcccccggaggggaauuuacaguuucuccacguaaugccccaggagaaauacuaugguccgccccauuaggcccagaucuaaauccauaucuaucacauuuagcuagaauguauaauggauaugcugguggauuugaaguacaagucauucuugcaggcaacgcuuucacugcuggaaaaguaauauuugcagcaguacccccaaacuuucccacagaaggacuaucaccaucucaaguuacaauguuuccucauaucguaguugauguaagacaauuagaaccuguacuaaucccacuacccgauguuagaaacaacuucuaucauuauaaccaaucuaacgacccuacaauaaaauuaauugcaauguuauauacaccauuaagagcaaacaacgcaggagaugauguauuuacaguuucaugucgaguucuuacaagacccuccccagauuucgauuuuauauuccuaguuccaccaacuguugaaucaagaacaaaaccauuuuccguaccaauacuuacaguagaagaaaugacuaacucuagauuuccaauaccuuuagaaaaacuauuuacagguccaucaucugcauuuguaguacaaccacaaaauggaagaugcacgacagauggaguacuuuuaggaacaacacaacuaucaccagucaacauuuguacauuuagaggagacguaacacacauaacaggaucccguaauuauacaaugaaccuagcaucacaaaauuggucaaacuacgauccaacagaagaaauuccagcaccauuaggcaucccagacuuugucggaaaaauacaaggcaugcuuacacaaacaacucgcacagacgguuccacaagaggacacaaggcaacaguuuacacagguucagcagauuuugcccccaaauuagguagaguucaauuugaaacggacacugaucacgauuuugaagcaaaucaaaauacuaaauucacuccuguaggcgucauacaagacgguucaacaacucauagaaacgaaccacaacaauggguuuuaccaucuuauucagguagaaauacucccaacguacacuuagcaccagccguagcaccaacauucccaggagaacaauugcuauucuucagaucaacaaugccaggaugcucaggauacccuaauauggaucuagauuguuuacucccccaagaauggguacaauauuuuuaccaagaagcagccccagcucaaucagacguugcacuacuacgcuuugucaauccagacacaggaagaguauuauuugaaugcaaacuucacaaaucugguuaugucacugucgcacacaccggccaacaugauuuaguaauaccaccaaauggauauuucagauuugauagcuggguaaaucaauuuuacacacuagcaccaauggguaauggaacaggcagaagaagagcauuauaa

SEQ ID NO: 31841 - RNA, 1623 nt, Artificial Sequence
  derived and/or modified sequence opt6 from VP1__Norovirus__AJA71457
augaaaauggcaaguucagaugccaauccaucagauggcucagcagcaaaucuaguaccagaaguaaacaacgaaguaauggcucuugaacccguagugggcgcagcuauugcagcaccaguagcaggacaacaaaaugugaucgacccuuggauuagaaauaacuuuguacaagcucccggaggagaauuuacaguuucaccacgaaaugcaccuggagaaauauuauggucagcaccucuaggaccagacuuaaacccauaucucucucauuuagcaagaauguacaaugguuaugcaggaggauucgaaguccaaguaauccuagcaggaaaugcauuuaccgcagguaaaguuauauuugccgcaguaccuccuaauuuuccaacugaaggacuuucuccaagucaaguaacaauguucccacacauuguaguagacguacgacaacuagaaccaguauuaauaccucuaccagauguacgaaauaacuuuuaucacuauaaccaauccaaugaccccacaauaaaauuaaucgcaaugcuauacaccccauuaagagcuaauaacgcuggagacgauguauuuaccguauccugucgcguauuaacacgaccaucaccagacuucgauuuuauauucuuaguccccccaacaguugaaucaagaacaaaaccauucucaguaccaguacuaacaguagaagaaaugacaaauucacgauuuccuauacccuuagagaaacucuuuacagguccaucaucagcauucguaguucaaccacaaaacggaagauguacuacugacgguguauuacuaggcaccacacaauuaucuccagucaauauauguacuuuuagaggagauguaacucacauaacgggaucaagaaauuacacuaugaaucuagccucacaaaauugguccaacuaugacccuacagaagaaauaccagcaccauuaggaacuccagauuuugucggaaaaauucaagggguauuaacacaaaccaccagaaccgacggauccacgagaggacauaaagcaacuguauauaccggcucagcagauuuugccccaaaacuuggaagaguccaauucgaaacugauaccgaccaugauuucgaagcaaaccaaaauacaaaauucacuccaguaggaguaauucaagauggcucaacuacacauagaaacgaaccacaacaauggguucuaccaucauauuccggucgaaauaccccuaacguacacuuagcaccugcaguagcaccuacuuuuccaggcgaacaauuauuauuuuuuagaucaacuaugccugguugcucaggcuacccaucuauggauuuagauuguuuacuaccacaagaauggguacaauauuuuuaucaagaagcagcaccagcccaaucagauguagccuuacucagauucguaaauccagacacuggaagaguacuauuugaauguaaacuacauaaaucaggauauguuacaguagcccauacaggacaacaugauuuaguuauaccaccaaauggcuauuucagauucgacucauggguaaaucaauuuuauacuuuagcaccaaugggcaacggaacuggacgaagaagagcccucuaa

SEQ ID NO: 31842 - RNA, 1623 nt, Artificial Sequence
  derived and/or modified sequence opt6 from VP1__Norovirus__AJA71458
augaaaauggcaucuucagacgcaaacccuuccgauggaagugccgcaaauuuaguaccugaaguaaauaaugaaguaauggcauuagaaccagucguaggagcagcaauagccgcaccuguagccggacaacagaauguaauagacccauggaucagaaacaacuuuguacaagcuccugguggagaauuuacaguaucaccuagaaaugcacccggagaaauauuauggucagcacccuuaggacccgauuuaaauccauauuuaucccaucuagcaagaauguauaaugguuacgcaggagguuucgaaguacaaguuauuuuagccggaaaugcauuuacagcaggaaaaguaauauucgcagccguacccccuaacuucccuaccgaaggccuguccccaucacaaguaacaauguucccacauaucguaguagauguacgacaauuagaaccaguauuaauaccucucccagauguaagaaacaauuucuaucauuauaaucaaagcaacgacccaacaauuaaauuaaucgccauguuguacacaccacuacgugcgaacaaugcaggagacgacguauuuacaguuucauguagaguccuaaccagaccaucaccagacuuugacuuuauauuuuuaguaccaccaaccguugaaucucgaacaaaaccauucuccguaccaguacucacaguagaagaaaugacaaauucaagauucccaauaccacuagaaaaauuauuuaccggaccaucaucagcauuugucguacaaccccaaaacggaagauguacaacagauggaguauuauuaggaaccacacaacuauccccaguaaauaucugcacauuccgaggcgacguuacacauauaacaggcucacauaacuauacaaugaacuuagcaucacaaaacugguccaauuaugauccagcagaagaaauaccagcaccacuaggaacaccugauuuuguugguaaaauacaaggaguacuaacacaaacaacaaggacagaugguucaacucguggacauaaagcaacaguauauacaggaucagcugacuuugcacccaaauuaggucgaguacaauucgaaacugauaccgauagagauuuugaagcuaaucaaaauacaaaauucacaccaguaggaguuauacaggacggaggcacuacacaucgcaacgaaccacaacaauggguauuaccuuccuauucaggaagaaauacaccaaauguucacuuagcaccagcuguagcaccaacauuccccggagaacagcuuuuauucuuuagaucuacaaugcccgguugcucuggauauccuaauauggauuuagauuguuuacuaccucaagaauggguacaauauuucuaucaagaagcagcacccgcacaaucagauguagcccuauuaagauucguaaauccugacacaggaagaguuuuauucgaaugcaaauuacacaaaucaggauacgucacaguagcacauaccggacaacacgaucuaguuauaccaccaaacggauacuucagauucgacucaugggucaaucaauuuuauaccuuagcaccaaugggaaauggaaccggacguagaagagcauuauaa

SEQ ID NO: 31843 - RNA, 1623 nt, Artificial Sequence
  derived and/or modified sequence opt6 from VP1__Norovirus__AJA71459
augaaaauggccucaagcgaugccaacccaucagauggaucagcagcaaaccuaguaccugaaguuaauaacgaaguaauggcauuagaaccaguuguaggugcagcaaucgccgcaccaguagcuggacaacaaaacgucauagacccuuggauccgaaacaauuuuguacaagcaccaggaggagaauuuacaguaucaccaagaaaugcacccggagaaauuuuauggucagccccacuaggacccgaccugaacccauauuuaucacauuuagcaagaauguauaauggauacgcaggagguuuugaaguacaaguaauacuagcaggaaaugccuuuacugcaggaaaaguaauuuucgcagcuguaccacccaauuuuccuaccgaaggacuaucuccaucucaaguaacaauguucccacacauaguagucgauguuagacaacuagaaccaguccugauaccacuaccagauguaagaaauaauuucuaccauuacaaccaaucaaaugauccaacaauaaaauuaauugcaauguuauauacuccucuacgcgccaauaaugcaggagacgauguauuuacaguaucauguagaguacuaacaagaccaucaccagauuucgauuucauauuccuaguaccuccaacaguagaaucuagaacaaaaccauucucaguaccaguauuaacagucgaagaaaugacaaauucuagauucccuauaccacuagaaaaacuauucacaggaccuaguucagcauucguuguacaaccacaaaauggcagaugcacaacugauggaguacuccuaggcacaacacaauuaucuccaguaaacauauguacauuuagaggagauguuacacauauaaccggcucuagaaauuacacaaugaacuuagcuucgcaaaacugguccaacuacgauccaacugaagaaaucccagcaccacuagguacaccagacuuuguaggaaaaauacaaggcguacuaacacaaacaacucgaacagauggaucaacacgaggacacaaagcaaccguauacaccggaucaguagacuuugcaccuaaacuuggacgaguacaauuugaaacagauacagaucacgauuuugaagcuaaucaaaauacaaaauuuacaccaguugguguaauacaagacggcucaacaacacauagaaacgaaccacaacaauggguauuaccaucauauucaggaagaaauacaccaaauguccaccucgccccugcaguugcuccaacauucccaggagaacaacucuuauucuuccgcucuacaaugccaggaugcuccgguuacccaaauauggaccuugauugccuucuaccacaagaauggguacaauacuucuaccaagaagcagcaccagcucaaucagacguugcauuauuaagauucguaaauccagauacuggaagaguccuauuugaaugcaaacuacauaagucuggcuaugucacaguagcacauaccggccaacaugauuuaguuauaccaccaaacggauauuucagauuugauucuuggguaaaucaauuuuauacauuagcaccuaugggaaauggaacaggaagaagacgagcacuauaa

SEQ ID NO: 31844 - RNA, 1623 nt, Artificial Sequence
  derived and/or modified sequence opt6 from VP1__Norovirus__AJA71460
augaaaauggccagcucagaugcaaacccuucagacgguucagcagcuaaccuuguaccugaaguaaacaacgaaguaauggccuuagaaccaguaguaggagcugcaauagcagcaccugucgcaggacaacaaaaugucauagacccauggaucagaaacaauuuuguacaagcaccaggcggugaauucacuguaucaccuagaaaugccccuggagaaauacuauggucagccccauuaggaccagaucuaaaucccuauuuaucacauuuagcaagaauguacaauggauaugcaggaggauucgaaguacaaguaauacuagcaggaaaugcauuuacagcuggcaaaguaauuuucgcagcaguaccuccaaauuuuccaacugaaggacuaucaccaucccaaguaaccauguucccacacaucguaguagauguuagacaacuagaaccuguucucauaccacuaccagauguacgaaacaauuucuaucacuauaaucaaucaaaugauccaaccauaaaauuaauagccauguuauacaccccacuaagagccaauaaugcaggugaugauguauuuacaguguccugcagaguacuaacucgaccaucuccagauuuugauuuuauauuucuaguccccccaacaauagaaucacgaaccaaaccauuuucgguaccaguauuaacaguagaagaaaugacuaacucacgauucccaauucccuuagagaaauuauuuacaggacccucuucugcauucguuguacaaccacaaaauggaagauguacaacugauggcguacuucuaggaacuacacaauuaaguccaguaaauauaugcacuuuucgaggagacguaacacauauaacaggaucacgaaauuauacaaugaauuuagcaucacaaaauuggaauaauuacgauccaacugaagaaauaccagcaccauuaggaacacccgacuuuguaggaaaaauacaaggcgucuuaacacaaacaacucgaacagacggaaguacaagaggacacaaagcaacaguuuauacaggaagcgcagacuucucuccaaaauuagguagaguacaauucgaaacagauacagaucacgacuuugaagcaaaucaaaauacaaaauuuacaccaguaggcguuauccaagacggagguacaacacacagaaaugaaccacaacaauggguucucccauccuacuccgguagaaauacaccaaauguucaucuagcaccugcaguagcaccgacauucccaggagaacaacuacucuuuuucagaucaacaaugccagguugcucaggcuacccaaauauggaccuagauugucuacuaccccaagaauggguacaauauuucuaccaagaagcagcaccagcacaauccgacguugcccuauuaagauucgucaauccugauacaggaagaguccuauuugaaugcaaacuacauaaaucaggauauguaacaguggcacacacaggacaacaugauuuaguuauaccaccaaacggcuauuuuagauucgauucaugggucaaccaauucuacaccuuagccccaaugggcaauggaacaggacgacgaagagcccuuuaa

SEQ ID NO: 31845 - RNA, 1623 nt, Artificial Sequence
  derived and/or modified sequence opt6 from VP1__Norovirus__AJA71461
augaaaauggccucaucagaugcuaauccuagugacggaucugcagcaaaccuaguaccagaaguuaacaaugaagucauggcccuagaaccaguaguaggcgcagcaauugcagcaccaguagcaggucaacaaaauguaauagacccauggauaagaaauaacuucguccaagcuccaggcggagaauuuacaguaucaccaagaaaugcaccaggagaaauauuguggagcgccccacuaggacccgauuuaaauccauaccuaucacaucuagcacgaauguauaacggauacgcaggagguuucgaaguacaaguaauacuagcugguaaugccuuuacagcuggaaaagucauauucgcggcuguaccaccuaacuucccuacugaaggacuaucaccaucacaaguaacaauguuuccucauauaguuguagacguuagacaauuagaacccguacuaauaccuuuaccagauguaagaaacaauuuuuaucauuauaaucaauccaaugacccaacaauaaaauuaauagcuaugcuuuauaccccacuaagagccaacaaugcaggagaugacguauuuacaguaaguugccgagucuuaacgagaccaucaccagacuucgacuuuauauuucucguaccucccacaguagaaaguagaacaaaaccauucucuguacccguacuaaccguagaagaaaugacaaacaguagauucccaauuccauuagaaaaacuuuuuacugguccaucaucagcauucguaguacaaccccaaaauggaagauguacaacagacggcguccuacuuggaacaacacaacuaucaccaguaaacauauguaccuuucgaggcgauguaacacacauuacaggaaguagaaauuacacaaugaaucuagcuucacaaaauuggucaaacuacgauccaacagaagaaauaccugcuccuuuagguacacccgauuucguagguaaaauucaaggaguacuaacacaaacaacaagaacagauggaaguacaagaggacauaaagcaacaguauacacaggauccgcagacuucgcaccaaaacuaggaagaguccaauucgaaacagauacagaccacgauuuugaagccaaucaaaauacaaaauuuacuccaguaggaguaauacaagauggauccaccacacauagaaaugaaccacaacaauggguacuaccaaguuauaguggaagaaauacaccaaauguacauuuagcuccugccguagcaccaacauucccaggagaacaacuccucuucuuucgcuccacaaugcccgguugcuccggauacccaaacauggaccuagauugcuuacuaccucaagaauggguucaguauuucuaccaagaagcugcaccagcccaaucagacguagcucuauuaagauucguaaauccagauacaggacgaguauuauucgaauguaaauuacauaaaagcggcuacguaacuguagcacacacaggacaacaugaucuaguuauaccucccaaugguuauuuucgauuugacucauggguaaaucaauuuuacacauuagccccaaugggaaacgguacaggcagacgaagagcacuauaa

SEQ ID NO: 31846 - RNA, 1623 nt, Artificial Sequence
  derived and/or modified sequence opt6 from VP1__Norovirus__AJA71462
augaaaauggcauccucagaugccaacccuucagaugguucagcagcaaauuuaguaccagaagucaauaaugaaguaauggcacuagaacccguagucggcgcagcuauagcagcaccaguagcaggacaacaaaauguaauagauccauggauaagaaauaacuuuguacaagcaccuggcggcgaauuuacaguaucacccagaaaugcaccaggagaaauacuauggagcgcuccucucggaccugaucuaaacccauaccuaucacacuuagcaagaauguauaacggauaugcuggagguuucgaaguacaaguaauacucgccggaaacgcauucacagcuggaaaagucauauuugcugcaguaccaccuaacuuucccaccgaaggccuaucuccuucacaaguuacaauguuuccucacauaguaguagacguaagacaauuagaaccaguccuuauaccacuaccagauguaagaaauaauuucuaucauuauaaccaauccaaugauccaacaauaaaacuaauagcuaugcuauauacuccuuuaagagcaaacaaugcaggagaugauguauuuacaguaucaugucguguacucacaagaccaucuccugauuuugacuucauauuucuaguacccccaaccguagaaucaagaacaaaaccauucucuguaccuguauuaacuguagaagaaaugaccaauucuagauucccaauacccuuagagaaacuauuuacaggaccaucaucagcuuucgucguacaaccacaaaacggaagauguacuacagacggaguauuacuagguacaacacaauuaucaccaguuaauauaugcacuuucagaggagauguaacacacauaacaggaucaagaaacuacacaaugaauuuagcuucccaaaauuggaacaauuaugaccccacagaagaaauuccagcaccacuagguacacccgacuucguagguaaaauacaagguguauuaacccaaacaacuagaacagacgguucuacacgaggucauaaagccacuguguauacaggaucugccgauuucgccccaaagcuaggaagaguacaauuugaaaccgacacagaucacgacuuugaagcuaaucaaaauacaaaauuuacaccaguaggaguaauacaagacggaucaacaacccauagaaaugaaccacaacaaugggucuuaccauccuauucaggaagaaauacaccuaacguacaccuagcaccugcuguugccccaacauuuccaggugaacaauuauuauucuucagaucaacaaugccaggauguuccggauauccuaacauggaucuagauuguuuacucccacaagaauggguacaauacuucuaucaagaagcagcaccugcacaaucugacguagcucuucuacgauuuguaaacccugacaccggaagaguacuuuuugaaugcaaauuacacaaaucaggauacguaacaguagcucacacaggccaacacgauuuaguuauaccaccaaauggauacuuucgauucgacagcuggguaaaccaauucuauacacuagcuccaaugggcaaugguacuggaagacgaagagccuuauaa

SEQ ID NO: 31847 - RNA, 1623 nt, Artificial Sequence
  derived and/or modified sequence opt6 from VP1__Norovirus__AJA71463
augaagauggcaaguucagacgccagucccucagacggaucagccgccaaccuaguuccagaaguaaauaacgaaguaauggcauuagagccaguaguaggugcagcaauugcagcaccaguugcaggccaacaaaauguaauagaccccuggauaagaaauaauuucguacaggcaccuggcggagaauucaccguuucaccacguaaugcuccaggagaaauauuauggucagcaccuuuaggaccagaucuaaaucccuaccuaucacaucuagcuagaauguauaacggauaugcgggagguuucgaaguucaaguaauauuagcugguaacgccuucaccgcaggcaaaguaauauucgcagcaguaccaccaaauuuuccaacugaaggacuaucaccaucacaaguaacaauguuuccacacauugucguagauguuagacaacuagaaccaguacuaauaccacuaccagauguuagaaacaauuucuaucauuacaaucaauccaaugacccaacaauuaaauuaauagcaaugcuuuauacaccauuaagagcaaauaacgcaggagacgauguauucaccguaucaugccgaguucuaacuagaccaucacccgauuuugauuucauauuuuuaguucccccaacaguagaaucaagaacaaaaccauuuucaguacccguacuaacagucgaagaaaugacaaauucacgauuuccaauaccucucgaaaaacuauuuacaggacccagcucagccuuuguaguacaaccacaaaacggcagaugcaccacagacggaguauuacuaggaaccacacaacuaucaccuguaaauaucugcacuuuccgaggagacguaacacauauaacaggauccagaaauuacacaaugaaccuugcaucccaaaacuggucuaauuaugaucccacagaagaaauuccagcaccucuaggaacucccgacuuugucgguaaaauacaagguguauuaacucaaacaacccgaacugacggcucaacaagaggacacaaagcaacaguauauacaggaucagcagacuucgcaccaaaacucgguagaguacaauucgaaacugauacagaucacgauuucgaagccaaucaaaacaccaaauucacaccuguaggaguaauucaagacggaggcacaacacauagaaaugaaccacaacaauggguacuaccuucauauucagguagaaauacaccaaacguacacuuagcaccagcaguagcaccaacauuuccaggagaacaauuauuauucuuuagaucaacaaugccaggauguuccgguuacccaaacauggaucuagauuguuuacucccccaagaauggguucaauauuucuaccaagaagccgcaccagcacaaagcgacguagcacuuuuaagauucgucaacccagauacaggaagagucuuauuugaauguaaacuacauaaaucuggauacguaacuguagcacauacaggccaacacgauuuaguaaucccaccaaauggauauuucagauuugauagcuggguaaaccaauucuacacauuagcaccaaugggaaauggaacaggaagaagacgugcccucuaa

SEQ ID NO: 31848 - RNA, 1623 nt, Artificial Sequence
  derived and/or modified sequence opt6 from VP1__Norovirus__AJA71464
augaaaauggcaucaucagacgcaaauccuagugauggaucggcagcaaauuuaguaccagaaguaaacaaugaaguuauggcguuagaacccguugucggagcugcuauugcagcaccagucgcaggacaacaaaacguaauugacccauggauaagaaauaauuucguacaagcuccuggaggagaauucacgguuucaccuagaaacgcaccuggcgaaauacuaugguccgcaccacucggaccagaucuaaaucccuaucuaucacacuuagcacgaauguacaauggauacgcaggaggauuugaaguacaaguaauacuagcagguaaugcauucacugccgguaaaguaauauucgccgcaguccccccaaacuuuccgacagaagguuuauccccaucccaaguaacaauguuuccacacauaguaguagauguuagacaacuagaaccuguacuaauaccacuaccagacguuagaaacaacuucuaucacuauaaucaaucaaaugacccaaccauaaaauuaauagcaaugcuuuauacaccacuaagagcaaacaaugcaggagacgauguauucacaguaucuugucgaguucuaacaagaccaucuccagauuucgauuuuauauucuuaguaccaccuacaguugaaagccgaacaaaaccauuuaguguaccuguauuaacagucgaagaaaugacaaacucuagauuuccaauaccauuagaaaaauuauuuacaggaccaucaucugcauucguaguacaaccacaaaauggcagauguaccacugacggugucuuacuaggcacaacacaauuaucaccuguaaacauuuguacauuccgaggugaugucacacauauaacuggaucacacaauuauacaaugaaucuagcaucacaaaauuggucaaauuacgacccaacagaagaaauaccagcgccauuaggaacuccagacuuuguugggaaaauacaaggaguacuaacacaaacaacccgaacugacgguucaacaagaggacauaaagcaacugucuacacaggaagugcagauuuugcaccuaaacuaggcagaguucaauucgaaacagauacagaucgagacuuugaagcaaaucaaaacacaaaauuuacuccaguaggaguaauacaagacggaggcacaacacaucgaaaugaaccccaacaauggguauuaccuucuuauagugguagaaauacaccaaacguacauuuagcaccagcaguagcaccaacuuuuccaggcgaacaacuccuauuuuuucgaucaacaaugccgggauguucaggauaucccaauauggaucuagauugccuuuuaccacaagaauggguacaauauuucuaucaagaagcagcacccgcacaaucagacguugcacuuuuacguuuuguaaacccagacacaggacgcguauuguucgaauguaaauuacauaaaucagguuauguaacaguagcccauacaggccaacacgaucucguaaucccaccaaauggauauuuuagauucgauagcuggguuaaucaauuuuauacuuuagccccaaugggaaacggaacaggaagaagaagagcccucuaa

SEQ ID NO: 31849 - RNA, 1623 nt, Artificial Sequence
  derived and/or modified sequence opt6 from VP1__Norovirus__AJA71465
augaaaauggcuucuucggacgcuaauccuucagacggaucugcagcaaauuuaguucccgaaguaaauaaugaaguaauggcauuagaaccaguuguaggagccgcaauagcagcacccguugcaggacaacaaaauguaauagauccauggauuagaaauaacuuuguacaagcacccggaggagaauuuacuguaucaccacgaaaugcaccaggagaaauauuauggucagcaccacuuggacccgaucuaaauccauauuuaucacauuuagcaagaauguauaacggauacgcaggaggauuugaaguacaaguaauauuagcagguaacgcauucacagcagguaaaguaauauuugcugcuguuccuccaaauuucccuacagaaggauuaucuccuucacaaguuacuauguuuccccacauaguagucgauguuagacaacuugaaccaguucuaauuccacuaccugauguuagaaauaauuuuuaccauuauaaccaaucuaacgacccaacaaucaaacuaauagcaaugcuauacacuccauuacgagccaacaacgcuggagacgacgucuuuacaguaucauguagaguucuaacaagacccucuccagacuucgauuucauuuuucugguaccaccuacaguagaaucaagaacaaaaccauuuucaguaccaguuuuaacaguagaagaaaugacaaacucacgauuuccaauuccacuagaaaaacuauuuacaggaccauccucagcuuuuguaguacaaccccaaaacggaagauguacaacagaugguguauuauuaggaacaacacaauuaucaccaguuaacauuugcacauuuagaggugauguaacacauauaacaggaucacauaacuauacuaugaauuuagcgucucaaaauuggucuaauuacgacccaacagaagaaauaccagcaccauuaggaacuccugauuucguaggaaaaauccaagguguucuaacucaaaccacaagaacugacggauccacaagaggucacaaagcuaccguauauacuggaucugcagacuuugcuccaaaauuaggccguguccaauuugaaacagauacagacagagacuucgaagcuaaucaaaacacuaaauuuacaccaguaggugucauacaagacggaggaacuacacaccgaaaugaaccacaacaauggguuuuaccuucauacucaggacguaacacaccaaauguucauuuagcucccgccgucgcaccgaccuuuccuggagaacaauuacucuuuuuuaggucaacuaugccuggaugcaguggcuauccaaauauggauuuagauugcuuauuaccucaagaauggguucaauauuuuuaucaagaagcagcuccagcucaaucagacguagccuuauuaagauuuguuaacccagacacaggaagaguuuuauuugaauguaaauuacacaaaucugguuacgucacagucgcacauacaggccaacaugauuuaguaauaccccccaacggauauuuccguuuugacucaugggucaaccaauuuuacaccuuagccccaauggguaauggaacaggaagaagacgagcauuauaa

SEQ ID NO: 31850 - RNA, 1623 nt, Artificial Sequence
  derived and/or modified sequence opt6 from VP1__Norovirus__AJA71466
augaaaauggcauccucagaugcgaacccuucagauggaucagcagcaaaccucguaccagaaguuaauaaugaaguaauggcauuagaaccaguaguaggugcagcaauagcugcaccaguagcaggacaacaaaaugucauagaucccuggauucgaaauaauuuaguccaagcuccuggcggagaauuuacuguaucaccccgcaaugcaccaggggaaauauuauggucagcaccccucggaccagaauuaaacccauacuuaucacauuuagcaagaauguauaaugguuacgccggagguuuugaaguucaaguaauauuagcagguaaugcauuuacugcuggaaaaguaauuuucgcagcagucccaccaaacuucccaacagaaggucucuccccaucccaaguaacaauguucccucauauaguagucgacguaagacaauuagaacccguacuuaucccacuaccagauguccgaaauaauuuuuaucacuauaaccaaucaaaugauccaacaauaaaacuaauagccauguuauacaccccacuaagagcaaauaaugcuggugacgauguauuuacaguauccuguagaguauuaacaagaccaaguccugacuuugacuuuaucuuuuuaguaccaccaacaguagaaucaagaacaaaaccauucucaguuccuguauugacagucgaagaaaugacaaauucacgauuuccuauaccacuugaaaaauuauucacagguccaucaucugcauucguaguacaaccacaaaacgguagaugcacaacagacggaguauuacuuggcacaacacaauuaucccccguaaacauaugcacauuucgcggcgacgucacacacauaacaggcucaagaaacuacaccaugaaccuagcaucacaaaacuggucaaacuacgacccaacagaagaaauaccagcaccucuaggcacaccagauuucguaggaaaaauccaaggaguccuaacucaaacaacacgcacagacggaucaacucgcggacauaaagccacuguauauacaggcucagcugacuucgcacccaaacuaggaagaguacaauuugaaacugacacagauagagacuucgaggcuaaucagaauaccaaauuuacaccaguuggcguaauucaagacggaucuacaacucauagaaaugaaccacaacaauggguuuuaccaucauauucaggaagaaacacuccaaacguucaccuagcacccgcaguagccccaacuuucccaggugaacaacuacucuucuuucgaucaacaaugccaggauguucaggauacccaaauauggacuuagacugcuuauuaccacaagaauggguacaauacuuuuaucaagaagcugcaccagcucaaucagaugucgcacuccuacgcuuuguaaauccagacacuggaagaguauuauuugaauguaaauuacacaaaucagguuacgucacuguugcacauacaggccaacacgauuuaguaaucccaccaaauggauauuucagauucgacucauggguaaaucaauuuuacacacucgcaccaaugggaaauggaaccggaagaagaagagcauuauaa

SEQ ID NO: 31851 - RNA, 1623 nt, Artificial Sequence
  derived and/or modified sequence opt6 from VP1__Norovirus__AJA71467
augaaaauggccucuucagaugcaaauccaucagauggaucugcagccaaccuuguaccagaaguaaacaaugaaguaauggcacuagaaccaguuguaggugcagcgauagcagcaccuguagcaggccaacaaaauguaaucgauccauggauaagaaauaacuucguacaagcaccaggaggugaauuuacaguaucaccaagaaacgcaccaggagaaauccuauggucagcaccucuaggaccagaccucaauccauaucuaucacaucuagcaagaauguauaauggauaugcaggaggauucgaaguacaaguuauauuagccggaaaugcauucacagcuggaaaaguaauauucgcagcuguaccuccuaacuuucccacagaaggucuauccccaucucaaguaacaauguucccacacauugucguugacguaagacaacuagaaccaguauuaauuccacuaccagauguacgaaacaauuucuaucacuauaaccaauccaacgacccaacaauaaaauuaauagcuaugcucuacacccccuuaagagcaaacaaugcaggcgaugauguauucaccguaucauguagaguauuaacacgacccuccccagacuucgacuuuauauuucuaguaccaccaacaguagaaucaagaacaaaaccauuuucaguuccuguacuaacuguugaagaaaugacuaauucuagauuuccuauaccacuugaaaaacuauucacagggccaucguccgcauucguaguacaaccacaaaacgguagauguacaacugacggaguccuuuuaggaaccacacaauuaucccccguaaauauauguacauuucgcggugauguaacacauauaacgggaucuagaaacuacacaaugaauuuagcuucccaaaacuggaacaauuaugacccaacagaagaaauaccagcaccuuuaggcacaccugauuuugucggaaaaauucaaggaguauuaacacaaacaacuagaacugacggaaguacucgaggacacaaagcaacagucuauacagguagcgccgacuuugcaccaaaacuuggacgaguacaauucgaaaccgacacagaccaugauuuugaagcaaaucaaaauacaagguucacaccaguagguguuauacaagacggaggaaccacacauagaaaugaaccacaacaauggguccuaccaucuuacucaggaagaaauacaccuaauguccacuuagcaccagccgucgccccaacuuucccaggcgaacaauuauuauucuuuagauccacaaugccaggauguucuggcuauccuaauauggauuuagauugucuccuaccacaagaauggguacaacauuuuuaucaagaagcagccccagcacaaagcgacguagcacuacuaagauuuguaaacccagauacaggcagaguacuauucgaaugcaaacuacauaaaucaggauauguaacagucgcacauacuggacaacacgaucuaguaaucccuccaaacggcuauuuccgcuucgacucauggguaaaucaauuuuacacguuagcaccaaugggaaacggaacagguagaagaagagcacuauaa

SEQ ID NO: 31852 - RNA, 1623 nt, Artificial Sequence
  derived and/or modified sequence opt6 from VP1__Norovirus__AJA71470
augaaaauggcaaguucagaugcaaaucccuccgaugguucagcagcaaaucuuguccccgaaguaaacaaugaagucauggcuuuagaaccaguaguaggagcugcuauugcugcaccaguagcaggacaacaaaacguaaucgacccauggaucagaaauaacuuuguccaagcaccugguggcgaauuuacaguauccccuagaaaugcaccaggagaaauucuauggucugccccacuagguccagauuuaaauccauacuuaucucaucuagcaagaauguauaauggauaugcaggcggauuugaaguucaaguaauuuuagcaggcaaugcauucacugcaggcaaaguaauauucgcugccguaccaccaaacuucccaacugaaggauuaucccccucccaaguaacaauguuuccacauauaguugucgacguaagacaacuugaaccaguauuaauaccauuaccugacguaagaaacaauuucuaccauuauaaccaaucaaaugacccaacaauaaaauuaauagcuaugcuauacacaccacuaagagcaaacaaugcuggagacgauguuuuuaccguuucaugccgaguacuaacacgaccaucccccgacuucgacuuuaucuuucuaguaccaccaacaguugaaucaagaacaaaaccauucucaguaccaauacuaacaguugaagaaaugacaaacucaagauuuccaauaccacuugaaaaauuauuuacaggaccaucaucagcuuuugucguucaaccacaaaacggccgauguacaacagacgguguuuuacucggaacaacucaacucagcccuguaaauauauguacuuucagaggagacguuacucacauaacuggcucucgaaauuacacaaugaacuuagcaucacaaaacuggucuaauuacgacccuacagaagaaauaccagccccucuaggaauaccagacuucgucggaaaaauacaaggaaugcucacacaaaccacccgaacagacgggucaacuagaggacacaaagcaacagucuauacaggaucagcagauuuugcuccuaaauuaggaagaguacaauucgaaacagauaccgaucacgauuucgaagcaaaccaaaauacaaaauuuacuccaguaggaguaauacaagauggaucuacaacacaucgaaaugaaccccaacaauggguacuaccaucauacucaggaagaaauacaccuaacguccacuuagcaccagcaguugcaccaacauuucccggagaacaacuguuauucuuuagaucaacaaugcccggauguucaggcuacccaaacauggauuuagauuguuuacuaccucaagaauggguacaauacuuuuaucaagaagcagcaccagcacaaucugauguagcccuacuacgauucguaaauccagacacuggaagagucuuauucgaauguaaauuacauaaaucaggauauguuaccgucgcucauacaggacaacacgaucuaguuauaccaccaaauggauauuucagauuugauucauggguaaaccaauuuuauacacuagcaccaaugggaaauggaacaggaagaagaagagcauuauaa

SEQ ID NO: 31853 - RNA, 1623 nt, Artificial Sequence
  derived and/or modified sequence opt6 from VP1__Norovirus__AJA71471
augaaaauggcauccucugaugcuaauccaucagaugguagugcugcuaacuuagucccagaaguaaauaaugaaguaauggcauuagaaccaguaguaggagcugcuauagcagcacccguagcaggacaacaaaacgucauagauccauggauacgaaauaauuuuguacaagcacccggaggugaauuuacaguuucgcccagaaaugcacccggagaaauacuaugguccgcaccacuaggaccagaauuaaauccauaucuaucacaccuugcuagaauguauaaugguuaugccggaggauuugaaguacaaguaaucuuagcaggaaacgcuuucacagcaggaaaagucauauuugccgcaguuccuccaaacuuuccaacagaaggcuuaucaccaucccaaguaacaauguuuccucauauaguaguagauguacgccaacuagaaccuguauuaauaccuuuaccagacgucaggaacaauuucuaucacuacaaccaaucuaaugacccaacuauaaaacuaauugcaauguuauauacaccucuaagagcaaacaaugcaggagacgauguauuuaccgucucaugcagaguccuaacacgaccaucccccgacuuugacuucauauuuuuaguaccuccaacaguagaaucccgaacaaaacccuuuucaguaccaguacuuacaguugaagaaaugacuaacucuagauuuccaauaccauuagaaaaacuuuuuacaggucccucuucagcauucguuguccaaccacaaaauggacgauguacuacagaugguguauuacuaggaacaacacaacuuuccccaguaaauauuugcacauucagaggagauguaacucauauaaccgguaguagaaauuauaccaugaacuuagcuucccaaaacuggucaaacuaugauccaaccgaagaaauuccagcaccacuugguacaccagacuuuguaggaaaaauacaaggaguauuaacucaaaccacucgcacagauggaucaacacgaggccauaaagcaacaguauauacaggcagcgcagauuucgcaccaaaauuaggaagaguacaauucgaaacugauacugauagagauuucgaagcuaaucaaaacacaaaauucacacccguaggagugauacaagaugguucaacuacacaccguaacgaaccucaacaauggguccucccaucauacucuggacgaaauacaccaaauguacauuuagcuccugcuguugcuccaacauuucccggagaacaauuacuauucuucagaucaaccaugccagguuguucaggauaucccaauagggauuuagauugucuauuaccccaagaauggguacaauauuuuuaccaagaagcagcuccagcacaaucugauguugcauuacuuagauuuguaaacccagacacaggaagaguacuauuugaaugcaaacuacacaaaucugguuacguaaccguagcacacacuggacaacacgauuuaguuauaccacccaacggauauuucagauuugauucuuggguaaaccaauuuuauacucuagcuccgaugggaaacgguacaggaagaagaagagcauuauaa

SEQ ID NO: 31854 - RNA, 1623 nt, Artificial Sequence
  derived and/or modified sequence opt6 from VP1__Norovirus__AJA71472
augaaaauggcuucaagcgaugccaauccuucagauggaucagcagcaaacuuaguaccugaagugaacaacgaaguaauggcuuuagaaccaguaguuggagcagcaauagcagccccaguagcaggacaacaaaauguaauugauccuuggauccgaaauaacuuuguacaagccccaggaggcgaauuuacaguauccccacgaaacgcaccaggagaaauauuauggucagccccuuuagguccagaauuaaauccauauuuaucucaucuagcaagaauguauaacggauaugcaggagguuuugaaguccaaguaaucuuagcuggaaaugccuucacagcagguaaagucauauucgcagcuguuccaccaaacuuuccaacugaaggacuaagcccaucacaagucacaauguucccacauauaguaguagacguaagacaacuagaaccaguccuuauaccauuacccgauguaagaaacaacuucuaucacuauaaucaaucaaaugauccaacaauaaaacuaauagccaugcuauauacucccuuaagagcaaauaacgcaggagacgacguauuuacaguaucauguagagucuuaacaagacccucaccagauuucgacuucauauuuuuaguaccaccaacagucgaauccagaacaaaaccuuuuaguguaccagucuuaacaguagaagaaaugacaaauucacgauuuccaauaccauuagaaaaauuauuuacaggaccaucaucagcauucguaguacaaccccaaaacggaagauguacaacagacggagucuuacuaggaaccacacaauuaucaccaguaaacauaugcaccuuuagaggcgauguaacacacauaacaggcucaagaaacuacacaaugaaucuagcaagucaaaauuggucaaacuacgauccuacagaagaaauuccagcuccacuaggaacaccagauuuuguugguaaaauucaaggcguuuuaacucaaacaacaagaacagacggaucaacacgaggacacaaagcuacaguuuacacagguucagcagacuucgcacccaaauuaggaagaguacaauucgaaacagauacagacagagacuucgaagcaaaucaaaacacaaaauuuacaccaguuggagucauacaagacggauccacaacucacagaaaugaaccacaacaauggguuuuaccaucauauucaggaagaaacacaccaaacguacauuuagcacccgcaguagcaccuacauuuccaggcgaacaacuauuauuuuuucgaucuacaaugccaggauguagcggauauccaaacauggaccuugauugucuacuaccucaagaauggguacaauauuucuaccaagaagcugcaccagcacaaagcgacguagcauuacuaagauuuguaaauccagauacaggaagaguauuauuugaauguaaacuacacaaaaguggauacgucacaguugcucauacaggacaacacgaucucguaaucccaccaaauggauacuucagguucgauucauggguuaaccaauuuuacacauuagcacccaugggaaauggcacaggcagaagacgagcacuauaa

SEQ ID NO: 31855 - RNA, 1623 nt, Artificial Sequence
  derived and/or modified sequence opt6 from VP1__Norovirus__AJA71473
augaaaauggcaucaagcgacgcaucuccaucagacggcucagcagccaaccuaguaccagaaguuaacaaugaaguuauggcacuagaaccaguaguaggcgcagcaaucgcagcaccaguugcuggacaacaaaaugucauugacccauggauuagaaauaacuuuguacaagcucccggaggugaauucacaguaucaccaagaaaugccccaggagaaauauuauggucagcaccauuagguccagaccuaaauccauauuuaucacacuuagcacguauguacaauggauaugcaggaggauuugaaguacaaguuauucuagcaggaaaugcauucacagcaggcaaaguaauauucgcugcaguaccaccaaacuuucccacagaaggucucucuccaucucaaguuacaauguuuccacacauaguaguagauguucgacaauuagaaccaguacuaauuccacuaccagauguacgaaauaauuuuuaccauuauaaccaaucaaaugacccuacaauaaaauuaauagcuauguuauauacaccacuaagagcaaauaacgcaggagaugacguauucacaguauccugcaggguuuuaacaagaccaagccccgauuuugauuuuauauuucuaguaccaccuacagucgaaucacguacuaaaccuuuuucaguaccaguccucaccgucgaagaaaugaccaauucuagauuccccauaccacucgaaaaauuauuuacaggacccucaagcgcauucguaguccaaccacaaaacggaagaugcacaacugacgguguauuacuaggaaccacacaauuaucuccaguaaauauaugcacauucagaggagacguaacccauaucacagguagcagaaacuauacaaugaauuuagcaucacaaaauuggucaaauuacgaccccacugaagaaaucccagcaccauuaggaacaccagauuuugucgguaaaauucaaggaguacuaacccaaacaacacgaaccgauggcucaacaagaggacauaaagcuacaguauauacaggaucagcugauuuugcaccaaaauuaggaagaguacaauucgaaacagauacagauagagauuucgaagccaaucaaaauacuaaauucacuccaguaggaguaauucaggauggagguacaacacacagaaaugaaccacaacaauggguucuaccaucauauuccggaagaaauaccccaaacguucaucuagcaccagcuguagcaccaacauuuccaggugaacaacuuuuauucuuuagaucaacaaugccaggcugcucuggauauccaaauauggaucuagauugucuucuaccucaggaauggguacaauacuucuaucaagaggcagcaccagcucaaucagacguagcacuacuaagauucguaaauccugacacaggacgagucuuauucgaaugcaaauuacacaaaucagguuauguaacuguagcacauacuggacaacaugauuuaguaauaccaccaaaugguuauuucagauucgauucuuggguaaaccaauuuuauacuuuagcuccaaugggcaauggcacuggaagaagaagagcacuuuaa

SEQ ID NO: 31856 - RNA, 1623 nt, Artificial Sequence
  derived and/or modified sequence opt6 from VP1__Norovirus__AJA71474
augaaaauggcaagcucagaugccaauccaucagacggaucugcagcaaacuuagucccagaaguuaauaacgaagucauggcacuagaaccuguaguaggagccgcaauugcagcaccaguugcaggacaacaaaauguaauagacccauggauuagaaauaauuuuguacaagcaccagguggggaauuuacaguaaguccacgaaaugcaccaggagaaauauuauggucagcaccauuaggaccagauuuaaauccauaucuaucucacuuagcaagaauguacaacgguuacgcaggaggauuugaaguacaaguaauucucgcuggaaaugcauuuacagcaggaaaaguaauauucgcugccguuccaccuaacuuuccuacugaaggucuaucaccaucacaaguuaccauguuuccacacaucguaguagauguucgacaauuagaacccguacuaauaccauuaccagauguuagaaacaauuucuaccauuauaaccaaaguaacgauccaaccauaaaacuuaucgcuauguuauacacaccucuacgagcaaauaacgcaggagacgauguauuuacaguaucaugccgaguucuaacaagaccaucaccagauuucgauuuuauauuucuagucccuccaacaguagaaucucguacaaaaccuuuuuccguuccuguguuaacaguagaagaaaugaccaacucccgauuuccaauaccacuagaaaaacuauuuacugguccaucaucagcuuuuguaguacaaccacaaaacgguagaugcacaacagauggaguauuacuagguaccacacaauuaucccccguaaauauauguacauuuagaggcgacguuacacauauaacuggaucaagaaauuacacaaugaaccuagcaucacaaaacuggucuaacuaugacccaacagaagaaauuccugcaccauuaggaacaccugauuuugucggaaaaauacaaggcguacuaacacaaacaacaaggacagacggaucaacaagaggucacaaagcaacaguauauacaggaagcgcagauuuugcaccaaaacuuggaaggguacaauuugaaacagacacagaccgcgauuuugaagccaaccaaaauacaaaauucacuccaguaggcguaauacaggauggaggaacaacucaucgcaaugaaccacaacaauggguucuuccuucauacucaggaagaaauacacccaauguucacuuagccccagcaguagcacccacuuuccccggagaacaacuacuauucuuuagaaguacaaugccgggauguucaggauauccaaauaccgaucuugauugcuuacuaccacaagaauggguccaauacuucuaucaagaagccgcuccagcacaaucagaugucgcauuauuaagauucguaaaccccgauacaggaagaguauuauucgaauguaaauuacauaaauccggauauguaacaguagcacauacaggccaacacgaccucguuauacccccaaauggauauuuuagauucgacucuugggucaaccaauucuauacacuagccccaaugggcaauggaaccggaagaagacgagcacuauaa

SEQ ID NO: 31857 - RNA, 1623 nt, Artificial Sequence
  derived and/or modified sequence opt6 from VP1__Norovirus__AJA71475
augaaaauggcaucaucagaugccaauccauccgauggcuccgccgccaaucuaguuccagaagucaauaaugaaguuauggcuuuagaacccguaguaggagcagcaauagcagccccaguagcaggacaacaaaacguaauagauccauggauaagaaacaauuuuguacaagcaccaggaggagaauuuacuguaagcccaagaaaugcaccaggagaaauauuauggucagcaccacuagguccagaccucaacccuuaccuaucucaucuugcaagaauguauaauggauaugcaggaggcuuugaaguacaaguaauucuagcaggaaaugccuuuacagcuggcaaaguuauuuucgcagcaguacccccaaauuuuccaacagaaggucuaucaccaucacaaguaacaauguuuccucacauuguaguagacguuagacaacuagaaccaguuuuaauaccacuuccugauguacguaauaauuucuaccauuauaaucaaucaaaugauccuacaaucaaacuuauagcaaugcuauauacuccccucagagcuaauaaugcaggagaugauguauucacaguaucuugccguguacuaacuagaccaucaccagauuuugacuuuauauuccuaguaccucccacagucgaaucacgaacuaaaccauuuucagugccaguauuaacagucgaagaaaugacgaauucaagguuuccuauaccacucgaaaaacuauucacagguccgucuucagcauuuguaguacaaccccaaaacggccgauguacaacagauggaguauugcuaggaacaacucaacuaucuccagucaauauuuguacauuuagaggagauguaacacauauaaccggaucacgcaauuauacaaugaaucuagcaucacaaaacuggucuaauuacgacccaacagaagaaauaccagcaccauuaggaacaccagauuuuguugguaaaauacaagguguucuaacacaaacaacaagaacugacggaucuacuagaggacauaaagcaacuguuuacacaggaagugcagacuuugcccccaaacuagguagaguucaauuugaaacagauacugaucacgauuucgaagcuaaccaaaacacaaaauucaccccaguuggcguaauucaagauggaggaaccacacacagaaacgaaccucaacaauggguauuaccuucuuauucaggcagaaauacacccaacguacaccuagcaccugcagucgcacccacauucccaggagaacaacucuuauuuuucagaucuacuaugccaggauguucaggauauccuaacauggauuuggacugcuuacucccccaagaauggguacaauauuuuuaccaagaagcugcaccagcacaaucugacguagcccuauugagauuuguuaauccagacacaggaagaguuuuauucgaauguaaacuacauaaaucuggauauguaacaguugcacacacuggccaacacgaucucguaauacccccaaauggauauuuuagauuugacucauggguuaaucaauuuuauacucuugcaccaaugggaaacggaacaggacgccgacgagcucuauaa

SEQ ID NO: 31858 - RNA, 1623 nt, Artificial Sequence
  derived and/or modified sequence opt6 from VP1__Norovirus__AJA71476
augaaaauggcaucaucagacgcaaauccaucagauggaucagcagcuaauuuaguucccgaaguuaacaaugaaguaauggcauuagaaccaguaguaggcgccgcaauagcagcacccguagccggucaacaaaauguuauagauccauggauaagaaacaacuuuguacaagcaccaggaggagaauuuacaguuuccccacgcaaugccccuggagaaauacuauggucagcaccccuaggaccagaucuaaauccauacuuaucucaccuugccagaauguauaacggauaugccggagguuucgaaguacaaguaauacuugcaggcaaugcuuuuaccgcagguaaaguaauauucgccgcaguaccacccaauuuuccaaccgaaggauuaucuccaagccaaguaacaauguuuccucauaucguaguagacguaagacaauuagaaccaguacuuauucccuuaccagauguaagaaauaauuucuaccacuauaaccaaagcaaugacccaaccauaaaauuaauagccauguuauauacacccuuaagagcaaacaaugcaggcgacgauguauuuacaguuucauguagaguauuaacaagaccaucacccgauuuugacuuuauuuuucuuguaccaccaacaguagaaucaagaacaaaaccuuucucaguaccagucuuaacaguagaagaaaugaccaauucaagauuuccuauaccauuagaaaaacuauucacuggaccuucaucagcauuuguaguacaaccacaaaauggcagaugcaccacagacggcgucuuauuaggaacaacacaauuaucaccuguaaacauuuguacauuucgaggagauguuacacauauaacuggcucuagaaauuacacaaugaauuuagccucucaaaacuggaauaauuaugaucccacagaagaaaucccagcuccucuaggaacaccugauuuuguaggaaaaauacaagguguccucacacaaacuacaagaacagacggauccacaagagggcacaaagcaacagucuacacuggaucagcagacuuugcaccaaaauuaggacgaguacaauuugaaacagauacggaucacgauuuugaagcaaaccaaaauacaaaauuuacaccaguaggagucauacaagauggauccacaacacauagaaaugaaccacaacaauggguauuacccagcuauucaggaagaaacacaccaaacguacauuuagcgccagcaguagcaccaacauucccaggagaacaauuacuauucuuucgcuccacaaugccuggauguaguggauauccaaauauggaucuugauugccuauuaccucaagaauggguccaauauuuuuaccaagaagccgcacccgcacaaagcgacguagcacuacuuagauuuguaaauccagauaccggaagaguauuauuugaaugcaaauuacauaaaucaggauacgucacaguugcccacacaggacaacacgacuuagucauaccuccaaacggcuacuuccgauucgacucauggguuaaucaauucuauacauuagcaccaaugggaaauggcacuggaagaagaagagcacuauaa

SEQ ID NO: 31859 - RNA, 1623 nt, Artificial Sequence
  derived and/or modified sequence opt6 from VP1__Norovirus__AJF21974
augaaaauggcuucaucugaugccaacccuucugauggaucugcagcaaaucuaguaccagaaguaaauaaugaaguuauggcacucgaaccaguuguaggugcagcaauagcagcuccaguagcaggccaacaaaauguaaucgaccccuggauacgaaacaauuucguucaagcaccaggaggagaauuuacaguuucacccagaaaugcaccuggagaaauauuauggucagcaccuuuaggucccgacuuaaauccauacuuaagccacuuagcaagaauguauaacggauaugccggcggauuugaaguacgaguaauacuugccggaaaugccuucacugcaggaaaaguuauauuugcagcagucccaccaaacuuuccaacagaaggacucuccccuucucaagucacaauguucccacauauuguuguagacguccgacaacuagaaccaguauuaauuccauuaccagauguacgaaauaauuuuuaucacuauaaccaaucaaaugacccaacuauaaaauuaauagcuauguuauacacaccauuaagagcaaacaacgccggugaugacguauuuacaguaucaugucgaguauugacuagaccuucuccagauuuugacuuuauauuucuaguaccccccacagucgaaucaaggacaaaaccauuuucuguaccaauauuaacuguagaagaaaugacaaacucuagauuuccaaucccauuagaaaaacuauuuaccggaccaucaucagcuuucguaguacaaccucaaaaugguagaugcacaacagacgguguauuacuuggaacaacucaauuaucccccguaaauauaugcacauuuagaggagauguaacccauauaacaggaucacgaaauuauacaaugaaucuagcaagucaaaauuggucaaauuacgaccccacagaagaaauuccagcaccauuaggaauacccgauuuuguagguaaaauacaagguaugcuaacacaaacaacaagaacagauggauccacacguggucacaaagcuacugucuacaccgguucagccgauuuugcuccuaaauugggcagaguccaauucgaaacagauacagaucacgauuucgaagcaaaucaaaauacaaaauucacaccagucggaguuauucaggauggaucaaccacacaucgaaaugaaccacaacaauggguauuaccaucauauuccggcagaaauacacccaacguucauuuagcaccagcuguagccccaacauuucccggagaacaacuacucuucuuucgaucaacuaugccaggaugcucuggauauccaaauauggacuuagauugccuauuaccacaagaauggguucaauauuucuaccaagaagcagcaccagcacaaagcgauguagcacuauuaagauucguaaauccagauacaggaagaguauuauucgaaugcaaacuacauaaaucaggcuacguuacaguagcccacacaggccaacacgaucuugucauuccaccaaacggauauuuccgcuuugauucaugggucaaucaauucuauacccuagcaccuaugggcaauggaacaggaagaagaagagcacuauaa

SEQ ID NO: 31860 - RNA, 1623 nt, Artificial Sequence
  derived and/or modified sequence opt6 from VP1__Norovirus__AJF21975
augaaaauggcaucaucagacgcaaauccuucagauggaucugcagcaaauuuaguaccugagguaaauaacgaaguaauggcauuagaaccaguaguaggagcagcuauagcugcaccuguagcaggacaacaaaauguaauagacccauggauaagaaacaacuucguccaggcaccaggaggagaauuuaccguaucuccacgaaaugcuccaggagaaauacuauggucagccccacuagguccagauuuaaacccauaucuuucacacuuagcaagaauguauaacggcuaugcuggaggauucgaagugcagguaauacuagccggaaacgcauuuaccgcugguaaaguaauauucgcagcagucccaccaaacuucccaacagaaggucuaucgccaucacaaguaacuauguucccacauauagucgucgauguaagacaacuagaaccaguucuuauaccauuaccagauguacgaaauaauuuuuaccauuacaaccaaucaaaugauccuacaauaaaauuaauugcaauguuauauacuccauuaagagcaaacaaugccggcgaugauguauuuacaguaucauguagaguauuaacucguccuucaccagauuuugacuuuauauuucuuguaccaccgacaguagaauccagaaccaaaccuuucucuguccccguauuaacaguagaagaaaugacuaauucaagauucccaauaccauuagaaaaauuauuuaccggaccaucuucugcauuuguaguacaaccacaaaaugguagauguacaacagauggaguacuacucggaacuacacaacuuaguccaguaaauauauguacauuuagaggagacguaacacauauaacaggcuccagaaauuauacuaugaaccuagcaucacaaaauuggucaaacuacgauccaaccgaagaaaucccagccccacucgguaccccagacuuuguaggaaaaauacaagguguauuaacacaaacaacccgaacugacggaucaacaagaggacacaaagccacaguauauaccggaagcgcaaacuuugcaccaaaacuuggcagaguacaauucgaaacagacaccgaucacgacuucgaagcuaaccaaaauaccaaauucacuccaguaggaguaauacaagacggaggaacuacacaucguaacgaaccccaacaauggguacuaccgucauauucagguagaaacacaccaaauguacacuuagcaccagcaguagcaccaacauuuccaggcgaacaacuauuauucuuucgcucaacuaugccaggauguucaggauauccuaauauggacuuagauugucuuuuaccacaagaauggguacaauacuuuuaucaagaagcagcaccagcacaaucugacguagcccuccuucgauucgugaacccugacacaggacgaguucuuuuugaguguaaauuacauaaauccggauacgucacagucgcacauaccggacaacaugacuuaguaauuccacccaacggauauuucagauucgacuccuggguaaaccaauuuuacacacuagcaccaaugggaaauggaacagguagaagaagagcauuauaa

SEQ ID NO: 31861 - RNA, 1623 nt, Artificial Sequence
  derived and/or modified sequence opt6 from VP1__Norovirus__AJF21976
augaaaauggcaucaucagaugcaaacccaucagauggcucagcagcaaacuuaguaccugaaguuaauaaugaaguaauggcucuagaaccuguagucggagcagcaauagcugcaccaguagcaggacaacaaaauguaauagaccccuggauaagaaauaacuucguccaggcaccaggcggugaauuuacaguaucaccuagaaacgcacccggagaaauacuauggucagcaccguuaggaccagacuuaaauccauaccuuucacaucuagcacgaauguacaauggauacgcaggaggauuugaaguacaaguaauacuagcaggcaaugcauuuacagccggaaaggucauauuugcagcaguaccacccaacuuuccaacagaaggauuaucgccaucucaaguuacaauguuuccccauauaguaguagaugucagacaacuagaaccaguacuaauaccauuacccgauguaagaaauaauuucuaucauuauaaucaaucaaaugauccaacaauuaaacucauagcaaugcuauauacaccauuaagagcaaacaaugcaggugacgacguauucacuguuucauguagaguuuuaacuagaccaagcccugacuuugauuucauauuucuaguaccaccaacaguagaaucaagaacaaaaccauucucuguaccaguauuaacaguagaagaaaugacgaacucuagauucccuauuccauuagaaaaacuauuuacggguccgucuagcgcauuuguaguacaaccacaaaacggaagauguacaacugacggaguacuacucggaaccacacaacuuucaccaguaaauauauguacauuccgcggagacguaacacauauaacagguuccagaaauuacacaaugaaucuagcuucacaaaacuggaguaacuacgauccaacagaagaaaucccagcuccacuaggaaccccagacuuuguaggaaaaauccaaggaaugcuaacacaaacaaccagaacagacgguucuacucgaggacacaaagcaacgguauauacagguucagcagacuucgcucccaaacuaggcagaguacaauuugaaacagauacagaucaugauuuugaagcaaaccaaaacacuaaauucacaccuguuggaguaauccaagacggaagcacaacacaucgaaaugaaccccaacaauggguacuaccgucuuauucuggaagaaauaccccaaacguucaccuugcaccagcaguagcaccaacauuuccaggugaacaauuacuuuuuuuuagaucaacaaugccaggaugcucuggauaccccaauauggaucuagauugccuauuaccucaagaauggguacaauauuucuaucaagaagcagcaccggcacaaucagauguagcauuacuaagauuuguaaacccagauacaggaagaguacuauuugaauguaaauuacauaaaucaggauaugucacaguagcacacacaggacaacacgaccuaguaauaccccccaaugguuauuuuagauucgauucauggguuaaucaauuuuacacauuagcaccaaugggaaauggaacagguagaaggcgagcauuauaa

SEQ ID NO: 31862 - RNA, 1623 nt, Artificial Sequence
  derived and/or modified sequence opt6 from VP1__Norovirus__AJF21977
augaaaauggcaucaucagaugcuaacccuucagauggcucagcugcuaaucuaguaccagaaguaaacaacgaaguaauggcacuugaaccaguuguaggagcagcuauagcugcuccagucgccggacaacaaaacguaauagacccauggauaagaaauaauuucguacaagcaccaggaggugaauucacuguaaguccgcgaaaugcuccaggagaaauauuauggucugcaccccuaggacccgaucuaaaucccuaucuaucacacuuagccagaauguacaacggauaugcuggaggauucgaaguacaagucauauuagccggaaacgcuuuuacugcuggaaaaguaaucuucgcagcaguaccaccaaauuucccaacagaagguuuaucaccaucucaaguaacaauguuuccacauauaguaguugacguacgacaacuugaaccaguuuuaaucccacuuccagauguaagaaacaauuuuuaucauuauaaucaaucaaaugauccaacuauuaaauuaauagcuauguuauacacaccacuccgugcaaacaacgcuggagacgauguauuuacagugucaugcagaguacuaacaagaccaaguccagacuuugauuucauuuuucugguaccaccaacaguugaaucccgcacaaaaccauuuucaguaccaguccuaacaguagaagaaaugaccaacucacgauucccuauaccauuagaaaaacucuuuaccggacccucuucagcauuuguuguacaaccacaaaacggccgauguacaacagauggagucuuauuaggcacaacccaacuaucuccuguuaauauauguacauuuagaggagauguaacacauauaacaggaucgcauaauuauacaaugaaucuagcaagucaaaauuggagcaauuaugacccaacagaagaaauaccagccccacuaggaacaccagacuuuguaggaaaaauacaaggaguauuaacacaaacaacaagaacagacggauccacaagaggacacaaagccacagucuauacuggaucugcugacuucgcaccaaaacuaggaagaguacaauucgaaacugauacaaaucaugauuuugaagcaaaucaaaauaccaaauucacaccugucggagucauacaagacggcucuacuacucauagaaaugaaccccaacaauggguccucccaucauauagcggaagaaacacaccaaacguacauuuagcaccagcaguagcaccuaccuucccaggugaacaacuacuuuucuuucguucaacaaugccaggcugcucuggauaccccaauauggaucuugacuguuuauuaccacaagaauggguucaauauuucuaucaagaagcagccccagcucaaucagacguagcacuauuaagauuuguaaacccagauacgggaagaguuuuauucgaaugcaaacuacacaaauccggauauguuaccgucgcacacacaggccaacacgacuuaguaauuccacccaauggauauuuccgauucgacucuugggucaaccaauucuacacauuagcacccaugggaaauggcacuggacgaagacgagcauuauaa

SEQ ID NO: 31863 - RNA, 1623 nt, Artificial Sequence
  derived and/or modified sequence opt6 from VP1__Norovirus__AJF21978
augaaaauggcaucaucagacgcaaauccuagcgaugggagugcagcaaaucuaguaccagaaguaaauaaugaagugauggcacuagaaccuguaguaggagcagcaauagccgcacccguagcaggacaacaaaauguaauugacccauggauuagaaauaacuuuguccaagcaccuggcggugaauuuacaguaucacccagaaaugcaccaggagaaauauuauggucagcaccacuugguccagacuuaaauccauauuuaucacacuuagccagaauguauaacggauaugcaggaggauucgaaguacaaguaauuuuagcaggaaacgcauucacugcugguaaagucauauucgcugcaguaccaccaaacuuuccaacagaaggccucucgcccucacaaguaaccauguucccacacauagucguagauguuagacaauuagagccaguacuuauaccauuaccagauguuagaaacaauuucuaucauuacaaucaaucuaaugaccccacaauaaaauuaaucgcuauguuauauacaccauuaagagcuaauaacgccggagacgauguuuuuacaguaagcuguagaguauuaacccgacccucaccugauuuugauuuuauauuucuaguaccaccaacugucgaauccagaaccaaaccuuucucagucccuguauuaacagucgaagaaaugacaaauucaagauuuccaauaccacuagaaaaauuauuuacaggaccuucaucagcauuuguaguacaaccccaaaauggaagauguacgacagauggaguauuacuaggcacaacacaauuauccccugucaauauaugcacauuuagaggagauguaacacacauaaccggaucacgaaauuacacaaugaauuuagcaucacaaaacugguccaacuaugauccuacugaagaaauaccagcacccuuaggaacaccagauuuuguugguaaaauucaaggaguauugacucaaacuaccagaacagacggaucaacuagaggucacaaagcaacaguauauacugguagugcagauuucgcaccaaaauuaggaagaguacaauuugaaacagauacagaucacgacuucgaaacaaaucaaaauacaaaauuuacucccguugguguaauacaagauggagguacaacacacagaaacgaaccucaacaauggguacucccauccuauucuggccgaaacaccccaaacguacacuuagcaccugcaguugcaccaacauuuccuggagaacaauuauuauucuuuagaucaacaaugccaggcugcucuggcuacccuaauacagaucucgauugccuacuaccacaagaauggguacaauacuucuaucaagaagcugccccagcucaaucagacguagcauuauuacgcuuuguaaacccugacacagguagaguuuuauuugaaugcaaacuacauaaaucgggauacgucacaguagcucauacuggacaacacgaccucguaauaccaccaaacggauauuucagauuugacucauggguaaaucaauuuuacacacuagcucccaugggaaaugguacaggaagaagaagagcacucuaa

SEQ ID NO: 31864 - RNA, 1623 nt, Artificial Sequence
  derived and/or modified sequence opt6 from VP1__Norovirus__AJF21979
augaaaauggcauccucugacgcuaacccaucagauggaucagcagcuaacuuaguacccgaaguaaacaaugaaguuauggcacuagaacccguaguaggagcagcaauagcagcaccugucgcaggacaacaaaauguuauagacccauggauaagaaacaauuucguacaagcacccggaggagaauuuacaguuuccccaagaaaugcaccaggcgaaauacuaugguccgcaccauuagguccagauuuaaauccuuauuuaucacacuuagcuagaauguauaacggauacgcaggaggauucgaaguacaaguaauauuagcaggaaaugcauuuacagccggaaaaguuauauucgcagcagucccaccaaauuuuccaacagaaggacuaucacccucacaaguaacaauguuuccucauauuguaguagacguuaggcaacuagaaccaguacuaauuccacuaccugauguacgcaacaacuucuaucacuauaaccagucuaaugaccccacaauaaaacuaauagcaauguuauacacaccacuaagagccaacaaugcaggcgaugacguauuuacuguaucaugucgaguacuaacaagaccaagcccugacuuugacuucauauuucuuguaccaccaacuguagaaucaagaacgaaacccuucucaguaccaguauuaacaguagaagaaaugacaaauucaagauuuccaauaccacuugaaaaacuauuuacuggaccauccucagcauuugugguacaaccacaaaacggccguuguacaacagacggaguuuuauuaggaacaacacaauuaucaccaguuaauauauguacauuuagaggagauguaacacauauaacuggaucacacaauuauacaaugaaccuagcaucacaaaacuggucaaauuaugauccuacagaagaaauaccagcaccucucggaacaccagacuucguuggaaagauacaaggaguauuaacccaaacaacaagaacagaugguuccacaagaggucauaaagcaacaguuuauacaggaagugcugauuucgcacccaaacucgguagaguacaauuugaaacugauacaaaucaugauuucgaagccaaccaaaacaccaaauuuacaccaguaggaguuauccaagauggaggaacaacacauagaaacgaaccccaacaauggguauuaccaucauauagugguagaaauacaccaaacguacauuuagcuccugcaguagcaccaacauuuccaggagaacaacuacucuucuuuagaucaacaaugccuggaugcucaggauaccccaauauggauuuagacugcuuacucccgcaagaauggguucaauacuuuuaucaagaagcagcaccugcacaaucagauguagcauuauuaagauucguaaacccagacacaggacgaguacuauucgaaugcaaauuacauaaaaguggauauguaacugucgcacacacaggucaacaugaccuuguaauaccacccaacggauauuuucguuucgauucauggguaaaucaauuuuauacuuuagcaccaauggguaauggaaccggaagaagaagagcccuauaa

SEQ ID NO: 31865 - RNA, 1623 nt, Artificial Sequence
  derived and/or modified sequence opt6 from VP1__Norovirus__AJF21980
augaaaauggccuccucagacgcaaauccaucugauggaucugcagcaaauuuaguaccagaaguaaacaaugaaguaauggcucuugaaccagucguaggcgcagcuauagcagcaccugucgcuggacaacaaaauguaauugacccauggauuagaaauaacuuuguacaagcuccagguggagaauuuacaguauccccaagaaaugcaccaggggaaauauuauggucagcaccacuuggcccugaucuaaauccauaucuaucucacuuagcaagaauguacaauggauaugccggcgguuuugaaguucaaguaauucuagcuggcaaugcauuuacugcaggaaaaguaauauuugcagcuguaccaccaaacuuuccaacugaagguuuaucuccaucucaaguaacaauguuuccacauauaguaguagacgucagacaauuagaaccaguauuaauaccacuacccgauguaagaaauaauuuuuaucacuauaaccaaucaaaugacccaacaauaaaacuaauagcaaugcuauacacaccuuuaagagcuaacaaugcaggcgacgaugucuuuacaguauccuguagaguccuuacuagaccaucaccugauuucgauuuuauuuuucuaguaccaccaacaguugaaucaagaacaaaaccauucucaguaccuguauuaacugucgaagaaaugacuaauucucgauucccaauaccacuagaaaaauuauuuacagguccuucaucugcauucguuguacaaccacaaaacgguagauguacaacagauggaguauuauuagggacaacccaacuaucuccaguaaauauauguacauuucgaggagaugucacacacaucacuggaucaagaaauuauacuaugaauuuagcaucacaaaacuggaauaauuaugacccaacagaagaaauuccugccccucuagguacaccagacuucguagguaaaauucaagguauguuaacucaaacuacaagaacagauggaucaacuagaggacacaaggcuacaguguauaccgguucugcugauuuugccccaaaauuaggaagaguacaauucgaaaccgacacagaucacgacuucgaagcaaaccaaaacacaaaauucacuccaguuggcguaauucaagacgguucuacaacacaucgaaaugaaccccaacaauggguauuaccuucuuauucugguagaaauacacauaauguacaccuagcccccgcaguagcaccaacuuuuccaggagaacaauuacuauucuuuagaucaacgaugcccgguugcaguggauauccaaauauggaccuagauugucuauuaccccaagaauggguacaauauuuuuaucaagaagcagccccagcacaauccgacguagcauuauuacgauuugucaauccagauacaggaagaguacuauuugaauguaaacuccauaaaagugguuauguuacaguugcacauacuggacaacacgauuuaguuauaccaccaaacggauauuuuagauucgauucauggguaaaccaauuuuacacucuagcucccaugggaaauggaacaggaagacgaagaguaguauaa

SEQ ID NO: 31866 - RNA, 1623 nt, Artificial Sequence
  derived and/or modified sequence opt6 from VP1__Norovirus__AJF21981
augaaaauggcaucuucagaugcaaauccauccgauggcucagcagcuaacuuagucccagaagucaacaaugaaguuauggcacuagaaccgguagucggagcagcaauagcugcaccagucgcuggacaacaaaauguaaucgacccauggauaagaaauaauuuuguacaagcaccuggaggagaauucacaguuuccccacguaacgcaccuggagaaauauuauggucagccccacucggucccgauuuaaauccauauuuaucacaccuagccagaauguauaauggauacgcaggcggauuugaaguacaaguaauauuagcaggaaaugcauuuacagcaggaaaaguuauuuuugcagcaguaccaccaaauuuucccacagaaggauuaucuccaucacaaguaacuauguucccacacauaguaguagacguacgccaacuugaaccuguacuaauaccauuaccagauguaagaaacaauuucuaccauuauaaccaaagcaaugacccuacaauaaaauuaauagcaaugcuauacacuccuuuaagagcuaacaaugcaggugacgaugucuuuacuguaucaugucgagugcuaacaagaccaaguccugauuucgacuucauauuucucguaccaccaacaguagaaucaagaacaaaaccuuuuucaguaccuauccuaacugucgaagaaaugacuaacucaagauucccaauaccccuugaaaaacuauuuacuggaccuucguccgcauuuguaguacaaccucaaaacggaagauguacaacugacggcguauuacuaggcacaacacaauuaucaccuguaaacauauguaccuuccgaggugacguaacucauauaacaggauccagaaauuauacaaugaauuuagcuucucaaaauugguccaauuaugauccaacagaagaaauuccugcaccauuaggaauacccgauuuuguagggaaaauucaaggaaugcuuacacaaaccacaagaacagauggaucaaccagaggccacaaagccacaguauacacaggaucagcagacuuugcacccaaacuuggaagaguacaauucgaaacagacacagaucaugauuucgaagcaaaucaaaacacaaaauuuacaccuguaggaguaauacaagacggauccacaacucaccgaaaugaaccacaacaauggguauuaccaucauauuccggaaggaauaccccaaauguccaucuagcaccagcaguagcaccaacauuuccaggagaacaacuccuuuucuucagaucaacaaugccaggauguucaggcuauccuaauauggaccuagacuguuuacuaccucaagaauggguacaauauuucuaucaagaagcagccccagcacaauccgacguugcucuauuaagauucguuaacccagacacaggcagagucuuauucgaauguaaauuacauaaaucaggauacguuacaguagcucacacuggacaacacgauuuaguaauaccaccaaauggauacuuuagguuugauaguuggguaaaccaauuuuauacacuagcaccaauggguaauggaacaggacguagaagagcauuauaa

SEQ ID NO: 31867 - RNA, 1623 nt, Artificial Sequence
  derived and/or modified sequence opt6 from VP1__Norovirus__AJF21982
augaaaauggcaucaucagaugcaaauccauccgaugguucugcagcaaauuuaguaccagaaguuaauaacgaagucauggcuuuagaaccaguaguuggagcagcuauagcagcaccuguagcaggacaacaaaacguaauugacccauggauaagaaauaacuuuguacaagcacccggcggagaauuuacuguaucuccaagaaacgcucccggagaaauauuauggucagcuccauuaggaccugaucuuaacccuuaccuuagucaucucgcacguauguauaauggauacgcaggaggauuugaaguacaaguaauauuagcugguaaugcauuuacagcaggcaaagucauuuucgcugcagugccaccuaacuuuccuacagaaggacuaucacccucucaaguaacaauguucccacauauuguaguagacguaagacaauuagaaccaguacuaauaccacuuccagauguacgcaauaauuucuaucauuacaaucaaucaaaugauccaacaauaaaacuaaucgcaauguuauacacaccacuccgugcaaacaaugcaggcgaugacguauuuacaguaucuugcagaguauuaacaagaccaucaccagauuuugacuuuaucuuuuuaguuccccccacuguagaaucaagaacaaaaccauucucuguaccaguucuaacuguagaagaaaugacaaauucuagauuuccaauaccuuuagaaaaauuauucacaggacccaguagugcuuuuguaguacaaccacaaaauggaagauguacaacagauggcguauuauuaggaaccacucaacucuccccaguaaauauauguacauuuagaggcgauguuacucauauaacagguucccacaauuacacuaugaacuuagcaucccaaaauuggucaaauuaugaucccacagaagaaauuccugcaccacuaggaacaccagacuuuguuggaaaaauacaaggaguuuuaacacaaacaacaagaacagauggcucaacacgaggccacaaagcgacugucuauacaggaucagcagacuuugcaccaaaauuagguagaguucaauuugaaacagauacagaccgugauuuugaagcaaaucaaaauacuaaauuuacaccuguuggaguaauacaagaugguggaacaacacaucgaaacgaaccgcaacaauggguuuuacccucuuauucuggaagaaauaccccaaacguucauuuagccccugccguagcuccaacauuuccaggagaacaacuucuauuuuucagaucaacaaugccaggaugcucaggauacccaaauauggaucuagauugccuacuaccacaagaauggguacaauauuuuuaccaagaagcagcaccagcacaaucagacguagcucuauuaagauucguuaauccagauacaggucggguuuuauucgaauguaaauuacauaaaucaggauaugucacuguagcacauacaggccaacacgauuuaguaauaccacccaauggauauuuuagguuugauuccuggguuaaucaauucuacacauuagcuccuauggguaauggaacaggaagacgacgagcacuuuaa

SEQ ID NO: 31868 - RNA, 1623 nt, Artificial Sequence
  derived and/or modified sequence opt6 from VP1__Norovirus__AJF21983
augaaaauggcaucaucagacgccaacccaagugauggauccgcagccagccuuguaccugaaguaaacaaugaaguaauggcauuagaaccaguaguaggagcagcaaucgcagcuccaguagcaggacaacaaaacguaaucgauccauggauaagaaacaacuuuguucaagcaccuggaggugaauucacugucagcccaagaaaugcacccggagaaauauuauggucagcaccacuaggaccagaucuaaacccauauuuaucccacuuggcgcguauguauaacgguuaugcuggaggauucgaaguacaaguaauacuagccggaaacgcauuuacagcaggaaaaguaauauucgcagcaguaccacccaacuuuccaacugaaggacuaucacccucccaaguaacaauguuuccacacauaguaguagacguuaggcaacuugaacccguauuaauuccacucccagauguaagaaauaauuucuaucacuauaaucaaaguaaugaccccacaauaaaauuaauagcaauguuauacacaccacuuagagccaacaaugcaggagacgauguauuuacaguaucauguagaguacucacaagaccuucaccagauuuugauuuuauauuucuaguuccaccuacaguagaaucuagaacuaaaccauuuucaguaccaguacuaacuguagaagaaaugaccaacucaagauuuccaauaccucuagaaaaauuauuuaccggacccucaucugcauucguuguacaaccacaaaacggacguugcacgacugacggugucuuauuaggaacaacacaacugagcccaguaaauauauguacauucagaggagacguuacacacauaacaggaucaagaaauuauacaaugaauuuagcaucacaaaauuggaauaacuacgacccaacugaagaaauaccggccccucuagguacaccagauuuuguaggaaaaauacaaggaguauuaacccaaacaacaagaacagacggaucaacaagaggucacaaagcaacuguauauacaggaucagcugauuuuucaccaaaauuaggacgaguacaauucgaaacagauacagaucgagauuucgaagcaaaucaaaauacaaaauucacaccaguuggaguuauacaagauggugguacaacucauagaaaugaaccacaacaauggguacuaccaagcuauucagguagaaacgcaccaaauguacauuuagcaccugcaguagcaccgacauuuccaggugaacaacucuuauuuuuuagaucaacuaugccaggcugcucaggauaucccaauauggaucuugacuguuuacuaccacaagaauggguacaauauuuuuaucaagaggccgcacccgcacaaucagauguagcacuuuuacgauucguaaacccagauacaggccgaguacuauuugagugcaaacuacauaaauccggcuacguaacuguugcucauacaggacaacaugauuuaguaauaccacccaauggauauuuuagauucgacucauggguaaaccaauuuuauacacuagcaccuaugggaaauggaacuggacgaagaagagcauuauaa

SEQ ID NO: 31869 - RNA, 1623 nt, Artificial Sequence
  derived and/or modified sequence opt6 from VP1__Norovirus__AJF21984
augaaaauggcaucaagugaugccaauccauccgauggaucggccgcaaauuuaguaccagaagucaacaacgaaguaauggcauuagaaccaguagucggagcagcaauagcagcaccaguagcaggucaacaaaacguuauagacccauggauacgaaacaacuucguucaggcaccaggcggagaauuuaccgugucaccaagaaaugcaccuggagaaauucuuuggucagcaccacucgguccugauuuaaacccuuacuuaucucaccuagcuagaauguacaauggauacgcaggaggauucgaaguacaagucauacuugccggaaacgcguuuacagcagguaaaguuauauucgcagcaguaccaccaaacuuuccuacagaagguuuaucuccaucacaagucacaauguucccacacauaguagucgauguaagacaacuagaaccagucuuaauuccucuuccagacguucguaacaacuuuuaucacuauaaucaaucuaaugauccaacaaucaaauuaauagcaauguuauauacuccuuuacgagcaaauaacgcaggagaugauguuuuuacaguuucauguagaguucuuacacguccaucaccugauuuugacuuuaucuuucuaguuccuccuacaguugaaucaagaacuaaaccauuuagcguaccaguacuaaccguagaagaaaugacuaauucacgauuuccaauaccuuuagaaaaauuauucacaggacccaguagcgccuuuguaguacaaccacaaaacggacgauguacaacagauggaguacuacucgggacaacacaacuuuccccuguaaacauauguaccuucagaggagauguaacacacauuaccggaucacauaauuacacaaugaaccuagcaucccaaaauuggucaaauuacgacccuacagaagaaauuccagcuccacuuggaacuccagauuuuguuggaaaaauucaagguguccuaacacaaaccacaagagcagauggaucaacaagaggucacaaagccacagucuacacuggaucugcagacuuugcaccaaaacuugguagaguucaauuugaaacagauacaaaccaugauuucgaagcaaaucaaaauacaaaauuuacccccguaggaguuauacaggauggaggaacaacccaccguaaugaaccacaacaauggguacuaccaucuuauucaggaagaaauacaccaaacguccaccuagcgccagccguagcuccaacauuuccaggagaacaauuauuauucuuuagaucaacaaugccaggaugcuccggauauccaaauauggaccuagauugccuacuuccacaagaauggguacaauacuuuuaccaagaagcagcucccgcacaauccgacguagcacuccuacgauuuguaaauccugauacaggaaggguauuauuugaauguaaauuacauaaaucugguuauguaacaguagcacauacaggacaacaugaucuaguaauaccuccaaauggauauuuuagauuugauucaugggugaaucaauuuuauacccuagcaccaauggguaaugguacaggaagaagaagagcauuauaa

SEQ ID NO: 31870 - RNA, 1623 nt, Artificial Sequence
  derived and/or modified sequence opt6 from VP1__Norovirus__AKE37037
augaaaauggcaucgaaugacgcagcaccaucaaacgacggagcagccggacuagucccagaaggaaacaaugaaacacuacccuuagaaccaguagcaggcgccgcaauagcagccccgguaaccggacaaaacaauaucauagauccuuggauacgaacaaauuucguacaagccccuaauggagaguuuacaguaucaccaagaaauaguccaggagaaauacucuuaaaucucgaacuagguccagaccucaauccauaucuagcucauuuauccagaauguauaauggauaugcagguggcguagaaguacaaguacuuuuagcaggcaaugcuuuuacagcaggaaagauacuauuugcagcaguaccaccaaacuuucccguugaauuccuaucacccgcccaaauuacaauguuaccucauuuaaucguagacguaagaacacucgaaccaauaaugauucccuuaccagacguaagaaacacauucuuccauuauucaaaccaaccuaacucaagaaugcgucuuguagcaauguuauauacuccacuuagauccaaugguaguggagacgacgucuucaccguauccugccgaguucuaacacgaccuacccccgauuucgaauuuacauaccuaguccccccaucuguugaaucuaaaacaaaaccauuuucauuaccaauacuuacauuaucugaacuaacaaacucuagauuuccaguucccauagauucacuauuuacagcacaaaauaauguacuacaaguacaaugccaaaacggccgauguacacuugacggagaacuccaaggaacgacacaacuuuuaccaucagguauaugugcauuucgaggaagagucacugcucaaauaaaccaaagagauagauggcauaugcaacuucaaaauuuaaaugguaccacauaugauccaaccgaugacguacccgcaccauuagguacuccugauuucaaaggaguagucuucggaaugguuucucaacgaaauguaggaaaugacgcaccaggcucaacucgcgcacaacaagcaugggugucaaccuacucaccacaauucguuccaaaacuaggaucaguaaaccuacguauaucagauaaugacgacuuccaauuccaacccacaaaauuuacaccaguaggaguaaaugacgacgacgauggacauccauuuagacaaugggaauuaccaaacuacucaggagaauuaacacuaaacaugaacuuagcaccuccaguagcuccaaacuuuccaggagaacaacuacuauuuuuucgaucauucguacccuguucagggggauacaaccaaggaauuaucgauugcuuaaucccacaagaauggauacaacauuuuuaucaagaaucagcaccaucucaaucagauguagccuuaauaagauauguaaauccagacacaggucgcacacuauuugaagcaaaacugcauagaucuggcuauauaacaguagcacauucaggagauuacccacuagucguucccgcaaauggccauuucagauuugauucauggguaaaccaauucuacucccuagcaccaaugggaacaggaaauggaagaagacgcgcccaauaa

SEQ ID NO: 31871 - RNA, 1632 nt, Artificial Sequence
  derived and/or modified sequence opt6 from VP1__Norovirus__AKM20815
augaugauggcaucuaaagacgcacccacuaauauggauggaacaucgggagcaggucaauuaguaccagaagcaaauacagcagaaccauuaccaauuaaaccaguagcaggagcagcaacagcaguugcuacagcuggccaaguaaauaugauagauccuuggaucaugaacaauuuuguacaagcuccacaaggugaauucacaauaucaccaaauaacacaccaggugauauucuauuugaucuccaauuaggaccucaccuaaauccuuuucuugcacacuugucaagaauguauaacggcuggguaggaaauaugcaaguaagaauuaugcucgcaggaaaugcauuuucagccggaaaaauaauaguuuguuguauaccaccaggauucagcucucaaucuauaucaauagcacaagcuacuauguucccacauguuaucgcagauguucgaguacuugagcccauagauguaccauuagaugauguaagaaauguauuauuucauaauaacgauaauccacaaacaaugaggcuacucuguauguuauauacaccauuaagaucaggcggaacuucaagcggaaccgauccauucguaauugcaggacguguauuaacauguccaacuccugauuuuucuuuuuuauuuuuagugccaccagauaucgaacaaagaacaaaaccauuuucuguucccaauauccccaugaaccuaaugucuaauuccagaguaucaaugcuuauugauggaaugaugguuaguaaugaucaaaaucaaguaccacaauuccaaaacggaagaguaacacuagauggacaacuacaaggaaccacaacaguauccgcagcaugcguagcacguaugagaggacguauuuuuaacaauaauggaaacuaugguguaaaucucacagaacuagaugguaacccauaucaugcauucgauucacccgcaccauuaggauuuccagauuucggaaacugcgacuuacauaugacuuucguaaaaauaaacccaaaugaauuaucaucuggagauccaucuggcaaaguagucauaagaucauaugacgcuacauuugcaccacaccuuggaaccguaaaauuagaaaaugacgaugaacuugcacgauucguagguaaagaagucguacuagaauuaacauggguaagcaacagagaaggagcgacuuuaaaucuaugggcaguaccaaauuauggaucaucacuaacucaagcaucacaacuagcaccacccauauauccacccggauucggagaagcuauaguauauuuuacaucuacauuuccuacugucuccaacccaaaaguaccauguacauuaccacaagaauuuguaucacacuucgucaaugaacaagcaccaaccagaggagaugcagcuuuacuacacuauguugauccagauacccacagaaauuuaggcgaauucaaaauguauccagaagguuauaugacuuguguaccaaaugcuggaggaggaccacaaacauuacccauaaaugguguauuuguauuuaucucauggguaucaagauacuaccaacuaaaaccaguaggaacagcaggagccgcccgaagacuaggauuaagaagaucauaa

SEQ ID NO: 31872 - RNA, 1623 nt, Artificial Sequence
  derived and/or modified sequence opt6 from vp1__Norovirus__AKM20818
augaugauggcaucaaaagacgcaccaacaucaccagauggugccucuggagcaggacaacucguaccagaagcaaauacugcagaacaaaucucaauggacccuguagcaggugcaucaacugccguugcaacagccggacaaguaaacaugauagauccauggauauuuaacaauuuuguacaagcaccacaaggugaauucaccauaucaccaaauaauacaccaggagacauacuuuucgacuuacaauuagguccucauuuaaacccauuccuagcacauuuaucccaaauguauaacggaugggucgguaauaugagaguaagaauauuauuagcaggcaaugccuuuacugcagguaaaauuauaauauguugcguuccaccuggauuugaugcucgaauacuuacuauagcacaagcuacacuauuuccucauuuaaucgcugauguaagaacauuagaacccguagaauuaccacucgaagauguacgaaauguacuguaccauaacucuucacaaccucaacccacaaugagauuaguugcuauguuauacacaccccuacgaacuggcggagguucaggcgguacagaugcauuuguaguugccggcagaguacuaacaugcccagccccagacuucagcuuucuguuuuuaguuccuccuucagucgagcaaaaaaccagaguauucucaguaccaaauauaccccuuaaagauuuaucuaacucacguguacccguaccaauacaagguauguuuaugucaccagauguaaaccaaucuguacaauuucaaaaugguagaugccaaaucgacggacaacuacaaggcacaacuccaguaucacuaucccaauuauguaaaauuagaggaaaaacaucaucaaaugcacgaguacuuaaucuaucagaaguugauggaaccccuuuuauuccccuagaaucaccagcaccuguaggcuuuccagaucuaggaggaugugauuggcauguaaacuuuucauuucaaacacaagaucgugauccuucucaaucaguuacauucgcuaccaaugacgcaucauucguaccauaucucggaucaguaucaccacauaacggagaagguuuccaagcuggugauauuauaggaucacuaggauggauaagcgcaccaucugauaacucacaauuuaauguaugggcaauaccaaaauauggaucaucccuuccagauguaacucauuuagcaccugcaguauuuccuccaggauuuggagaaguuauauuauacuuuuacagcaccuucccaggaucuggacaaccaucacaauuacaagucccaugccuauuaccacaagaauuuauaacacauuucuguaaugaacaggcuccuauagccggagaagccgcacuauuacauuacgucgauccagacacaggaagaaauuuaggagaauuuaaacuuuauccagacggauucaugacaugcguaccuaacucagucucaucagguccucaaacacuaccuauaaauggaguuuucguauucguaucauggguaucucgauuuuaucaacuaaaaccagucggaacagcaucagcugccagaagauuaggacuaagaagaauauaa

SEQ ID NO: 31873 - RNA, 1623 nt, Artificial Sequence
  derived and/or modified sequence opt6 from VP1__Norovirus__ALD83748
augaaaauggcaucaaacgaugcugccccaucuaaugauggagcuacuggacuaguaccagaaguuaacaacgaaacacuaccauuagaaccaguagccggagcagcaaucgccgcaccaguuacaggacaaaacaauauaauagauccauggauaagaacaaacuuuguacaagccccaaauggagaauuuacaguauccccacgaaacucaccaggagaaauuuuauuaaacuuagaauuaggacccgaccugaaccccuauuuagcucaccuaucuagaauguauaacggauaugcaggaggaguagaaguacaaguauuacuagcaggaaaugcauucaccgcagguaaaauauuguuugcagccguaccaccaaacuuuccuguagaauuccucagcccagcacaaauaacaauguuaccacauuuaaucguggauguaagaacacuagaaccuauaaugauaccacuuccugacguacgaaauaccuucuuccauuauaacaaccaaccaacaaacagaaugcgacuaguagccauguuauauacaccauuaagaucaaauggauccggagacgacguauucacaguaucaugcagaguauuaacccgacccacaccagauuucgaauuuacauauuuaguacccccaucaguagaaucuaaaacuaaaccauucucacuaccaauacuaacaauaucagaauuaacuaacucaagauuuccuguaccuguagauucacuauucaccgcccaaaacaacaaccuuaauguccaaugucaaaauggaagauguacguuagauggagaauuacaaggcaccacucaacuucaaccuucuggaauaugcgcauucagagguaaaauaacugcagacgucagaccaaaccacgacgacagauggcauaugcaauuaaccaacuuaaacggaacaccauuugacccuacagaagacgugccagcgccauuaggaacgccagacuucacaggucuauuauucggcgucgcaucucaaagaaauguacaacccaauccaaauacaacaagagcccaugaagccgucauaucaacuaccucaucacaauucguaccaaaauuaggcuccauaaauuucgguuccacuagcgaagacuuuauaguaggacaaccaacaaaauuuacaccaguaggaauaaaaaucgaagacggacaugcauucgaucaauggacccuaccuagauauucuggacaucuaacauuaaacaugaacuuagcuccuccaguagcaccaaauuucccaggcgaacaacuucuuuucuucagaagcaacguuccuugcgcagguggaauaucugacggcgucauagacugucuccucccacaagaauggauacaacauuucuaccaagaaucagcccccucacaaucagacguagcauuaauucgauacguaaauccagacacaggacgaacauuauuugaagcaaaacuacacagaacaggauauauaacaguagcucauagcggagacuauccacuaguaguacccuccaauggcuauuucagauuugacaguuggguaaaccaauucuacagucuagcaccuaugggaacaggaaaugguagacgcagaguccaauaa

SEQ ID NO: 31874 - RNA, 1623 nt, Artificial Sequence
  derived and/or modified sequence opt6 from VP1__Norovirus__ALF12528
augaaaauggcaagcucagacgcuaaccccucagacggcucaacagcaaauuuaguaccagaaguaaacaaugaaguaauggcacuagaacccgucguuggugccgcaauagcagcaccuguagcaggacaacaaaacguaauagacccauggauaagaaauaacuuuguacaagccccaggaggagaauuuacuguaucaccacgaaaugcaccaggcgaaauauuauggucagcuccauuaggacccgauuuaaauccauacuuaucacauuuagcaagaauguauaaugguuacgcaggaggauucgaaguacaaguuaucuuagcaggaaaugcauuuaccgcuggaaaaauaauauucgcagcaguucccccaaauuuucccaccgaaggauuauccccaucucaaguaacaauguucccucacauuauuguagacguacgucaauuagaaccaguacuaauaccccuccccgauguucgaaauaacuucuaccacuacaaucaaucaaacgauccuacaaucaaauuaauagcuaugcuuuacacaccacuacgcgcaaacaaugcaggugacgauguauucacaguauccugcagaguacuaacaagacccucaccagauuuugacuuuauauuccuaguaccaccuacuguagaaucaagaacaaaaccuuucucuguaccuauccuaacaguagaagaaaugacuaauucaagauuuccaauaccuuuagaaaaauuauuuacaggaccaagcucaacuuucguaguccaaccccaaaaugguagauguaccacugacggaguauuauuaggcacaacacaauuaucaccaguaaauaucuguacauuuagaggcgacguuacccauauagcagguucacacaauuacacaaugaaucuagccucccaaaauuggaauucauacgauccuacugaagaaauaccagcuccucuaggaacccccgacuuuguaggaaaaauacaaggaguauuaacacaaacaacaagaacugacggaucaacucgaggccauaaagcaaccguauauacaggaucagcagauucaaguccuaaauuaggacgaguccaauuugccacagacacagauaacgauuuuguagcgaaucaaaauacaaaauuuacuccagucgguguuauacaagacgguggaacagcacaccguaaugaaccacaacaauggguauuaccaucauacucaggaagaaacacacacaauguacaccucgcaccagcaguagcaccaacauuuccaggagaacaacuacuauucuuucguucaacuaugccaggaugcucaggcuaucccaauauggauuuagauugucuuuuaccacaagaauggguacaauacuucuaucaagaagcugcucccgcacaaucugauguugcuuuauuaagauuuguuaacccagauacuggaagaguacuauuugaauguaaacuacauaaaucaggauacguaacucaagcacacacaggacaacaugaccuagucauaccaccaaauggauauuuccgauuugauucauggguuaaucaauucuauacauuagcaccaaugggaaauggaacaggcagacgcagagcacuauag

SEQ ID NO: 31875 - RNA, 1623 nt, Artificial Sequence
  derived and/or modified sequence opt6 from VP1__Norovirus__ALF12529
augaaaauggcaaguucagaugcuaacccauccgauggaucagcugcuaaucuaguaccagaagucaauaacgaaguuauggcauuagaacccguagucggggcagcaaucgcagcaccagucgcuggucaacaaaacguuauagacccauggauaagaaacaacuuuguacaagcaccgggaggugaauuuacaguaucuccaagaaacgcuccuggugaaauauuauggucagccccucuaggaccagaucuaaacccauaucuaucacauuuagcaagaauguauaacggauacgcagguggauucgaaguucaaguaauauuagcaggaaaugcauuuacugcaggaaaaauuguauuuucagcaguaccaccaaauuuuccaacagaaggacuaucaccaucacaaguaacuauguuuccucacauaaucguagacguaagacaacuagaaccuguauuaauuccauuaccagauguaagaaauaauuucuaucacuacaaucaaucaaacgacccaacaauaaaauuaauagcaaugcuuuacacacccuuaagagccaauaaugccggugacgacguauuuacaguaucaugucgugucuuaacaagaccaucacccgauuuugauuuuauuuuucucguucccccuacaguagaaucaagaacaaaaccauucucaguacccauacuaacagucgaagaaaugaccaauucuagauuuccaauaccauuagaaaaauuauucacaggaccaucaucaacuuucguaguucaaccacaaaacggcagauguaccacagauggaguauuacuaggaacaacacaacuuucacccguuaauauauguaccuuuagaggcgauguaacacacauagcaggaucacgcaacuacacaaugaaucuagccucccaaaauuggaauucuuaugauccaaccgaagaaauaccagccccauuaggaacaccagacuucguaggaaaaauacaaggaguauuaacacaaaccacaaggacagacgguuccacucgaggucacaaagcaacagucuauacaggaucugcagauuuuucacccaaauuaggucgaguacaauuugcuaccgauacagauaacgauuuugaugcuaaucaaaauaccaaauucacacccgucggaguaauacaagacgguaacacagcucacagaaaugaaccucaacaauggguacuaccaucauauagcggacgaaauacacauaauguacaucuagcgccagcaguugcaccuacauuucccggagaacaacuucuauucuuuagauccacaaugccaggaugcagugguuacccaaauauggaucuagauugucuauuaccgcaagaauggguccaauauuucuaucaagaagcagccccugcucaaucugacguagcucuuuuaagauuuguuaaccccgauacuggaagaguacuauucgaaugcaaacuacacaaaucaggauauguaacaguagcacauacuggacaacaugauuuagucauaccaccaaauggauauuucagauuugauuccugggucaaccauuuuuacacacuugcaccagucggaaacggaaccggaagacgacgagcacucuaa

SEQ ID NO: 31876 - RNA, 1623 nt, Artificial Sequence
  derived and/or modified sequence opt6 from VP1__Norovirus__ALF12530
augaaaauggcaucaucagaugcaaacccuuccgauggaucuacugcaaaccuaguaccagaaguaaacaaugaaguaauggcacuagaaccaguaguuggugccgcaauagcugcaccaguagcaggccaacaaaacguaauagacccuuggauacgaaauaauuuuguacaagcaccaggaggagaauucacuguaucaccuagaaaugcaccaggcgaaauucuuuggucugcaccauuaggacccgaucugaauccauauuuaucacaucuugcaagaauguauaacggauacgccggaggauuugaaguacaaguaauacuagcagguaacgccuucacugcaggaaaaauaauuuucgcagcagucccacccaauuucccaacagaaggauuauccccaucacaagucacaauguucccccacauaauaguugacguaagacaauuagaaccuguacuaauaccauuacccgacguaagaaacaacuucuaucauuauaaucaaucaaaugauccaacaauaaaacucauagcaaugcuuuacacaccacucagagcaaacaaugccggcgacgauguauuuacaguuucaugcagaguauuaacaagaccaucaccagacuucgauuuuauauuuuuaguaccaccuacaguugaaucccgaaccaaaccauucucaguaccaauauuaacaguagaagaaaugacuaauucacguuucccuauaccucuagaaaaacuauuuacaggaccaucuuccgcauuuguaguacaaccccaaaacggucguuguacaacugauggcguacuacuaggaacaacacaacuaucaccaguaaauauaugcaccuuucgaggcgacguaacccauauagcaggaucacacaauuacacaaugaauuuagcuucacaaaacuggaacuccuaugauccaacagaagaaauaccagcuccacuugguacgccagauuuugugggaaaaauacaaggaguauuaacacaaacaacccgagccgacggcuccaccagaggccauaaagcaacaguuuauacaggcucugcagacuuuuccccuaaguuaggaagaguacaauuugccacagacacuaauaacgacuuugaugcaaaucaaaauacaaaauucaccccagucgguguaauacaagacggagaaaccgcccauagaaaugaaccacaacaauggguucucccauccuauucagguagaaacauacauaacguacacuuagcuccagcuguagcaccaacauuuccaggagaacaauuacuauucuuuagaucuacaaugccagguugcucuggauaucccaacauggaauuagacugucucauaccccaagaauggguacaauauuuuuaucaagaagcagcaccagcacaaucagacguagcacuauuacgauuuguaaaccccgacacaggcagaguacuauucgaauguaaguuacauaaaucaggauauguaacaguagcacauacaggacaacacgauuuaguaauaccaccaaacggauacuuuagauuugauucauggguuaaccaauuuuauacucucgcacccaugggaaaugguacuggaagaagacgugcccuauga

SEQ ID NO: 31877 - RNA, 1623 nt, Artificial Sequence
  derived and/or modified sequence opt6 from VP1__Norovirus__ALF12531
augaagauggcaucaucagaugcaaauccaucagacggaaguacagcaaacuuaguaccggaaguaaauaaugaaguaauggcccucgaacccguaguuggagcagccauagccgccccaguagccggacaacaaaauguaauagauccauggauucgaaacaauuuuguacaagcuccaggaggagaguucaccguaucaccacgaaaugcccccggagaaauucuaugguccgcaccccuaggcccagaucuaaauccauaucuaucacacuuagcccgaauguauaauggauacgcaggcggauucgaaguccaaguaauacuagcaggaaaugcauucacagcaggaaaaauuauauucgccgcaguacccccaaacuuuccaacagaaggacuaucacccucacaaguaacaauguucccccauauuauaguagacguacgacaacuagaaccuguacuaauaccauuaccagauguaagaaacaauuuuuaccacuauaaucaaucaaaugacucaacaauaaaacucauagcuauguuauacacaccacuucgggcaaauaaugcaggagaugauguauuuacaguauccugucgaguauuaaccagaccuucaccagacuuugacuuuauauuucucguaccaccaacaguagaaaguagaacaaaaccauuuucugucccaauacucacaguagaagaaaugacaaacucuagauuucccauaccuuuagaaaaacuauucacuggaccaucauccgcauucguaguacaaccacaaaauggaaggugcacaaccgacgguguauuacuaggaacaacucaacuaucacccguaaauauuuguacauucagaggagacguaacacacauagcuggaucaagaaacuacacaaugaaucuagcaucacaaaacuggaauucuuaugauccuacagaagaaaucccugcaccauuagaaacacccgacuuuguaggaaaaauacaaggaguccuuacacaaacaacuagaacagauggaucaacuagaggucacaaagcaacuguauauacugguucagcagacuucaguccaaaauuaggcagaguucaauuugcaacagauacagauaaugauuucgacucaaaucaaaauacuaaauucaccccaguaggaguaauacaagacgguggaacaacacaucgaaaugaaccccaacaauggguauuaccauccuauucaggaagagacauacacaacguucacuuagcccccgccguagcacccacauuccccggcgaacaauuauuauucuuuagaucuacaaugccaggauguucaggcuacccaaauauggaccuagauuguuuacuaccccaagaaugggugcaauacuuuuaccaagaagcagcaccagcacaaucagacgucgcccuacuacguuuuguaaacccagacacaggaagaguauuauucgaauguaaacuacauaaaaguggauauguaaccguagcacauaccggucaacaugaucucguaauaccaccaaauggauauuuuagauucgauaguuggguaaaucaauuuuauacacucgcacccaugggaaauggaacuggcagaagaagaguuuuauaa

SEQ ID NO: 31878 - RNA, 1623 nt, Artificial Sequence
  derived and/or modified sequence opt6 from VP1__Norovirus__ALF12532
augaaaauggcuucaucagaugcaaauccaucugauggcucaacagcaaaccuaguuccagaaguaaacaaugaaguaauggcacuagaaccagucguaggagcagcaaucgcagcacccguagccggccaacaaaaugcaauagacccauggaucagaaauaauuuuguccaagcucccggaggagaauucacagucucaccaaggaaugccccaggagaaauacuauggucugcaccucuagguccagaucucaacccauaucucucccaccuagcaagaauguauaauggauacgcaggaggauucgaaguacaaguaauauuagcaggaaaugcauuuacagccggaaaaauaauauucgcagcagucccuccaaacuucccaaccgaaggccuaucacccucacaaguaaccauguuuccccacaucauuguagacguaagacaacuagagccuguacuuauacccuuaccagacguuagaaacaauuucuaucacuauaaccaaucaaaugacuccacaauaaaacuuauagcaaugcuauacacuccacuacgagcaaauaaugccggcgacgauguauuuacaguaucauguagagugcuaacaagaccaucuccagauuuugacuuuauauuucucguaccaccuacaguagaaucaagaacaaagccauuuuccgucccaauacuaaccguagaagaaaugacuaacucaagauuuccaauaccauuagaaaaauuauuuacaggucccucaucagcauuuguuguacaaccacaaaacggaagaugcacuacugacggaguauuauuaggaacaacacaauuaucaccuguaaacaucugcacauucagaggcgauguuacacacauagcaggaucaagaaauuacacaaugaaucucgccucccaaaacuggaauaguuacgaucccacagaagaaauaccagcaccacuaggaacaccagacuuugucgguaaaauacaagguguauuaacccaaaccacaagaacugacggcuccacacgaggacauaaagcaacaguauauaccggaagcgcagacuucuccccaaaauuaggaagaguccaauucgcuacagauacagauaacgauuucgaugccaaucaaaauacuaaauucacaccugucggaguuauacaagauggaggaacaacacaccgaaaugaaccucaacaauggguccucccaagcuacuccggaagaaauauccauaacguacacuuagcaccagcuguagcuccaacauuuccaggcgaacaacuauuauuuuuuagaucaacaaugccaggauguucuggauauccaaacauggauuuagauugucuacuaccacaagaauggguacaauauuuuuaucaagaagcagcaccagcacaaucggauguagcacuacuaagauucguaaauccagacaccggucgaguauuauuugaaugcaaauuacauaaaucaggauacguaaccguagcacacacuggucaacaugaucuaguaauaccaccaaauggcuauuuuagauuugauaguugggucaaucaauucuacacacucgcaccaaugggcaacggaaccgguagaagacgugcacucuaa

SEQ ID NO: 31879 - RNA, 1623 nt, Artificial Sequence
  derived and/or modified sequence opt6 from VP1__Norovirus__ALF12533
augaaaauggcaucaucagacgcaaaccccucugauggaucuacagcaaacuuaguaccagaaguuaacaacgaaguaauggcauuagaacccguaguuggagcagcaauagccgcaccuguagcaggacaacaaaacgucauagacccauggauacgaaauaacuuuguacaagcaccaggaggagaauucacuguuuccccuagaaaugccccuggagaaauauuaugguccgccccacuaggaccugauuuaaaucccuaccuaucacaucuagcaagaauguauaacgguuacgcagguggcuucgaaguucaaguaauauuagcaggaaaugcauuuacagcuggaaaaauuacuuuugccgcaguucccccaaacuuuccaacagaaggccucuccccaucacaaguaacaauguucccacauauuauaguagacguacgacaacuagaaccaguacuaauuccauuacccgauguaagaaacaacuucuaucauuauaaccaaucaaaugacccaaccauaaaauuaauagcaaugcuguacacuccauuaagagcuaacaaugcaggcgacgaugucuuuacagucagcugcagaguacuuacaagaccaucuccagacuuugacuucauauuuuuaguaccaccaaccguagaaucaagaacuaaaccauucagugucccaauacuaacaguugaagaaaugacaaauaguagauucccaauaccacuagaaaaguuauucacuggaccaucuuccacauuuguaguucaaccacaaaauggaagauguacuaccgacggaguacuacuuggaacaacacaauuaucaccuguaaacauaugcacauuucgaggagacguaacacauauaacaggaucccacaauuacacaaugaaucuagcaucacaaaacugguccucauaugacccuacugaagaaauaccagcuccucuaggaacaccagacuuuguaggaaaaauacaaggaguacuaacacaaacuacacguaccgauggaucaacacgaggacauaaagcuaccgucuuuacuggaucugcagacuuuucaccuaaacuuggaagaguacaauuugcuaccgacaccgauaacgauuucguagcuaaucaaaauacaaaauuuacuccagucgguguaauacaagaugguggaacagcccauagaaacgaaccacaacaauggguucuaccaucauauucuggaagaaacauacacaacguacacuuagcaccagcaguagcaccuacauucccuggagaacaacuauuauuuuuucgcucuacaaugccaggauguucaggauacccaaauauggacuuagauuguuuacuaccacaagaauggguccaauauuuuuaccaagaagcagcuccugcucaaucugacgucgcacuucuacgauuuguuaauccagacacuggacgcguauuauuugaauguaaauuacauaagucuggauauguaaccguugcucacacuggacaacacgauuuaguuaucccaccaaauggauauuucagauucgauucauggguaaaucaauucuacacuuuagcaccaaugggaaacggaaccggacgacguagagcacuauaa

SEQ ID NO: 31880 - RNA, 1623 nt, Artificial Sequence
  derived and/or modified sequence opt6 from VP1__Norovirus__ALF12534
augaaaauggcaucaucagacgcaaauccaucagauggaaguaccgcuaacuuaguaccagaaguaaauaacgaaguaauggcuuuagaaccuguuguaggagcagcuauagcagccccagucgcaggccaacaaaacguaauagaucccuggauucgaaauaauuuuguacaagccccagguggagaauucacaguuucaccaagaaacgcaccaggugaaauauuauggucagcaccauuaggucccgauuuaaaucccuaucuaucacacuuagcaagaauguauaacgguuaugcaggaggauuugaaguacaaguuauuuuagcagguaacgcauucacagcaggaaaaaucauuuucgcagcaguacccccaaauuucccaacagaaggacuaucaccaucacaaguaaccauguucccacacauuaucguagauguucgacaacuugaaccaguacuaaucccacuuccagauguaagaaauaauuucuaucacuacaaccaaucaaaugacucuaccauaaaacucauagcaaugcucuacacacccuuaagagcaaauaaugcaggagaugaugucuucacaguaagcuguagagucuuaacaagaccaaguccugacuucgacuuuauauuuuuaguccccccaacaguugaaucuagaacaaaaccauuuucaguaccuguauuaacaguagaagaaaugaccaacucaagauuucccauuccccuugaaaaauuauucaccggacccuccucagcauucguaguacaaccccaaaacggucguuguacaaccgacggaguauuacuaggaacuacacaacuauccccaguaaauauauguacauuucgaggcgauguaacacauauaccaggaucuagaaacuauacuaugaaucuugcaucacaaaacuggaauucauacgauccaacagaagaaauaccagcaccauuagguacaccagacuucguaggaaaaauccaaggcgucuuaacacaaacaacaagaacaaacgguuccacucgaggacacaaagcaacuguauacaccgguucagcagacuuuucaccaaaauuaggaagaguucaauucgcaacugauacagauaaugauuucgaaaccaaucaaaauacaaaauuuacucccguaggaguaauacaagacggaucaacaacaccacgcaaugaaccccaacaauggguuuuaccaucuuauaguggcagaaauauacacaacguacaccuagcuccugcugucgccccaacuuuuccaggugaacaacuacuauucuuccgaucaacaaugccaggaugcucuggauauccuaauauggauuuagauugcuuauuaccacaagaauggguacaauauuucuaccaagaagcugcaccugcucaaucagacguagcacuacuaagauucguuaacccugacacagguagaguauuauuugaauguaaauuacacaaaucaggauauguuacaguagcucacacaggacaacaugaccuuguuauaccaccaaauggcuauuuuagauuugauucauggguuaaucaauucuucucacuagcacccauggguaacgguacagguagaagacgagcacuauaa

SEQ ID NO: 31881 - RNA, 1623 nt, Artificial Sequence
  derived and/or modified sequence opt6 from VP1__Norovirus__ALF12535
augaaaauggcaucuucagacgcaaacccaaguguaggaucagcagcuaaccugguaccugaagucaauaacgaagucauggcacuagaaccuguaguaggugcagcaauagcugcucccgucgcuggucaacaaaaugucauagauccauggauaagaaauaauuuuguacaagcuccugggggagaauuuacaguauccccaagaaaugcuccuggagaaauacuauggagugcuccacuuggaccugauuuaaauccauacuuaucacacuuagcacguauguauaacggauaugcuggaggauucgaaguauuaguaauucuagcaggcaacgccuuuacagcuggcaaaauaauuuuugcugcuguuccaccaaauuuuccaacagaaggacuaucuccaucucaaguuacaauguucccacacauaauaguagaugucagacaacuagaaccaguacuaauaccacuaccagacguacgaaacaauuucuaccauuauaaucaaucaaaugacccaaccauuaaauuaauagcuaugcuuuauacuccauuacgagcaaauaacgcaggagacgaugucuucacuguuucuuguagaguuuuaacucgaccuuccccagacuuugacuuuauauuucucguuccacccacagucgaaucuagaacaaaaccauucuccguuccaauacuuacaguagaagaaaugacaaauucaagauuucccauaccauuagaaaaacuauucaccggccccucauccgccuuuguuguccaaccacaaaauggacgaugcacaacagacgguguacuacuaggcaccacacaacuuucacccguaaauauaugcaccuuucguggagacguaacacacaccacuggaucccacaauuacaccaugaaucuagcuacacaaaauuggaacucauaugaccccacugaagaaauaccagcuccuuuaggaacaccagauuuuguuggaaaaauucaagguguacucacacaaacaacaaaaacugacggauccacaagaggacacaaagcaacaguauauacuggaagcgcagauuuugcuccuaaacucggcagaguacaauucgccacagauacagauaacgauuuugaagcaaaucaaaauacaaaauucacaccaguuggugucauacaagacggagggacagcucauagaaaugaaccucaacaauggguacuaccuucauacucagguagaaauacacauaauguucaucuagcuccagcaguugcaccuacauucccaggagaacaacuauuauuuuucagaucuacuaugccaggcugcucaggauaucccaacauggaucuagauuguuuauuaccacaagaauggguacaauacuucuaccaagaagcagcaccugcacaaucagaugucgcuuuauuaagauuuguaaacccugauacaggucgaguuuuauuugaaugcaaacuucacaaaucuggauauguaacaguagcucauacaggcccucacgaucuaguaaucccaccaaauggauauuucagauucgauucauggguaaaucaauuuuacacauuagcaccuaugggaaacgggacagguagacguagagcauuauaa

SEQ ID NO: 31882 - RNA, 1623 nt, Artificial Sequence
  derived and/or modified sequence opt6 from VP1__Norovirus__ALF12536
augaaaauggcaucaagcgacgcaaacccuuccgauggaagugcugcaaacuuaguaccagagguaaauaaugaaguaauggcauuagaaccagucgucggagcagcaauagcagcaccaguagcaggacaacaaaauguaauagacccauggauaagaaacaacuuuguacaagcaccuggaggcgaauucacaguaucaccaagaaaugcaccaggagaaauacuuuggagugcaccauuaggucccgauuuaaauccuuaucuaucucaccuugccagaauguacaacggcuaugcaggagguuucgaaguacaaguaauacuugccggaaaugcuuucacagcaggaaaaauaauauucgcagcaguaccaccaaacuucccuacagagggccuaucaccaucucaaguaacaauguuuccccacauaauaguagauguaagacaauuagagccaguucuaauaccacuacccgauguacgaaauaacuuuuaucauuauaaucaaucaaacgauccaacaauaaaauuaauagcaauguuauauacaccacuccgagcaaauaaugcaggagacgacgucuucacaguaucaugcagaguucuuaccagaccuucaccugacuuugauuuuaucuuuuuaguaccaccuacuguagaauccagaacaaaaccauuuucaguaccuauacuuacaguugaagaaaugacuaacucuagauuucccauaccacuagaaaaacuauuuacaggaccaucaucagcauuuguuguucaaccacaaaauggcagaugcacaacagacggaguacuacuugguaccacacaacugucuccgguaaacauaugcacuuucagaggugacguuacacacaccacaggaucucauaauuauacuaugaaucuagcaacacaaaauuggucuucauaugacccaaccgaagaaauaccugcuccacuaggcacaccagauuuuguagguaaaauccagggagucuuaacacaaacuacaaaaacagacggauccacccgaggacacaaagcaacaguauauacgggaucagcagauuuugcaccaaaacucggaagaguccaauucgcaacagauaccgauaaugauuucgaagcaaaucaaaauacaaaauuuacaccaguaggagucauucaagacggaaauacagcucauagaaaugaaccccaacaauggguauuacccuccuauuccggaagaaacacacacaauguucaucuugcaccagcagucgcaccaaccuuucccggagaacaauuauuauuuuuucgaagcacaaugccaggauguucaggauacccaaauauggauuuagauuguuuacucccacaagaauggguacaauauuucuaucaagaagcagcaccagcucagucugacguugcauuauuacgauucguaaacccagauacagguagaguauuauucgaauguaaauuacauaaaucaggguauguuacaguagcucacacaggaccacaugauuuaguaauaccaccaaaugguuauuucagauucgauucauggguaaaucaauuuuacacacuagcuccuaugggaaauggcacaggacgaagacgagcauuauaa

SEQ ID NO: 31883 - RNA, 1623 nt, Artificial Sequence
  derived and/or modified sequence opt6 from VP1__Norovirus__ALF12537
augaaaauggcaucaucagacgcaaacccaucugauggcucuacagcuaacuuagcuccagaaguaaauaacgaaguaauggcauuagaacccgucguaggugcagcuauagcagcccccguagcuggacaaaaaaauguaauagacccauggaucagaaacaauuuuguacaagcaccugguggagaauucacaguaucaccuagaaacgccccaggagaaauacuuuggucugcaccauuaggacccgaucuaaauccauauuuaucacaccuugccagaauguauaacggauaugccggcggauucgaaguccaagucauucuagcaggaaaugcauucacugcuggaaaaaucaucuuugccgcaguuccaccaaacuuuccaaccgaaggacuaucaccaucacaaguuacaauguucccacacauaaucguugacguucgacaauuagaaccaguacuaauaccauuaccagacguacguaauaauuuuuaucauuacaaucaauccaaugauccaacuauaaaacuuauagcaaugcuauacacaccacuacgagcaaacaacgcaggagacgauguauuuaccguaucauguagaguucuaacucgaccuucaccggacuucgacuuuauauuucuaguacccccuacaguagaaucucgaacuaaaccauuuucagcacccguauuaacaguagaagaaaugacaaacagcagauuccccauaccucuugaaaaacuauuuacaggucccucaucagcauucguuguacaaccacaaaauggaagauguacuacugacggcguuuuauuaggaacaacacaauuaucuccuguaaacauaugcacauuuagaggagacguuacccauauaaguggaagcagaaauuauaccaugaauuuagcuucacaaaauuggaacucguacgauccaacugaagaaauaccagcaccuuuagguacaccagauuuuguuggaaaaauacaaggagucuuaacccaaacaaccagaacaaacggcuccacaagaggacacaaagccacuguauacacaggaucagcagauuucucccccaaauuaggaagaguccaauucgcaaccgauacagauaacgacuucgaaacaaaccaaaauacaaaauucacacccguaggcguaauacaagacggaucaacaacaccaagaaaugaaccacaacaauggguucuccccucauauucaggaagaaacacacacaacguacacuuagcaccagcuguagcaccaacauuuccuggagaacaauuacuuuucuuuagaucaaccaugccugguugcucaggauacccaaauauggaccuagauugcuuacuaccacaagaauggguacaauauuucuaucaagaagcugcaccagcacaaucugauguagcccuacuaagauucguaaauccugacacaggacgaguauuauucgaaugcaaauuacacaaaucuggcuauguaacuguagcacacacaggacaaagagaccuaguuaucccaccaaaugguuauuucagauucgauucuuggguaaaucaauuuuauucacuagcaccaaugggaaauggaacaggucgaagaagagcucuauaa

SEQ ID NO: 31884 - RNA, 1623 nt, Artificial Sequence
  derived and/or modified sequence opt6 from VP1__Norovirus__ALF12538
augaaaauggcaucaucugacgcaaaccccucagacggauccacagccaacuuaguacccgaaguaaacaaugaaguaauggccuuagaaccaguaguaggugcagcuauagccgcaccaguugccggucaacaaaauguaauagacccauggauaagaaauaacuuuguacaagcaccaggaggagaauuuacaguuucaccacgaaaugcaccgggugaaauacuauggucagcaccacucggcccugaucucaauccuuauuuaucccaucuagccagaauguacaacggauacgcaggaggauucgaaguacaaguaauauuagcaggaaacgccuucacugcaggaaaaauaauauucucagcaguaccaccaaauuuuccuacggaaggacuaucuccaucacaaguaacaauguucccacauauaauuguugacguaaggcaacuagaaccuguuuuaauaccauuaccagacgucagaaauaacuucuaucauuauaaccaaucaaaugauccaacaauaaaacucauagcaaugcuuuacacaccauuacgagcaaacaaugcaggagaugacguauuuacagucuccuguagaguauuaacacgaccgucaccugauuuugauuuuaucuuucuaguaccuccaacaguagaaucaagaacaaaaccauuuucaguaccaauccuaacaguagaagaaaugaccaacucccgcuucccuauacccuuagaaaaacuauucacuggaccauccucagcuuucguaguacaaccacaaaauggacgauguucaacagaugguguauuacuaggcacaacccaauuaucaccaguaaauauauguacauuuagaggagauguuacacacauagccggaucacauaauuacacaaugaaccuagcaucucaaaacuggucaucguaugauccaacagaagaaauaccagcaccacucggaacaccugacuuuguaggaaaaauacaaggcguccuaacacaaacuacuagaucagacggcucaacacgaggucauaaagcaacagucuauaccggaucagcagacuucucuccuaaacuuggaagaguucaauucgcaacagauacugauaacgauuucguuucuaaucaaaauacaaaauucacaccagucggaguaauucaagauggagacacagcccaucguaaugaaccacaacaauggguacuaccuucauauagcggaagaaacauacauaacguucacuuagcucccgccgucgcaccuacauuuccaggagaacaacuacuuuucuuccgcuccaccauaccaggcuguuccggauauccaaauauggauuuagacuguuuacucccucaagaauggguacaauacuuuuaucaagaagcagcaccagcacaaucugacguagcauuacucagauucgugaauccagauacaggaagaguacuauucgaauguaaauuacacaaaucuggcuaugucacaguagcacauaccggacaacacgauuuaguuaucccuccaaacggauauuuuagauucgauucaugggucaaucacuuuuacacauuagcaccaaugggaaacggaacugguagaagaagaguauuauaa

SEQ ID NO: 31885 - RNA, 1623 nt, Artificial Sequence
  derived and/or modified sequence opt6 from VP1__Norovirus__ALF12539
augaaaauggcaucaucugacgcaaauccaucagauggaucaacagcaaaucuaguuccagaaguaaacaaugaaguaauggcauuagaaccaguaguuggcgccgcaauugcagcaccaguagcaggccaacaaaaugucauagacccuuggauacguaauaacuuuguacaagcaccaggaggagaauuuaccguuuccccaagaaacgcuccaggagaaauauuaugguccgcuccgcuuggcccagacuuaaauccauaccuaucacauuuagcacgaauguauaauggauacgcaggagguuucgaaguucaaguuauacuagcaggaaacgcauuuacugcaggaaaaaucauauucgcagccguuccaccaaacuuuccaacugaaggacuaucacccucacaaguaacaauguucccaagaauuauaguugauguucgccaacuugaaccaguacuaauaccucuccccgauguaagaaacaauuucuaccacuacaaccaauccaaugacccaacaauaaaacuaauagcaaugcuauacacaccauuaagagccaauaaugcaggcgaugauguauuuacaguaucauguagaguauuaacacgaccuucaccagacuuugauuuuaucuuuuuaguaccaccaacaguagaaucacgaacaaaacccuucucaguaccaauacuaacaguagaagaaaugacaaauucacgauuucccauaccauuagaaaaacuauuuacaggaccaucaucagcauucguaguacaaccucaaaacggccgaugcaguaccgacggugugcuauuaggaaccacucaauuaagcccaguaaauauaugcacauuuagaggagaugucacacauauagcuggaucacacaauuacaccaugaaucucgcaagucaaaauuggucaucuuaugauccaacagaagaaauaccagcacccuuaggaacacccgacuuugucggaaaaauccaaggaguauuaacacagaccacaagaacagacggcucaacaagaggacauaaagcaaccguuuacacagguucagcagacuucucaccaaaacuagguagaguccaauucgcaaccgauacaaauaaugauuuugaaucaaaucaaaauacaaaauucgcaccaguaggaguuauacaagauggaggcacugcucauagaaaugaaccacaacaguggguauuacccuccuauagcggacgaaacauacauaacguucaucuagcacccgcaguagcuccaacauuuccaggagaacaauuauuauuuuuuagauccacuauaccaggaugcucaggauaucccaacauggaccuagacugucuuuuaccccaagaguggguucaauacuuuuaucaagaggcagcuccagcacaaucggauguagccuuacuacgauucguaaaccccgauacaggaagaguacuauuugaauguaaauuacauaaaucaggauauguaacuguugcucacacuggucaacaugauuuaguaauaccaccuaauggauauuuuagauucgauucguggguaaaccaauucuacacauuagcaccuaugggcaauggaacugguagacgacgagcacucuaa

SEQ ID NO: 31886 - RNA, 1623 nt, Artificial Sequence
  derived and/or modified sequence opt6 from VP1__Norovirus__ALF12541
augaaaauggcaucaucagaugcuaacccauccgacggcuccacagcuaaccuaguaccagaaguaaauaaugaaguuauggcacuagaaccaguaguaggagcugcaaucgcagcaccaguagcaggacaacaaaaugucauagaccccuggauaagaaauaacuuuguccaagcuccaggcggugaauucacgguuuccccaagaaacgccccaggagaaauauuauggucugcuccucuaggaccagauuuaaacccauacuuaagucacuuagcaagaauguacaauggcuacgcaggagguuucgaaguacaaguaauauuagugggaaacgcauucaccgcuggaaaaaucaucuuugcagcuguaccaccaaauuuucccacagaaggacuaucaccaucacaaguaacaauguucccacauauaaucguagacguaagacaauuagaaccaguacuaauaccauuaccagauguucgcaacaauuuuuaucacuacaaccaaucuucagauucaacaauaaaauuaaucgcuaugcuauauacuccauuacgagcaaacaaugcuggagacgauguauuuacaguuucaugucgaguacuaacaagacccagcccugauuucgacuuuaucuuuuuaguaccaccuacuguagaaucaagaacuaaaccauucucaguaccuguauuaacuguagaagaaaugacuaauucuagauucccaauaccauuagaaaaauuauucacaggaccaucaagugcauucguaguacaaccacaaaacggaagauguacuacagacgguguacuuuuaggaacaacccaauuauccccaguaaacauauguacauuucgaggagacguaacacacauaucuggaucacauaacuacacuaugaacuuagcuagucaaaacuggaauucauacgauccaacagaagaaaucccagcuccauuaggaacaccagacuuuguaggaaaaauacaagguguauuaacacaaacaacaagaacagauggaucaacaagaggacacaaagcaacaguauacacagguaguacagacuucaccccaaaacuuggcagagcacaauucgcaacagauacggacaacgauuuugaaacaaaccaaaauaccaaauucacucccguaggaguaauucaagacggugguacaacccacagaaacgaaccccaacaauggguucuaccuucauauucaggaagaaauacacauaauguacacuuagcaccagcaguugcccccacuuucccaggagaacaacuacuauucuuuagaucuacaaugccagguugcucaggcuacccaaauauggaccuagauugcuuauuaccucaagaauggguacaauacuuuuaccaagaagccgcaccagcucaaagcgacguugcauuauuaagauucgucaacccagacacaggaagaguauuauuugaauguaaacuacauaaaagcggauauguaacaguugcacacaccggacaacacgaucuuguaauaccuccaaauggauauuucagauuugauagcugggucaaccaauuuuacacucuagccccuaugggaaauggaacaggaagacgaagagcacuauaa

SEQ ID NO: 31887 - RNA, 1623 nt, Artificial Sequence
  derived and/or modified sequence opt6 from VP1__Norovirus__ALF12542
augaaaauggcauccucagacgcaaauccaucagacgguuccgccgcaaacuuaguuccagaaguuaacaaugaaguaauggcacuagaacccguagucggugcagcaauagccgcuccaguagcuggucaacaaaaugucauagauccauggauacgaaacaacuucguacaagcacccggaggugaauucaccguaucaccacgaaaugcuccaggagaaauauuauggucugcaccucucggacccgacuuaaaccccuaucuaagucaucuugcaagaauguauaauggauaugcuggaggauuugaaguacaaguaauacuugccggcaacgcauuuacagcaggaaaaguaauauuugcagcaguacccccaaauuuuccaacugaaggacuaucaccuucacaaguuacaauguucccacacauaguagucgauguaagacaacuagaaccaguccuaauaccauuaccagauguaagaaacaauuucuaucauuauaaccaaucuaaugacccaacaauuaaacucaucgcaaugcuauacacuccauuaagagcuaauaaugcaggagacgauguauuuaccguaagcuguagaguacuaacaagaccuucaccugauuuugacuucauauuucuaguaccaccuacagucgaaucaagaacuaaacccuuuucaguaccaguauuaacuguagaagaaaugacuaauucaagauucccaauccccuuagaaaaacuauuuaccggaccuucaucugcauucguaguucaaccccaaaacggaagaugcacaacagauggaguccuacuagguaccacacaauuaucaccuguaaauauauguacuuuucgaggugauguaacacauauaacaggaucuagaaauuauacaaugaauuuagccucccaaaauuggaauaauuaugauccaacugaagaaaucccagcaccauuaggcgccccagauuuuguaggaaaaauacaaggaaugcuuacacaaacaaccagagcugacggaucuacacguggacacaaagccacugucuauacaggcucugcagauuucgccccuaaauuaggaagaguacaauuugaaacagauacugaucacgauuucgaagcaaaccaaaacacaaaauucaccccaguagguguaauucaagaugguuccacaacacauagaaaugaaccccaacaauggguacuaccaucauauuccggucgaaacacucauaacguacacuuagcaccagcaguagcaccaacuuuuccaggugaacaauuacuauucuuucgauccacaaugccagguugcucuggauauccuaauauggauuuagacugcuuauuaccucaagaauggguacaauacuuuuaucaagaagcugccccagcucaaagcgaugucgcuuuauuaagauucguuaauccagacacagguagaguauuauuugaaugcaaauuacauaaaucaggauauguaacaguugcacacaccggucaacaugauuuaguaauaccuccaaacggauauuuuagauucgauucauggguaaaucaauucuacacguuagcaccaaugggaaauggagcuggaagacgcagagcccuauaa

SEQ ID NO: 31888 - RNA, 1623 nt, Artificial Sequence
  derived and/or modified sequence opt6 from VP1__Norovirus__ALF12543
augaaaauggccucaucagaugcaaauccaucagacggauccgcagcuaacuuaguacccgaaguaaauaaugaaguuauggcuuuagaacccguaguaggugcagcaauagcagcaccagucgcaggacaacaaaacguuauagauccuuggauucgaaauaacuuuguccaagcaccuggcggagaauucacagucucaccaagaaacgcaccuggcgaaauacuauggucagcaccacuaggcccagaucuaaauccuuacuuaagccaccuagcaagaauguauaauggauacgccggcggauuugaaguccaaguaauacucgcaggcaacgcuuuuacugcugguaaaauuauauucgcugcaguaccaccaaacuuuccaacagaaggauuaucuccaucacaaguaacaauguuuccacacaucauaguugacguaagacaacuagaaccaguacuuauuccacuaccagacguaagaaacaauuucuaucauuauaaucaaucaaaugacuccaccauaaaacucauagcaauguuauacaccccacuucgagccaauaaugcuggagacgacguuuuuacuguauccuguagaguacuuacuagaccauccccagacuucgacuucauauuuuuaguaccaccaacugucgaaucucgcacuaaaccauucucuguaccaguuuuaaccguagaagaaaugaccaauuccagauuuccaauaccuuuagaaaaauuauucacaggaccaucaagcgcauuuguaguacaaccacaaaauggaagaugcacaacagaugguguauuacuuggaacaacacaacucucaccaguaaacauauguaccuuucgaggggacguaacacauauaacugguucaagaaauuauacaaugaaucuagcaucucaaaauuggaauaacugcgacccaacagaagaaauuccagcaccauuaggaacaccagacuuuguaggaaaaauacaaggaauguugacacaaacuacaagaacugacggaucaacccgaggacacaaagcuacaguauauacuggcucagcagacuuugccccaaaacuagguagaguacaauuugaaacagauacugaucacgacuuugaagcaaaucaaaacacaaaauucacuccaguugguguuauacaagauggaucaacaacacaucgcaaugaaccacaacaauggguucucccaucauauuccggaagaaacacccauaauguacaucuagcuccagcagucgcaccaacguucccuggagaacaacuucuauuuuuuaggucaacaaugcccggauguagcggauauccaaauauggaucuugauugucuacuaccacaagaauggguacaauacuucuaucaagaagcagccccagcacaauccgacguugcacuccuaagauuuguaaauccugacacagguagaguauuauucgaaugcaaacuacacaaaucaggauacguaacaguagcucacacaggccaacacgacuuaguaauacccccaaacggcuauuuccgcuuugauuccuggguaaaccaauuuuauacacuagccccaauggguaaugguacaggacgaagacgcgcacuauaa

SEQ ID NO: 31889 - RNA, 1623 nt, Artificial Sequence
  derived and/or modified sequence opt6 from VP1__Norovirus__ALF12546
augaaaauggcaucaucagaugcaaacccuagugaaggcucuacugccucauuagucccagaaguaaauaaugaaguuauggcacuugaacccguagcaggagcagcaauagcugccccaguugcaggccaaguaaacguaaucgaucccuggauaagaaauaauuucguacaagcacccggaggagaauuuacugucucaccaagaaaugcaccaggugaaauauuauggucagcuccacuaggaccagaucuaaaucccuaccuaucucacuuagcuagaauguauaauggauaugcuggaggcuucgaaguacaagucauacuagcaggaaaugccuuuacagcugguaaaaucauauucgcagcaguacccccaaauuuucccacagaaggacuaucaccaucccaaguuacaauguucccccauauaauaguagauguaagacaacuagaacccguacucauaccacuaccagaugucagaaauaacuuuuaucacuauaaccaaucuaaugaaccuacuauuaaacucguagcuaugcucuacacucccuuaagagcaaauaaugcaggugacgauguuuucaccgucucuuguagaguuuuaacacgaccaucaccagacuucgauuucauauuucuaguuccaccaacaguagaaucaagaacuaaaccauucucaguuccaauccuaacaguugaagaaaugaccaacucacgauuuccaauaccacuugaaaaauuauucaccggacccaguagcuccuuuguaguacaaccccaaaauggaagauguaccacagacggaguccuauuaggcacuacacaacuaaguccaguuaacauauguaccuuucguggugacguuacacacauaucagguucaagaaaucauacuaugaauuuagccucacaaaacuggaauucuuaugacccaacagaagaaauaccagcaccccuuggaacaccugacuucgucggaaaaauacaaggaguauuaacacaaacaacaagaagugacggaagcacaagaggucauaaagcaacaguauauacugguucagcagacuuuucuccaaaauuaggaagaauacaauuugccacagauacagauaacgacuuugaaacaaaucaaaacacaaaauuuacacccguaggaguaauccaagacggaggaaccacacauagaaaugaaccacaacaauggguacuuccuacauacucaggaagaaauacucauaacguucaccuagcucccgcaguagcaccuacuuucccuggagaacaauuauuauuuuuucgcucuacuaugccaggaugcuccggauauccagauauggauuuagacugcuuauuaccacaagaauggguacaacauuuuuaccaggaagcagcuccagcacaaucagacguagccuuauuacgauucguaaauccagauacaggaagaguacuauucgaaugcaaauuacauaaagccggauaugucacaguagcacauacaggacaacaugaucucguaauaccaccuaauggauauuucagauucgauucaugggucaaucaauucuucacucuagcucccaugggcaauggcacaggaagacgucgagcccuauaa

SEQ ID NO: 31890 - RNA, 1623 nt, Artificial Sequence
  derived and/or modified sequence opt6 from VP1__Norovirus__ALF12547
augaaaauggcaucaucagaugcaaaccccuccgauggaucugcagcaaauuuaguaccagaaguaaacaaugaaguaauggcauuagaaccaguuguaggagcagcuauagcagcaccuguugcaggacaacaaaaugucaucgauccuuggauuagaaauaauuuuguacaagcaccaggaggagaauucacaguuucaccacgaaacgcuccaggagaaauauuauggucagccccccuaggaccagauuuaaaucccuaccuaucucaccuugcacguauguauaaugguuacgcuggcggauucgaaguacaaguaauauuagcagguaaugcauucacagcaggcaaaauaaucuucgcagcaguaccaccaaacuuuccuacagaaggucuaucacccucacaaguaacaauguuuccacacauaauugucgacguacgacaacucgaacccguuuuaauaccauuaccagauguaagaaacaauuucuaucacuacaaucaaucaaaugacccaaccauaaaacuaauagcuaugcucuacaccccauuaagagcaaacaaugcaggagacgacguauuuaccgucucuuguagaguucucacucgaccuuccccugauuuugacuuuaucuucuuaguuccucccacuguagaaucacgaacaaaaccauucucagucccagucuuaacaguagaagagaugacaaauagccgauuucccauaccauuagaaaaauuauuuacaggacccucuucagcuuucguaguacaaccacaaaacggaagaugcacaacagacgguguuuuacucggaacuacucaacucaguccaguuaacauauguacauuucgaggcgauguaacucauauaacugguucacgaaacuauacaaugaauuuagcaucacaaaacuggaauaacuaugaucccacagaagaaauaccagcaccuuuagguacaccagacuucguaggaaaaauucaaggaauguuaacacaaacaacacgaacagauggaucaacucgaggccauaaagcaacaguuuauacaggcucagcagauuuugccccaaaacuuggaagaguacaauuugaaaccgacacagaucacgacuucgaagcaaaucaaaauacaaaauucacaccaguaggagucauacaagauggauccacuacacauagaaacgaaccacaacaaugggucuuaccaucuuauagcggaagaucagcacauaauguacaucucgccccagcaguugcucccacuuuucccggagaacaacuauuauucuuuagauccacaaugcccggaugcucaggauauccaaauauggauuuagacugcuuacucccacaagaauggguucaauauuucuaucaagaagcugcacccgcccaaagugacguagcauuauuacgauucgucaauccugacacaggcagaguacuuuuugaauguaaauuacauaaaucaggauauguaacagucgcacauacaggacaacacgauuuaguaauuccacccaauggauauuuuagguucgacucauggguaaaucaauuuuacacauuagcaccaaugggaaacggaacaggcagaagaagagcauuauaa

SEQ ID NO: 31891 - RNA, 1623 nt, Artificial Sequence
  derived and/or modified sequence opt6 from VP1__Norovirus__ALF12560
augaaaauggccucauccgacgcaaacccuucagauggaucaaccgccaaucuaguaccagaaguaaacaaugaaguaauggcacuagaaccaguuguuggagccgcaauagcugcaccaguagccggacaacaaaauguuauagacccauggauccgcucuaauuucguacaagcuccaggcggagaauucacaguauccccacguaaugcuccuggagaaauucucuggucugcuccauuaggaccagauuuaaauccuuauuuaucacauuuagcuagaauguauaauggcuaugccggaggauuugaaguccaaguaauacuagcagguaacgcauuuacagcaggaaaaauaauauuugcugcuguacccccaaauuuucccacagaaggacuaucaccuucacaagugacaauguuuccacauauaauaguagauguacgucaauuagaaccaguauuaaucccucuaccagacguaagaaauaacuucuaccauuauaaucaaucaaacgauccaacaauaaaacucauugcaauguuauacacaccacuacgagccaauuccgcuggcgacgacguauuuacaguaucaugcagaguacuaacccgaccauccccagauuucgacuuuaucuuucuuguaccaccuacaguagaaucacguacuaaacccuuuucuguaccuauacucacuguagaagaaaugaccaacucuagauuuccaauaccauuagaaaaacuuuuuaccggacccaguucagcuuuuguaguacaaccccaaaauggaagaugcacaacugacggaguucuacuuggaacaacucaacuauccccaguaaauauuuguucauuuagaggagauguuacucauaucgcugguucuagaaauuauacaaugaaccuagcaucccaaaauuggaauucuuaugauccaacugaagaaauaccugcaccucuaggaacaccagacuuuguagguaaaauacaaggaguccuaacccaaacaacaagaacagauggauccacaagaggccaucgagcuacaguauauacaggaucagcagacuuuucaccuaaauuagguagaguucaauuugcaacugauacagauaaugauuucguagcaaaccaaaauacaaaauuuacaccaguaggaguaauacaagacggagacacagcacauagaaaugaaccacaacaauggguacucccaucauacucuggaagaaauauacauaauguacauuuagccccagcaguugccccuacauuuccuggagaacaacuucuauuuuucagaucaacaaugccagguugcaguggauauccaaacauggaccuagacuguuuauuaccccaagaauggguccaacauuuuuaucaagaagcagcuccagcacaaucagaugucgcacuacuccgauuuguuaauccagauacaggcagaguauuauuugaauguaaacuacauaaaagcggcuauguaacaguugcacacacuggccaacaugaucuaguuauaccaccuaacgguuauuuuagauuugauuccuggguaaaucaauucuacacacucgcaccaaugggaaauggaacaggucgacgaagagcauuauaa

SEQ ID NO: 31892 - RNA, 1623 nt, Artificial Sequence
  derived and/or modified sequence opt6 from VP1__Norovirus__ALF12562
augaaaauggccucaucugaugcuaaccccucugacggaucuacugcuaaucuaguaccagaaguaaacaacgaaguaauggcuuuagaaccaguagucggagcugcuauagcugcacccguagcuggacaacaaaacguaauagacccuuggauaagaaauaacuuuguccaggcaccaggaggcgaauucacaguaucuccaagaaacgcaccaggagaaauauuauggagcacuccacuaggccccgaucuaaacccuuacuuaucucauuuagcuagaauguauaacgguuacgccggaggauucgaaguacaaguaauucuagcugguaacgcauuuacagccgguaaaaucauauuugcagcaguuccccccaacuuuccaacagaaggauuauccccaucacaaguuaccauguuuccacacauaauuguagauguacgacaacuagaaccaguauuaauaccacucccagauguaagaaacaauuucuaucauuauaaccaaaguaaugaccccacaauaaagcucauagcaauguuauacacuccauuaagagcaaauaaugcuggagacgacguauuuacaguaucaugccgagucuuaacaagaccaucaccagacuucgacuucauauuucuaguaccaccaacuguagaaaguagaacaaaaccauucucaguaccaguauuaacugucgaagagaugacaaauucaagauuuccaauaccucuagaaaaacuauuuacaggaccaucuagugcauucguuguccaaccacaaaauggccgaugcaccaccgacggaguauuacuaggaacaacucaauuauccccagugaauauaugcacauuucgaggugacguaacacauauaucaggaucucgaaacuacacaaugaaccuagcaucccaaaauuggaacucauacgauccuacagaagaaauccccgcaccacuaggaacaccagacuuuguaggaaaaauacaaggaguacuaacacaaacaacuagaacggacgguagcacaagaggucauaaagcaacaguuuauaccggcagugccgauuuuucaccaaaacuaggaagaguacaauuugcuaccgacacagauaacgauuuugaaaccaaucaaaauaccaaauucacaccaguaggaguaauacaagacggaagcacuacccauagaaacgaaccccaacaauggguacuuccaucauacucaggucgcaacacacauaacguacaucuagcaccagcaguugcacccacuuuuccaggagaacaacuacuuuucuucagaucaacaaugccaggauguaguggauacccaaacauggaucuugacuguuuacuaccccaagaauggguacaauauuucuaccaagaagcagcaccagcucaaucagacguagccuuauuaagauucguaaauccagacacaggucgaguauuauucgaaugcaagcuacauaaaucuggauauguaacaguagcacacacaggucaacaugauuuaguaauaccaccaaauggcuauuuuagauucgauuccuggguaaaucaauuuuauacucuagcuccaaugggaaauggaacaggacgaagaagagccuuauaa

SEQ ID NO: 31893 - RNA, 1623 nt, Artificial Sequence
  derived and/or modified sequence opt6 from VP1__Norovirus__ALF12564
augaaaauggcaucauccgacgcaaacaguagugacgguucagcagcaaacuugguaccagaaguaaauaaugaaguaauggcauuagaaccuguuguaggagcagcaaucgcagcaccaguagcuggacaacaaaauguaauagaucccuggaucagaaacaauuuuguacaagcaccuggaggcgaauuuacaguaucaccacgcaaugcaccuggagaaauauuauggucugccccacuaggacccgaucuuaacccuuaccuaagccaucuugcacguauguauaauggauacgcaggugguuuugaaguacaaguaauucuagcaggaaaugccuuuacagcaggcaaaauaauauucgcagcaguaccaccuaauuucccaacagaaggauuaucaccaucccaaguaacuauguuuccccacauaauaguagacguacgccaauuagaaccaguacuaauaccauuaccugauguaagaaauaauuuuuaucacuacaaccaaucuaaugaccccacaauaaaacuaauagcaauguuauacaccccacuacgcgcuaauaaugccggugaugacguauucacaguaucauguagaguuuuaacaagacccucucccgauuucgacuuuaucuuuuuaguaccaccuacagucgaaucuagaacuaaaccauucuccgucccgauauuaaccguagaagaaaugacaaacucaagauuuccuauuccauuagaaaaacuauuuacaggaccaucauccgcauuuguaguucaaccccaaaauggacgauguacuacugacgguguacuauuaggaacaacacaacuuagcccagucaauauauguacauuuagaggagauguaacccacauaacaggcucucgaaacuacacaaugaaucucgcaacacaaaacuggaacucauacgacccuacagaagaaauaccugcuccuuuagguacaccagacuuuguuggaaaaauccaaggugucuuaacacaaacaacuaaaacagauggaucaacacgaggacauaaagcaacaguauacacaggaucagcagacuuugcuccuaaauuaggaagaguacaauucgcaacagacacagauaacgauuuugaagcaaaucaaaauacaaaauucaccccuguaggaguaauacaagacggcggaacaacacauagaaaugaaccccaacaauggguacuaccaucauauucuggaagaaauacucacaacguacauuuagcaccagccguugcuccaacauuccccggcgaacaacuacuauucuuuagauccacaaugccugguuguucaggcuauccuaauauggauuuagauugucuacuaccacaagaauggguacaauauuucuaccaagaagcagcacccgcacaaucagaugucgcacuacuacgauucguaaauccagacaccggucguguauuauucgaauguaaacuccauaaaucaggauauguaaccguagcacacacagguccacacgauuuaguaauaccacccaauggauauuuuagauucgauucauggguaaaucaauuuuauacauuagcaccuaugggaaauggaaccggaagaagacgagcaacauaa

SEQ ID NO: 31894 - RNA, 1623 nt, Artificial Sequence
  derived and/or modified sequence opt6 from VP1__Norovirus__ALF12566
augaaaauggcaucaucugacgccaauccuucagauggcucugccgcuaaccuaguaccugaaguaaauaaugaaguuauggcacuugaacccguaguuggagcagcaauugcagcgccuguagcaggacaacaaaacguaaucgacccauggauacgagacaauuuuguacaagcaccaggaggagaauuuacaguaaguccaagaaaugcacccggugaaauacuauggucagcuccacuaggaccagaucuaaauccauauuuaucccauuuagcacgcauguacaacggcuacgcaggagguuuugaaguucaaguaaucuuagcaggaaacgcuuuuacagcuggaaaaguaauauuugcagcuguaccaccaaacuucccuaccgaaggauuauccccaucacaaguaaccauguuuccacacaugauaguagacguuaggcaauuagagccaguauuaauaccacuaccugauguuagaaauaauuucuaucauuauaaucaaucaaacgauccuacauuaaaauuaauagcuauguuauauacgcccuuacgagccaauaaugcaggcgaugacguuuucacaguaucguguagaguauuaacaagaccaucuccagacuuugauuuuaucuuuuugguaccaccuacuguagaaucaagaacaaaaccuuuuuccguaccaguuuuaacaguugaagaaaugaccaauuccagauuuccaaucccauuagaaaaacuauucacaggaccauccucagcuuuuguuguccaaccacaaaacggacgcuguacaacagauggagucuuacuaggaacaacccaacuuucuccuguuaacauauguaccuuucgaggagauguuacacauauaacagggucucgaaauuacacgaugaaccuagcaucucaaaauuggaauaacuacgauccaacagaagaaauaccagcaccacucggagcuccugacuuuguagguaaaauacaaggaaugcuuacacaaacaacaagaacugacgguucaacaagaggacauaaagcaacagucuauacaggaucugcagacuucgccccaaaauuaggcagaguacaauuugaaacagauacagaccaugauuuugaagcaaaucaaaauaccaaguucacaccaguaggaguaauacaagaugguucuacaacgcauagaaacgaaccacaacaauggguauuaccuucuuacucagguaggaauacacauaauguacaucuagccccagcaguugcaccaacauucccaggugaacaacucuuauuuuucagaucaacuaugccagguuguucugguuauccaaacauggauuuagauuguuuacuaccucaagaauggguacaauauuucuaucaagaagcagcaccagcacaaucugauguugccuuacuaagauuuguuaauccagacacuggaagaguucuauucgaaugcaaauuacauaaaucaggauauguaacaguagcacauacaggccaacaugaccucguaauaccuccuaacggcuauuuucgauuugauucauggguaaaccaauuuuacacucuagcaccaaugggaaacgguacagguagaagaagaauuguauaa

SEQ ID NO: 31895 - RNA, 1623 nt, Artificial Sequence
  derived and/or modified sequence opt6 from VP1__Norovirus__ALF12569
augaaaauggcuuccagugacgcaaacccuucagauggcagcgcagcuaauuuaguaccagaagucaauaaugaaguaauggcacuagaaccaguugucggagcagcaaucgccgcaccaguagcuggacaacaaaauguaauagacccauggauacgcaacaauuuuguacaagcucccggaggugaauuuacaguaucaccacgaaaugcaccaggagaaauacuauggucagccccacuaggaccagauuuaaauccauaccuaucacauuuagcaagaauguacaacggauacgcaggcggauuugaaguacaaguuauauuagcuggaaaugccuuuacagcaggcaaaauaauauuugcagcaguccccccaaauuuccccacugaaggucuaucaccuucacaaguuacaauguucccacacauaauuguagacguuagacaacuagaaccaguacuaauuccauuaccagauguaagaaauaauuucuaccauuauaaucaaucaaacgauucuacaauaaaacuuaucgcaauguuauacacaccacuaagagcuaauaaugcaggugaugacgucuucacagucagcuguagagucuuaaccagaccaucaccugacuuugauuucauauuucuaguacccccaacagucgaaucacgaacuaaaccuuucucuguacccguccuuacaguugaagaaaugacaaauaguagauuuccaauaccacuugaaaaauuauuuacagguccaagcucagcauucgucguacaaccacaaaacggaagauguaccacagacggaguccuacuuggaaccacacaauuaucaccaguaaauauuugcacauuucgaggagauguaacacauaucacaggauccagaaauuacacaaugaaccuugcuucucaaaacuggaacaacuacgaucccacagaagaaauaccagcaccacuagguacaccugacuucguagguaaaauacaaggaaugcuaacacaaaccacaagaacugaugguucaacacgaggucacaaagcuacaguauauacaggaucagccgauuuugcuccuaaacucgguagaguacaauucgaaacagauacugaccacgauuucgaagcaaaucaaaauaccaaauuuacaccaguaggaguaauacaagacggcagcacuacucauagaaaugaaccacaacaaugggucuuacccucauauucaggaagaaacacacacaacguacacuuagcaccugcaguagcaccaacauuucccggugaacaacuaccuuuuuuccgaucuacuaugccuggaugcuccggauaccccaauauggauuuagacuguuuauuaccacaagaauggguacaauauuuuuaucaagaagcugccccagcucaaucagacguagcauuauuaagauucguaaacccagacacuggaagaguacuauuugaauguaaacuacacaaaucaggauauguaacaguagcacacacuggacaacacgaucucguuaucccuccuuacggauauuucagauucgacucauggguaaaccaauuuuacacacuagcaccaaugggcaauggaacgggaagaagacgagcucuauaa

SEQ ID NO: 31896 - RNA, 1623 nt, Artificial Sequence
  derived and/or modified sequence opt6 from VP1__Norovirus__ALQ28762
augaaaauggcaucuaaugaugcagcaccuucaaaugacggagcagcuggacuagucccagaaggaaacaaugaaacuuuaccacuagaaccuguagcuggugcagcaauagcagcaccaguaacaggacaaaauaauauuauugacccauggauacgaacaaacuucguacaagcaccaaacggcgaauucacuguauccccaagaaacucaccuggagaaauauuacuaaaucuugaacuaggacccgaccuaaauccauaucucgcacaccuaucuagaauguauaauggcuacgcaggaggaguugaaguacaaguacucuuagcuggaaacgcauucacagcaggaaaaauauuauucgcugcaguacccccaaacuuuccagucgaauucuuaucaccagcacaaauaacaauguuaccacacuuaauuguugauguacgaacacuagaaccaauaaugauuccuuuaccggacguacgaaauacauucuuucacuauucaaaucaaccaaauucacgaaugagauuaguagcaaugcuauacacuccauuacgauccaacggaucaggagaugauguuuucacaguuucaugcagaguuuuaacacguccaacaccagacuucgaauuuacauaucuaguacccccaucaguugaauccaaaaccaaaccauuuucacuacccauauuaacccuaucugaacucacaaacaguagauucccaguaccaauagacucacuauuuacagcacaaaauaacguacuccaaguucaaugucaaaauggacgauguaccuuagacggagaauuacaaggaaccacccaacuccuaccauccggcauaugugcauuucgagguagagucaccgcacaaauaaaccaaagggacagauggcacaugcaauugcaaaauuuaaauggaacuacauaugauccaacagacgacguacccgcaccucuagguacuccagauuucaaaggaguaguauuuggcaugguaucacaaagaaauguaggaaaugacgcccccggaucaacacgagcacaacaagcauggguuucaacauacuccccacaauuuguaccuaaauuaggaucuguaaauuuacguauaucagacaaugacgauuuucaauuccaaccuacuaaauuuacaccaguaggaguaaaugacgaugaugauggacauccauuuagacaaugggaacuuccaaacuauucuggugaauuaaccuuaaacaugaaccuagcaccaccaguugcaccaaacuuccccggugaacaauuacuauucuucagauccuuuguuccaugcagcggcggauauaaccaaggaauaauagauugucucauaccacaagaauggauacaacacuucuaccaagaaucagcaccaucucaauccgacguagcacuuauaagauacguaaacccagacacuggccgaacccuauucgaagcuaaacuacaucgaucuggauauauaacuguagcacacucaggugauuacccucuaguaguaccagcaaacggccacuucagauuugacucaugggucaaucaauuuuauucacuugcaccaauggguacuggaaacggaagaagaagagcacaauaa

SEQ ID NO: 31897 - RNA, 1632 nt, Artificial Sequence
  derived and/or modified sequence opt6 from VP1__Norovirus__ALS03883
augaaaauggcaucaaaugacgcagccccaucaaaugacggagcagcaggccuaguaccagaaauaaacaacgaaacaauggcucucgaacccguagcaggcggugcaauagcagcaccacuaacaggacaaacaaacuucauugacccauggaucagaggaaauuacguacaagccccuaauggagaauuuacaguauccccaagaaacucaccaggagaaauuuuacucaacuuagaauuaggaccagaauuaaacccauuccuuagccaucuaucaagaauguacaacggauacgcaggaggaauagacguccaaguaauaauggcaggaaacgcauuuacagcagguaaaauuauauucgcagcaaucccaccccacuucccagucgaaaacuuaucaccuccccaaauaaccauguucccacacauaauaguugauguaagaacacucgaaccaauaaacauuccaguaccagacguccgaaacaacuucuuucacuacaaucaaaacaaugaaucaagaaugagauuaguagcaaugcucuauacaccacuaagaucaaacgguucagcagaagauguauuuaccguaucuuguagaguucucacaaaaccaucugccgacuuugaguucaacuauuuaguaccaccaacuguagaaucccgaacaaaaccauucacuauaccaauucuuacuauaggagaaaugacaaauucaagauucccaguaccaauugauaugcuacacacuagcccaacagaaaacauuguaguacaaccacaaaauggcagaugcacaauagauggagaauuauuaggaacaacacaacuaauaacaucaaacauaugcuccuuccgaggaucaauaucuggacacgaagguaacgacgaucaacaccuauggcacuuuaauauaaccaacccaaauggcacaccuuucgacccaacagaagauguacccgcacccuuaggcaccccagauuucagaggccaacuauacggcguaauuucucaacgagacagggaaggaacccccagcgaaaacaaccaaaaagcaaaucgaucacaccaaggaguuauaucaacaauuucuccaaaauucguuccaaaauuaggcucaguaaugauaggaacauggacaacagaugauauuaaaaaccaacccucaaaauucacaccaauaggacuaaaugacgacgacaacuuuaaacaaugggaacucccaaauuacucuggagcacuuacacuaaauaugggacuugcaccauccguauuuccaacuuauccaggagaacaaauacuauuuuuccgaucauaccuuccacuaaaaggagguuacggaucaccauucauagacugccuagucccacaagaauggguugcucacuucuaccaagaaucagcaccagcccaaacugacgucgcucuaauaagauauguaaaucccgaaacaggcagaguacucuucgaagcaaaacuacacagacaaggauucauuaccguagcaaaaucuggagacuccccaauuaauguacccgccaauggauacuuccgauucgacucauggguaaaccaauucuacucauuagccccaaugggaacaggcaacggaagacgacgaauacaauaa

SEQ ID NO: 31898 - RNA, 1617 nt, Artificial Sequence
  derived and/or modified sequence opt6 from VP1__Norovirus__ALT06546
augaaaauggcuucaaacgaugcagcuccuagcaaugauggagcagcaggacuaguaccagaagguaauaaugaaaccuuaccauuagaaccaguugcaggagcagcuauagcugcaccaguuacaggacaaaauaauauaauagacccuuggauacgaacaaauuuuguacaagcaccaaacggagaauuuacugucucaccucguaauucaccaggcgaaauacuauuaaauuuagaacuugguccagacuuaaauccauacuuagcacacuuaaguagaauguauaacgguuaugcaggaggaguagaaguacaaguauuacuagcaggcaaugcauucacagcaggaaaaauacuauucgcagcaguaccaccaaacuuuccaguugaauuuuuaucacccgcucaaauaacaauguuaccccaccuaauaguagauguaagaacacuagaacccauaaugauacccuuacccgauguacgcaauacuuucuuccauuauaacaaucaaccaaacucuagaaugcgauuaguagcuauguuguauacaccuuuaagaucaaacggcucaggagacgauguauuuacagucucauguagaguucuaaccagaccuacaccugacuuugaauuuacuuauuuaguaccaccaucuguagaaucaaaaacaaaaccuuucucacuuccuauauuaacacuauccgaauuaacaaacuccagauuuccaguaccaauagauucuuuauuuacagcacaaaauaacguacuucaaguacaaugccaaaacgggagaugcacauuagauggugaauuacaagguacaacccaauuauuaccaagcggcauaugugcauuuagaggacgcguuacagcagaaacagaccacagagacaaauggcacaugcaacuacaaaaucuaaauggaacaacauacgaccccaccgaugacguaccagcccccuuagggaccccagacuucaaagguguaguauuuggaauggcaucacaaagaaacguaggaaaugacgccccagguucuacacgugcacaugaagcaguaauuaguacauauagcccacaauucguacccaaacuuggcucaguaaauuuuagaucaaaugacaacgauuuucaacuacaacccacuaaauucacaccaguuggaauuaaugaugacggugaucauccauuucgacaaugggaacucccugacuauagcggacccuuaacacuaaacaugaacuuagcaccaccaguagccccuaauuuuccaggugaacaacuuuuauuuuuucguaguuucguuccauguucaggaggauauaaccaaggaauuguagauugcuuaauaccacaagaauggauucaacauuucuaccaagaaucagcuccaucacaaucagacguagcauuaauaagauacguaaacccugacaccggaagaacccucuucgaagcaaaauuacacagaucagguuauauaacaguagcacacucaggagacuauccucuaguaguaccagccaacggauauuuucgauucgauucuuggguuaaucaauucuacucucucgcaccaauggguacaggaaauggaagaagaagagcacaauaa

SEQ ID NO: 31899 - RNA, 1647 nt, Artificial Sequence
  derived and/or modified sequence opt6 from VP1__Norovirus__BAG30939
augaaaauggcaucaaacgaugcaacaccuucgaacgacggagccgcuggccuaguaccagaaauaaacaacgaagcaauggcacucgacccuguagccggagccgcuauagcagcaccacuaacaggacaacaaaacauaaucgauccauggauaaugaacaauuucguacaagcacccggaggagaauuuacaguuuccccaagaaacuccccuggagaagucuuauuaaaccuagaauuaggaccagaaauaaacccauauuuagcucaucuagcaagaauguacaauggauaugcaggcggauuugaaguacaaguaguacuagccggaaaugcauuuacagcuggaaaaauaaucuuugccgcaauaccuccaaauuuuccaauugauaaucucagugcacgucaaauuacaauguguccacacguaauaguagacgucagacaauuagaaccaguuaauuuacccaugccagauguacgaaacaacuuuuuccacuacaaucaagguucagauucaagacuaaggcuaauugcaaugcuauacacaccacuucgagcaaauaacuccggagaugacguauucaccguaucauguagaguacuaacacguccaucacccgauuuuucauucaacuuccuaguaccaccuacugucgaaucaaaaacaaaaccauucacacuaccuauucuaacuauaucugaaaugagcaacucacgauucccaguaccaauagacucacuacacacuucacccacugaaaauauaguuguacaaugucaaaauggccguguaacauuagauggugaacuaaugggaacaacacaacuucuacccucacaaauaugcgcauucauggguguacucacaagaucaacaucaagagcuucagaucaagcugacacagcaacucccagauuauucaacuacuacuggcauauacaauuagacaauccaaacgguacacccuacgacccugcugaagauauaccaggaccauuaggcacuccagacuuccgaggaaaaguauuuggaguagcaucacaaagaaauccagacuccacaacuagagcccaugaagcaaaaguugacacaacugccgguagauucaccccuaaauuaggaucauuagaaauaagcacagaaucagacgacuuucaucaaaaccaacccacuagauucacaccaguagguauaggagucgauaacgaagcagauuuccaacaauggucauuaccagacuacagcggacaauuuacacauaauaugaaccuagcuccagcaguagcaccaaauuucccaggagaacaacuucuauuuuucagaucacaauuaccuucuucuggaggacgaucaaacggaauauuagauugccuaguaccacaagaauggguccaacacuuuuaccaagaaucagcaccaucacaaacucaaguugcauuaguacguuacguaaaucccgauacugggagaguuuuauuugaagcaaaauuacauaaacuaggauucaugacuauagcaaaaaauggugauucuccaauuacuguuccaccaaaugguuacuucagguucgaaucuugggucaauccauucuauacucucgcaccaaugggaacuggaaauggaagacgaagaauccaauaa

SEQ ID NO: 31900 - RNA, 1623 nt, Artificial Sequence
  derived and/or modified sequence opt6 from VP1__Norovirus__BAG70428
augaagauggcaucaaaugaugcaaauccaucugaugguucagcagcaaacuuagucccagaaguuaauaaugaaguaauggcauuagaacccguaguaggagccgcaaucgcagcaccaguagccggccaacaaaaugucauagaccccuggauacgaaauaauuuuguucaagcaccagguggagaauuuacagucucccccagaaacgcuccaggcgaaauauuauggucagcacccuuagguccagaucucaacccguaucuaucucaccuagcuagaauguauaacggauacgcuggaggauucgaaguacaagucauucuagcaggaaacgccuuuacagcuggaaaaauaauauuugccgcuguacccccaaacuucccaacugaaggacuaucaccaucacaaguuaccauguucccacacaucauaguugacguaagacaacuugaaccaguacuaauaccauuaccagauguaagaaacaauuucuaccauuauaaccaaucaaaugauucuaccaucaaacuaauagcaaugcuauacacaccacuaagagcaaacaaugccggugaagacguauuuacugucuccugucgcguacuuacacgcccaucaccagacuuugauuuuauauuuuuaguaccacccacaguagaaucucgaacaaaaccauucacaguaccaauauuaacaguagaagaaaugacaaacucaagauuuccaauaccucuugaaaaacuauuuacaggaccaucaggagcauuuguuguacaaccacaaaacggaagauguaccacagauggaguacuuuuaggaacuacucaacuaucccccgucaauauauguacauuccgcggagacguaacacacaucgccggaucacgcaacuacacuaugaacuuagcaucauuaaacuggaauaacuacgauccaacagaagaaauucccgccccccuaggaacaccagacuucguagguaaaauacaaggaguacuaacccaaacaacuaaaggcgacgguucaacacgcggucauaaagcaaccguauauacaggcucagcaccauuuacaccaaaauuaggcucaguacaauuuucaacagacacagaaaaugacuuugaaacucaucaaaacacaaaauucacaccagucggcguaauacaagacggaucaacaacacaccguaacgaaccacaacaauggguacuucccuccuauucaggaagaaacguucauaacguacaucuagccccagcuguugccccaacauuuccaggcgaacaauuacuauucuuccgaucuacuaugccaggauguucaggauauccaaauauggacuuagauugcuuauuaccacaagaauggguccagcauuuuuaccaagaagcagcacccgcacaaucugauguagccuuauuaagauucguaaacccugauaccggucgaguauuauucgaaugcaaacuacacaaaucaggauauguaacaguagcacacaccggucaacacgaccucguaauuccaccaaauggauauuucagauucgauagcuggguaaaccaauucuacacucuugcaccaaugggaaauggaacaggacgaagacgagcauuauaa

SEQ ID NO: 31901 - RNA, 1623 nt, Artificial Sequence
  derived and/or modified sequence opt6 from VP1__Norovirus__BAG70431
augaaaauggcaucaaacgaugcuaaccccuccgacggcagcgcugcuaacuuaguuccagaaguaaacaacgaagucauggcucuagaacccguaguaggagcagcaauugcagcaccuguagcuggccaacaaaauguuauagacccauggaucagaaacaacuucguacaagcaccuggaggagaauucacaguaucucccagaaacgcuccuggagaaauacuuuggagcgcaccccuaggucccgauuuaaauccauaucuaagccacuuagcaagaauguacaacggauaugcaggcggauucgaaguacaaguaauacuagcaggaaaugcauuuacagcugguaaaauaauauucgcagcaguuccaccaaacuuuccaacagaaggauuaucaccaucccaaguuacaauguuuccacauauaauuguagauguucgacaacuagaaccaguacuuaucccacuaccagauguaagaaauaauuucuaccacuacaaccaaucuaaugacucuacaauuaaauuaauagcaaugcuauauaccccacuacgagcaaacaaugcaggugaagacguauuuacaguuuccugcagaguacuaacaagaccaucaccagacuuugauuuuauuuuucuaguuccaccaacaguagaaagcagaacuaaaccauuuaccguaccuaucuuaacaguagaagaaaugacuaauucuagauuucccauuccucuugaaaaacuauuuacaggaccaucuggugcuuucguuguacaaccacagaacggaagauguacaacagacggaguacuacucggaacaacacaacuaucucccguuaacauauguacauuccgaggagacguuacacauaucgcaggaucgagaaacuacacaaugaauuuagcaaguuuaaacuggaacaauuacgauccuacagaagaaaucccagcaccacuagguacccccgacuuuguaggaaaaauacaaggaguauuaacacaaacaacaaaaggugacggcucaacaagaggucacaaagccaccguuuauacagguagcgcacccuucacaccaaaacuaggaucaguacaauucaguacagacacagaaaacgauuucgaaacacaccaaaauacaaaauuuacaccaguaggaguaauacaagacggaucaacaacccaccguaaugaaccacaacaauggguccuaccaucauauucuggacgaaacguacauaacguacauuuagcaccagcaguagcaccaacauucccuggugaacaacuacuauuuuuucgaucuacaaugccaggaugcucuggcuauccuaauauggauuuagauugccuuuuaccacaagaauggguacaacauuuuuaucaagaagcagcaccagcacaaagcgacguagcauuacuucgcuuuguuaacccagauacaggacgaguauuauuugaaugcaaacuacauaaaucaggauauguaacaguagcccacacaggccaacacgaucuaguaauuccaccaaauggcuauuuucgauucgacucauggguaaaucaauuuuacacacucgcuccaaugggaaacggaacuggaagaaggagagcauuauaa

SEQ ID NO: 31902 - RNA, 1623 nt, Artificial Sequence
  derived and/or modified sequence opt6 from VP1__Norovirus__BAG70434
augaaaauggcaucaaaugaugcaaacccaagcgauggauccgcagcaaauuuaguaccagaagucaacaaugaagucauggcacuagaaccaguaguaggagcagcaaucgcagcaccaguagcaggccaacaaaaugucauagacccauggauacgaaauaacuuuguacaagcaccagguggagaauuuacagucucaccuagaaaugcaccaggagaaauccuauggucagcaccacucggaccagaccuaaauccauacuuaagucaccuagcuagaauguacaacggauaugccggaggcuucgaaguacaaguaauacuagcuggaaaugcauucacagcaggaaaaauaauuuuugcagcaguuccacccaauuuuccuacagaaggauuaucaccaucucaaguaacaauguuuccacauaucauaguagacguucgacagcuagaaccuguauuaauaccuuuaccagaugucagaaacaacuucuaucauuauaaccaaaguaacgacaguacaaucaaauuaauagcuauguuauacacaccacuccgagcaaauaaugcaggagaagacguauucacaguaucauguagaguacuaacaagaccaucccccgauuucgacuucauauuucuaguuccacccacugucgaaucaagaacaaaacccuucacaguaccaauccuaaccguugaagaaaugacaaauagccgcuucccaauaccacuagaaaaacuauuuacagguccaucaagcgcauuuguaguacaaccacaaaacggucgcuguacaacagauggaguacuucuaggcacaacacaacuauccccaguaaauauauguacauuuagaggagacguaacacacauagcaggaucaagaaacuacacaaugaaucuugcaagccuaaacuggaacaauuacgacccuacagaagaaauaccugcuccacuaggaacuccagauuuuguaggcaaaauucaaggaguacucacacaaacgacaaaaggagacgguucuacaagaggucacaaagcaaccguauauaccgguucagcaccauuuacaccuaaacuaggaaguguacaauucucuacagauacugaaaacgauuuugagacacaucaaaacacaaaauucacaccugucggaguaauacaagacggaucaacaacacaccgaaaugaaccacaacaauggguucuaccauccuauucaggaagaaaugcacacaauguacacuuagcaccagcaguugcaccaacauuccccggcgaacaacuuuuauuuuuccgaucaaccaugcccggaugcucgggauauccaaacauggacuuagacugcuuacucccacaagaauggguacaacauuuuuaucaagaagcagcuccagcacaaucagacguagccuuauuaagauuuguaaacccagacacaggaaggguccuuuucgaauguaaacuacauaaaucaggauauguaacugucgcacauacaggacaacacgaccuuguaaucccaccaaauggauauuucagauucgacuccuggguuaaucaauuuuauacacuagcaccaaugggaaauggaacaggaagaagacgagcucuuuaa

SEQ ID NO: 31903 - RNA, 1623 nt, Artificial Sequence
  derived and/or modified sequence opt6 from VP1__Norovirus__BAG70437
augaaaauggcaucuaacgacgcaaauccaucagauggaucaacagcaaaucuaguaccugaaguaaacaaugaaguaauggcauuagaaccaguaguaggagccgcaauugcagccccuguagcaggacaaacaaacguaauagauccauggauuagaaauaauuuuguccaagcaccaggaggugaauuuacaguauccccuagaaacgcaccaggcgaaauauuauggucugccccacuaggccccgauuuaaauccauaucucucacaucuugcuagaauguauaacggauacgcaggaggauucgaaguacaaguaauacuagcaggaaaugcauuuacagccggaaaaauaauuuuugcuaaaguaccacccaacuucccaacugaaggacucucuccuucccaagucacaauguucccacauauaauaguugauguucgacaauuagaaccuguucuuauaccauuaccagauguaagaaacaacuuuuaccacuauaaccaaucuaaugauuccacaauaaaacuaaucgcuaugcuauacacacccuuaagagcaaauaaugcuggagaagauguauuuacaguuucaugccgaguacuuacaagaccaucaccagacuuugacuuuauauuucuaguacccccaacuguagaaucaagaacuaaaccauucacaguaccaauacuuacuguagaagaaaugacaaacucacgauuuccaaucccauuagaaaaacuauuuacaggaccuucaggagcauuugucguacaaccacaaaacggacgauguacaacagaugguguacuucucggaaccacccaauuaagcccaguaaauaucuguaccuuuagaggagacguuacacauauugccggcaguaggaauuacacaaugaaucuagcaucacuaaacuggaacaacuacgauccuacugaagaaauaccagcaccauuaggcacuccagacuuuguagguaaaauacaaggaguauuaacucaaacaaccaaaggagacggcucaacuagaggccacaaagcaacaguauacaccggaucagccccuuucacaccaaaauuaggcuccguucaauucuccacugauaccgaaaaugauuucgaaacacaucaaaacacaaaauucacuccugucggaguuauacaagacggaucaacaacacauagaaaugaaccacaacaaugggucuuaccauccuauuccggaagaaauguacauaacguacauuuagcaccagcaguagcaccaacauucccaggagaacaacuauuauuuuuucgaucaaccaugcccgguugcagcggcuacccuaauauggacuuagauugcuuacuaccacaagaauggguccaacacuucuaucaagaagcagcacccgcccaaagugacguagcacucuuaagauuugucaacccagauacaggaagaguacuauuugaaugcaaacuacauaaaucaggcuaugucacgguagcacauacaggucaacacgaucuuguuauaccaccaaauggauauuuuagauucgauagcuggguaaaucaauucuauacgcuagcuccaauggguaacggaacaggccgaagaagagcuuuauaa

SEQ ID NO: 31904 - RNA, 1623 nt, Artificial Sequence
  derived and/or modified sequence opt6 from VP1__Norovirus__BAG70440
augaaaauggcuucaaaugacgcaaauccaagcgaugguagcacagcaaaccuaguuccugaaguuaacaaugagguaauggcacuugaaccaguuguaggagccgcaauagcagcaccaguagcaggacaacaaaauguuauagacccauggauaagaaauaacuuuguacaagcaccaggcggugaauucacaguaucuccaagaaacgcaccaggugaaauauuaugguccgccccacucgguccagaucucaauccauaucuaucacaccuugcuagaauguacaacggauaugcugguggauucgaaguacaaguaauucuugcagguaaugcauuuaccgcaggaaaaaucauauuugcagcaguaccuccgaacuuuccaacugaaggauuaucacccucucaagucacaauguucccacacauaaucguagauguacgacaacuagaaccuguucuaauaccacuuccagauguaagaaacaauuuuuaccacuacaaucaaucuaaugauucaacaauaaaacucauagcaauguuauauacaccccucagagcaaauaaugcuggagacgacguguuuaccguaucaugucgaguauuaacuagaccaucaccagacuuugacuucauauucuuaguaccaccaacagucgaaucaagaacuaaaccauucacagucccuaucuuaacaguagaagaaaugacaaauucucgauucccgauaccacuugaaaaacuauuuacaggaccaucaucagcauuugucguacaaccacaaaauggaagaugcacuacagauggaguacuacucggaacuacacaauuaucaccaguaaauauuuguacauuuagaggagacgucacacauauagcagguucuaggaauuauacaaugaaucuagcaucccuaaacuggaauaauuaugauccuacagaagaaauaccugcaccacuuggaacaccagauuuuguaggaaaaauccaaggaguuuuaacucaaacaacaaaaggugacggaucaacacgaggacacaaagcuacuguauauacaggaucagcaccauuuaccccaaaauuaggcucaguacaauuuucaacagacaccgaaaaugacuucgaaacccaucaaaauacaaaauuuacaccaguaggaguaauacaagacggaggaacaacacacagaaaugaaccacaacaauggguacuuccaucuuacucaggaagaaauguacauaacguccacuuagccccagcugucgcuccaacuuuuccaggagaacaacuccuauuuuuucgaucuacaaugccaggaugcucugguuauccaaacauggauuuagauugucuccuaccccaagaauggguucaacauuucuaucaagaagcagcuccagcacaaucugauguagcauuauuaagauuuguaaauccugacacaggaagaguacuauucgaaugcaaacuucauaaaucaggcuauguuaccguugcauacacaggacaacaugauuuaguuauaccuccuaauggauauuucagauucgauucauggguaaaccaauucuacacacuggcacccaugggaaacggaacaggaagaagacgagcuuuauaa

SEQ ID NO: 31905 - RNA, 1623 nt, Artificial Sequence
  derived and/or modified sequence opt6 from VP1__Norovirus__BAG70446
augaaaauggcgucaagcgaugcaaacccuucagacgguucuacugcaaaccuaguccccgaaguaaauaaugaaguuauggcccuugaacccguaguaggagcugcaauagcagcaccaguagcaggacaacaaaacguaauagauccuuggaucagaaauaauuucguacaagcaccuggaggugaauucaccguaucccccagaaaugcaccaggcgaaauauuauggucagcaccauuaggaccagaccuaaaccccuauuuaucucacuuagcacgcauguauaauuccuacgcaggaggauuugaaguacaaguaauauuagcaggaaaugcguuuacagccggaaaaauaauauuugcagcugucccaccuaacuuuccuaccgaaggacuaucaccuucucaaguaacaauguuuccacacauaauugucgauguaagacaauuagaaccaguccuuauuccauuaccagauguaagaaacaauuuuuaucacuauaaucaaucaaacgacccaacaauuaaauuaauagcaaugcuauacacuccauuacgcgccaacaacgcuggagacgaugucuuuacagucuccugcagaguacuaaccagaccaagcccagacuucgauuucaucuuucuaguuccuccuacaguugaaucaagaacaaaaccauuuaguguaccaauauuaacaguugaagaaaugaccaauucaagauucccaauucccuuagaaaaacuuuuuacaggaccaucuucugcauucgucguacaaccacaaaacggucgauguacaaccgaugguguauuacuuggaacuacacaauuaucuccaguaaacauauguaccuucagaggagauguuacacauauagcuggcacccaagaauauacuaugaauuuagcaucucaaaauuggaauaauuacgacccaacagaagaaauaccagccccuuuaggaacacccgauuuugucggaaaaauucaaggaguuuuaacacaaacaacaagaagagacggauccacaagaggacauaaagcaaccguauccacaggaucaguacauuuuacucccaaacuuggacgaauacaauucucaacagauacaagcaacgauuuugaaacaggacaaaauacccgauucacuccagucggaguaguacaagacgguuccacaacacaucaaaaugaaccacaacaauggguucuacccaauuacucaggaagagauucacauaacguacauuuagcaccagcgguagcccccucauuuccaggagaacaauuacucuucuucagaucaacaaugcccgguugcaguggauauccuaauaugaacuuagauugucuauuaccacaagaauggguucaacauuucuaucaagaagcagcacccgcccaaucagauguagcucuuuuacgcuucguaaauccugauacaggaagaguacucuuugaauguaaauuacauaaaucaggauacguaacagucgcacacacaggacaacaugaccuuguuaucccaccaaaugguuauuuucguuucgacagcuggguaaaucaauuuuauacauuagcaccaaugggaaauggaacaggcagaagaagagcauuauaa

SEQ ID NO: 31906 - RNA, 1623 nt, Artificial Sequence
  derived and/or modified sequence opt6 from VP1__Norovirus__BAG70449
augaaaauggcaagcaacgacgccaacccaucagauggaucagcagccaaccuaguaccagaaguuaacaaugaaguaauggcucuggaaccaguaguaggcgcugcaauugcagcaccaguagcuggccaacaaaaugucauagacccauggaucagaaauaacuucguacaagcaccaggaggagaauuuaccguaucaccaagaaacgcaccaggagaaauauuaugguccgccccacuuggaccagacuuaaauccauaucuaucucaccucgcaagaauguacaacucauacgcaggaggauuugaaguacaaguaauucuagcaggaaaugcauuuacagcaggaaaaauaauuuucgcagcaguaccaccuaacuuucccacagaaggacucucaccaucacaagucacaauguucccccauauaauaguagauguuagacaauuagaaccaguucuaauaccacuaccagacguacgcaacaauuucuaucacuacaaucaaucuaaugauccaacaauaaaauuaauagcaaugcuuuauacaccacucagagcaaacaaugcaggagaagauguauucacagucucuuguagaguauuaacacgaccuucaccugacuuugauuuuauauuuuuaguaccuccaacaguugaaucacgaacaaaaccauuuaccguaccaauauuaaccgucgaagaaaugaccaacucuagauucccaauaccucuagaaaaauuauuuacaggacccucaggagcauucguaguacaaccacaaaacggucgauguacaacugauggaguuuuacuaggcacuacacaauuaucuccaguaaauaucugcacauucagaggagauguaacucauauugcaggaucccguaacuacacaaugaauuuagcaucucucaacuggaauaauuacgauccaacagaagaaauaccugcuccauuaggaacaccagacuucguaggaaagauacaaggagugcuaacacaaacaacaaaaggagauggaaguacuagaggucacaaagcaacuguauauacaggaucagcucccuuuacaccaaaauuaggaucuguacaauucagcaccgacacagaaaacgauuuugaaacacaucaaaauacaaaauuuacccccguaggaguaauacaagacggaucuacgacacauagaaaugagccccaacaauggguauuaccaucuuacuccggaagaaauguacauaacguacauuuagccccagcaguugcaccaacauucccaggagaacaacuacuauuuuucagaucaacuaugcccggaugcuccgguuauccaaauauggaccuagacugucucuuaccacaagaauggguacaacauuucuaccaagaagccgcaccagcacaaucagauguugcacuacuacgauuuguaaauccagacacuggaagaguauuauuugaauguaaacuacauaaaucagguuauguaacagucgcacacacaggacaacacgaucuaguuauaccaccaaauggauauuucagauuugauucauggguuaaucaauuuuacacacuagcaccaauggguaacggaacaggaagaagacgagcccucuaa

SEQ ID NO: 31907 - RNA, 1623 nt, Artificial Sequence
  derived and/or modified sequence opt6 from VP1__Norovirus__BAG70452
augaaaauggcaucaaaugaugcaaauccaucagacggaagcgcagcaaauuuaguacccgaaguaaauaaugaaguuauggcauuagaaccaguaguaggugccgccauugcugcaccuguagcaggccaaacuaacguaauugacccauggauacgcaacaauuuuguacaagcaccuggaggagaauuuaccguuucaccccgaaaugcaccaggagaaauacuauggucagcaccauuagguccagaccuaaauccauaccuaagucauuuagcacgaauguauaacggauacgcuggaggauucgaaguacagguuauuuuagcaggaaaugcauuuaccgcaggaaaaauaauauuugccgcaguaccaccaaacuuucccaccgaagguuuaucaccaucacaaguaacaauguucccacauauaauuguagacguaagacaauuagaacccguacuaauuccauuaccagauguacgaaacaauuucuaccacuauaaccaauuaaacgacuccacaauaaaauuaauagccaugcucuauacuccacuuagagcaaacaaugcaggagaagaugucuuuacuguaucuuguagaguauuaacaagaccauccccagauuucgauuuuauauucuuaguaccccccacuguagaauccagaacgaaaccauuuaccguaccaauauuaacugucgaagaaaugacaaacucaagauuuccaauaccccuugaaaaacucuuuacaggucccucaggagcuuuuguuguacaaccacaaaacggaagauguacaacagacggaguacuauuaggaacaacccaacuauccccuguuaauauauguacuuuuagaggagacguaacucauauagcaggaucaagaaauuacacaaugaauuuagcaucccuuaauuggaacaauuacgauccaacagaagaaauaccagccccauuaggaacccccgacuucgucggaaaaauacaaggaguuuuaacucaaacaacaaaaggagacggaaguacccguggucauaaagcaaccguauauacaggaucugcaccauuuacaccaaaauuaggaucuguccaauucucaaccgauaccgaaaaugacuucgaaacacaucaaaauacaaaauuuacuccaguaggaguaauacaagacgguucaacuacacacaggaaugaaccccaacaaugggucuuaccaucauacucagguagaaauguacacaacguacacuuagcaccagcaguagccccuaccuucccaggagaacaauuacuauucuuucgcucaaccaugccuggauguucaggauaucccaauauggacuuagauugcuuacuaccacaagaauggguacaacauuuuuaucaagaagcugcuccagcacaaucugauguagcccuacuucgauucguaaacccagacaccggaagaguauuauucgaaugcaaacuacauaaaucuggauauguaaccguagcacacacuggucaacaugaucuaguaauaccaccuaauggauauuuuagauucgacuccuggguaaaucaauucuauacacuugcaccaaugggaaacggaacaggaagacgacgagcucuauaa

SEQ ID NO: 31908 - RNA, 1623 nt, Artificial Sequence
  derived and/or modified sequence opt6 from VP1__Norovirus__BAG70458
augaaaauggcaaguaaugacgcaaacccaagcgacggaucagccgcuaaccuaguaccagaaguuaauaaugaaguuauggcacuagaaccaguuguaggagccgcaauagcagcaccaguugcuggccaaacaaauguaauagacccauggauacgaaacaacuucguacaagccccaggcggagaauuuaccguauccccuagaaaugcaccaggcgaaauacuuugguccgccccacuaggaccugaucuaaauccauacuuaucacaccuugcaagaauguauaacggauaugcuggaggauuugaaguacaaguaauauuagcaggaaaugcauuuacagcugguaaaauaauauuugcugcagugccaccaaauuuuccuacugaaggacuaucaccaucacaaguaacuauguucccacauauuauaguugauguacggcaacuagaaccaguauuaauacccuuaccagacguaagaaauaauuucuaucacuauaaccaaucaaacgacucaacaauaaaauuaauagccauguuauacaccccacuaagagcaaacaaugcaggagaagacguauuuacaguuucaugcagaguauuaacccgaccuucccccgacuuugacuuuauauuuuuaguacccccaacaguugaaucacgaacuaagccauucacuguaccaauacuuacugucgaagaaaugacaaauuccagauuuccaauaccacuagaaaaacuauucacaggaccaucaggcgcauuuguuguacaaccccaaaacggaagaugcaccacugacggaguauuacucggaacuacacaacuaucaccaguaaauauauguaccuuucgaggagauguaacacauauagcaggaagcagaaauuauacaaugaacuuagcaucauuaaacuggaacaauuaugauccaacagaagaaauaccugccccacuaggaacaccagauuuuguagggaaaauacaaggaguauuaacucaaacaaccaaaggugauggauccacacgcggucacaaagcaacaguauacacagguucagccccauuuacaccaaaauuaggaaguguacaauucucaacagauacugaaaacgacuuugaaacccaccaaaacacaaaauucacucccguuggaguuauacaagacgguucaacaacacauagaaaugaaccacaacaauggguucuuccaucauauucuggaagaaauguacacaacguacaccuagccccugcagucgcaccaacauuuccaggagagcaacuauuauuuuucagaucgacaaugcccggcuguucaggauauccaaacauggacuuagacugucuauuaccacaagaauggguacaacacuucuaucaagaagcagcuccagcccaaucugauguagcuuuacuuagauucguaaauccugauaccggaagaguacuauucgaaugcaaacuucauaaaucaggcuauguaacugucgcacacaccggacaacaugacuuagucauuccaccaaauggauacuucagauuugauucuuggguaaaucaauuuuauacuuuagcuccaaugggaaauggaacaggccgucgaagagcacuauaa

SEQ ID NO: 31909 - RNA, 1623 nt, Artificial Sequence
  derived and/or modified sequence opt6 from VP1__Norovirus__BAG70461
augaaaauggcaucaaacgacgcuaacccaucagacggaucugcugcaaacuuaguuccugaaguuaacaaugaagucauggcacucgaaccaguaguaggagcugcaauagcagcaccaguagcaggacaacaaaacgucauagacccauggauacgcaacaacuucguacaagcaccugguggagaauuuaccguaucuccaagaaacgcacccggagaaauucucuggucagcaccucuaggacccgauuuaaauccauaucuaucccaccuagcaagaauguauaauggcuaugcaggaggauucgaaguccaagucauacuagcaggaaaugcauuuacagcuggcaaaaucaucuucgcugcaguaccaccaaauuuuccaacagaaggucuaucaccaucucaaguuacaauguucccacauauaauaguagacguacgacaauuagaaccagucuugauaccauuaccagacguaagaaauaauuucuaucacuauaaccaaucaaaugacucuacaauaaaauuaauagcuauguuauacacaccacuccgagcaaauaaugccggugaagacguauucacuguaucuuguagaguacuaacacgaccaucaccagauuucgauuucauauuucuaguaccaccuacaguagaaucacguacaaaacccuuuaccgucccaauauuaacaguagaagaaaugacuaacucacgauuuccaauaccccuugaaaaacuauucacuggaccaucauccgcuuuuguaguacaaccacaaaaugguagauguacuacagacggaguauuauuaggaacaacacaacuuucaccuguaaacauauguacauuuagaggagauguaacccacauagcuggaucccgaaauuacacaaugaaucuagcaucccuuaacuggaauaauuacgaucccacagaagaaauuccugcacccuuagguacuccagacuuuguaggcaaaauccaaggcguacuuacacaaacaacaaaaggagacggaucuacuagaggacauaaagcaacuguauauacaggaucugcuccauuuaccccaaaacuagguucaguucaauucagcacagauacagaaaaugauuuugaaacacaccaaaauacaaaauuuacuccaguaggugucauacaagauggaucuacaacacauagaaaugaaccccaacaauggguacuaccaucauauucaggacgaaauguacaaaauguucaucuagcaccagcaguugcaccaacauuuccaggagaacaacuccucuuuuuccgaucaacuaugccaggcugcucagguuacccaaacauggaccuagacugccuauuaccccaagaauggguucaacauuucuaccaagaagccgcacccgcccaaucagacguagcacuauuaagauucguaaacccagauacaggaagaguccuauucgaauguaaauuacauaaauccgguuauguaacuguugcacacacuggacaacacgauuuagucauuccaccuaauggcuauuuccgauucgauucauggguaaaucaauuuuauacacuagccccaaugggaaacggcaccggcagaagacgugcauuauaa

SEQ ID NO: 31910 - RNA, 1623 nt, Artificial Sequence
  derived and/or modified sequence opt6 from VP1__Norovirus__BAG70464
augaaaauggcaucuaaugaugcaaauccuuccgauggaucagccgcuaauuuaguaccagaaguaaacaaugaaguaauggcacuagaaccaguaguaggagcagcaauagcagcaccaguugcuggccaacaaaaugucauugaucccuggauacgaaauaauuuuguacaagcuccuggaggagaauuuacugucucaccucgaaaugcuccaggcgaaauacuaugguccgcaccacuugguccugauuuaaaccccuacuuaucacauuuagcacgcauguauaacggauacgcaggaggauuugaaguacaaguaauauuagccggaaacgcauuuacagcuggaaaaauaaucuucgcagcaguaccaccaaauuuuccaacugaaggucuaaguccaucucaagucacaauguuuccacacauaauaguugauguaagacaacuagaaccaguauuaauaccccuccccgauguuagaaacaauuucuaccauuacaaucaaucaaacgacucaaccauaaaauuaauagcuauguuauauacaccuuuaagagcaaacaacgccggagaagacgucuuuacaguauccuguagaguacuaacuagaccaucaccagacuuugacuuuauauuucucgucccaccaacuguagaaucaagaacaaaaccauucacuguaccuaucuuaacaguagaagaaaugacaaacucuagauuuccaauaccauuagaaaaauuauucacaggaccaucaucugccuuuguuguccaaccacaaaaugguagauguacuacagacgggguauuauuaggcacuacacaauuauccccagucaauauaugcacauucagaggugaugucacccauaucgcagguucuagaaauuacacaaugaaucucgcaucacuuaacuggaacaauuaugacccaaccgaagaaauaccagcaccauuaggaacaccagacuucguaggaaaaauacaaggcguacuaacacaaaccaccaaaggcgacggauccaccagaggacacaaagccacgguauacacaggaucugcuccauucacaccuaaacucggaucuguacaauucucaaccgauacagaaaaugacuuugaaacacaccaaaauacaaaauucacucccguaggaguaauacaagauggcucaacaacacacagaaacgaaccacaacaauggguacuaccaucauauucaggacgaaauguacaaaacguucaccuagcuccagcaguagcacccacauuuccaggagaacaauuauuauuuuuuagaucaacaaugccaggaugcucaggauaccccaacauggauuuagacugccuacucccucaagaauggguacaacauuuuuaccaagaagcagcaccagcacaauccgacguagcucuucuacgauuuguuaacccagacacuggaagaguccuauucgaaugcaaauuacauaaaucaggauauguaacuguagcacacacuggucaacaugaccuugucauuccucccaacgguuacuuucgcuucgauucauggguaaaccaauuuuauacauuagccccaauggguaacggcaccggacgaagacgcgcacuauaa

SEQ ID NO: 31911 - RNA, 1623 nt, Artificial Sequence
  derived and/or modified sequence opt6 from VP1__Norovirus__BAG70467
augaaaauggcaagcaacgaugcaaacccuuccgauggaucagccgccaacuuaguaccagaaguuaacaacgaaguaauggcauuagaaccagucguuggagcugcaauagcagcaccaguagcagggcaacaaaauguaauagauccauggaucagaaauaacuucguacaagcaccuggaggugaauuuacaguaucaccaagaaacgcaccaggagaaauacuauggucagcaccauuaggaccagacuuaaauccauaucuaucacauuuagcaagaauguauaauggauaugccggcggauucgaaguacaaguaauauuagcaggaaacgccuucacagcggguaaaauaauauucgcagcaguaccaccaaauuuucccacugaaggacuaucacccucacaaguuacaauguucccacauauaauagucgacgucagacaacuagaaccaguacuaauuccauuaccagauguuagaaacaacuucuaucacuauaaccaaucuaacgacucaacaauaaaacuaauugcaauguuauacaccccacuacgagcaaacaacgcuggcgaagauguauuuacaguaucaugcagaguucuaaccagaccuagcccagacuuugauuucauuuuucuaguucccccaacaguagaaucccgaaccaaaccuuuuacaguaccuauacucacaguagaagaaaugacaaacucaagauucccaauaccauuagaaaaacuauuuaccggaccuucaagcgcauucguaguacaaccacaaaacggaagaugcacaacagacggaguauuacuaggaaccacacaacuaucaccagucaauauauguacauuuagaggugaugucacacacauagcuggaucaagaaauuacacuaugaauuuagccagccuuaauuggaacaacuacgauccaacagaagaaauuccagcaccauuaggaacuccagacuuugucggaaaaauucaaggaguccuaacacaaacuacaaaaggugacgguucaacaagaggacacaaagcaacaguauauacaggauccgcaccauuuacgccaaaauuaggauccguccaauucuccacagacacagaaaacgacuuugaaacacaucaaaacacaaaauucacaccaguaggcgucauccaagacgguuccacuacacauagaaacgaaccacaacaauggguacucccuucuuauucaggacgaaauguacaaaacguucauuuagcucccgcaguagcaccaacauuuccaggagaacaacuccucuucuuucgaucaacaaugccaggcugcucaggauauccaaacauggaccuugauugucuacuaccacaagaauggguacaacauuucuaucaagaagcagcccccgcacaaucagacguugcuuuauuaagauucguaaacccagacacagguagaguacuauucgaauguaaauuacauaaauccggauacguuacaguagcacauacaggacaacacgauuuaguaauaccuccaaauggauauuuucgauucgauuccuggguaaaccaauucuacacauuagcaccaaugggaaauggaacaggcagacgaagagcccuauaa

SEQ ID NO: 31912 - RNA, 1623 nt, Artificial Sequence
  derived and/or modified sequence opt6 from VP1__Norovirus__BAG70470
augaaaauggcuuccaacgacgcaaacccaucugacggaucagcagccaauuuaguaccagaaguaaacaaugaagucauggcauuagaaccaguaguaggagcugcaauagcugcaccaguagcuggacaacaaaacguaauagauccauggauaagaaauaacuucguucaagcucccggaggagaauucacaguaucaccacguaaugcuccuggcgaaauacuauggucagcuccucuagguccugaucuuaaucccuacuuaucacaucuagccagaauguauaauggauacgcuggaggauucgaaguacaaguaauauuagcaggaaaugcauuuacagcaggcaaaauaauauucgcggcaguaccaccaaauuuuccaaccgaaggacuaucuccuucacaaguaacaauguuuccacauauuauaguagacguaagacaacuagaaccaguauuaauaccacucccagauguaagaaacaauuucuaucacuauaaucaaucaaacgauucaacaauaaaauuaaucgcaaugcuuuacacuccccuaagagcaaauaaugcaggugaagauguauuuacaguaucauguagagucuuaacuagaccaucacccgacuuugacuuuauauuuuuaguaccuccaacaguagaaagccgaacaaaacccuucacaguaccuauacuaacaguagaagaaaugacuaauucaagauucccaauaccccuagaaaaacuauuuacuggccccucaggagcauucguaguacaaccccaaaacggucguugcacaacagacggaguacuuuuaggaaccacacaauuaucaccaguaaauauaugcacauucagaggagacgucacacauauagcaggaucuagaaauuauacuaugaaucuagcaucacuuaacuggaacaauuaugacccuacagaagaaauaccagcuccacuuggaaccccagacuucgucggcaaaauacaaggaguauuaacacaaacaaccaaaggagauggaucaacucgcggacacaaagcaacaguauacacaggaucugcuccauucacuccaaaauuaggaucuguacaauucucaacagauacagaaaaugacuucgaaacucaucaaaauacuaaauucacuccagucggaguaauacaagaugguucaaccacccacagaaacgaaccacaacaauggguauuaccaucauauucaggacgaaacguucacaacguacauuuagcaccagcagucgcaccgacauucccaggugaacaauuacuuuucuuuagaucaacaaugccaggauguucaggauaucccaauauggaucuagauugucuacuaccacaagaauggguacaacauuucuaucaagaagcagcuccagcacaaucugacguagcuuuauuaagauuuguaaacccagacacaggaagaguauuauuugaaugcaaacuacacaaaucaggauaugucaccguagcacacacaggacaacaugaccuaguaauacccccaaaugguuauuuccgauuugauucauggguaaaucaguucuauacacuugcaccaauggguaauggaacaggccgacgacgagcccuauaa

SEQ ID NO: 31913 - RNA, 1623 nt, Artificial Sequence
  derived and/or modified sequence opt6 from VP1__Norovirus__BAG70473
augaaaauggcaucaaacgaugcaaacccaucagauggaucagcagcuaaccuaguuccagaaguaaacaaugaaguaauggcauuagaacccguugucggagcagcuauagcagcuccaguagcaggucaacaaaauguuauagacccauggaucagaaauaacuuuguacaagccccuggaggugaauuuaccguaucacccagaaaugcaccaggugaaauuuuauggucugcaccacucggaccagaucucaaucccuaccuaucacauuuagcccgaauguauaacggauaugcgggaggauucgaaguucaaguaauauuagcaggcaacgcauucacugcaggaaaaaucaucuuugcagcaguaccaccaaacuucccaacggaaggucuaucaccaucucaaguuacaauguuuccacauauaauaguagauguaagacaacucgaacccguacuaauaccauuaccagauguuagaaauaauuuuuaccacuauaaccaaucuaaugacuccacaauaaaacuuauagcaaugcucuacacaccucuuagggcuaacaaugccggagaagaugucuucacaguaucauguagaguucucacaagaccaucaccagacuuugauuuuauauuuuuaguaccuccuacaguagaaagcagaacaaaaccauucacugugcccauccuuacaguagaagaaaugaccaacucgagauuuccaauaccacuugaaaaacucuuuaccggacccuccggagcuuucguaguacaaccacaaaauggaagauguacaacagacggaguacuuuuaggaacaacacaacuaucaccagucaacauauguaccuuuagaggagacguaacacauauugccggaucaagaaacuacacaaugaauuuagcuucauuaaacuggaacaacuacgacccaaccgaagaaaucccagcaccccuaggaacuccagauuuuguaggaaaaauacaaggaguauuaacccaaacaacaaaaggugacggaucaacacgcggacauaaagcaacaguauacaccgguucagcaccuuucacuccaaaacucggcucuguacaauucucuacugauacagaaaacgacuuugaaacccaccaaaacacaaaauuuacuccagucggcguuauacaagaugguaguacaacucaccgcaacgaaccacaacaauggguccuaccaucauauucuggacgaaauguucacaacguacauuuagcuccagcaguugccccuacauucccaggcgaacaauuacuauucuuuagaucuacaaugccuggauguucaggauacccaaauauggaucuugauugccuuuuaccacaagaauggguccaacauuucuaccaagaagcagcaccagcacaaucagacguagcauuauuacgauuuguaaacccagacaccggaagaguacuauucgaaugcaaacuacacaaaucaggcuauguuacaguagcacacacuggacaacacgauuuaguaauucccccaaacggauauuucagauuugauucauggguaaaucaauuuuacacacuagcaccaauggguaauggaacagguagaagacgagcacuauaa

SEQ ID NO: 31914 - RNA, 1623 nt, Artificial Sequence
  derived and/or modified sequence opt6 from VP1__Norovirus__BAG70476
augaaaauggcuuccaacgacgcuaauccaagcgauggaucagccgcaaaccucguaccagaaguaaauaaugaaguaauggcacuagaaccaguaguaggugcagcaauagcagcaccaguagcaggacaacaaaauguaauagacccauggauaagaaauaauuuuguucaagcaccaggaggugaauuuacaguuuccccaagaaaugcaccaggugaaauacuauggucugcuccacuagguccagaccucaauccauaucugucccauuuagcacgcauguacaacggauaugcaggaggauuugaaguacaaguaaucuuagcaggcaaugcauuuacagcaggcaaaauaauuuucgcagcaguaccaccaaacuucccaacagaaggcuuaucaccaucacaaguuacaauguuuccacauauaauaguagacguacgacaauuagaaccaguacuaauuccauuacccgauguaagaaacaauuucuaucauuacaaucaaucaaaugacucaacaauuaaauuaauagcuauguuauauacaccucuuagagcuaauaaugcaggagaagacguauuuacagucucaugcagaguauugacaagaccuagcccagacuuugauuuuauauuucucguuccaccuacaguagaaucacgcacaaaaccuuucacagucccaauacuaacagucgaagaaaugacaaacucuagauuuccaauaccuuuagaaaaauuauuuaccggaccaucaggggcauuuguaguucaaccacaaaauggaagaugcaccacagacggagucuuacuagggacaacacaauuaagcccuguaaacauauguaccuuucgaggugacguaacacauauagcagguuccagaaauuacacgaugaauuuagcaucauuaaacuggaauaauuaugauccaacugaagaacuaccugccccucuaggcacaccugacuuuguuggaaaaauccaagguguauuaacccaaaccacuaaaggcgauggaucaacaagaggccacaaagcaacuguauauacaggcucagccccauucacaccaaaacugggaucaguccaauucucaacagacacagaaaacgacuuugaaacacaccaaaauacaaaauuuaccccaguaggagucauacaagacgguuccacaacacaucgaaacgaaccucaacaauggguauuaccuaguuauaguggaagaaauguacauaacguccaccuagcaccagccgucgcaccgacauuuccaggagaacaacuacuauuuuuccguucaacaaugccaggauguucaggcuauccaaauauggaucuagauugccuucuuccacaagaauggguacaacauuuuuaucaagaagcagcaccagcacaaucagacguagcacuucuaagauuuguuaaucccgacaccggaagaguacucuucgaaugcaaauuacauaaaucagguuauguuacaguagcucacacaggacaacaugaucuaguuauacccccaaauggauacuucagauucgauucuuggguaaaccaauuuuacacauuagcaccaaugggcaauggaacuggacgaagaagagcuuuauaa

SEQ ID NO: 31915 - RNA, 1623 nt, Artificial Sequence
  derived and/or modified sequence opt6 from VP1__Norovirus__BAG70482
augaaaauggcaucaaaugacgcaaauccuucagaugguucagccgcaaacuuaguaccugaaguaaacaacgaaguaauggcucuugaacccguaguaggcgcagcaauagcugcaccuguugcuggucaacaaaacgucauugauccuuggauaagaaauaauuucguacaagcaccaggaggugaauucacaguuucaccacgaaaugcaccuggcgaaauacuauggucagcaccacucggucccgauuuaaauccauauuuaucacacuuagcaagaauguacaauggauaugccggaggauucgaaguacaaguaauccuagccggaaaugcauuuacagcaggaaaaauuauauuugcagcuguuccaccaaauuuuccaacagauggucuaucaccaagucaaguaacaauguucccacauauuauaguagacgucagacaauuagaacccguacuuauuccguuaccugauguaagaaacaauuucuaucauuauaaccaaucuaaugauagcacaauuaaacucauagcuaugcuuuacacaccauuaagagccaacaaugcaggugaagacguuuucacaguaucauguagaguacuaacuagaccaucaccugauuuugacuuuaucuuucuaguuccuccaacaguagaaucccguacaaaaccauuuacuguuccaauauuaacaguugaagaaaugaccaacucuagauuuccaauaccacuagaaaaacuauuuacaggaccaucaucagcauuuguuguacaaccacaaaacggcagauguacuacagacggaguauuauuaggaaccacucaauuaucuccaguaaauaucuguaccuuuagaggugauguuacucauauugccggaagcagaaacuauacaaugaaucucgcaucacucaacuggaauaacuacgacccaaccgaagaaauaccagcaccacuaggaacaccagacuuuguaggaaaaauacaaggaguuuuaacacaaaccacuaaaggugacggaucaacaagaggacauaaagccacaguauacacugguucagcaccauuuacaccaaaacuaggaucaguacaauucucuaccgauaccgaaaacgauuuugaaacucaucaaaacacaaaauucacaccaguuggaguaauacaagaugguggaacaacacacagaaaugaaccacaacaauggguuuuaccaucauacucagguagaaauguacauaacguacaccuagcaccagcaguugcaccaaccuuccccggagaacaacuacuauuuuuuagaagcacaaugcccggaugcucaggcuauccaaauauggaucuagauugucuucuaccacaagaauggguacaacacuucuaucaagaagccgcucccgcacaaucagauguagcacuccuuagauucguaaacccugacacuggaagagucuuauucgaauguaaacuacauaaaucgggcuacguuacaguagcucacacaggacaacacgaccuuguuauuccacccaauggcuacuuuagauucgauucauggguaaaucaauuuuauacauuagcaccaaugggaaauggaacaggucgacgacgagcguuauaa

SEQ ID NO: 31916 - RNA, 1623 nt, Artificial Sequence
  derived and/or modified sequence opt6 from VP1__Norovirus__BAG70485
augaaaauggcaucaaaugacgccaacccuagcgaugguucugccgcaaacuuaguaccagaaguaaauaaugaaguaauggcucuugaaccaguaguaggagcagcaaucgcagccccuguugcaggacaacaaaauguaaucgacccauggauaagaaauaauuucguucaagccccaggaggagaauuuacaguauccccuagaaaugccccaggcgaaauauuauggucagccccacuagguccugauuuaaacccauauuuaucccauuuagcaagaauguacaacggauacgcaggagguuuugaaguacaaguaauacucgcaggaaaugcuuuuacagcuggaaaaauaauauucgccgcuguuccaccuaauuuuccaacagaaggccucucaccaagucaaguaacuauguuuccacacauaauaguugacguaagacaacuagaaccaguacuuauaccacucccagacguaagaaacaauuucuaccauuauaaucaaucaaacgauaguacaauaaaauuaauagcuauguuauacacuccauuaagagcaaacaaugcuggagaagacgucuuuacaguaucuugccgaguauuaaccagaccauccccagauuuugauuucauauuuuuaguccccccaacaguagaaucaagaacuaaaccuuucacaguaccuauacucacaguugaagaaaugacaaacucacgauuuccaauaccauuagaaaaacuauucacuggaccaucaucagcauucguuguucaaccccaaaauggcagauguacaacagacggaguauuauuagguacaacacaacuaucuccaguuaauauaugcacauucagaggugacguaacucauauagcaggaucacgaaacuacacaaugaacuuagcaucacucaauuggaacaacuacgaucccaccgaagaaauaccugcuccacuagguacaccugauuuuguaggaaaaauucaaggaguccuaacucaaacaaccaaaggugacggaucuacaagaggucauaaagcaaccguauacacaggaucagcaccauuuacaccaaaacuaggaucuguccaauuuucuacagauacagaaaacgauuuugaaacacaucaaaacacaaaauuuacaccaguaggaguaauacaagacggaucuacaacacaucguaaugagccacaacaauggguauuaccaaguuacucaggaagaaauguucaaaacguacaccuagcaccagcaguagcaccaacauuuccaggagaacaauuauuauucuuucgaaguacaaugccaggaugcucaggauacccaaauauggacuuagauugcuuacuaccccaagaauggguacaacacuucuaucaagaagcugccccagcucaaucagauguugcauuguuaagauucguuaacccagauacuggucgcguacuauucgaauguaaacuacauaaaucagguuauguaacaguagcacacacaggacaacacgaucuuguaauaccccccaacggcuauuucagauucgauucauggguaaaccaauuuuacacucuagcuccuauggguaauggaacuggcagacgaagagcacuauaa

SEQ ID NO: 31917 - RNA, 1623 nt, Artificial Sequence
  derived and/or modified sequence opt6 from VP1__Norovirus__BAG70488
augaaaauggcaucaaaugacgcaaauccaucugacggaucagcagcuaauuuaguccccgaaguaaauaaugaaguuauggcacuagaaccaguaguaggugcagcaauagccgcuccaguagcaggacaacaaaauguaauagaucccuggauccgaaacaauuuuguccaagcaccaggaggagaauucacuguaaguccaagaaacgcaccaggagaaauauuauggucagcaccacuaggaccugaucucaauccauaucucagucacuuagcaagaauguauaacggauaugcaggaggauuugaaguucaaguuauauuggcagguaaugcuuuuacagcaggaaaaauuauuuucgcagccguaccaccaaauuuuccaacagaaggucuaucccccucacaaguaacaauguucccacauauaauuguagacguucgacaauuagaaccaguacucauucccuuaccugacgucagaaauaauuuuuaucauuauaaucaauccaaugauucaacuauaaaacuaauagcuaugcuauauacaccuuuaagagcaaauaaugcuggagaagauguauucacaguaucuugucgaguuuuaacacgaccuucucccgacuuugauuuuauuuuucuaguaccuccaacaguagaaagcagaacaaaaccauuuaccguucccauacuaacaguugaagaaaugacaaacucacgauucccuauaccucuugaaaaauuauuuaccgguccaucaucagcauucguaguacaaccucaaaacggacgauguaccacagacggaguauuacuaggaacuacacaauuaucaccaguaaauauauguacauucagaggagacguaacgcauauagccgguucaagaaauuauacgaugaaucuagcaucucuaaauuggaauaauuaugacccuacagaagaaauucccgcaccauuaggaacaccagauuuuguaggaaaaauucaaggcguuuuaacacaaacaacuaaaggugacggcucaacacgaggccacaaagcaacaguauauaccgguucugcaccauucacaccaaaauuaggaucaguucaauucucaacagacacugaaaacgauuuugaaacacaucaaaacacaaaauuuacaccaguaggaguuauacaagauggauccacaacucaccgaaacgaaccccaacaauggguuuuaccuaguuauucaggacgcaacguucaaaacguacacuuagcuccagcaguagcgccaacauucccgggagaacaauuacuauuuuuccgaucuacaaugccaggaugcucagguuauccuaacauggaccuagauugucuauuaccacaagaauggguacaacacuucuaucaagaagcagcaccagcccaaucagacguagcccuauuacgauuuguaaaccccgacacagguagaguauuauuugaauguaaacuacacaaauccgguuacguuacuguagcacauacaggacaacacgaccuuguaaucccaccuaacgguuauuucagauuugauucuuggguaaaucaauuuuauacuuuagcaccaaugggcaaugguacaggucguagacgcgcauuauaa

SEQ ID NO: 31918 - RNA, 1623 nt, Artificial Sequence
  derived and/or modified sequence opt6 from VP1__Norovirus__BAG70491
augaaaauggcaucaaacgaugcaucaccaucagauggauccacagcaaacuuaguaccagaaguaaauaaugaagucauggcacuagaacccguaguaggagcagcaauagcagcuccaguugcaggucaacaaaaugucauagacccauggauacgcaauaacuuuguacaagcuccaggaggggaauuuacaguaucuccacgcaacgcaccuggagaaauacuuuggucagccccucuaggcccagauuuaaauccauacuuaucacacuuagccagaauguacaaugguuacgcaggcggauucgaaguacaaguaauuuuagcaggaaacgcauuuacagcaggcaaaauaauauucgcagcuguaccaccaaacuuuccaacagaaggacuaucaccuagucaaguuacaauguucccacauauaaucguagaugucagacaauuagaaccaguacucauuccauuaccugaugucagaaauaauuucuaucacuauaaccaaucaaacgacuccacaauaaaauuaauagcuaugcuauauacaccacuacgagcaaacaaugcaggagacgauguauuuacaguauccugcagaguacuaacaagacccucaccagacuuugauuuuaucuuccuaguaccaccaacuguagaaucaagaacaaaacccuuuacaguaccuauauuaacuguugaagaaaugacaaauucacgauucccaauaccacuagaaaaacuauucacuggaccauccagugcauucguaguacaaccccaaaauggaagauguacaacagauggcguauuauuagguacaacacaacuaaguccaguaaacauauguacauuccgaggugacgucacccacaucccuggaacacgaacuuaccgaaugaaucuagcaucccaaaauuggaacaacuacgauccuacagaagaaauaccagcaccucucggaacccccgacuucguaggaaaaauacaaggaauguuaacccaaacaacaaaaggugacggaucaaccagaggucacaaagcaacaguaucaacaggaucaguagacuuuaccccaaaauuaggaucaguacaauucgcaacagauacagauaacgacuuugaaacaggucaaaauaccagauuuacuccuguuggaguuauacaagacggaaguucaacacauagaaacgaaccccaacaguggguacuuccugacuauuccggaagaacugcacacaacguacacuuagcaccagccguagcuccaacauuuccaggagaacaacuuuuauucuuucgaucaacaaugcccggaugcucaggauauccuaacauggauuuagauugcuuacuaccccaagaauggguacaacauuuuuaucaagaagccgcacccucacaaucagacguagcauuacuuagauucgucaauccagacacuggaagaguauuauuugaaugcaaacuacacaaagcaggauauguaacaguagcucacacaggucaacaugaucucguaauacccccaaauggauauuuucgcuuugacucauggguuaaucaauuuuacacauuagcaccaaugggaaacggcgcaggaagaagaagagcauuauaa

SEQ ID NO: 31919 - RNA, 1623 nt, Artificial Sequence
  derived and/or modified sequence opt6 from VP1__Norovirus__BAG70494
augaaaauggcaucaaacgacgcaaacccaucagacggaucagcagcaaaccuaguaccagaaguaaacaacgaagucauggcacuagaacccguaguaggagccgcaauagcagcacccguagcaggccaacaaaauguaauugacccauggauccgaaacaauuuuguacaagcuccaggcggcgaauuuacugucuccccaagaaaugcaccuggcgaaauauuauggucagcaccucuagguccagaucuaaauccguaucuuucccacuuagcaagaauguauaacgguuacgcaggugguuucgaaguucaagucauacuagcaggaaaugcauuuacagcuggaaaaauaauauucgcagcaguaccaccuaacuuuccuacagaagguuuaucuccaucacaaguaacuauguucccacacaucauaguagacguucgucaauuagaaccagucuuaauacccuuacccgauguaagaaauaacuuuuaucacuacaaucaaagcaaugauucaaccaucaaacucauagcaauguuauacacaccacuaagagcaaacaaugcuggagaagauguauuuacuguaucaugcagaguauuaacuagaccaucaccagacuucgacuuuauauuccuaguacccccaacaguagaaucuagaaccaaaccauuuacaguaccaauauuaacaguagaagaaaugacaaacucucgcuuuccaauuccacuagaaaaacuuuuuacaggccccucaggagcauucguuguacaaccccagaaugguagauguacaacagauggagucuuacuugggaccacucaguuaucacccguaaauauauguaccuuucgaggagacguaacucacauagcuggaucaagagauuauacaaugaaccuagcauccuuaaauuggaauaacuacgauccuacagaagaaauaccugcaccauuaggcaccccagacuuuguaggaaaaauacaaggagucuuaacacaaacaaccaaaggagacggaucuacaagaggacacaaagcaacuguuuauaccggaucugcaccauuuacaccuaaacuagguucuguucaauucucuacagacacagaaaacgauuucgaaacucaucaaaauacuaaauucacaccagucggcguaauacaagacggauccacaacacauagaaaugaaccacaacaaugggugcuaccaucauauucaggaagaaauguacauaacguacaccuagcaccagccguagcaccuacuuucccaggcgaacaacucuuauucuucagaucaacuaugccuggaugcucaggauauccaaauauggaucuagauugcuuauuaccacaagaauggguacaacauuucuaucaagaagcagcaccagcacaaucagacguagcacuacuaagauucgucaacccugacaccgguagaguacuauucgaauguaaauuacauaaaucaggauacguaaccguagcacauacuggacaacacgaucuaguaauaccaccaaauggauauuucagauucgauucauggguaaaucauuucuauacacuagcucccaugggcaauggaaccggacgaagaagagcacuauaa

SEQ ID NO: 31920 - RNA, 1623 nt, Artificial Sequence
  derived and/or modified sequence opt6 from VP1__Norovirus__BAG70497
augaaaauggcaucaaaugaugccaauccaucugauggcucagccgcaaacuuaguaccugaaguuaacaacgaagucauggcacucgaaccuguaguuggagccgccaucgcagcaccaguagcaggccaaacaaauguuauugauccauggaucagaaacaacuuuguacaagccccuggaggagaauuuacaguuaguccucguaaugcaccaggagaaauauuauggucagcaccucuaggaccagaucuaaaucccuaucuuucacacuuagccagaauguacaauggcuaugcaggaggauucgaaguucaaguaauacucgccggaaaugcuuuuacagcagguaaaauaaucuuugcagcaguaccaccaaauuuuccaacagaaggccuaucacccucccaaguuacaauguuuccacauauuauaguugauguccgacaacuagaaccaguacuaauacccuuaccagauguacgaaacaauuucuaccacuauaaucaauccaaugacucuacuauuaaacuaauugcuauguuauauacucccuuaagagcaaacaaugcaggggaagauguauuuacaguaucauguagaguacuaacaagaccaagccccgacuuugauuucauauuucuaguaccuccaacaguagaaucacgcacuaaaccauucacuguuccaauacuaacugucgaagaaaugacuaacucaagauucccuauaccacuagaaaaacucuuuacaggaccuucaggagcauucguaguacaaccacaaaacggacgauguacuacugauggcguacucuuagguacaacacaacuaucaccuguuaauaucuguaccuuccgaggagauguaacacacauagcaggaucucgaaauuacacaaugaaccuagccucacucaauuggaacaacuacgacccaacagaagaaauccccgcucccuuaggaacaccagacuucguagguaaaauacaagguguacugacccaaaccacaaaaggagacggaaguacaagaggacauaaagcaacaguauacaccggauccgcuccauucacaccaaaacuagguaguguacaauuuucuacagacacagaaaacgauuucgaaacucaucaaaacacaaaauucacucccguaggaguaauacaagacgguucaacaacacacagaaacgaaccacaacaauggguauuaccaucauauuccggaagaaacguacacaacguacacuuagccccagcaguagcuccaaccuucccaggcgaacaacuccuauucuuucguucaacaaugccagguugcucugguuauccuaauauggauuuagauugcuuauuaccacaagaauggguacaacauuucuaccaagaagccgcaccagcacaaucagacguagcacuacuaagauucguaaacccagacaccgguagaguacuauuugaaugcaaacuucauaaaaguggcuauguaacaguagcacauacuggacaacaugauuuaguuaucccaccaaauggauacuucagauucgauucauggguaaaucaauucuacacauuagcuccaaugggaaacggcacuggaagacgaagagccuuauaa

SEQ ID NO: 31921 - RNA, 1623 nt, Artificial Sequence
  derived and/or modified sequence opt6 from VP1__Norovirus__BAG70503
augaaaauggccucaaaugaugccaacccaucagacggauccgcugcaaaccuuguaccagaaguaaauaacgaaguaauggcauuagaaccaguaguuggagcugcaauagcagcaccagucgccggccaacaaaauguaauugacccuuggaucagaaauaacuucguucaagcaccagguggagaauucacaguuucaccccgaaacgccccaggagaaauuuuauggucugcaccacuaggaccagaucuaaacccauaucuaagucaucuagcaagaauguacaacggcuacgcaggaggauucgaaguacaaguaauauuagcaggaaacgcauuuacagcaggaaaaauaauauucgcugcaguaccuccaaauuuuccuacagaaggucuuucccccucacaaguaaccauguucccucauauaauaguagacguuagacaacuagaaccaguauuaauaccacuaccagauguaagaaauaauuucuaucauuacaaucaaucaaaugacucuacaauaaaauuaauagccaugcuuuacacaccacuaagagcaaacaaugcaggagaagacguauucacaguuaguugucgaguuuuaacaagaccaucuccagacuuugacuucaucuuuuuagucccaccaacaguugaaucacgaacaaaaccauucacugucccaauauuaacagucgaagaaaugacaaacucaagauuuccaauaccccuagaaaaauuauuuacaggccccucuggagcauuuguaguacaaccccaaaauggacguuguacaaccgaugguguacuacuaggaacuacucaacuuucacccguaaauauaugcaccuuuagaggagacgucacacauauagcaggcacaagaaacuacacaaugaaucuugcaucacuaaacuggaacaacuacgauccaacagaagaaauaccugcaccacucggaacaccugauuuuguuggaaaaauacaagguguacuuacucaaacaaccaaaggagacggaucaacaagaggccacaaagcaacagucuacacaggcucagcaccauucacucccaaauuaggcucaguccaauucucaacagauacugaaaacgauuuugaaacucaccaaaauaccaaauucacaccaguaggaguuauacaagacggaggaacaacucacagaaacgaaccacaacaauggguauuacccaguuauucaggaagaaauguacacaacguccaccuugcaccagcagucgccccuacauucccaggcgaacaacuauuauucuuucgcucaacaaugccaggauguucagguuaccccaauauggaucuagauugccuucuaccacaagaauggguucaacacuucuaucaagaagcagcaccagcacaaucugacguggcauuaaugagauucguaaauccagacacaggccgaguauuauucgaaugcaaacuacauaaaucuggauaugucacaguagcacauacuggacaacacgauuuaguaauaccccccaauggauauuuuagauuugacucauggguuaaucaauuuuacacucuagcaccaauggguaauggaacaggacgacgacgagcacuauaa

SEQ ID NO: 31922 - RNA, 1623 nt, Artificial Sequence
  derived and/or modified sequence opt6 from VP1__Norovirus__BAG70506
augaaaauggcaucaaaugaugcaaacccuucugauggaucagcagcaaauuuaguacccgaaguaaacaacgaaguaauggcauuagaacccguaguaggagccgcaauagcagcaccugucgcuggacaaaccaauguaauagauccauggauuaggaacaauuuuguacaggcuccaggaggagaauucacaguuucuccacgaaaugcaccaggcgaaauauuauggagugcaccacuaggaccagaccucaacccuuauuuaucgcacuuagcacgcauguacaacggauacgcuggaggcuuugaaguccaaguaauauuagcaggcaaugcauuuacagcaggaaaaaucauuuucgcugccgugccaccaaacuuuccuacagaaggacuaucaccaucacaaguaacaauguuuccacauauuauaguagacgucagacaacuagaaccaguucuaauaccauuaccagacguaagaaacaauuucuaccauuauaaucaaucaaaugacucaacaauaaagcuaauagccauguuauauaccccauuaagagcaaauaacgcaggagaagauguuuuuacaguaucaugcagaguauuaacacgaccuucaccagacuuugauuuuauauuccugguaccacccacagucgaaucucgaaccaaacccuuuacaguaccaauauuaacaguagaagaaaugacaaacagccgcuuuccaauaccauuagaaaaacuauucacaggaccaucaggagcauucguaguacaaccacaaaauggcagaugcacaacagacgguguuuuauuagguacuacacaauuaagcccagucaauauauguaccuuccgaggugacguaacacauauagcaggaucacgaaauuacacaaugaacuuagccagcuuaaacuggaauaauuacgaccccacagaagaaaucccagcaccacuaggaacaccagacuucguaggaaaaauacaaggaguauuaacacaaacaacaaaaggugauggcucaacaagaggacacaaagcaacaguauauacaggaucagcaccauucacaccaaaacuaggcuccguacaauucuccacagauaccgaaaaugauuucgaaacacaucaaaauacaaaauucacaccaguagguguaauacaagacggaucaacuacacaccgaaaugaaccacagcaauggguucuccccucuuauucaggcagaaauguccauaacguacacuuagcaccagccguagcaccaacauuuccaggagaacaauuacuauucuucagaucuacaaugccugguuguuccggauauccaaauauggaucuugacugcuuauuaccacaagaauggguacaacacuucuaucaagaagccgcuccugcucaaagcgauguagcucuacuaagauucguaaacccagacacagguagaguacuuuucgaaugcaaacuacauaaaucuggauauguaaccguagcccacacuggccaacacgacuuaguaauaccaccuaauggcuauuucagauucgauuccuggguaaaccaauucuauacuuuagcuccaaugggaaacggaacaggaagacgcagagcacucuaa

SEQ ID NO: 31923 - RNA, 1623 nt, Artificial Sequence
  derived and/or modified sequence opt6 from VP1__Norovirus__BAG70509
augaaaauggcauccaacgacgcaaaccccucagauggaagugccgcaaaccuaguuccugaaguuaacaaugaaguaauggcccuagaaccaguagugggagcagcaauagcugcaccaguagcaggacaacaaaacguuauagauccauggauuagaaauaauuucguacaagcaccaggaggagaauuuacaguaucaccaagaaaugcaccuggagaaauauuauggucugcaccuuuaggaccugacuuaaauccauauuuaucacacuuagcaagaauguauaacggauacgcaggaggcuucgaaguacaaguaauccuagcuggaaaugcauuuaccgcaggaaaaauaauauucgcagcaguuccaccuaauuucccaacagaaggucuaucaccaucucaaguaaccauguucccacacauaauuguagacguacgccaacuagaaccaguucucauuccuuuaccugacguaagaaauaauuucuaucacuauaaccaaagcaaugauuccacaauaaaauuaauagcaaugcuauauacaccacuaagagcuaauaacgccggcgaagauguauuuacaguaucuuguagaguauuaacucguccaucaccugacuucgacuuuauauuuuuaguaccuccaacaguagaaucccguacaaaaccauucacuguaccuauacuaacaguagaagaaaugacuaauucacgauuuccaauaccauuagaaaaauuauuuacuggaccaucuggagcauucguaguccaaccacaaaauggaagaugcacgacugacgguguucuacuaggcacaacucaacuauccccagucaacaucuguacauucagaggagacguuacacacaucgcaggaacuagaaauuauacuaugaacuuagcaucauuaaacuggaacaauuacgauccaacagaagaaauacccgcaccucuaggaacacccgauuuuguaggaaaaauacaaggcguguuaacacaaacaacuaaaggugacggaucaacucgcggucauaaagccacaguauauacugguucagcacccuuuaccccaaaacuuggaucuguucaauucucaacagacacagaaaaugauuucgaaacacaucaaaauacaaaauuuacuccaguaggcguaauacaagacggaggaacaacccacagaaaugaaccccaacaaugggucuuaccuucauacuccggacgaaauguucacaauguccaucuagcuccagcaguagcaccaacauucccaggagaacaacuacuuuucuuucgaucaacaaugcccggaugcucagguuauccaaacaugaaccuagauugccucuuaccacaagaauggguccaacacuuuuaucaagaagccgcuccugcacaaucugacguagcacuacuaagauucgucaacccagacacuggacgaguauuauucgaaugcaaauuacauaaaucuggauauguuaccgucgcacacacaggacaacaugaucuuguaauaccuccaaacggauauuucagauucgacucauggguaaaucaauucuauacauuagcacccauggguaauggaacaggcagaagaagagcacuauaa

SEQ ID NO: 31924 - RNA, 1623 nt, Artificial Sequence
  derived and/or modified sequence opt6 from VP1__Norovirus__BAG70512
augaaaauggccagcaaugacgcaaacccaucagauggaucagccgcaaaccuaguaccugaagucaacaacgaaguaauggccuuagaacccguaguaggagcagcaauagcagcacccguagcaggacaacaaaauguaauagacccuuggauuagaaacaauuuuguccaagcaccaggcggagaauuuacaguauccccaagaaacgcaccaggagaaauccuauggucagcaccacuaggaccagauuuaaauccauauuuaucacacuuagccagaauguauaaugguuacgcaggaggauuugaagugcaaguaauucuagcagguaaugcauuuacagccggcaaaauaauauucgcagcaguaccgccaaacuuuccaacagaaggauuaucaccaucacaaguaacuauguucccacacauaauaguugauguaagacaauuagaaccaguuuuaauaccacuaccagauguaagaaauaacuuuuaccacuacaaccaauccaacgacucaacaauaaaacuuauagcgaugcucuacacaccacucagagcaaauaacgcuggagaagauguauucacaguuuccuguagaguauuaacucgacccucaccugacuuugauuuuauauuuuuagugccaccuacaguugaauccagaaccaaaccuuucacaguaccaauauuaacaguagaagaaaugacaaauuccagauucccaaucccauuagaaaaacuuuucacuggaccaucuggagcguuuguaguccaaccacaaaacggacgaugcacuacugacggaguauuacuaggaacaacacaauuaucaccuguaaacauauguacauuuagaggagauguaacacauauagcaggaacaagaaacuacacaaugaaucuagcaucauuaucauggaauaacuacgauccaacugaagaaaucccagcuccuuuaggaacaccagacuuuguaggaaaaauacaaggaguccucacacaaaccacuaaaggugacggcucaacaagaggacacaaagcaacuguauauacaggcucagcuccauuuacuccaaaauuaggcucuguacaauucucaacagacacagaaaaugauuuugaaacacaucaaaacacaaaauuuacuccuguaggcguaauccaagaugguggaacuacucauagaaaugaaccacaacaauggguauuaccaucauauuccggcagaaacguacauaacguucauuuagcacccgcuguagccccaacauuuccuggugaacaacuacucuucuuuagaucuaccaugccagguuguucaggcuauccaaauauggacuuagauugcuuacuuccacaagaauggguacaacauuuuuaccaagaggcagcucccgcacaaucagacguagcacuuaugagauucguaaacccugacacagguagaguauuauucgaauguaaauuacauaaaucaggcuacguaacagucgcccauacaggacaacacgauuuagucauaccaccaaacggauauuuuagauucgauagcuggguaaaucaauuuuacacauuagcuccaaugggcaauggaacagguagaagacgcgcauuauaa

SEQ ID NO: 31925 - RNA, 1623 nt, Artificial Sequence
  derived and/or modified sequence opt6 from VP1__Norovirus__BAG70515
augaagauggcaucuaacgacgcaaacccaucugacggcuccgcagcaaauuuaguaccagagguuaacaaugaaguaauggcauuagaaccaguaguaggagcagcaaucgcugcaccaguagcaggacaacaaaauguaauagacccauggauaagaaauaacuuuguacaagcaccaggaggugaauuuacaguaucaccaagaaaugcaccaggagaaaucuuauggucugcaccucuaggaccagaucuaaauccauaccuaucccacuuagcuagaauguauaacggauaugcaggaggcuuugaaguacaaguaauacuugcaggaaaugcauucacagccgguaaaauaauauucgcugcaguaccaccaaacuucccaacagaaggcuuaucaccaucucaaguaaccauguucccucacauuauaguagaugucagacaauuagaaccaguacuaauaccauuaccagauguaagaaauaacuucuaucauuacaaucaaucuaacgacucaaccauaaaacuuaucgcaaugcuauacacuccauuaagagcaaauaacgcaggagaagaugucuuuaccgucucauguagaguauuaacuagaccaucaccagauuuugauuuuauuuuccucguaccaccaaccguagaaucacgaacaaaaccauucacaguaccgauauuaacaguagaagaaaugacaaacucaagauuuccuauacccuuagaaaaauuauuuacaggaccaucaggagccuucguaguccaaccccagaacgguagauguacaacagaugguguauuacucgguacaacacaacuaucuccaguaaacauuugcacuuuuagaggugacguaacucauauagcaggaucucgaaacuacacaaugaaccuagcauccuuaaacuggaacaauuaugauccaacagaagaaaucccagcaccacuaggaaccccagauuucguuggaaaaauacaaggauuacuaacacaaaccacaaaaggagauggaucaacacgaggucacaaagcaacagucuauaccggaagugcuccauuuacaccuaaauuaggaucaguucaauuuucaacagacacagaaaacgauuucgaaacacaucaaaacacaaaguucacaccaguaggaguaauacaagacggaucaacaacacauagaaaugaaccacaacaauggguucuaccuucuuauucaggaagaaauguacauaacguacauuuagcaccagcaguugcacccacauuuccaggagaacaacuacucuucuuuagauccacaaugccagguuguuccggauauccaaauauggaucucgacugcuuacuaccacaagaauggguccaacacuuuuaucaagaagccgcaccagcucaaucagaugucgcuuuacuaagauucguaaauccugacacuggacgaguauuauuugaaugcaaacuacauaaauccggauauguaacaguagcccacaccggucaacaugaucuagugaucccaccuaauggauauuuccgauucgauuccuggguuaaccaauuuuacacauuagcaccaaugggaaacggcacaggcagacgaagagcauuauaa

SEQ ID NO: 31926 - RNA, 1623 nt, Artificial Sequence
  derived and/or modified sequence opt6 from VP1__Norovirus__BAG70518
augaaaauggcuaguaaugacgcaaauccaucagauggaucagcagcaaaucuaguuccugaagucaauaacgaggucauggcacuagaacccguaguaggugcagcaauagcagcaccaguugcuggccaacaaaacguaauagaucccuggauuagaaauaacuuugugcaagcaccaggaggcgaauucacaguauccccacgcaacgcuccaggagaaauucuuuggucagcuccucucggaccagacuuaaaucccuaucucucucaucuagcacgaauguauaaugguuacgcagguggcuucgaaguacaaguaauauuagcaggaaaugcauuuacugcaggcaaaauaauauuugcagcaguuccaccaaacuuuccaacagaaggauuaucccccucacaaguaacuauguuuccacauauaauaguagacguacgacaacuagaaccaguacuaauaccacuaccagacguaagaaacaauuuuuaucauuauaaccaaucaaaugacucuacaauuaaacuuauagcuauguuauauacaccccuccgagcuaacaaugcaggagaagauguauucacaguaucaugcagaguccuaacaagaccaucaccagauuucgacuuuaucuuccuagugccaccaacaguagaaucuagaacaaaaccuuuuacaguuccaauauuaacuguagaagaaaugacaaacucaagauuuccaauaccacuagaaaaauuauuuaccggaccaucaggcgcauuuguaguacaaccccaaaauggaagauguacaacugacgguguacuacuaggaaccacacaauuaucaccaguuaauauuugcacuuuuagaggagacguuacgcauauagcugguucaagaaacuauacaaugaaucuagcaucacuuaacuggaacaacuacgacccaacagaagaaauaccagcaccauuaggaaccccagauuuuguaggaaaaauacaaggcuuacuaacucaaacaacaaaaggagauggaucuacuagaggacauaaagcaacuguuuacacuggcucugcaccauucacaccaaaauuagguagcguccaauuuucuacagauacagaaaacgauuuugaaacacaucaaaauacuaaauuuacaccaguaggaguaauacaagauggaucgacaacacacagaaaugaaccacaacaauggguauuacccucauauucuggcagaaacguccauaauguacacuuagcucccgcaguagcacccacauucccaggagaacaacuuuuauucuucagaucaacaaugccagguugcucaggauauccuaauauggaccucgauugucuacuaccccaagaauggguacaacacuuuuaccaagaagccgcuccugcucagucagacguagcacuacucagauuuguaaacccugauacaggaagaguacuauuugaaugcaaacuacauaaaucaggauauguaacaguugcacauacaggacaacacgauuuaguaauaccuccaaauggcuauuuuagauucgauuccuggguaaaucaauuuuauacauuagcaccgauggguaacggaacaggacgacguagagccuuauaa

SEQ ID NO: 31927 - RNA, 1623 nt, Artificial Sequence
  derived and/or modified sequence opt6 from VP1__Norovirus__BAG70521
augaaaauggcauccucagaugcaaaucccucagauggaucaacagcaaacuuaguaccugaaguaaauaaugaaguuauggcucuagaacccguaguaggcgccgcaauugccgcaccagucgcaggucaacagaacguaauugacccauggauaagaaauaacuuuguacaagcgcccggaggugaauuuacuguaucuccaagaaacgcaccgggugaaauauuaugguccgcaccacuaggcccugaucuaaauccauaucucucccaucuagcucgaauguauaauucauaugccggagguuucgaaguacaaguuauauuagcaggaaaugcuuucacagcaggaaaaauaauauuugcagcaguuccuccuaacuucccaacagaaggccuaucaccaucccaaguaaccauguucccacacauaauagucgauguaagacaacuagaaccaguuuuaauaccgcuacccgauguacgaaauaauuucuaucacuacaaucaaucaaaugaucccacaauaaaacuuauugcaaugcuuuacacaccauuaagagcaaauaaugcuggagaugauguauuuacaguaucaugccgaguauuaacacgaccaucaccagacuucgauuuuauauuuuuagucccaccaacaguagaaaguagaacaaaaccauucucugucccuguucucacaguugaagaaaugacuaauucaagauuuccaauaccuuuagaaaaacuauuuaccgguccuuccucugcuuucguaguacaaccacaaaacggccgaugcacaacugauggaguucuacuaggaaccacccaacuaucaccuguaaauaucuguacauuuagaggugauguaacccauauugcaggcacacaagaauauacaaugaacuuagcaucccaaaacuggaauaacuacgauccaacagaagaaauaccagccccacuaggaacaccagacuuuguagguaaaauacaaggaguccuaacacaaacaacuagaagagaugguuccacuagaggucauaaagcaacaguaucuacuggcuccguccauuucacacccaaacuaggaagaauacaauuuuccaccgacaccucaaaugauuucgaaacaggacaaaacacacgauucacaccaguuggcguaguacaagacggaggcacaacacaucaaaaugaaccacaacaauggguacuacccaauuauucaggaagagauucacacaacguacauuuagccccagcaguagcuccaaguuuuccaggcgaacaauuacuauuuuuucgaucaacaaugccuggauguucagguuacccaaauaugaaucuagauuguuuacuaccucaagaauggguacaacacuuuuaucaagaagcagccccagcacaaucagacguugcauuauuaagauucguaaacccagauacaggacguguauuauuugaauguaaauuacacaaauccggcuacguaacagucgcacacacaggacaacacgaucuaguaauacccccaaauggcuauuucagauuugacuccuggguuaaucaauuuuacaccuuagcaccaauggguaauggaacuggacgaagaagagcuuuauaa

SEQ ID NO: 31928 - RNA, 1623 nt, Artificial Sequence
  derived and/or modified sequence opt6 from VP1__Norovirus__BAG70524
augaaaauggccucaaaugaugccaaccccuccgauggaucagccgcaaacuuagucccagaaguaaacaaugaaguaauggcccuagaaccaguugucggugccgcuaucgcugcaccaguagcaggacaacaaaauguaauagauccauggauacgaaacaacuuuguacaagcaccaggaggagaauuuacuguaucaccaagaaaugcuccaggagaaauauuauggagcgcaccacuuggaccagaccucaacccauauuuaucacaccuagcaagaauguauaauggauaugcaggagguuuugagguccaaguaauauuagcaggaaaugccuucacugcaggaaaaauaauauuugcagcaguaccaccuaacuucccaaccgaaggacucuccccaucacaaguaaccauguucccacauauaauaguagacguaagacaauuagagccgguauuaauacccuuaccagauguuagaaauaacuucuaucacuauaaccagagcaacgacucaacaauaaaacucauagcaauguuauauacacccuuaagagcaaacaaugccggugaagauguuuucacugucuccuguagaguacuaacacgaccuucaccagauuuugacuuuauauuucuaguaccaccaacaguugaaucacgaacaaaaccauuuacuguaccaauauuaacaguagaagaaaugacaaauucuagauuuccaauaccauuagaaaaauuauuuaccgguccaucaggagcauuuguaguacaaccacaaaaugguagauguacaacagaugguguacuccuagguacaacacaacuaucaccuguaaacauaugcacauucagaggagacguaacacauauagcugguucaagaaacuacaccaugaaccuagcaucacuuaauuggaauaauuacgaucccacagaagaaauaccagccccauuagguacacccgacuucguaggaaaaauacaaggauuauuaacccaaacaacaaaaggcgacggcuccacucguggacacaaagccacaguauauacaggaucagcaccauuuacuccaaaacuuggaucaguccaauucucaacagauacagaaaacgauuucgaaacccaucaaaauacaaaauucacaccuguaggaguaauacaagauggcucaacaacacauagaaaugaaccacaacaauggguauuaccaucauauucaggaaggaauguacacaauguacacuuagcacccgcaguagcaccuaccuuuccaggugaacaauuaauauucuuuagaucuacuaugcccggaugcuccgguuacccaaacauggaccuagacugucuucuaccucaagaauggguacaacacuuuuaucaggaagcagcuccugcccaaucagauguagcucuccuaagauucguaaacccugacacuggucgagucuuauuugaaugcaaacuucauaaaucaggauauguaacagucgcacacacaggacaacacgauuuaguaauaccaccaaauggauacuucagauucgacagcuggguaaaccaauucuacacacuagcacccaugggaaacgguacaggaagaagacgcgcacuauaa

SEQ ID NO: 31929 - RNA, 1623 nt, Artificial Sequence
  derived and/or modified sequence opt6 from VP1__Norovirus__BAG70527
augaaaauggcaucaaaugaugcaaacccaagcgauggaucagccgccaaccucguaccagaagucaauaacgaaguaauggcacuagaaccaguagucggugcagcaauugcagcaccaguugcuggacaacaaaacguuauugauccauggauacguaauaacuuuguccaagcaccuggaggagaauuuacaguuucaccuagaaaugcuccaggcgagauacuauggucagcaccacuaggaccagaucucaaccccuaucuaucacaucuugcaagaauguauaacggauacgcaggagguuucgaaguacaaguaauacuagccggaaacgcauucacagcuggaaaaauaauauucgcagcaguacccccaaauuuuccaacugaagguuuaucuccaucucaaguaacaauguucccucacauaauaguagacgucagacaauuagaaccaguauuaauuccauuaccagacguaagaaacaauuuuuaucacuacaaccaauccaaugacucaaccauaaaacuaauagcaauguuauacacaccacucagagcaaacaacgcuggagaagacguauuuacaguaucauguagaguacuaacacgaccaucuccagauuuugacuucauuuuucuuguaccaccaacaguugaaaguagaacaaaaccauucacaguaccaauauuaacaguagaagaaaugacgaacagcagauuucccauaccauuagaaaaacuauuuacaggacccucaggagcuuuuguaguacaaccacaaaacggaagauguacaacagacggaguacucuuagguacaacccaauuaucuccaguaaauauauguacauuccgaggugauguaacacauauagccgguucaagaaauuacacaaugaaccuagcaucuuuaaacuggaacucauacgacccuacugaagaaauaccagccccuuuagguacaccagacuuuguaggcaaaauacaaggauuauuaacacaaacaacaaaaggagauggaucaacaagaggacacaaagcaacagucuauaccggaucugcaccauuuacuccaaaacuaggaucaguacaauuuucuacagacacagaaaaugauuucgaaacacaucaaaauaccaaauucacaccaguuggcguaauacaagacggcucaacaacacauagaaaugaaccacaacaauggguccugccaucauauaguggaagaaacguacauaacguucacuuagcucccgcuguugcaccaacauuucccggagaacaacuuuuauucuuuagaucaaccaugcccggaugcucuggcuauccaaacauggacuuagauuguuuauuaccucaagaauggguacaacauuuuuaccaagaggccgcaccagcacaaucugauguagcauuauuacgauucguaaauccagacacuggacgaguacucuuugaauguaaauuacauaaauccggauacguaaccguagcacacacaggacagcaugaucucguaauaccaccaaacggauacuuuagauucgauucauggguuaaucaguuuuacacuuuagcaccaaugggaaauggaacuggcagacgcagagcacuauaa

SEQ ID NO: 31930 - RNA, 1623 nt, Artificial Sequence
  derived and/or modified sequence opt6 from VP1__Norovirus__BAG70530
augaaaauggcaucaaacgacgcaaaccccucagacggaucagcagccaacuuaguccccgaaguuaauaaugaaguaauggccuuagaaccagucguaggagcagcuauagcagccccaguugcaggacaacaaaaugucauagacccauggauuagaaauaacuucguucaagcaccagguggagaauucacugucucuccaagaaaugcacccggugaaauauuauggucggccccacuaggaccagaucuaaauccuuacuuaucucacuuagcuagaauguacaacggauacgcaggaggauuugaaguacaaguaauacuagcagguaaugcauuuacagccggcaaaauaauauucgcagcaguaccaccaaacuuccccacagaagguuuaucaccuagucaaguaacuauguucccacacauaauuguagacguacgacaacuagaacccgucuuaauuccacuaccagauguucgaaacaauuuuuaucacuauaaccaauccaaugacucaacaauaaaauuaauagcaaugcuauacacaccauuaagagcuaacaaugcuggagaagauguauuuacuguaucuugucgaguucucacucguccauccccagacuucgacuuuauauuucuaguaccaccaacaguagaaucaagaacaaaaccauucacaguaccaauauuaacaguagaagaaaugacaaauucaagauuuccaauaccccuagaaaaauuauuuacagguccaaguggagcuuuuguuguacaaccgcaaaacggaagauguacaacagacggcguacuacuaggcacaacacaacuuucaccaguuaauauauguacauuuagaggagacguaacacauauugcagguucucgaaauuauacaaugaaucuagcaagccuuaauuggaacaauuacgacccaacagaagaaauaccagccccacuaggaacaccagauuuuguaggcaaaauucaaggacuauuaacccaaacaacaaaaggcgacgguuccacaagaggacauaaagcaacagucuauacagggucugcacccuuuacccccaaacuaggaucaguacaauucucaacagauacagaaaacgauuucgaaacacaucaaaacacaaaauuuacaccagucggcguaauacaagaugguucuacaacacauagaaaugaaccacaacaauggguacuaccaaguuauagcggaagaaacguacacaauguacauuuagcacccgcuguagcaccaacauuuccaggugaacaauuauuguucuuuagaucaacaaugccaggaugcaguggauacccaaauauggaccuagauugccuacuaccacaagaauggguccaacauuucuaccaagaagcagcacccgcacaaucagacguugcauuacuaagauuugucaaccccgauacaggcagaguacuauucgaauguaaauuacacaaaucaggauauguaacagucgcucacaccggacaacaugaccuaguaauacccccuaacggcuauuucagauuugauucauggguaaaccaauuuuacacacuagcaccuaugggaaauggaacaggacgaaggagagcauuauaa

SEQ ID NO: 31931 - RNA, 1623 nt, Artificial Sequence
  derived and/or modified sequence opt6 from VP1__Norovirus__BAG70533
augaaaauggcaucaaacgaugcgaauccaucagacggaagcgcagcaaaucucgucccagaaguaaacaaugaaguaauggcacuagaaccaguaguaggcgcugcuauagcagccccaguagcaggacaacaaaaugucauagacccauggaucagaaauaauuucguacaagcuccuggcggagaauuuacaguaucaccacguaacgcaccuggagaaauucuauggucagcaccucuagguccagaucuaaacccauaccuuucucaucuugcaagaauguauaacggauacgcagguggauucgaaguacaaguuauuuuagcaggaaaugcuuuuacagcaggaaaaauaauauuugcugcuguaccaccaaauuuucccacagaaggucuuuccccaucacaagucacaauguucccucacauaauaguugauguacgacaacuagaaccaguacuaauaccacuaccagacguaagaaauaauuucuaucacuauaaccaaucuaacgauucaacuauuaaauuaauagcaauguuauacacaccacuaagagcaaacaaugcuggugaagaugucuuuacaguauccugcagaguacuaacaagaccuuccccugacuuugacuuuauauuucuagucccaccaacugucgaaucaagaacuaaaccauuuacaguaccaauauuaacaguugaagaaaugacuaauucaagauucccaaucccacucgaaaaacuauuuacaggcccauccggugcauucguaguacaaccucaaaacggcagauguacaacugacggaguccuccuuggcacaacccaacucucaccaguaaauauuuguacauuuagaggagauguaacacauaucgcaggcucuagaaauuauacuaugaauuuagcaucacuaaauuggaauaauuacgacccaaccgaagaaauaccagcaccauuaggaacaccugacuuuguagguaaaauacaaggauuacuaacacaaaccacaaaaggagacggaucaacaagaggacauaaagcaacagucuauacuggaucagcgccauucacaccuaaacucggaucuguacaauuuaguacugacacagaaaacgauuucgaaacacaucaaaauacaaaauucacucccguaggcguuauccaagacggaucuacuacacaccguaaugaaccacaacaauggguuuuaccaucauauucaggaagaaauguacacaacguacaccuugcaccugcuguagcaccuaccuuuccaggagaacaauuauuauucuuucgauccacuaugcccgguuguucaggauauccaaauauggaccuagauugccuacuaccucaagaauggguacaacacuuuuaucaagaagccgcaccagcacaaucagauguugcacuacuuagauuuguaaauccagacacagguagaguccuauuugaauguaaacuacauaaaucaggcuacguaacaguagcacacacaggccaacacgaucuuguuauacccccuaacggauauuuccgauucgauucuuggguaaaucaauuuuauacuuuagcaccaaugggaaauggaacaggcagaagaagagcauuauaa

SEQ ID NO: 31932 - RNA, 1623 nt, Artificial Sequence
  derived and/or modified sequence opt6 from VP1__Norovirus__BAG70536
augaaaauggccuccaaugacgccaacccaucagauggcucugcagcaaaucugguaccagaaguaaacaaugaaguuauggcccuugaaccgguaguaggagcagcuauugcagcaccagucgcaggacaacaaaauguaauugacccuuggauaagaaauaauuucguccaagcaccaggaggcgaauucacaguaucaccaagaaaugcaccuggugaaauccuauggucagcaccucuaggaccagacuuaaauccauaucuaucacaccuugcccgaauguacaacggcuacgcaggaggauuugaaguacaagucauacuugccggcaaugcuuuuacagccgggaaaauaauauucgcagcaguuccaccuaacuuuccuacagaagguuuaaguccaucccaaguaacaauguucccccauauaauaguggauguuagacaauuagaaccuguccuaauaccauuaccugauguacguaauaacuuuuaucacuauaaccaauccaaugauucaaccaucaaacuaauugcaauguuauacacaccccuaagagcuaauaaugcaggagaagauguauuuaccguuagcuguagaguauuaacaagaccuucaccagauuuugauuuuauuuuucuaguaccaccaaccguagaaucuagaacaaaacccuuuaccguuccaauucucacaguugaagaaaugaccaacuccagauucccaauuccacuagaaaaacucuucaccggaccaucuggagcauucguuguacaaccacaaaacggaagaugcacaacugacggaguacuccuaggaacaacacaacucucaccagucaauauaugcacauuuagaggugacguuacacauauagcuggaucaagaaacuauaccaugaauuuagcaucucuaaauuggaacaauuacgauccaaccgaagaaauaccagcaccucucggcacaccggacuuuguaggaaaaauacaaggucuauuaacacaaacaacaaaaggagacggaucaacuagaggacauaaagccacuguauauacaggaucugcaccauucaccccaaaacugggaucaguacaauucucuacagacaccgaaaacgauuuugaaacacaccaaaauaccaaauuuacuccaguaggaguaauacaagaugguucuacaacacauagaaaugaaccacaacaauggguacuaccaucauacuccggaagaaacguacauaacguacaccuagcaccugcaguugcaccaacuuuccccggagaacaauuauuauuuuucagaucaacaaugccaggauguucuggauacccaaacauggaucucgauugccuacuaccacaagaauggguccaacacuuuuaucaagaagcugcuccagcucaaucagacguugcacuauuaagauucguuaacccagauacaggacgaguacuuuuugaaugcaaacuacauaaaucuggcuauguaacaguagcacauacaggacaacacgaccuuguaauaccaccaaauggauacuucagauucgauaguuggguuaaucaauuuuacacuuuagcuccuaugggaaauggaacaggacgaagaagagcacuuuag

SEQ ID NO: 31933 - RNA, 1623 nt, Artificial Sequence
  derived and/or modified sequence opt6 from VP1__Norovirus__BAI70518
augaaaauggccucaaaugaugcaaauccaucugauggaagugcagcaaacuuaguaccugaaguaaacaaugaaguaauggcccucgaacccguaguuggagcugcuauagcagcaccaguugccggacaacaaaauguaauugacccauggaucagaaacaauuucguccaagcaccaggaggagaauuuacaguaucccccagaaacgcaccaggagaaauacuuuggucagcaccacuaggaccagaucuaaauccauaccuuucacaucuugcacgaauguauaauggauacgcaggaggcuuugaaguucaagucauauuagccgguaaugccuuuacagcuggaaaaauaauauucgccgcaguacccccaaacuuuccaacagaaggucuaucucccucucaaguaacaauguucccacacauuauaguugacguaagacaacucgaaccaguuuuaauaccauuaccagauguacgaaacaacuuuuaccauuauaaccaaucaaaugauucuaccauaaaacucaucgcaauguuauacacaccauuaagagccaacaaugcaggugaagauguuuuuacaguaagcuguagaguauuaacaagaccauccccagacuucgacuuuauauuuuuaguaccaccaacaguugaaucaagaacaaaaccauucacaguuccaaucuugacaguagaagaaaugaccaacuccagauuuccaauaccacuagaaaaacuuuuuacaggaccuucuucagcauuuguaguacaaccacaaaacggaagauguacaacugacgguguauuacuaggaacaacgcaauuaucaccaguaaauauuuguacauuccgaggagacguaacacauauagcaggaucaagaaauuacacaaugaauuuagcaucauuaaacuggaacaauuacgauccaacagaagaaauaccugccccacuagguacaccagauuuuguaggaaaaauccaaggaguacuuacacaaacaacaaaaggcgacggaagcacucgaggccacaaagccacuguauauaccggaucagcccccuucaccccuaaauuaggcucuguacaauucucuacagacacagaaaacgauuuugaaacccaucaaaauacaaaauuuacaccaguaggagucauacaagauggagguacaacacaucgaaaugaaccccaacaauggguucuaccaucuuauucaggcagaaauguaccaaauguacacuuagcaccagcagucgccccaacauuucccggcgaacaacuauuauucuuuagaucaacaaugcccggauguucuggauauccaaauauggaccucgacugucugcuaccacaagaguggguacaacauuucuaucaagaagcagcaccagcucaaucugacguagccuuauuaagauucguaaaccccgacacuggacgaguccuauucgaauguaaacuacauaaaucaggauauguaacaguagcccauacaggacaacaugacuuaguaauaccaccaaauggauauuucagauucgauagcuggguaaaccaauuuuacacuuuagcacccaugggaaauggcacaggaagaagacgagccuuauaa

SEQ ID NO: 31934 - RNA, 1623 nt, Artificial Sequence
  derived and/or modified sequence opt6 from VP1__Norovirus__BAJ13508
augaaaauggccucuaaugaugcaaauccaucggauggaucaacagcaaacuuaguaccagaaguaaauaaugaagugauggcauuagagccugucgucggagcagcaauagcugcaccuguagcaggacaacagaauguaauagacccauggauccgaaauaauuuuguacaagcaccaggcggagaauucacaguuaguccuagaaaugcaccaggugaaauauuauggucagcuccucuuggucccgaucucaaucccuaucuaucacacuuagcuagaauguauaacggauacgcaggaggauucgaaguucaaguaauacuugcagguaaugccuucacagcaggaaaaauuauauucgcagcuguaccuccuaacuuuccaacagaaggacuaucuccaucucaaguaaccauguuuccacacauaauaguagacguaaggcaacuagaaccaguucuaauaccacucccagauguaagaaacaacuucuaucacuauaaucaaucuaacgaccccacaauaaaacuaauagcaaugcuauauacaccucuacgagcuaauaacgcaggagaugacgucuucacaguaucaugucgaguccuaacacgaccaucaccagauuuugauuuuauauucuuaguaccuccaacaguagaaucaagaaccaaaccuuuuacagucccaauuuuaacagucgaagaaaugacaaauucaagauuccccauaccauuagaacgucuuuauaccggaccguccucugcauuuguagugcaaccacaaaauggaagaugcacaaccgacggaguacuccuaggaacuacacaauuaucugcaguaaauauuuguacauuuagaggugauguaacacauauagcaggaagccgaaacuauacaaugaaucuagcaucacaaaauuggaauaauuaugauccuacagaagaaauaccagcaccauuaggaacuccagauuucguagguaaaauacaaggaauguuaacucaaacuaccagaucagacggaucuacucgaggucauaaagccacaguucuaacaggaucagcugacuuugcaccaaaacuaggaagaguacaauuugcaacugauacagacaacgacuuugaaucuggccaaaauacaaaauucaccccagucgguguaauacaagacggaucaacaacccauagaaaugaaccacaacaauggguucuaccaaauuauuccggacgcacuggacacaauguucaucuagcaccagcaguagcaccaacauaccccggagaacaauuauuauuuuuuagaucaacaaugcccgguuguucaggcuacccaaauauggacuuagacugcuuauuaccacaagaauggguacaacacuucuaccaagaagcagcuccagcacaaucagauauggccuuguuaagauuugucaacccugauacuggacgaguauuauucgaauguaaauuacauaaaucaggauacguaacaguagcucacaccggacaacaugaucuaguaauaccaccaaaugguuauuuuagauuugacucauggguaaaucaauuuuauacucuagcaccaaugggaaauggaacaggaagacgacgugcaguauaa

SEQ ID NO: 31935 - RNA, 1623 nt, Artificial Sequence
  derived and/or modified sequence opt6 from VP1__Norovirus__BAJ13513
augaaaauggcauccucggaugcaaacccuccagacggaucugcagcaaaccuaguaccagaaguuaauaaugaagucauggcauuagaaccaguuguaggcgccgcaauagcagcaccagucgcaggccaacaaaaugucauagacccauggauacgaaauaauuuuguucaagcuccaggaggcgaauuuacaguaucaccaagaaaugcuccaggagaaauacuauggucugcaccuuuagguccagaucuaaacccauaccuaucacacuuagcaagaauguacaacgguuacgcuggaggauuugaaguacaaguaauacuagccggaaaugcauuuacagcugguaaaauaauauucgccgcaguacccccaaacuuuccaacugaaggucuaucaccuucccaaguuacaauguucccucacauaauaguagauguacgccaauuagaaccaguucucauaccacuaccagauguaagaaacaauuucuaucauuauaaccaauccaacgacucaacaauaaaacucaucgcuaugcuuuauacuccccuaagagcaaauaaugcaggagaagacguauuuacaguaaguuguagaguacuaacccguccaagcccagauuuugacuuuauauuccucguaccacccacaguagaaucucguacaaaaccauucacaguacccauacuaacaguagaagaaaugacaaacucccgauucccuauaccacucgaaaaacuauucacaggaccaucaggagcauucguaguacaaccccaaaacgguagauguacaacugacggcguauuacuaggcaccacacaacuauccccuguaaauauauguacauuuagaggugacgcaacacauauagcagguucacgcucauacacuaugaaucuagcaucauuaaacuggaacaauuaugauccaacagaagaaauaccagcuccauuaggaacaccagauuucguagguaaaauacaagguaugcucacacaaaccacaaaaggagacggauccacaagaggacacaaagcaacuguauacaccggaucagcacccuucaccccaaaacuaggcucaguacaauucucaacagauacagaaaacgauuuccaaacucaucaaaauacuaaauucaccccaguaggaguaauacaagacggaucaacaacccacagaaacgaaccacaacaauggguuuuaccaucauauucaggaagagacguacauaacguacacuuagcaccugcgguagcaccaacauuuccaggagaacaauuauuauuuuucagauccacaaugccagguuguucaggauaucccaauauggaucuagauugucuacuaccacaagaauggguucaacauuucuaucaagaagcagcaccagcacaaucugauguagcauuacucagauucguaaauccugacaccggcagaguauuauucgaauguaaacuccauaaaucugguuauguaacaguagcacacacaggacaacaugauuuaguaauaccaccaaauggcuacuuuagauuugauucauggguaaaucaauuuuacacauuagccccaauggggaauggaacuggaagaagaagagcacuauaa

SEQ ID NO: 31936 - RNA, 1623 nt, Artificial Sequence
  derived and/or modified sequence opt6 from VP1__Norovirus__BAJ13520
augaaaauggcauccucagacgcuaauccaucagauggaucugccgcuaaccuuguaccugaaguaaacaaugaaguaauggcucuagaacccguaguaggugcagcaauagcugcaccuguagcuggacaacaaaauguaauugauccuuggauaagaaauaacuuuguacaagcaccuggaggagaauuuacaguaucacccagaaacgccccaggugaaauacucuggucggcaccacuaggcccagaccuaaauccauaucuaucacauuuagccagaauguauaacgguuacgccggaggauuugaaguacaaguaauauuagcaggaaaugcguuuacagcaggaaaaaucauauuugcagccgucccgccuaacuuuccaacagaaggacucaguccaucccaagucacuauguuuccacauauuauaguugacguaagacaacuugaaccaguccucauaccacuaccagauguaagaaacaauuuuuaucacuacaaucaaucuaacgacuccaccauaaaacuuauagcuauguuauauacacccuuaagagcaaauaacgcaggcgaagauguauuuaccguuucauguagaguuuuaacuagaccaucaccagauuuugacuuuauauuuuuaguaccaccaacaguagaaucccgaacuaaaccuuucacaguaccuauacuuaccguagaagaaaugaccaauucaagauuuccaauaccucucgaaaaacuauuuaccgguccaucuggagcauuuguuguacaaccacaaaacggaagauguacuacagacggagucuuacuagguaccacucaacucucaccaguaaauauauguacauucagaggcgacguuacucauauagcaggaucacgaaacuacacaaugaaucucgcaucauuaaacuggaauaacuacgacccaacugaggaaauaccagccccacucggaacaccagacuuuguagguaaaauacaaggaaugcuaacccaaacaacaaaaggagacggcucaacaagaggacauaaagcuacaguauauacaggaucagcuccauuuacaccaaaacuaggaaauguacaauuuucaacugauacugaaaaugauuucgaaacacaccaaaauacuaaauucacuccagucggaguaauacaagauggaucaacaacacauagaaaugaaccacaacaauggguuuuaccuuccuacucagguagagauguccauaauguacacuuagcaccugcaguagcuccaacauuuccaggugaacaauuacuauuuuuucguucuacaaugccagguuguucagguuauccaaauauggaucuagacugcuuacuuccacaagaauggguucaacauuucuaucaagaagcagccccugcucaaucagauguagcacuacuaagauucgucaauccugacacgggcagagucuuauucgaaugcaaauuacacaaaucuggauauguaacaguagcacauacaggacaacacgaucuaguaauaccaccaaauggcuauuucagauucgauucuuggguuaaucaauucuacaccuuagccccaaugggaaauggaacaggaagaagacgugcacuauaa

SEQ ID NO: 31937 - RNA, 1623 nt, Artificial Sequence
  derived and/or modified sequence opt6 from VP1__Norovirus__BAJ13534
augaaaauggcaucaaacgacgcaaauccaucagacggaucagcugccaaucuagucccggaaguaaacaaugaaguaauggcacucgaaccaguaguuggugcagcaaucgcagcuccuguagcaggacaacaaaacguuauugauccauggauaagaaauaauuuuguacaagcaccaggaggagaauuuaccguaucuccucguaaugcaccaggagaaauacuauggucagcaccacucggacccgaucuuaauccauaucuaucccauuuagcaagaauguauaaugguuacgccggcggauuugaaguacaagucauacuagcaggaaacgcuuuuaccgcaggcaaaauaauauucgcagcuguuccaccaaauuuuccaacagaaggauuaucaccaagccaaguaacaauguuuccacauauuauaguugacguuagacaacuagaaccaguuuuaauaccucuaccagauguucgaaauaauuucuaucacuauaaccaaucauccgauucaaccauuaaacuaaucgcaauguuauauacuccccuuagagcaaacaaugcaggcgaagauguauuuacaguuaguuguagaguauuaaccagaccaucaccagacuuugauuuuauuuuucuuguaccaccaacagucgaaucaagaacaaaaccuuucacaguuccaaucuuaaccguagaagaaaugaccaauucuagauuuccaauaccacuagaaaaauuauucacaggaccaucuggagcuuucguaguacaaccacaaaauggacguuguacaacagacggaguacuuuuaggaacaacacaacuuucaccgguuaauauuuguacauuuagaggagacguuacacauauugcaggaucacgcaauuacacuaugaaucuugcaucccuuaacuggaauaacuacgauccuacagaagaaauaccagcaccacucggaaccccagauuucgucgguaaaauacaaggcguccuaacacaaacaacaaaaggagaugguucaacaagaggacacaaagcaacagucuauacaggaucagcaccuuuuaccccaaaauuaggauccguccaauuuucaacagauacagaaaaugauuuugaaacacaucaaaauaccaaauucacaccaguaggaguaauacaagacgguucaacaacucaucgcaaugaaccucaacaauggguuuuaccauccuacucaggucgaaauguacauaacguacauuuagcacccgcuguagccccaacauucccaggcgaacaacuccuauuuuuucgaucaaccaugccagguugcaguggauaucccaacauggaucuagauugccuuuuaccucaagaauggguacaacacuucuaucaagaagcagcaccugcucaaagugacguagcauuacuuagauucguuaacccagacaccgguagaguuuuauucgaaugcaaacuccauaaaucaggauacguaacuguagcacauacaggccaacaugaucuaguaauaccaccaaauggauacuuccguuucgacucauggguaaaucaauucuacacauuagcuccaaugggaaacggaacaggcagaagaagagcacuuuaa

SEQ ID NO: 31938 - RNA, 1623 nt, Artificial Sequence
  derived and/or modified sequence opt6 from VP1__Norovirus__BAJ13537
augaaaauggccucaucagaugcuaauccuucagauggaucuacagcaaacuuaguuccagaaguaaauaacgaaguaauggcgcuagaacccguaguuggagcagcaauagcugcaccagucgcaggacaacaaaaugucauagauccauggauaagaaacaauuucguccaagcaccuggaggagaauuuacagucucaccuagaaaugcaccaggagaaauacuauggucagcacccuuaggaccagaccuaaaucccuauuuaucucauuuagcuagaauguauaacggcuacgcugguggcuucgaaguacaaguaguacuagcuggcaaugcauucacagcaggaaaaauaauuuucgcugcaguaccaccaaauuuuccaacugaaggacuaucuccaucucaaguuacaauguucccacacauaaucguagauguccgacaacucgaaccaguuuuaauaccccuuccagacguaagaaacaauuucuaucacuauaaucaaagcaaugacccaacaauaaaacuaauagcaaugcuauacacaccuuuacgagcuaacaaugccggagaugacguauuuacaguaucaugccguguccuaacaagaccaucaccugacuucgacuuuauauuuuuaguaccuccuacaguagaaucuagaacaaaaccuuucucaguaccaauauuaacaguagaagaaaugacaaauucaagauucccaauaccauuagaaaaauuauucacagggccuuccuccgcuuucgucguucaaccacaaaacgguagauguacaacagauggagucuuacucggaacaacacaauuaucaccaguuaauauaugcacauuucgcggagauguaacgcauauaacaggcucaagaaacuauacaaugaauuuagcaacacaaaauuggaacuccuacgauccaacagaagaaauaccagcaccacuagguacaccugacuuugucggaaaaauacaaggaguccucacccaaacaaccagagcagacggcucuacaagaggacauaaagcaacuguauauacuggauccgcagacuuugcuccaaaauuaggaaggguacaauucgcaaccgauacagauaacgauuuugaugcaaaccaaaacacaaaguucacuccaguagguguaauacaagacggugacacagcacauagaaacgaaccucaacaauggguccuaccauccuauucaggacgaaauaaccacaacguucauuuagcaccagcaguagcuccuacauuuccuggagaacaacuauuauucuucagauccacaaugccaggaugcucaggauacccaaacauggauuuagauugcuuacuaccacaagaauggguacaauauuucuaucaagaagccgcaccagcucaauccgauguagcauuacuaagauucguaaacccugacacaggaagaguuuuauucgaauguaaacuacauaaaucuggcuacgucacuguagcccacacaggacaacacgauuuaguaauaccacccaauggcuauuucagauuugacucauggguaaaucaauucuacacguuagccccaaugggaaauggcaccggacguagaagagcccuauaa

SEQ ID NO: 31939 - RNA, 1623 nt, Artificial Sequence
  derived and/or modified sequence opt6 from VP1__Norovirus__BAJ13540
augaaaauggcuuccaacgaugcaaauccaucugacggaucagcagcaaauuuaguuccugaaguuaauaaugaagucauggcgcuagaaccagucguaggagcugcaauugcagcaccugucgcuggacaaacuaauguaauugauccauggauaagaaauaacuuugugcaagcaccagguggugaauuuacaguaucaccaagaaacgcaccaggagagaucuuauggucagcaccacuaggaccagauuuaaacccauaucuaucacacuuagccagaauguauaauggauacgcuggaggauucgaaguccaaguaauauuagccggcaaugcauuuaccgcaggaaaaauaauuuuugcagcaguaccaccuaauuuuccuacagaaggauuaucuccaucucaaguaacaauguuuccacacauaauaguugacguaagacaauuagaaccaguauuaaucccauuaccagauguacgaaacaauuucuaucauuauaaucaaucuaaugacuccacaauaaaacuaauagcaaugcuauauacuccauuaagagcaaacaaugcaggugaagauguauuuacagucucaugucgaguauuaacacgaccuucaccagauuuugacuucauauuccucguaccaccuacaguugaaucaagaaccaaaccauuuacaguaccuauuuuaacuguagaagaaaugacaaacucuagauuucccaucccauuagaaaaacucuucacaggcccaucaggagcauucguaguacagccucaaaacggaagaugcacaacagacggagucuuauuaggaacaacacaacuaucaccaguaaauauaugcaccuuucgaggagacguaacacacauaguaggaucaagaaauuacacaaugaaucucgccucauuaaauuggaauaauuacgauccaaccgaagaaauuccagccccucuagguacaccugauuuuguagguaaaauacaaggaguacuaacacaaacaacuaaaggagacggcaguacucgaggccacaaagccaccguauacaccggcucagcaccauucacaccaaaauuaggaucaguacaauuuucuacagacacagaaaacgauuucgaagcacaucaaaauacaaaauuuacaccaguuggagucauacaagaugguucaaccacucauagaaaugaaccacaacaauggguacuuccaucauauucaggucgcaauguacaaaacguacauuuagcaccugcuguugccccaaccuuucccggcgaacaacuacuauuuuuucgaagcacaaugccaggaugcaguggauaucccaacauggaccuagauugucuauuaccccaagaauggguucaacauuucuaucaagaagcagcaccagcacaaucagacguagcccuauuaagauuuguaaacccugauacuggacgaguacuuuuugaauguaaacuacauaaaucaggauauguaaccguagcucacacaggacaacacgacuuagucauuccucccaauggauauuuuagauuugauuccuggguaaaucaauuuuauacacuagcaccaauggguaauggaacaggccguagaagagcauuauaa

SEQ ID NO: 31940 - RNA, 1623 nt, Artificial Sequence
  derived and/or modified sequence opt6 from VP1__Norovirus__BAJ13543
augaaaauggcuucaaaugaugcaaauccaagugauggaucagccgcuaaucuaguaccagaaguaaacaaugaaguaauggcucuugaaccagucguaggagcagcaauugcagcuccugucgcaggucaacaaaauguaauagauccauggauccgcaacaauuuuguacaagcaccaggcggagaauuuacaguauccccaagaaacgccccaggagaaauacuauggucagcacccuuaggacccgaccuaaauccauaccuaucacaucuagcucgaauguauaacggauaugccggaggauucgaaguccaaguaauauuagcaggaaaugccuuuaccgcuggaaaaauaauauuugccgcaguuccuccuaauuuucccacagaagguuuaucacccucacaaguaacaauguuuccacacauuauaguagauguacgacaacuagaaccaguuuuaauaccauuaccugacguaagaaacaacuuuuaucauuacaaccaaagcaacgacucaacaauaaaauuaauagcaauguuauauacaccauuaagagccaacaaugcaggagaagauguuuuuacaguaucaugccgaguauuaacaagaccaucaccagauuuugacuuuauauuucuaguacccccuacaguugaaucacguacaaaaccauuuacagucccaauccugaccguugaagaaaugacaaacucaagauuuccuauuccauuagaaaaauuauuuacaggaccuucauccgcuuucguuguacaaccccaaaacggacguuguaccacagauggcguauuacuaggaacuacucaacuaucaccuguuaacauaugcacauuuagaggagauguaacacauauagcaggaucaagaaauuauacaaugaauuuagcaucacuuaauuggaauaauuacgauccaacugaagaaauuccugcaccucuagguacacccgacuuuguaggaaaaauucaaggcguacuaacccaaacaacaaaaggagaugguucuacaagaggucauaaagcaaccgucuacacaggaucugccccauuuacaccaaaacuaggaagcguacaauucucuacagacacugaaaacgacuucgaaacucaccaaaauacuaaauucacaccagucgguguuauacaagacggaucuacaacucauagaaaugaaccucaacaauggguacuucccuccuauucuggaagaaaugcacauaauguacaccucgcaccagcaguagcaccuacauucccaggagaacaauuacucuucuuuagaucaaccaugcccgguugcaguggauaccccaauauggaucuagauuguuuacuaccccaagaauggguacaacauuuuuaucaagaagccgcacccgcacaaucagacguagcacuacuaagauucguaaacccagacacaggacguguacuuuucgaaugcaaacuucauaaaucaggauauguaacagucgcacauacaggucaacacgaccucguaauuccaccaaauggauacuucagauucgauagcuggguuaaccaauuuuauacauuagccccuaugggaaauggaacaggaagacgaagagcacucuaa

SEQ ID NO: 31941 - RNA, 1623 nt, Artificial Sequence
  derived and/or modified sequence opt6 from VP1__Norovirus__BAJ13549
augaaaauggccucaaaugacgccaacccaucagauggaucagcagcaaaccuaguaccagaaguaaacaaugaaguuauggcacuagaaccuguuguuggugccgcaauagcagcuccagucgcuggacaacaaaaugucauagaccccuggauacgaaacaacuuuguacaagcaccaggaggcgaauuuacaguaucaccacgaaaugcaccuggagaaaucuuauggucugcaccccuagguccagacuuaaauccauacuuaucacacuuagccagaauguauaauggauaugcaggaggauucgaaguacaaguuauauuagcagguaacgcauuuacagcugguaaaauuauauuugcagcagucccuccaaacuuuccaacagaaggucuauccccaucacaaguaacaauguuuccucauaucauaguagauguuagacaacucgaaccaguacucaucccacuaccagauguaagaaacaacuuuuaucacuauaaucaaucuaacgacucuaccauaaaauuaaucgcaaugcuuuacacacccuugagagcaaacaaugcaggagaagauguuuuuacaguuucaugcagaguacuaacaagaccaucaccagacuucgacuuuauauuuuuaguucccccaacaguagaaucaagaaccaaaccuuucacaguacccauacucacuguagaagaaaugacaaacaguagauuuccaauacccuuagaaaaauuauuuacaggacccucaucagccuucguaguccaaccacaaaacggaagaugcacaacagacggaguuuuacuaggaacaacacaacuaaguccuguaaacauauguacauuuagaggcgacguuacacacauagcgggaucaagaaacuacacuaugaacuuagccaguuuaaacuggaauaacuacgacccuacagaagaaauaccagcuccuuuagguaccccugacuuuguuggaaaaauacaaggaguacuuacacaaacuacaaaaggagacggaucaacuagaggucauaaagcaacagucuauacuggaucagcuccauuuacuccaaaacuaggaucuguccaauucucaacagacacagaaaacgacuucgaaacacaucaaaauacuaaauuuacgcccguaggaguuauacaagacggaucaacaacacauagaaacgaaccacaacaauggguacuaccaucauacucuggaaggaaugcccauaacguucacuuagcuccugcaguagccccaacauuccccggugaacaacuccuuuuuuuuagaucaacaaugccagguugcaguggauacccaaacauggaucuagauugcuuacuaccucaagaauggguacaacauuuuuaccaagaagccgcaccagcacagucugauguagcauuacucagauucguaaacccagauacuggccgcguauuauucgaaugcaaauuacauaaaucaggauauguaacuguagcacauacuggacaacacgauuuaguaauaccaccaaacggcuauuucagauucgauucauggguuaaucaauuuuacacacuagcuccuaugggaaauggaacaggaagaagaagagcauuauaa

SEQ ID NO: 31942 - RNA, 1623 nt, Artificial Sequence
  derived and/or modified sequence opt6 from VP1__Norovirus__BAJ13552
augaaaauggcaucuaaugacgcuaacccuuccgauggauccgcagcaaaccuaguacccgaaguaaauaaugaaguaauggcacuagaaccaguaguaggagcagcaaucgcugcacccguagcaggacaaacaaauguaauagacccauggauacgaaauaauuuuguccaagccccaggaggagaauuuacaguuucaccacgaaacgccccaggagaaauauuaugguccgcaccacuaggaccagaucuaaacccauauuuaucucaucuagcaagaauguauaacgguuacgcaggaggauuugaaguucaaguaauacuagccggaaacgcauuuacagcaggaaagauuauauucgcagcaguucccccaaauuuuccuacugaaggauuaagcccaucucaaguuacaauguucccacauauaauaguagacguaagacaacuagaaccaguacuaauaccauuaccagauguacguaacaauuucuaucacuacaaccaaagcaaugauucuaccauuaaauuaauagcaauguuauauaccccauuaagagccaacaaugcaggcgaagaugucuuuacaguaagcuguagaguacuaacaagaccaucaccagacuuugacuuuaucuuucuuguaccaccgacagucgaaaguagaaccaaacccuucacaguaccaauuuuaacagucgaagaaaugacaaacucuagauuuccaauaccacuagaaaaauuauuuaccgguccaucaggagcauuuguuguucaaccacaaaauggacgauguacaacagacgguguauuacuaggaacuacacaauuaucacccguuaauauauguacauuucguggagacguuacacauaucgcaggcucaagaaauuauacuaugaaccuagcaucauuaaacuggaauaauuaugauccaacagaagaaauuccagcaccacuaggaacacccgacuuuguaggaaaaauucaaggaguacuaacacaaacuacaaaaggagacgguaguacacguggacacaaagcaacaguauauacaggauccgcacccuuuacaccuaaauuaggauccguccaauucaguaccgauacagaaaaugauuuugaagcacaucaaaauacaaaauucacaccuguuggcguaauacaagacgguucaacuacacauagaaacgaaccacaacaauggguacucccaucauauucaggaagaaauguacaaaauguccaucuggcaccagccguagccccuaccuucccaggagaacaauuacuauucuuuagaucuacaaugccaggcuguucaggauauccaaacauggaucuugauugccuacuaccacaagaauggguccaacauuucuaucaagaagcagcuccagcacaaucagacguagcacuucuacgauuuguuaauccagauaccggcagaguacuauuugaauguaaauuacauaaaagcggauacguaacagucgcacacaccggacaacaugaucuaguaauaccacccaauggauauuuucguuuugacagcuggguaaaccaauucuauacacuagcaccaaugggaaauggaaccggaagaaggagagcacucuaa

SEQ ID NO: 31943 - RNA, 1623 nt, Artificial Sequence
  derived and/or modified sequence opt6 from VP1__Norovirus__BAJ13555
augaaaauggccucaaaugaccccucaccauccgaugguuccgcagcaaacuuaguaccagaagucaauaacgaaguaauggcauuagaaccgguaguaggagcagcuauagcagcaccuguagcaggacaacaaaacguaauugauccauggauaagaaauaacuuuguacaagccccuggaggagaauucaccguaucuccaagaaaugcaccaggagaaauacuuuggucugcaccacuuggacccgaucuaaacccauauuuaagucacuuagcaaggauguacaacggauacgcugguggauucgaaguacaaguaauuuuagcaggaaaugcauucacugccggcaaaauaauauucgccgcaguacccccuaauuuuccaacagaaggucuuucuccaucucaaguaacaauguucccgcacauuauaguagacguacgacaacuagaaccuguacuaauaccauuacccgauguaagaaacaauuuuuaucacuauaaccaaaguaaugauuccacaauaaaauuaauagcaaugcuauacacaccccuuagagcaaauaacgcaggagaagacguauucacaguuuccuguagaguacuuacaagaccaucaccagacuuugacuucauauuccuaguaccuccuacaguagaaagccgaacaaaacccuuuacaguaccaauacuuacaguugaagaaaugacaaauucaagguucccaauuccauuagaaaaacucuuuacagguccaucaucugcuuuugucguacaaccacaaaauggucgaugcacaacugacggaguacucuuaggaacaacacaacuaucacccguuaauauaugcacguuuagaggagauguuacacacaucgcaggaucucgaaauuacacaaugaaucuugcaagucuaaacuggaauaauuacgaccccacagaagaaauacccgcaccacucggcacaccugacuucguagguaaaauacaaggaguauuaacucaaacaacaaaaggagacggauccacaagaggacauaaagcaacaguauauacaggauccgcaccauucacaccaaaacuaggaucuguacaauuuucaacagauacagaaaaugacuucgaaacacaucaaaauacaaaauucaccccuguaggcguaauacaagauggugggacaacacaucgaaacgaaccacaacaauggguauuacccucuuacucaggacgagauguacaaaacguacaccuugcaccagcaguagcaccaacauuuccaggagaacaacuacuauucuucagaucaacaaugccaggauguuccggcuauccaaauauggacuuagauugucuacuuccacaagaauggguacaacacuuuuaucaagaagccgcuccagcacaaucugauguugcacuccuaagauucguuaacccagacacaggacgaguauuauuugaauguaaauuacauaaauccggauauguaacaguagcacauacaggacaacacgaucuaguaauaccaccaaauggauauuucagauuugacuccugggucaaucaauucuacacucuagcaccaaugggcaauggaacaggacgaagacgagcucucuaa

SEQ ID NO: 31944 - RNA, 1623 nt, Artificial Sequence
  derived and/or modified sequence opt6 from VP1__Norovirus__BAJ13558
augaaaauggcaucaaacgaugcaaacccaucugauggaucagcagcaaacuuaguaccugaaguuaauaaugaaguuauggcuuuagaaccaguaguuggagcagcaaucgcagcaccuguugcaggacaaacuaacguaauagacccauggauaagaaauaacuuuguacaagccccaggaggugaauuuacaguaucuccacgaaacgccccaggugaaauacuuuggucugcaccauuaggccccgauuuaaauccuuaucuaucacauuuagcaagaauguauaacgguuaugcaggaggauuugaaguucaaguuauucuugcaggcaaugcuuucacagcagguaaaauaauuuuugccgcuguaccaccaaacuuuccaacagaaggcuuaucaccaucacaaguuaccauguucccucacaucaucguagauguucgacaacuagaaccaguauuaauaccucuaccagacguaagaaacaauuuuuaucacuauaaucaauccaacgacucaacaauuaaacuaauagcaauguuauacacuccucuucgugcaaauaacgccggagaagauguauuuacuguuucaugucgaguuuuaacacgucccucaccagacuuugauuuuauauuucuaguacccccaacaguagagagcagaacuaaaccauucacaguucccauacuaacaguagaagaaaugacaaacucucgcuuucccauucccuuagagaaauuauucacaggaccaucaggugcuuucguuguacaaccacaaaauggaagaugcacaacagauggaguacuuuuaggaacaacucaauuaucacccguaaauaucuguaccuucagaggagacguaacacauaucgcaggaucacgaaauuacacaaugaacuuagcuucauuaaacuggaacaauuacgacccaacugaagaaauaccagcaccucuaggaacaccagauuuuguaggaaaaauacaaggaguucuaacacaaacaacaaaaggugauggauccacccgcggacauaaagcaacagucuacacaggaucugcuccauuuacaccuaaauuaggaucuguccaauuuucaacagacacugaaaacgauuucgaagcacaccaaaacacaaaauucacaccaguuggagucauacaagauggaucaacaacccauagaaaugaaccacaacaauggguauuaccaucauacucagguagaaauguacaaaacguccacuuagcuccagcaguugcaccaacauucccaggagaacaauuacuuuuuuuuagaucaacuaugcccggcugcucgggauauccuaauauggaucuagauugccuauuaccacaagaauggguucaacauuuuuaccaagaagcagcuccagcacaaucagacguagcauuacuaagauucguuaacccagauacaggacgaguauuauucgaauguaaacuacauaaaucaggcuauguaacuguagcacacacuggacaacaugaucuaguuauacccccaaauggauacuucagauucgauucuugggucaaucaauuuuacacccucgcacccaugggaaauggcaccgguagacgcagagcauuauaa

SEQ ID NO: 31945 - RNA, 1623 nt, Artificial Sequence
  derived and/or modified sequence opt6 from VP1__Norovirus__BAJ13561
augaaaauggcauccaaugacgcuaacccauccgauggauccgcagccaaucuaguacccgaaguaaacaacgaaguuauggcucucgaaccuguaguaggugcagcuauagcagcaccuguugcaggccaaacaaaugucauagacccauggauaagaaauaacuuuguacaagcaccaggaggagaauuuacaguaucaccaagaaaugcuccaggagaaauacucuggucagcaccacuaggaccagauuuaaauccuuacuuaucacaccuagcacgaauguauaaugguuaugcaggcgguuucgaaguacaaguaauacuagcaggcaacgcauuuacagcugguaaaauuauauuugcagcaguaccaccaaacuuuccaacagaagguuuaucaccaucacaaguaacaauguuuccucacauaauaguagacguaagacaauuagaacccguacuuauuccacuaccagauguaagaaacaauuucuaucacuauaaucaauccaacgacucaaccauaaaacuuauagcaaugcuauacacuccuuuaagagcaaacaaugcaggagaagacgucuuuaccguaaguuguagaguacuaacaagaccaucaccagacuuugauuuuauauuccuagucccaccuacaguagaaaguagaaccaaaccauucacuguaccaauuuuaacaguagaagaaaugaccaauucacgcuuuccaauaccacucgaaaaauuauucacaggacccucaggagcauuuguuguacaaccacaaaacggaagauguaccacagauggaguauuauuagguacaacccaacuaagucccguuaauaucugcacauucagaggagauguaacucacauagcaggcucccgaaacuacacaaugaauuuggccucauuaaacuggaacaauuacgacccuacugaagaaauaccagcaccauuaggaacuccagacuucgucggcaaaauacaggguguauuaacacaaaccacaaaaggagauggaaguacaagaggucauaaagcaacaguauauacaggcagugcaccauucacaccuaaauuaggcucuguacaauucucaacagauacagaaaaugauuuugaaacccaucaaaauaccaaauucacaccaguaggaguaauccaagacgguucaacuacucauagaaaugaaccacaacaaugggucuuaccauccuauucaggaagaaauguacacaacguucaccuugcaccagccguagcaccaaccuuuccaggagaacaacuacuauucuuuagaucaacaaugccagggugcucaggauauccaaauauggaucuagacugucuccuaccacaagaauggguacaacauuuuuaccaagaagcagcacccgcacaaucugacguagccuuacuuagauucguaaauccagacacagguagaguauuauucgaaugcaaacuacacaaaucaggauaugucaccguugcccacacuggacaacaugaucuaguaaucccaccaaauggcuacuucagauucgacucauggguuaaucaauuuuacacacuagccccaaugggcaauggaacuggaagaagaagagcacucuaa

SEQ ID NO: 31946 - RNA, 1623 nt, Artificial Sequence
  derived and/or modified sequence opt6 from VP1__Norovirus__BAJ13564
augaaaauggcauccaacgacgcaaaucccuccgacggauccgcagcuaacuuaguucccgaagucaacaaugaagucauggcacuugaaccuguagucggugccgccauagcugcaccuguagcuggacaacaaaacguaauagauccauggauacgaaauaacuucguccaagcaccuggaggagaauuuacuguuucaccccgaaacgccccaggagaaaucuuauggucagcaccuuuagguccugauuuaaaucccuaucuaucucaucuagcaagaauguauaacggauacgcuggaggauucgaaguacaaguaauauuagcuggcaacgcauucacagcaggaaaaauaauauuugcugcaguacccccaaacuuuccaaccgaaggacuaucaccaucacaaguaacaauguucccccauauaauaguagacguaagacaacuagaaccaguauuaauaccauuaccagauguaagaaacaauuucuaccauuauaaucaaagcaaugauucuacaauaaaacuaauagcaaugcuuuacacaccacucagagcaaacaaugccggagaagaugucuuuaccguuucuugcagaguacuaacacguccuucuccagacuuugacuucauauuccuaguaccaccuacaguagaaucaagaacaaaaccauuuaccguacccauauuaaccguugaagaaaugacuaacucaagauuuccaauaccauuagaaaaacuauuuacaggaccaucaagcgccuucguaguacaaccacaaaacggaagauguacaacagacggaguacuauuaggcaccacucaacuaucacccguaaauauaugcacauuuagaggagacguaacacacauagccggcucucgcaacuacauaaugaaucuagcuucauuaaacuggaacaauuacgacccgacagaagaaauacccgcaccucuagguacaccagauuuuguagguaaaauacaaggaguacuuacacaaacaacuaaaggagacggaucuacaagaggucauaaagcuaccguauacacuggcucagcaccuuuuacucccaaacuuggaucuguacaauucucuacugauacagaaaaugauuuugaaacacaucaaaauacaaaauucacaccaguaggaguaauacaagauggauccacuacucauagaaacgaaccacaacaauggguauuaccgucauauagcggaagaaacguucacaacguucauuuggcaccagcaguagcaccaacauuuccaggagaacaauuacuauucuuuagaucaacaaugccaggaugcucaggauauccaaauauggaucuugauugccuuuuaccacaagaauggguacaacauuucuaucaagaagcggcaccagcccaaucagauguagcacuauuacguuucguaaacccagacacuggacgaguauuauuugaaugcaaauuacauaaaucuggauaugucacaguagcccacacuggccaacaugaucuuguaauaccaccaaauggcuauuucagauuugauaguuggguaaaucaauucuacacccuagcaccaaugggcaauggaacuggcagaagacgagcauuauaa

SEQ ID NO: 31947 - RNA, 1623 nt, Artificial Sequence
  derived and/or modified sequence opt6 from VP1__Norovirus__BAJ13567
augaaaauggcaaguaacgaugcaaauccuuccgauggaucugcagcaaaccuuguacccgaaguuaacaaugaaguaauggcauuagaaccaguaguuggcgcagcuauugcugcaccaguugcuggccaacaaaacguaauagacccauggaucagaaacaacuuuguucaagcaccaggaggcgaauuuacugucucacccagaaaugcaccuggagaaauacuauggucugcuccucuaggaccagaucuaaaucccuaucuuucacauuuagcaagaauguacaacgguuaugcaggaggauucgaaguacaaguaauucuugccggaaaugccuuuaccgcaggaaaaaucaucuuugcugccguaccaccuaacuucccaacugaaggacuaucucccucacaaguaacaauguucccccauauaauaguagaugucagacaauuagaaccaguucucauacccuuaccugaugucagaaacaauuucuaucauuauaaucaauccaaugacucaacaaucaaacuuaucgcuauguuauacacaccccuaagagcaaauaaugccggagaagauguuuucacaguaucaugcagaguacuaacaagaccaucuccugacuuugacuucaucuuucuaguaccuccaacuguagaaucaagaacaaaaccauucacaguaccaauauuaacaguagaagaaaugacaaacuccagauuuccaauuccauuagaaaaauuauuuacaggaccaucaucugcauucguaguacaaccacaaaauggacguuguacuacagaugguguacuucuaggaaccacacaacuaaguccuguuaauauauguacauuuaggggcgauguaacucauauagcaggcucacgugacuacaccaugaauuuagcaucccuaaacuggaacaauuaugacccaacagaggaaauaccagccccuuuaggaacaccugacuuuguuggaaaaauacaaggagucuuaacucaaacaaccaaaggugacggaucaaccagaggccauaaagccacuguauacacaggaucagcaccauuuacuccuaaauuagguucaguaagauuuucuacagauacagaaaacgauuucgaaacacaucaaaacacaaaauucacaccaguaggaguaauacaagauggaagcacuacacaucgaaaugaaccacaacaauggguucuuccaucauauuccggaagagauguacauaacguacacuuagcaccagcaguugcaccaacauuuccaggagaacaauuauuauuuuucagaucaacaaugcccggaugcuccggauacccuaauauggaccuagauugucuauuaccacaagaauggguacaacauuucuaccaagaagcagcaccagcacaaucagacgucgcauuauuacgauucguaaacccagacacuggcagaguacuuuucgaguguaaauuacauaaaccagguuacguaacaguugcacauacaggccaacacgaucuaguuauuccuccaaacggauacuuuagauucgacucauggguaaaucaauuuuauacauuagcacccaugggcaacggaacaggacgacgacgugcacuauaa

SEQ ID NO: 31948 - RNA, 1623 nt, Artificial Sequence
  derived and/or modified sequence opt6 from VP1__Norovirus__BAJ13573
augaaaauggccucuaaugaugccaauccaucugauggauccgcagccaaucuaguaccugaaguuaauaaugaaguaauggcucuugaaccuguaguaggugccgcaaucgcagccccgguagcaggccaaacaaauguaauagacccauggauuagaaacaacuuuguccaagcaccaggaggagaauuuaccguaucaccucgaaacgcaccaggugaaauauuauggucagccccacuaggacccgaucuuaacccauacuuaucacaucuagccagaauguauaacggauaugccggagguuucgaaguccaaguaauucuagcaggaaaugcauuuacugcaggaaaaauuauuuuugcagcaguuccaccaaacuuuccaacugaaggacuaucaccuucacagguuacaauguuuccccauauaauuguagacguaagacaacuagaaccaguacucaucccuuuaccugauguaagaaacaauuucuaucacuauaaucaauccaaugacucuaccauaaaauuaauagccaugcuuuauacaccccuacgagcaaauaaugcaggagaagacguauuuacaguauccugcagaguacuaacaagaccaagccccgacuuugacuuuauauuucuaguaccaccaacaguagaaucaagaacuaaaccauuuacaguaccuauauuaacagucgaagaaaugacaaacucaagauuuccaauaccacuagaaaaacuauuuaccggaccaucuggagcauuuguaguacaaccccaaaacggaagauguacuacugauggagucuuauuaggaacaacacaauuauccccaguaaacauaugcacuuuucgaggagauguaacccauauagcuggaucaaggaauuacacaaugaaucucgcauccuuaaacuggaauaauuacgauccaacagaagaaaucccugcaccacuagguacaccagacuuuguaggaaaaauacaagguguacuaacucaaacaacuaaaggugacggaucaacaagaggccauaaagcaacaguauauacagguuccgcuccuuuuacacccaaauuaggauccguacaauuuucaacagacacagaaaacgauuucgaagcacaucaaaauacaaaauucacacccguaggaguaauacaagacggaucaacuacacauagaaaugaaccacaacaauggguauuaccuucauauucaggacgaaauguacaaaacguucacuuagcaccugcaguagcccccacauuuccaggcgaacaacuacuauucuuucguucaaccaugcccgguugcaguggauauccaaauauggaccuagacugcuugcuaccacaagaauggguucaacauuuuuaucaagaagcagcaccagcacaauccgacguagccuuacuucgauuuguaaacccagauaccggccguguacucuucgaaugcaaacuucauaaaucaggauauguuaccgucgcucacacaggacaacacgaccuuguaauccccccuaacggauauuuuagauucgauuccuggguaaaucaauucuacacccuagcaccaaugggaaauggcacaggaagaagacgagcauuauaa

SEQ ID NO: 31949 - RNA, 1623 nt, Artificial Sequence
  derived and/or modified sequence opt6 from VP1__Norovirus__BAJ13576
augaaaauggcaucaaacgacgcaaacccaucagacggcucagcugcaaaccuagucccagaaguaaauaaugaaguaauggcccuagaaccaguaguaggugcagcaauugccgcaccuguugcaggacaacaaaauguaauugaucccuggauaagaaauaacuucguacaagcaccuggcggugaauuuacaguaucaccaagaaacgcaccaggagaaauaccuuggucagaaccacuuggaccugaccuaaaucccuaccuaucucauuuggcacguauguauaauggauaugcuggaggauuugaaguacaaguuauacuagcaggcaaugcauucacugccggaaaaauaauauucgccgcaguaccaccaaacuucccuacagaaggacuaaguccaucacaaguaacaauguucccacacauuauaguugauguaagacaacuagaaccaguacuaauaccauuaccugauguccguaacaauuuuuaucacuacaaucaguccaacgauucaacuauaaaacuuauagcaaugcuauacacaccauuaagggcaaacaaugcaggcgaagaugucuuuacaguaucaugucggguauuaacaagaccaucaccagacuuugacuucauauuuuuaguccccccaacaguagaaucaagaacaaaaccauucacugucccuauauuaacuguagaagaaaugacuaacagccguuucccaauaccauuagaaaaacuauuuaccggaccauccucugcauucguaguacaaccacaaaacggaagauguacaaccgaugguguacuauuaggaacaacccaacucagcccuguaaauauauguacauuucguggagacguuacucauauugcagguucacgaaauuauacuaugaaucuagcaucauuaaauuggaauaauuaugauccaacagaagaaaucccugcaccauuagguacaccagacuuuguagguaaaauacaagguguacuaacacaaacaacuaaaggagacggcucaaccagaggacacaaagcaacaguuuauacaggaucagcugacuuuacaccuaaacuagguucuguacaauuuucaacugacaccgaaaacgacuucgaaacccaucaaaacacaaaauucaccccaguaggaguuauacaagauggaggaaccacccauagaaacgaaccacaacaauggguacuuccaagcuacucuggacgaaauguacacaauguccaccuagcuccugcaguagcuccaacauuuccaggagaacaauuacuauuuuuucgaaguacaaugccaggauguuccggauauccaaauauggacuuagauugcuuauuaccacaagaauggguucaacauuucuaucaagaagcagccccugcucaaucugacguagcacuacuacgcuuuguaaaccccgauaccggaagagucuuauucgaaugcaaauuacauaaaucuggauacgucacaguagcacauacgggacaacacgaucuaguaauaccacccaauggcuacuuccgauucgacucauggguaaaucaauuuuacacucucgcuccuaugggaaacggaacaggcagacgcagagcauuauaa

SEQ ID NO: 31950 - RNA, 1623 nt, Artificial Sequence
  derived and/or modified sequence opt6 from VP1__Norovirus__BAJ13579
augaaaauggcuuccaaugaugcaaauccaucagauggaucagccgccaaucuaguaccagaaguaaacaacgaaguaauggcacuagaaccaguaguaggagcugcaauagcggcacccguagcaggccaacaaaauguaauugacccauggauaagaaacaacuuuguacaagcuccaggaggcgaauuuacaguaaguccaagaaacgcuccaggagaaauacuauggucagcaccucucggacccgaucuaaauccauacuuaucacauuuagcaagaauguauaacggauacgccggcggauuugaaguacaaguaauauuagcaggaaaugccuuuacagcaggcaaaauuauauuugcagcaguaccacccaacuuuccaacugaaggacuuucaccaagucaaguuaccauguuuccucauauaauaguagacguccgacaauuagaaccagucuuaauaccgcucccagacguaagaaauaauuucuaccauuauaaucaaucaaaugauucaaccauuaaauuaauagcaaugcuauacacaccacuccgcgcaaacaaugcaggcgaagauguauucaccguaucauguagaguacuaaccagaccaucccccgauuuugauuuuaucuuccuaguaccaccaacaguugaaucaagaacaaaaccauucacaguaccaauacuuacaguagaagaaaugacaaacucuagauuuccaauuccccuagaaaaauuauuuaccggaccaucuucugcuuuuguaguacaaccacaaaacggaagaugcaccacagaugguguauuacuaggaacuacccaacuauccccagucaauauauguacauucaggggagauguaacacauauagcaggaucucgaaauuacacuaugaaucucgcaucauuaaacuggaacaacuaugaccccacagaagaaauaccugcaccucuaggaacaccagauuuugucggaaaaauacaaggagucuugacucaaacaaccaaaggcgacggauccacuagaggacauaaagcaacaguauauacuggaucagcugacuuuacuccaaaacuuggaucuguacaauucucaacagauaccgaaaaugauuuugaaacccaucaaaauacaaaauuuacacccguuggagucauacaagauggaggaacuacacaucguaaugaaccacaacaauggguacuaccaucauacucagguagaaauguacauaacguacauuuagccccagcagucgcaccaacauuuccaggagaacaacuucuuuuuuucagaucaacaaugcccggaugcucaggauacccuaauauggaucuagacugcuuacuuccacaagaauggguacaacauuuuuaucaagaagcagcaccagcacaaucagacguugcccuauuaagauucguaaauccagacacaggccgaguuuuauuugaauguaaauuacacaaaucuggauauguaacaguagcucacacaggccaacacgaccuaguaauaccaccaaauggcuauuuucguuucgacucauggguuaaccaauuuuauacuuuagcaccaauggguaauggaacaggccgaagaagagcauuauaa

SEQ ID NO: 31951 - RNA, 1623 nt, Artificial Sequence
  derived and/or modified sequence opt6 from VP1__Norovirus__BAJ13582
augaaaauggcauccaaugacgcuaauccauccgauggaucagcagcaaaucuaguuccagaaguaaauaaugaaguaauggcucuugaaccagucgucggagcagcuauagcugccccagucgcuggacaacaaaaugucauugacccauggauaagaaauaacuucguacaagcaccuggaggagaauuuacaguauccccaagaaacgcaccaggagaaauauuauggucugcaccauuaggaccagaccucaauccauauuuaucacaccucgcccgcauguauaacggauaugcaggcggauuugaaguacaaguaauuuuagcaggaaaugcauuuacagcaggaaaaauuauauuugccgcaguaccucccaacuuuccaacagaaggcuuaucucccucacaaguaacuauguucccacacauaauaguagacguacgccaacuagaacccguacuaauaccauuaccagauguaagaaacaauuucuaucacuauaaucaaucaaacgacuccaccaucaaacuaauagcaauguuauacacccccuuacgagcaaacaacgcaggcgaagacgucuucacuguaucuuguagaguccuaacucguccauccccugauuuugauuuuaucuuccucguaccaccaacaguagaaucuagaacaaaaccauuuacagucccuauccuaacaguagaagaaaugacaaacaguagguucccaauacccuuagaaaaauuauucacaggaccaucaggagcauucguaguacaaccccaaaacggacgcuguacuacugacggaguacuauuaggaacaacacaacuaucaccuguaaauauauguacauuucgaggagauguaacccacauagcaggaucaagaaacuauacuaugaaucuagcaagccuaaacuggaauaacuacgacccaacagaagaaauaccugcuccuuuagguacuccagauuucgucggaaaaauccaagguguccuaacacaaacaacuaaaggugauggaucaacucgcggacacaaagcaaccguauauacugguucugcaccauucaccccuaaacuuggauccguacaauucuccacggauacagaaaacgacuucgaaacacaucaaaauacuaaauucacaccugucggaguaauacaagauggaucaacaacccaucgcaaugaaccacaacaauggguauuaccuucauauuccgguagaaauguacauaacguucaucuagcaccagcaguagcaccaacauuuccaggagaacaacuauuauuuuucagauccacaaugccagguugcucuggauaucccaauauggacuuagauugccuuuuaccacaagaauggguacaacauuucuaucaagaagcagcaccugcccaaucugauguagcacuauuaagauucguaaaccccgauacuggucgaguauuauucgaaugcaaacuacacaaauccggcuacguaaccguagcucacacaggacaacacgaccuaguuauaccaccuaauggauacuuccgauuugacagcuggguuaaucaauucuauacacuugcccccaugggaaauggaacaggaagaagaagagcuuuauaa

SEQ ID NO: 31952 - RNA, 1623 nt, Artificial Sequence
  derived and/or modified sequence opt6 from VP1__Norovirus__BAJ13585
augaaaauggcuucaaacgacgcaaauccaagugauggcucagcagcaaaucuuguccccgaaguaaauaacgaaguaauggcacuagaacccguaguaggcgccgcaauagcagccccaguagcaggacaacaaaauguaauugacccuuggauaagaaauaacuucguccaagcaccuggaggagaauuuaccguaucacccagaaacgcaccaggcgaaauccuauggucagcaccccucggacccgaucuaaacccauauuuaucacaccuagcuagaauguauaacggauaugcaggaggauucgaaguacaaguuauacucgcaggaaacgcuuuuaccgcaggcaagauaauuuuugcugcaguaccuccaaacuucccaacugaaggacucucaccaucacaaguaacaauguucccucacauuauuguagacguaagacaauuagaaccaguuuuaauaccacuuccagauguuagaaacaauuuuuaccacuauaaccaaucaaacgacucaacaauaaaacuaauagcuaugcuauacacaccccuaagagcuaauaaugcuggugaagaugucuuuacagugucauguagaguacuaacaagaccauccccagacuucgauuucauuuuucuaguaccaccaacaguagaaucuagaacuaaaccauucacaguaccaauacuaaccguagaagaaaugacaaacucucgauuuccaauaccacuagaaaaacucuuuacaggacccucuucagcauucguuguccaaccacaaaaugguagauguacaacagacggaguacuucuagguacaacccaauuaagcccuguaaauauaugcacuuuucguggagauguaacucauauagcuggcucacguaacuauacaaugaauuuagcuucuuuaaacuggaacaauuaugauccuacagaagaaauuccagcuccucuagguacuccagauuucguaggcaaaauucaagguguauuaacacaaaccaccaaaggagacggaucaacuagaggucauaaagcaacaguauacacuggaucagcaccauuuacaccaaaauuaggauccguucaauucucaacagacaccgaaaacgauuuugaaacacaccaaaauacaaaauuuacccccguugguguaauacaagacggaggcacaacacauagaaaugaaccucaacaauggguccuaccaucauauucuggccgaaacguaccuaacguacauuuagcaccagccguugcaccaacauuuccaggagaacaacuacuauuuuuuagauccacuaugccagguugcucuggauauccaaauauggacuuagauugcuuacuuccacaagaauggguacaacauuuuuaucaagaagcagcaccagcucaauccgacguagcacuucuaagauucguaaauccagauacaggaagaguacuauucgaaugcaaauuacacaaaucuggauaugucacaguagcacauacaggacaacacgaucuagucauaccuccaaacggcuauuuuagauucgacuccuggguuaaucaauucuacacacuagcaccuaugggaaauggaacuggacgccgcagagcauuauaa

SEQ ID NO: 31953 - RNA, 1623 nt, Artificial Sequence
  derived and/or modified sequence opt6 from VP1__Norovirus__BAJ13591
augaaaauggcaagcaaugaugcuaaucccucagauggaucagcagcaaauuuagucccagaaguuaacaacgaagucauggcacuagaaccaguugucggugcugcaaucgcagcaccuguagcaggacaacaaaauguuauagauccauggauacgcaauaauuucguacaagcaccaggaggagaauuuacaguaucaccaagaaacgcaccuggagaaauauuauggagcgccccucucgguccugaucuuaaccccuauuuaucucacuuagcucgcauguauaauggauacgcaggaggauucgaaguucaaguaauauuagcagggaaugcauuuaccgcuggcaaaauaauauuugcugcagucccaccaaacuucccaacagaaggucuaucccccucacaaguaaccauguucccacacauuauaguagacguaagacaacuagaaccaguuuuaauaccacuaccagacguaagaaacaauuuuuaucauuauaaucaauccaaugauucaacuauaaaacuaauagcaauguuauacacuccucuacgagcaaacaacgcaggugaagacguauuuacagucucuugucgaguacuaacaagaccauccccagacuuugauuucauauuuuuaguaccaccaacaguugaaucaagaacaaaaccauucacuguuccaaucuuaacuguagaagaaaugacaaacucaagauuucccauaccacuagaaaaauuauucacaggacccucaucagcauucguaguacaaccacaaaauggaagauguaccaccgacggaguucuucuaggaacaacacaacuaucuccagucaauauuuguacauuuagaggagacguaacacacauagcaggcucaagaaauuacacaaugaaccuagcaucuuuaaauuggaauaauuaugaucccacagaagaaauaccagcaccuuuaggaacuccagauuucgugggaaaaauucaaggaguauuaacccaaacaacaaaaggagacggauccacaagaggccauaaggcuacaguuuauacagguucagcaccuuucaccccaaaauuaggauccguacaauucucaaccgauaccgaaaaugacuuugaaacacaucaaaacacuaaauucacaccaguaggcguaauacaagauggcggcacuacacacagaaacgaaccacaacaauggguuuuaccaucauauucagguagaaauguaccaaacguccaucucgcaccagcuguagcccccacuuuuccaggcgaacaacucuuauuuuuucgaucaacaaugcccggauguucuggauacccaaauauggacuuagauugcuuauuaccacaagaauggguucaacauuucuaccaagaggcagcuccagcucaaucagaugucgcuuuacuaagauucguaaauccagauaccggaagaguauuauuugaaugcaaacuauacaaaucaggauaugucaccgucgcacacacuggacaacaugaccuaguaauaccacccaauggcuauuucagauucgacucuugggucaaucaauuuuauacacuagcaccaaugggcaauggaacaggacgcagaagagccuuauaa

SEQ ID NO: 31954 - RNA, 1623 nt, Artificial Sequence
  derived and/or modified sequence opt6 from VP1__Norovirus__BAJ13594
augaaaauggcaucaucugaugcuaaccccucagauggauccgcagcuaaccuuguaccagaaguaaacaaugaagucauggcacuagaacccguaguaggagcagcaaucgcagcaccaguagcaggacaacaaaauguaauagauccauggauacgcaauaacuuuguacaagcaccuggcggugaauucacaguuagccccagaaaugcaccaggagaaauacuaugguccgcaccacuaggacccgaccuaaaucccuauuuaucacacuuagccagaauguauaacggauaugcugguggauucgaaguacaaguaauauuagcagguaaugcauuuacagcaggaaaaauaauauucgcagcaguaccaccuaacuucccaacagaaggacuuuccccuagucaaguaacuauguuuccacacauaauagucgaugucagacaacuagaaccaguacuaauaccauuaccagacguacgcaauaacuuuuaucauuauaaccaaagcaaugacaguacaaucaaacucauagccauguuauauacaccauuaagagcaaacaacgcaggagaagauguauuuacaguaagcugucgaguacuaacgagaccaucaccugacuuugauuuuauauuucucguaccgccuacuguagaaucaagaacuaaaccauuuacuguaccaauacuaacaguugaagaaaugacuaacucacgauuucccauaccacuagaaaaacuauucacaggcccaucaggagccuuuguaguacaaccacaaaacggacgauguacaacagacgguguuuuacuuggaacaacacaacuaaguccaguuaauauaugcacauuuaggggagauguaacacacauagccggaucccguaauuacacaaugaauuuagcaucacuaaacuggaacaauuacgacccaacugaagaaauaccagcaccccuaggaacaccugacuuuguaggaaaaauacaagguauguuaacacaaacaacaaaaggugacgguagcacaagaggacacaaagcaacuguauacacaggaucagccccauuuacacccaaacuugguucuguacaauucucaacugauacagaaaacgauuuugaaacacaccaaaacacaaaauucacaccaguuggcguaauacaagacggaucaacaacacaucgaaaugaaccacaacaauggguacuaccaucauauucaggaagagauguacauaacguccacuuagcacccgccguagcuccuacauucccuggagaacaauuauuauuuuucagaucaacaaugcccggauguucuggauauccaaauauggacuuagauugccuacuuccacaagaauggguacaacauuuuuaucaagaagcagcccccgcacaaagugacguagcuuuacuaagauuuguaaauccagauacaggaagagucuuauuugaaugcaaacuacauaaaucaggauauguaacuguagcccacacaggccaacacgaucuuguaauuccacccaauggauauuucagauucgauucauggguaaaucaauuuuacacucuagcaccaaugggcaauggcacuggacgucguagagcauuauaa

SEQ ID NO: 31955 - RNA, 1623 nt, Artificial Sequence
  derived and/or modified sequence opt6 from VP1__Norovirus__BAJ13597
augaaaauggcaucaaaugaugccaauccaucagacggauccgccgcaaacuuaguccccgaaguaaauaacgaaguaauggcccuugaaccaguaguaggagcagcaauagcugccccuguagccggacaaacaaauguaauagauccauggauucgaaauaauuucguacaagcaccagguggagaauucacaguaucaccaagaaacgccccaggagaaauacuuuggucagcaccuuuaggaccagacuuaaauccauaccuaucacaccuagccagaauguauaaugguuacgcaggagguuucgaaguccaagucauauuagcuggaaaugcuuuuacagcaggaaaaauaauauuugcagcaguaccucccaauuuuccuacagaaggacuaagucccucacaagucaccauguucccacacaucauaguagaugucagacaacuagaaccaguauuaauaccauuaccagaugucagaaauaacuuuuaucauuacaaucaaucaaacgacucaacaauaaaacuaauagcaaugcucuacacgccauuacgagccaacaacgcuggagaggacguauuuacaguaucauguagaguauuaacaagaccaucuccagauuuugacuuuauuuuuuuaguaccaccaacaguagagucaagaacaaaaccauuuacagucccgauucuaaccguagaagaaaugacuaauucuagauucccaauaccauuagaaaaacuauuuacggguccuucuggugcauucguaguacaaccacaaaacgguagauguacaaccgacggaguucuucuaggaaccacacaacuaucuccuguaaauauaugcacauuuagaggcgacguuacacauauagcugguucaagaaauuacacaaugaacuuagcaagccuaaauuggaauaauuaugacccaacagaagaaauaccagccccacucgguacaccagacuucguuggaaaaauacaaggaguacuaacacaaaccacuaaaggagacgguucaacuagaggacacaaagcaacaguuuauacaggaucagcaccauuuacacccaaauuaggaucaguccaauucucuacagacacagaaaacgacuucgaagcacaucaaaauacaaaauucacaccaguaggaguaauacaagacggaucaaccacacacagaaaugaaccacaacaaugggucuuaccauccuauucaggcagaaauguacaaaacguacaccucgcuccagcaguagccccuacauuuccaggugaacaauuauuauuuuuuagaucaacaaugccagguugcucaggauacccaaauauggauuuagacugccuucucccacaagaauggguacaacacuuuuaucaagaagccgcuccagcacaaucagauguagccuuacuaagauucgucaauccagacacuggaagaguauuauucgaaugcaaacuacauaaauccggauaugucaccguagcccacacaggacaacacgacuuaguuauaccuccaaauggauacuucagauucgauucauggguuaaucaauucuacaccuuagcaccaaugggaaacggcacaggccgccgaagagcacucuaa

SEQ ID NO: 31956 - RNA, 1623 nt, Artificial Sequence
  derived and/or modified sequence opt6 from VP1__Norovirus__BAJ13603
augaaaauggcauccaacgacgcuaauccuucugacggauccgccgcuaaccuagucccagaaguaucaaaugaaguaauggcacuugaacccguuguuggagcagcaauagcagcaccugucgcaggacaacaaaacguaauagacccauggauaagaaauaauuuuguacaagcaccuggaggugaauuuacagucaguccgagaaaugcuccaggagaaauauuauggucagcaccauuaggaccagauuuaaauccauaucuaucacauuuagcaagaauguauaacggauacgcaggaggauucgaaguacaaguaauauuagcaggcaaugcauuuacagccggaaaaauaauauuugcagcagucccaccaaacuucccuacagaaggccuuucuccaucacaaguaacaauguucccucacauuaucguugacguaagacaacuagaaccaguauuaauaccauuaccagaugucagaaacaauuucuaucauuauaaucaaucaaacgacucaacuauuaaauuaauagcuauguuauacacaccccuucgagcuaacaaugcaggagaagauguauucacuguuagcugucgaguucuaacuagaccaucccccgacuucgacuuuauauuucuagucccaccaacagucgaaucaagaacaaaaccauucacaguuccuauauuaaccguugaagaaaugaccaacucaagauuuccaauaccacuagaaaaauuauucacaggaccaucuucagcauucguaguacaaccacaaaacggacgaugcacaacugacgguguacuacuaggaaccacacaacuaaguccagucaauauauguacuuuucgcggggacguaacccacauagcaggaucccguaacuacacaaugaauuuagccucauuaaauuggaacaacuacgauccaaccgaagaaauaccagcuccacuaggaacaccagacuuuguaggaaaaauacaagguguucuaacacaaacaacaaaaggugacggcucuacacgaggacauaaagcuacaguauacacaggaucugcaccauuuacaccuaaauuagguucaguacaauuuuccacagauacagaaaaugacuuugaaacucaucaaaauacaaaauucacaccaguagguguuauacaagaugguggcacuacccauagaaaugaaccccaacaauggguucucccaucauauucaggacguaauguaccaaacguacaucuagcaccugccguagcaccuacuuuucccggugaacaacuccuauuuuuucgaucaacaaugccaggauguucagguuaccccaauauggaucuagauuguuuauuaccacaagaauggguacaacacuuuuaucaagaagcagcaccagcacaaagugacguugcuuuauuaagauucguaaacccagacacaggucgaguuuuauucgaaugcaaauuacauaaaucugguuauguaacaguagcacacacaggacaacacgaccucguaaucccuccaaauggcuauuucagauucgacagcugggucaaucaauuuuacacacuagcaccuaugggcaacggaacaggaagaagaagagcauuauaa

SEQ ID NO: 31957 - RNA, 1623 nt, Artificial Sequence
  derived and/or modified sequence opt6 from VP1__Norovirus__BAJ13606
augaaaauggcuucuucagaugcaaauccauccgacgguucugcugcaaaccuaguacccgaaguaaacaacgaaguaauggccuuagaaccaguaguaggugcagcaauagcagccccaguugcaggacaacaaaaugucauagauccuuggauaagaaacaacuuuguucaagcaccaggcggcgaauucacaguaagcccuagaaaugcaccaggagaaauauuauggucagcaccauuaggcccagaucuaaacccauacuuaucacaucuagcaagaauguauaacggcuaugccgguggauucgaaguacagguuauacuagccggaaaugccuuuacagcaggaaaaauaauauuugcagccguaccuccaaauuucccaaccgaagguuuauccccaucacaaguaaccauguucccacauauaauuguagacguuagacaauuagaaccuguauuaauaccacuuccagacguaagaaauaauuuuuaucacuauaaccaaucuaaugacucaacuauaaaacuuauagccaugcuuuacacaccauuaagagcuaacaaugccggagaagaugucuuuaccguaucauguagaguacuuacucgcccaucaccagauuucgacuucauauuccuaguuccaccaacaguagaaucacgaaccaaaccauuuacagucccaauauuaacagucgaagaaaugacaaauucaagguuuccaauaccacuagaaaaauuauuuacaggaccauccucagcauucguaguacaaccacaaaauggaagauguacaaccgauggaguauuacuagguacuacacaacuaucaccaguaaauauauguacauuucgcggagacguaacacacaucgcuggaucaagagauuacacgaugaaucuagcaucacuaaauuggaacaauuacgauccaacugaagaaauaccagcaccccucggaacaccagacuuuguagguaaaauacaagguguacuaacacaaacuacaaaaggagacggaucaacaagaggacacaaagcaacaguauacacaggaucagcuccauuuacuccaaaacuagguucaguacaauucucaacagacacaggagacgauuuccaaacccaccaaaauacuaaauucacaccagucggaguaauacaagauggaggcacaacacauagaaaugaaccacaacaauggguacuacccucauauuccggaagaaacguaccaaauguccauuuagcaccagccguugcuccaacauuuccuggagaacaauuacuuuucuuccgaucaacaaugcccggguguucaggauauccaaauauggaucuagauugucuacuaccacaagaauggguccaacacuuuuaucaagaagccgcuccugcacaaucagacguagcacuccuacgcuuugucaacccagacacaggaagaguauuauuugaaugcaaauuacacaaagccggauauguaacaguagcacacacaggacagcaugacuuaguuauacccccaaauggauacuuuagauucgauucuuggguaaaccaauuuuacacauuagccccaaugggaaauggaacaggaagaagacgagcacuuuaa

SEQ ID NO: 31958 - RNA, 1623 nt, Artificial Sequence
  derived and/or modified sequence opt6 from VP1__Norovirus__BAJ13609
augaaaauggccucaaaugacgcaaacccaucagauggaucugcagcaaaccuaguaccagaaguaaacaacgaaguaauggcacuagaacccguaguaggugccgcaauugcagcaccaguagcuggccaacagaauguuauagacccuuggauuagaaacaauuuuguacaagcaccuggaggagaauuuacaguaucaccaagaaacgcaccaggagaaauacuauggucugcacccuuaggaccagauuuaaauccuuaucuaucccacuuagcuagaauguacaacgguuaugccggaggauucgaaguacaagucauacuugcuggaaaugcauuuacagcaggaaaaauaauauuugcagcuguaccuccaaacuucccuacagaaggucuaucuccaucacaaguaaccauguuuccucauauuauaguagacguaagacaacuugaaccaguccuaauaccacuaccagauguuagaaauaacuuuuaccauuauaaccaaucgaacgacucaacaauaaaacuaaucgccaugcuauauacuccacuacgagcuaacaaugcaggagaagacguauuuacaguuagcugcagaguauuaacuagaccaucaccagacuucgauuuuauauuccuaguaccaccaaccguagaaucucgaacaaaacccuucaccguacccauacuaacugucgaagaaaugacuaacucacgauucccaauaccacucgaaaaacuauuuacaggacccucaucagcauucguuguacaaccucaaaacggaagauguacaacagauggaguccuucuugguacaacacaauuaaguccagucaacauauguaccuuucgaggcgacguaacucauauagcaggaucaagaaacuacaucaugaaucuagcaucacuaaacuggaauaauuaugacccaacagaagaaauaccagccccacuagguacaccagacuuuguaggaaaaauacaaggcguacuaacacaaacuacaaaaggcgauggaucaacuagaggacacaaagcaacuguauacacagguucagcaccauuuacaccaaaauuaggcucuguccaauucucuacagacacugaaaacgauuucgaaacacaucaaaauacaaaauucaccccaguuggaguaauccaagacgguuccacaacccauagaaaugaaccacaacaauggguauuaccuucauacucugguagaaauguccauaauguacacuuagcaccugcagucgcuccaaccuucccaggagaacaacuauuauucuuucgaucaacaaugccagguuguucaggauauccaaauauggaucuagauugcuuacuaccacaagaauggguccaacauuucuaucaagaagcagcaccagcacaaucagauguugcccuacuucgauucguaaauccagauacuggcagaguuuuauuugaaugcaaauuacauaaaucagguuacguaacaguagcacacacuggacaacacgaccuaguaauaccacccaauggauauuuccgcuucgauucauggguuaaucaauuuuauacauuaacacccaugggaaauggaacaggaagaagacgagcucuauaa

SEQ ID NO: 31959 - RNA, 1623 nt, Artificial Sequence
  derived and/or modified sequence opt6 from VP1__Norovirus__BAJ13612
augaaaauggcaucaaaugaugcaaacccaucagauggcucugccgcaaaucuaguacccgaaguuucaaaugaaguuauggccuuagaaccaguuguaggugcugcaauagcagcaccaguagcaggucaacaaaacguaauagacccauggauaagaaauaacuuuguacaagccccaggaggugaauucaccguuaguccacgcaaugcaccuggagaaauauuauggucagcaccauugggaccagaucuaaauccuuauuuaucacaucuagcacgcauguauaacgguuacgcgggcggauucgaaguacaaguaauauuagcaggaaaugcauuuacagcuggaaaaauaauuuucgcagcuguaccaccaaauuuuccaacagaagguuuauccccaagucaaguuacgauguucccccauauaauaguagauguaagacaauuagaacccguauuaauaccauuaccagauguacgaaauaacuucuaccauuauaaccaaucaaaugacucaacaauaaaacuaaucgcaaugcuauacaccccacuaagagccaacaacgcaggagaagauguauucacaguaucauguagaguauuaacaagaccuucaccagacuuugauuucauauuuuuaguaccaccaacaguagaaucuagaacaaaacccuuuacaguaccuauacuaacuguugaagaaaugacaaacagcagauucccaauaccccuugaaaaacuauucacuggacccaguggcgcauucguaguacaaccacaaaauggaagaugcacaacagacgguguauuauuaggaacaacucaauuauccccuguaaauauauguacauuuagaggagacguaacacauauagccgguuccagaaacuauacuaugaaccuagcaagcuuaaauuggaacaauuaugacccaacugaagaaaucccagcaccauuagguacaccagauuuuguaggaaaaauacaaggaguacuaacacaaacaacaaaaggugauggaucuacccgcggacacaaagcaaccguauacaccggauccgcuccauucacaccaaaacuaggcucaguacaauucucuacagacaccgaaaacgacuuugaaacacaucaaaacaccaaauucaccccaguuggaguaauucaagacgguggaacaacacacagaaaugaaccacaacaauggguacuaccaaguuauucagguagagauguacauaacguucauuuagcaccagcuguugcaccuacauuuccaggagaacaacucuuauucuucagauccacaaugccaggaugcaguggcuauccuaauauggaucucgauugccuacuaccacaagaauggguccaacauuuuuaucaagaagccgcaccagcacaaucugacguugcucuacuaagauuuguuaacccagacacgggaagaguacuauuugaaugcaaacuacacaaaucagguuauguaacuguagcacauacaggacaacacgaucuaguuauaccuccaaauggauauuucagauucgauucauggguaaaucaauuuuauacacuagcaccuaugggaaauggcacaggcagaagaagagcacuauaa

SEQ ID NO: 31960 - RNA, 1623 nt, Artificial Sequence
  derived and/or modified sequence opt6 from VP1__Norovirus__BAJ13615
augaaaauggcauccaaugaugcaaauccgucagacggaucagcagcaaaucuuguacccgaaguaaauaaugaaguaauggcauuagaaccaguaguuggagccgcuauagcagccccaguagcuggacaacaaaauguaauagacccauggauaagaaauaauuuuguucaagcuccaggaggcgaauuuacgguaucaccuagaaaugcacccggagaaauacuauggucugcaccuuugggaccagaucucaaccccuaucucucccacuuagccagaauguauaacggauacgccgguggauuugaaguacaaguaauccuagcuggaaaugcguuuacagcaggaaaaauuauauucgcagcaguaccaccaaacuucccaacagaaggucucucuccaucacaaguaacaauguuuccccauauuauaguugauguuagacagcuugaacccguauuaauaccauuaccagacguaagaaacaauuucuaucauuacaaucaaucaaaugauucaaccauaaaacuaauagcuauguuauacacuccucuucgugccaacaaugcaggagaagauguauucacaguaucaugcagaguacuaacuagaccaucaccugacuuugauuuuauauuucuuguaccaccaacaguagaaucacgaacuaaaccauuuacuguacccauacuuacaguagaagaaaugacaaauuccagauuuccaauaccauuagaaaaauuauuuaccgguccaucuggagcauucguaguacaaccacaaaacgggagauguacaacagauggaguacuauuaggaaccacacaauuaucaccuguaaacauauguacauuuagaggagacguaacucauaucgcaggaucccgaaacuacacaaugaaccuagcaucauuaaacuggaacaacuacgacccaacugaagagauaccagcaccacuuggaacaccagacuuuguagguaaaauccaaggaguacuuacacaaacaaccaaaggugacggcucaacaagaggccauaaagcaacaguauacacaggaucugcucccuuuacaccaaaauuaggaucaguacaauucucaaccgacacagaaaacgauuucgaaacucaucaaaauacaaaauucacaccaguaggcguaauacaagauggaggaacaacacauagaaacgaaccacaacaauggguauuaccaucauauucaggaagaaacguucacaacguccaccuagcaccagcaguagccccaacauuuccaggagaacaauuauuauucuucagauccaccaugccagguuguucaggauauccaaacauggaucucgauugcuuacuaccucaagaauggguucaacauuucuaucaagaggcagcucccgcacaaucagauguagcacuauugagauucguuaauccagacaccggaagaguacucuucgaaugcaaauuacauaaauccggauauguaacaguagcacacacaggacaacacgaucuaguaauaccaccuaacggauacuuccgauucgauucauggguaaaccaauuuuacacacuagcuccuauggguaacggaacagguagaagacgugcauuauaa

SEQ ID NO: 31961 - RNA, 1623 nt, Artificial Sequence
  derived and/or modified sequence opt6 from VP1__Norovirus__BAJ13618
augaaaauggcaucaaaugacgcaaauccaucagauggaucagcagcaaaccuuguuccagaagucaacaaugaaguuauggcauuagaaccaguaguaggugcugccauagcagcaccagucgcaggucaacaaaauguaauagacccauggauuagaaauaacuuuguucaagcgccugguggagaauuuacagucuccccaagaaacgcuccaggagaaauauuauggucagcaccauugggaccagacuuaaacccauaucuuucucaucuagcacguauguauaacggauaugcaggaggauucgaaguacaaguaauucuagccgguaaugcauucacagcuggaaaaauaauauuugcagccgucccuccaaacuucccaaccgaaggucuaucaccaucacaaguaacaauguucccacacauuaucguagacguaagacaacuagaaccuguccuaauuccacucccugauguaagaaauaacuucuaucacuauaaccaaucaaaugacucaacaauaaaauuaauagcaaugcuuuacacaccacuaagagcaaacaaugcaggugaagacguauucacagucuccugucgaguauuaacacguccaucaccagauuucgacuuuauauuucuaguuccaccuacaguagaauccagaacaaaaccauuuacagucccaauucucacuguagaagaaaugacaaauucacguuuuccaauuccauuagaaaaauuauuuacaggacccuccucagcauuuguaguacaaccccaaaacggaagauguaccacagacggcguauuacuaggaaccacacaauuaucaccuguaaauauaugcacuuuuagaggcgacguaacacauauugcugguucuagaaauuacacaaugaaccuagcuucauuaaauuggaacaacuacgauccaacugaagagauuccagcacccuuaggaacuccagacuuuguaggaaaaauacaaggcguauuaacccaaacaacaaaaggugacggaucaacuagaggacauaaagcuacaguuuauaccgguuccgcaccauucacaccaaaauuaggaucuguccaauucucaaccgauacagaaaacgauuucgaaacacaucaaaauacuaaauuuacuccaguaggaguuauacaagacggaucuacuacacacagaaacgaaccacaacaauggguauuaccuucuuauucaggacgaaauguucaaaacguacauuuagcacccgcaguagcaccaacauuuccaggugaacaauuauuauucuucagaucuacaaugccaggaugcucuggcuauccuaacauggacuuagauugcuuauuaccacaagaauggguacaacauuuuuaucaagaagccgcaccggcucaaucagauguagcacuauuaagauucguuaauccagacaccggacggguacuauucgaauguaaacuucauaaguccggcuauguuacaguagcacacacaggucaacacgaccuuguaauaccuccaaauggauauuucagauucgauucauggguuaaucaauuuuacacauuagcacccaugggaaacggugcaggaagacgacgcgccuuauaa

SEQ ID NO: 31962 - RNA, 1623 nt, Artificial Sequence
  derived and/or modified sequence opt6 from VP1__Norovirus__BAJ13621
augaaaauggccucuaaugaugcuaacccaucugacgguuccgcagcuaacuuagucccugaaguuaauaacgaaguaauggcucucgaacccguuguaggagcagcaauagcugcuccaguugccggacaaacaaauguaauugauccauggauaagaaauaacuuuguacaagcaccaggaggugaauuuacaguaucaccaagaaaugcaccaggugaaauacucuggucagcaccauuaggaccagaccuaaauccguaucuaucucaccuagcaagaauguauaauggauacgcaggaggcuuugaaguccaaguaauacuagcaggaaacgcuuuuacagccgggaaaauaauuuuugcagcaguuccaccuaacuuuccaacugaaggucuaucaccaucacaaguaacaauguucccucacauuaucguugauguuagacaacuagaacccguauuaauaccauuaccagauguaagaaacaacuuuuaucauuauaaccaaucaaaugacucuacaauaaaauuaauagcuaugcuuuauacacccuuaagagcaaauaaugcaggagaagauguauuuacaguaucaugcagaguuuuaacacgaccaucaccugacuucgacuucauauucuuagucccaccaaccguugaaucaagaacaaaaccauucacaguaccaauacuaacaguagaagaaaugacuaauucacgauuuccaauuccacuagaaaaacuuuucacaggcccaucuggagcauuuguaguacaaccccaaaacggaagaugcaccacagacggagucuuacuaggcacaacucaacuuucuccaguuaauauauguacuuuucgaggugacguuacacacauagcagguucucgaaauuauacaaugaaucuagcaucauuaaacuggaauaauuacgacccaacagaagaaauaccagcaccucucggcacacccgacuucguaggaaaaauacaagggguauuaacucaaacuacaaaaggugacggaucaaccagaggacauaaagccacaguauauacuggaucagcuccauuuacaccaaaauuaggaucaguacaauucucaaccgauacagaaaacgauuucgaaacacaucaaaacaccaaauuuacuccaguaggaguuauacaagacggaucaacuacccacagaaacgaaccucaacaauggguucuuccaucauacuccggaagaaauguccauaacguacaucuagcacccgcuguugcuccaacauuuccuggcgaacaauuacuauucuuuaggucaacaaugccaggauguucugguuauccuaauauggauuuagauugcuuauuaccacaagaauggguacaacacuuuuaucaagaagcugcaccagcccaaucagauguagcccuauuaagauuuguaaacccagacacaggaagagucuuauuugaaugcaaacuccauaaaucuggauauguaacagucgcucauacuggacaacacgaucuaguuauaccuccaaaugguuauuuccgauuugauucauggguaaaccaauuuuauacacuugcucccaugggaaauggaacaggacgaagaagagcccucuaa

SEQ ID NO: 31963 - RNA, 1623 nt, Artificial Sequence
  derived and/or modified sequence opt6 from VP1__Norovirus__BAJ13624
augaaaauggcaucuaacgacgcuaauccuucagauggaucagcagcaaauuuaguaccagaagucaauaacgaaguaauggcacuagaaccaguaguaggagcagcaauagcagcucccguagcaggccaacaaaauguaauagauccauggauuagaaacaacuuuguacaagcaccaggaggugaauuuacaguaucacccagaaaugcaccuggagaaauacuuuggucagccccuuuaggaccagaccuaaaccccuacuuaucacaucuagcacguauguacaauggauacgcaggcgguuuugaaguacaaguaauacuagcaggaaaugccuuuacagcagguaaaauaauauuugcagcggucccaccaaacuuucccacugaaggacuaucaccaucccaaguaacaauguucccacacauaauaguugaugucagacaacucgaaccaguauuaauaccauuaccagauguaagaaacaauuucuaucacuauaaucaaucaaaugauucaacaauaaaauuaauagcaaugcuauacacaccacuaagagcuaacaaugccggugaagauguauuuaccguaucauguagaguucuaacaagaccuucaccagauuucgacuuuauauuccuaguuccaccaacaguugaaucaagaacaaaaccuuucacuguacccauacucaccgucgaagaaaugacaaauucaagauucccuauaccacuugaaaaacuauuuacaggccccucuucagcauucgcaguacaaccacaaaacgguagauguaccacugacgguguacuccuaggcacaacacaauuaucaccaguaaauauauguacauuuagaggagacguaacacauauagcaggaucuaggaacuauaccaugaaccucgcaucuuuaaacuggaacaacuacgauccaacagaagaaauaccugcuccacuaggcaccccggacuuuguagguaaaauacaaggaguucucacucaaaccacaaaaggagacggauccacuagaggucacaaagcaacaguauauacaggaucagcaccuuucaccccaaaacuaggaucaguacaauuuagcacagauacagaaaacgauuuugaaacccaucaaaauacaaaauucacuccaguugguguaauacaagauggaucaacaacacaucgaaaugaaccacaacaauggguauuaccaucauauucuggcagaaauguccccaacguccacuuagcccccgcaguugcuccuacauucccaggagaacaacuucuuuuuuuucgaucaacuaugccaggaugcucaggcuaucccaauauggaucuagacuguuuauuaccccaagaauggguacaacacuucuaucaagaagcagcuccagcacaauccgaugucgcauuauuaagauucguaaacccagacaccggucguguauuauucgaaugcaaacuccauaaaucuggcuauguaacuguagcacauacaggacaacacgaucuaguuauuccuccaaacggauacuucagauucgauaguuggguaaaucaauuuuacacauuagcuccaaugggaaauggcacaggacgucgucgagcacuauaa

SEQ ID NO: 31964 - RNA, 1623 nt, Artificial Sequence
  derived and/or modified sequence opt6 from VP1__Norovirus__BAJ13627
augaaaauggcaucuaacgacgcaaauccauccgauggaucagcagcaaaucuuguaccagaagucaauaaugaagucauggcauuagaaccaguaguaggagcagcaauugcagcuccagucgcaggucaacaaaauguaauagauccauggauaagaaacaacuuuguccaagcaccuggaggagaauucacuguaucaccuagaaaugcaccaggugaaauacuuuggucggccccacuaggacccgaucuaaauccauaucuaagccacuuagcuagaauguacaaugguuacgcuggaggauucgaaguccaaguuauccuagcaggaaaugccuuuacagccggaaaaaucauuuuugcugcaguaccaccaaacuucccaacagaaggccuaaguccuucacaagugaccauguucccgcacauuaucguagauguaagacaauuagaaccaguucucauaccacuaccagacgucagaaacaauuucuaucauuauaaucaauccaaugacaguacuauaaaauuaauagcaauguuauauacaccauuaagagcaaauaaugcaggagaagauguuuuuacaguaucauguagaguuuugaccagaccauccccagauuuugauuuuauauuccuaguaccaccaacaguagaaucaagaacuaaacccuuuacaguacccauauugacaguugaagaaaugacaaacucaagauucccaauaccacuagaaaaacuauuuacuggaccaucaggagcauuugucguacaaccacaaaauggaagauguacuacugacggaguauuacucggaacuacccaauuaucaccuguaaauauauguaccuuuagaggugacguaacccauauagcuggaucaagagauuacaccaugaaucuagcaagccuuaacuggaauaauuacgauccaacagaagaaauaccagcuccuuuagguacaccagacuucgucgguaaaauacaaggaguucucacacaaacaacaaaaggagacggaucaacaagaggacauaaagcaacaguauauacaggcucaacucccuuuacaccgaaacucggaaguguacaauuuucuacagauacagaaaacgauuuugaaacacaccaaaauacaaaauucacaccaguagguguaauacaagacggaucaacuacccacagaaaugaaccucaacaauggguauuacccuccuacuccgguagaaauguccaaaacguucaucuagcaccagcugucgcaccaacauuuccaggagaacaauuauuauucuuuagaucaacuaugccaggaugcucuggcuauccaaauauggaucuagauuguuuacuaccgcaagaauggguacaacacuuuuaccaagaagcagcaccugcacaaucagacguagcacuauuaagauucguaaacccagacacaggccguguacuauucgaaugcaaauuacacaaaucaggauauguaacugucgcacacacaggacaacacgauuuaguaauaccaccaaauggauauuuucgcuuugauagcuggguaaaucaauuuuacacuuuagccccaaugggaaauggcacaggcagaagacgagcauuauaa

SEQ ID NO: 31965 - RNA, 1623 nt, Artificial Sequence
  derived and/or modified sequence opt6 from VP1__Norovirus__BAJ13630
augaaaauggcaaguuccgacgcaaauccaucagacggaucugccgcaaaucuaguacccgaaguuaacaacgaagucauggcccuagaacccguaguaggagcagcaauagcugcaccaguagcaggucaacaaaacguaauagacccauggaucagaaacaacuucguccaagcacccggcggagaauucacaguaucaccacgcaacgcaccaggcgaaauucuuuggucagcaccacuaggaccagaucuaaauccauacuuaucacauuuagcaagaauguacaacggauacgcaggagguuucgaaguacaaguaauacucgcaggcaaugccuuuaccgcaggcaaaauuauauuugcagcaguaccaccuaacuuuccaacagaaggacuaucaccaucacaaguuacaauguuuccacacauaauugucgaugucagacaacuagaaccaguucuaauaccacuaccagauguaagaaacaauuucuaucauuauaaccaaucaaaugacagcacuauaaaacuuauagcaauguuauacacaccauuaagagcaaauaacgcaggcgaagaugucuuuacaguuucauguagaguauuaacaagaccaagcccugauuuugacuuuauauuuuuagucccaccaacuguagaaucuagaacaaaaccauuuacaguaccuaucuuaaccguagaagaaaugaccaauucacgauuuccaauaccacuagaaaaauuauuuacaggaccuucaagcgcauucguaguacaaccccaaaacggaagauguacaacagaugguguauuacuaggaacaacacaauuaucaccaguaaacaucugcacauuuagaggagaugucacucauauagcaggaucacgaaacuacaccaugaaccuagcuucacuaaacuggaacaauuacgauccaacggaagaaaucccugcaccccucggaaccccugauuuugucgguaaaauacaaggcguacuaacacaaacaaccaaaggagacgguucaacccggggacacaaagcuacuguauauaccggauccgcaccauucacuccaaaacuaggaucgguucaauuuucaacagacaccgaaaacgacuucgaaacacaucaaaacacaaaauucacaccaguaggcguaauacaagauggagguacaacacauagaaaugaaccacaacaauggguguuacccucauauucagguagaaauguaccaaacguacauuuagcaccagcaguagcuccuacauuuccaggagaacaauuacuauucuuuagaagcacaaugcccggaugcucaggauauccaaauauggaucuagauugccuacuaccacaagaauggguacaacauuucuaucaagaagcagcaccagcacaaucagacguagcacuacuucgguucguuaauccagauacaggaagaguauuauuugaauguaaauuacacaaagcgggauauguaacaguagcccacacuggacaacacgaucuagucauacccccuaauggauacuuccgauucgauuccuggguaaaucaauuuuauacacuugcaccaaugggaaauggaacaggaagaaggagagcacuuuaa

SEQ ID NO: 31966 - RNA, 1623 nt, Artificial Sequence
  derived and/or modified sequence opt6 from VP1__Norovirus__BAJ13633
augaaaauggcauccaacgaugccaaccccuccgauggaucagcagcaaacuuaguaccagaaguaaauaacgaaguuauggcacuagaaccaguuguaggagccgcaauagcagcaccagucgcaggacaacaaaacguaauagauccauggaucagaaacaauuuuguccaagcaccuggaggugaauucacaguaucuccacgaaaugcaccaggugaaauacuauggucugcaccucuagguccagaucuaaaccccuaucuaucucaucuagcacguauguauaacggauacgcaggaggauucgaaguacaaguuauucuagcaggaaaugcuuucacagccgguaaaauaauauucgcugcugucccaccaaauuuuccaacagaaggacuaucuccaucacaaguuaccauguuuccccauauaauaguagauguuagacaauuagaacccguauuaauuccuuuaccagauguaagaaauaauuuuuaucacuauaaccaauccaaugauucaacaauaaaauuaauagcaaugcuguauacaccacuaagagcaaauaaugcaggggaagacguauuuacaguaaguuguagaguauuaacaagaccaucaccagacuuugauuucauauuccuaguacccccaacaguugaaucucgaacuaaaccauucacuguaccuauacuaacaguagaggagaugacaaacucaagauucccaaucccacuagaaaaauuauucacuggaccaucuagugcauucguuguacaaccacaaaacggacgcuguaccacagauggcguacuauuagguaccacucaacuaucuccugucaauauaugcacauucagaggagaugucacccauauagcaggaucaagaaacuauacaaugaaucucgcuucauuaaacuggaauaacuacgauccaacagaagaaauaccagccccacuaggaacaccugauuucguaggaaaaauacaaggaguauuaacacaaacaacaaaaggagaugguucuacacgaggacacaaagcaacaguguacacagguagugcacccuucacaccaaaacucggcucuguacaauucuccacagacaccgaaaacgauuuugaaacacaucaaaauacaagauucaccccuguaggaguaauacaagacggcggcacaacacauagaaaugaaccacaacaauggguuuuaccuuccuauucuggacgaaauguucccaacguacacuuagcaccugcaguugcuccgacauuucccggagaacaauuacuuuuuuuuagaucaacaaugcccggauguucuggauaucccaauauggaucuagauugccuacuaccacaagaauggguacaacacuuuuaucaagaagcagcuccagcacaaucagacguagcucuauuaagauucgucaaccccgacacaggaagaguauuauucgaguguaaacuucauaaaucugguuacguuacagucgcacacacaggacaacaugaucuaguaauaccaccuaauggauacuucagauucgauuccuggguaaaucaauuuuacacuuuagcaccaaugggaaauggaacaggaagaagaagaguaucauaa

SEQ ID NO: 31967 - RNA, 1623 nt, Artificial Sequence
  derived and/or modified sequence opt6 from VP1__Norovirus__BAJ13636
augaaaauggcaucaaacgacgcaaacccaucagauggauccgcagcuaaccugguuccagaaguaaacaacgaaguaauggcauuagaaccaguaguaggcgcagccauagcagcaccuguagcaggacaaacaaacguuauagacccuuggauacgcaauaauuucguucaagcacccggaggugaauuuacaguaucaccuagaaacgcaccaggugaaauacucuggagcgccccacuugguccagauuuaaacccauaucuuagucacuuagcacguauguacaacggauacgcaggaggcuucgaaguacaaguaauauuagcaggaaacgcauuuacagccggaaaaauaauauucgcugcaguaccaccaaacuuuccaacagaaggauuaagcccaucccaaguuaccauguucccacacauaauaguagacguucgucaacuugaaccaguacuaauaccauuacccgacguacgaaacaauuuuuaucacuauaaucaauccaaugauucuacaauuaaacucauagccauguuauauacaccacuccgcgcaaauaacgcaggugaagauguauuuaccguuucuuguagaguuuuaaccagaccuucacccgacuuugacuucaucuuucuaguucccccaaccguagaaucaagaacuaaaccauuuacaguaccaauccuaacaguugaagaaaugacuaauucacguuuucccaucccacucgaaaaacuauucaccggaccaucaggagccuucguuguacaaccacaaaauggacgauguacaacugacgguguauuacuagguaccacucaauuaucaccaguaaauauauguacauucagaggagacguaacacauauagcaggcucuagaaauuauacuaugaaucuugcaucauuaaacuggaacaauuaugauccuacagaagaaauuccagcuccgcuaggaacacccgacuuuguaggaaaaauacaaggcgucuuaacacaaacaacaaaaggagauggaucaacccgaggacacaaagcaacaguuuauacagguuccgcaccauuuaccccaaaacuaggaucaguacaauuuucaacagauacagaaaaugacuuugaagcacaucaaaauacaaaauuuacaccaguuggaguaauacaagacgguucaacuacacauagaaaugaaccacaacaauggguauuaccauccuauucuggaagaaauguccaaaacguucacuuagcacccgcaguagcaccuacauuuccaggagaacaacuacuauuuuuuagaucaaccaugccaggcugcucaggauauccaaacauggaucuagacugucuauuaccacaagaauggguucaacauuuuuaucaagaagcagcaccagcacaaucagauguugcauuacuccgauucguaaauccagauacaggaagaguacuauucgaauguaaacuccauaaaaguggauauguaacaguagcacacacaggccaacacgauuuaguaauaccaccaaacggauauuucagauucgauucauggguaaaccaauuuuacacacuggcaccaauggguaauggaacaggaagaagacgcgcauuauaa

SEQ ID NO: 31968 - RNA, 1623 nt, Artificial Sequence
  derived and/or modified sequence opt6 from VP1__Norovirus__BAJ13639
augaaaauggcaucaaaugacgcaaacccaucagauggcucagcagcuaauuuaguacaagaaguaaauaacgaaguaauggcauuagaaccaguagucggcgcagcaauagcugcuccaguagcaggccaacaaaauguaauagaucccuggauucgaaauaauuuuguacaagcaccaggaggagaauuuacaguaaguccaagaaaugcacccggagaaauucuauggucagcaccccuaggaccagaucuaaauccauauuuaucacaccuagcuagaauguauaacggauacgcaggaggauucgaaguacaaguaauauuagcaggaaaugcauuuacagcaggaaaaauaauauuugcugcaguacccccaaacuucccaacugaaggauuaucacccucccaaguuacaauguuuccucacaucauuguagacgucagacaacuagaaccaguucuaauaccacuaccugacguaagaaacaauuucuaucauuauaaccaaagcaaugacucuacaaucaaauuaauagcaauguuauacacaccacuaagagcaaacaaugcaggagaagacguuuucacaguaucaugucggguucuaacacgcccuuccccagacuucgacuuuauauuuuuaguaccaccaaccguagaaucacgaacaaaaccauuuacaguaccaauacuaacagucgaagaaaugacgaacucacgcuuucccauaccacucgaaaaacuauuuacaggaccaucaucugcauucguuguacaaccucaaaacggaagauguacaacagaugguguacuauuaggaacaacacaauuaucaccuguaaauauauguacauuuagaggcgacguaacacauauagcuggaucacguaauuacauaaugaauuuagcaucacuaaacuggaacaauuaugauccuacugaagaaaucccugcaccauuaggaacaccagacuuuguaggcaaaauacaaggcguacucacacaaacaacaaaaggagacggaucaacuagaggccacaaagcuacuguauauaccggcucugcaccauuuacuccaaaacuaggaucaguacaauuuucaacagauacagaaaacgacuuugaaacacaucaaaauacuaaauuuacaccagucggagucauucaagacggauccaccacacauagaaaugaaccucaacaauggguacuaccaucuuauucaggaggaaauguacauaacguacacuuagccccagcaguagcuccgacuuuuccaggagaacaacuucuuuuuuuuagaucaacaaugccaggauguucagguuaucccaauauggauuuagauugucuacucccacaagaauggguacaacacuucuaccaagaagcagcuccagcucaaucagacguagcacuacucagauucgucaauccagauacuggaagaguuuuauucgaauguaaacugcacaaauccggcuaugucacaguugcacacacaggacaacaugacuuaguaauuccaccaaauggcuauuucagauucgauucauggguaaaucaauucuacacacuagcuccaaugggcaacgguacuggaagacguagagcauuauaa

SEQ ID NO: 31969 - RNA, 1623 nt, Artificial Sequence
  derived and/or modified sequence opt6 from VP1__Norovirus__BAJ13642
augaaaauggcuaguaacgacgcaaacccuuccgacggaucagcugccaauuuaguaccugaaguuaauaacgaaguaauggcacuagaaccagucguuggagccgcuauagcagcuccuguagcuggacaaacaaauguaauagacccauggauaagaaacaauuucguacaagccccuggaggagaauuuacaguaucacccagaaacgccccaggagaaauauuauggucagcuccucuaggaccagaucuaaauccauauuuaucucauuuagcaagaauguacaacggauaugcuggaggauuugaaguccaaguaauuuuagcaggaaaugcauuuacagccggaaaaauaauauuugcugcagucccaccaaacuuuccaacagaaggucuuucaccaucacagguaacuauguuuccacacauaaucguagauguaagacaacuugaaccaguauuaauaccucuaccagauguccgaaacaacuucuaccauuauaaucaaagcaaugauuccacuauaaaacuaaucgcaaugcuauacacaccacuaagagcaaacaacgcaggagaagauguauuuaccgugucaugccgaguucuaaccagaccauccccagacuuugacuucauuuuccuaguaccaccaacaguagaauccagaacuaaaccauuuacuguaccgaucuuaacuguagaagaaaugacuaacucccgauuucccauacccuuagaaaaauuauuuacaggaccauccggcgcauuugucguacaaccccaaaacggaagauguacaacagauggcgucuuacuaggcacaacacaacuuucaccaguaaauauaugcaccuuuagaggagaugugacacacauagcuggcuccagaaauuacacaaugaauuuagcuucccuaaauuggaacaacuacgauccaacugaagaaauaccagccccauuaggaaccccagauuuuguaggaaaaauacaaggaguauuaacccaaacaacaaaaggagaugguucaacuagaggacacaaagcgacagucuauacagguucugcaccauuuacucccaaauuagguucuguacaauucucuaccgauacagaaaacgauuuugaagcucaucaaaauacaaaauucaccccaguagguguuauacaagacggaucaacaacacacagaaaugaaccacaacaauggguucuacccucauauucaggaagaaauguacaaaauguucaucuagcaccggcaguagcaccaacauuucccggagaacaacuauuauucuucagaucaacaaugcccggauguucaggcuauccuaauauggaucuagauugcuuauuaccccaagaauggguucaacauuuuuaucaagaagcagcacccgcacaaucagauguagcuuuacuaagauuuguuaacccagacacuggacgaguauuauucgaaugcaaauuacacaaaucaggauaugucacaguagcccacacuggacaacacgaccuaguaauaccuccuaauggauauuuuagauucgacaguuggguaaaucaauucuacacauuagcacccaugggaaauggaacuggacgaagacgagcauuauaa

SEQ ID NO: 31970 - RNA, 1623 nt, Artificial Sequence
  derived and/or modified sequence opt6 from VP1__Norovirus__BAJ13648
augaaaauggcaagcaaugacgcaaauccauccgauggaucagcagcaaaucucguaccugaaguaaauaaugaaguaauggcuuuagaaccaguuguaggagccgcaauagcagcaccagucgcaggacaacaaaauguaauagauccauggauuagaaauaauuuuguacaagcaccagguggagaauuuacuguaucaccaagaaacgcaccaggagaaauuuuauggagugcaccacugggacccgaucucaaucccuauuuaucacaucuagcaaggauguauaauggauacgcaggaggauuugaaguacaaguaauucuagcaggaaacgcuuuuacagcaggaaaaauuauauucgcagcaguuccaccaaauuuuccaacagaaggucuaucuccaucacaaguaaccauguuuccacacauaauaguugacguuagacaauuagaacccguauuaaucccauuaccugauguaagaaauaacuucuaccauuauaaccaaucgaaugacucaaccauaaagcucauagccaugcuauauacaccacuuagagcuaacaaugcaggcgaagaugucuuuacaguaucauguagaguauuaacaagaccuucaccagauuucgacuuuauauuucuaguaccacccacaguagaaucuagaacuaaaccauucacaguaccaauccuaacaguagaagaaaugacuaauucuagauucccaaucccacucgagaaauuauuuacagguccaucuggagcauucgucguacaaccacaaaauggacgauguaccacagacgguguacuacuuggaacaacucaauuauccccuguaaacauauguaccuuuagaggagacguuacacacauagcaggaucacgcaauuacacaaugaauuuagcaucucucaauuggaauaauuaugauccaacagaagaaaucccagccccauuaggaacacccgauuuuguaggcaaaauacaagguguacuaacacaaacuacaaaaggagacggaucaacaagaggacacaaagcuacgguauacacaggauccgccccauuuacuccaaaauuaggaucaguacaauucaguacagauacagaaaaugauuucgaaacucaucaaaacacuaaauuuacaccuguaggaguuauacaagauggaggaacaacccauagaaaugaaccacaacaauggguacuucccuccuauucugguagggauguccauaauguacauuuagcacccgcaguagccccaacauuuccuggagaacaacuauuauucuucagauccacuaugccaggauguucaggauaccccaacauggaucuugauugccuauuaccacaagaauggguacaacauuuuuaucaagaagcagccccugcacaaucugacguagcacuacuacgauucguuaacccagacacuggaagaguauuauuugaaugcaaauuacauaaaucagguuacgucacaguagcacacacaggacaacaugaucuuguaauaccaccuaauggauauuucagauuugauuccuggguaaaucaauuuuacacauuagcaccaaugggcaauggaacaggcagaagaagagcacuguaa

SEQ ID NO: 31971 - RNA, 1623 nt, Artificial Sequence
  derived and/or modified sequence opt6 from VP1__Norovirus__BAJ13651
augaaaauggcaucuaaugaugcuaaucccucagacggcucugcagcaaacuuaguaccagaaguaaacaaugaaguuauggcauuagaaccuguaguaggagcagcaauagcagcccccgucgcaggacaacaaaauguaauagacccuuggauacguaauaacuucguacaagcaccaggaggugaauucacaguaagcccuagaaacgcaccaucagaaauucuuuggucugccccuuuagguccagaucuaaacccauaucuaucccacuuagcacgaauguauaacggauaugcaggcggauuugaaguacaaguuauacucgcuggaaacgcuuucacagcaggaaaaauaauauuugcagcaguaccaccaaacuuuccaacagaaggucuaucaccgucacaagucacaauguucccacacauaauaguagauguacgacaauuagaaccaguacuaauaccauuaccagauguaagaaauaauuuuuaucauuauaaccaaucaaacgauucaacaauaaaauugauagcaauguuauauacacccuuaagagcuaacaaugccggagaagacgucuuuacaguauccugcagaguucuuacuagaccaucuccugauuuugacuucauauuucuaguaccaccaacugucgaaucaagaacaaaaccauuuacaguaccaauacuaacaguagaggaaaugacaaacagucgauuuccaaucccauuagaaaaacuauucacaggacccucuucugccuuuguaguccaaccucagaacggaagauguacaacagauggaguacuacuaggaaccacacaauuaucaccuguaaacauaugcacauucagaggugacgucacacacauagcuggaucacgaaauuacacuaugaaccuagcaucaaucaacuggaacaacuacgauccaacagaagaaauaccagcaccauuaggaacucccgacuucguuggaaaaauccaaggaguauuaacacaaacaacuaaaggagauggcucaacacgaggacacaaagcuacagucuauacaggaucagcaccauucacaccaaaauuaggcucaguacaauucucuacagacacugaaaaugauuucgaaacccaucaaaauaccaaauuuacaccaguaggaguaauacaagauggagguacaacucaucaaaacgaaccccaacaauggguacuaccagguuacucuggacgaaauguaccuaauguacaucucgcaccagcuguagcuccaacauuuccaggugaacaacuacuauucuuccgaucgacaaugcccggauguucaggauacccaaacauggacuuagacugccucuuaccacaagaauggguacagcauuucuaccaagaagcagccccagcucaaucugacgucgcauuauuaagguuuguaaauccagacacaggacgaguauuauucgaaugcaaacuacauaaaucaggauauguaaccgucgcacauacaggacaacacgacuuaguaauaccacccaauggcuauuucagauuugacaguugggucaaccaauuuuacacucuagcuccaauggguaacggaaccggaagacgacgagcccuuuaa

SEQ ID NO: 31972 - RNA, 1623 nt, Artificial Sequence
  derived and/or modified sequence opt6 from VP1__Norovirus__BAJ13654
augaaaauggcaucaaaugacgcaaauccaucagauggaucagcagcuaaucuaguaccagaaguaaacaaugaaguaauggcauuagagccaguaguaggagcagcaaucgcagcaccaguagcuggacaacaaaacguuauagacccuuggauacguaauaauuucguccaagcaccaggaggugaauucacaguaucaccucgcaaugcaccaggagaaauauuauggucugcaccacuuggacccgauuuaaacccauacuuaucucaucucgcccgaauguacaacggcuacgcaggcggauuugaaguacaaguaauauuagcuggaaacgcauuuacagcaggaaaaauaauauuugcagcagucccaccuaauuuuccaacagaaggacuaucaccuucacaaguaacaauguuuccacacaucauagucgacgucagacaauuagaaccagucuuaaucccuuuaccugauguccgcaauaauuucuaucauuauaaucaaucuaacgauucaacuauaaaauuaauagcaauguuauacacuccauuacgagcuaacaaugcuggugaagauguuuuuacagucucuuguagaguccuaacuagaccuagccccgacuuugauuucauauuucuagucccacccacaauugaaucaagaacuaaaccuuuuaccguucccauacuaacuguugaagaaaugacaaauucaagauucccaauacccuuagaaaaacucuucacaggucccucuggcgccuuuguaguccaaccacaaaacgguagaugcacuacagacggaguauuacuuggaacaacacaauuaucaccaguuaauauaugcacauuuagaggagacguaacacauauagcaggcucacgagacuauacaaugaauuuagcaucacuuaacuggaauaauuacgauccaacugaagaaauaccagcaccacuuggaacuccugacuuuguagggaaaauucaaggcguauuaacacaaacaacaaaaggcgacgguagcacuagaggacacaaagccacaguuuauacuggaucugcaccauuuacaccaaaauuaggcucaguccaauuuuccacagacacagaaaaugauuuugaaacacaucaaaauacaaaauuuacaccuguaggaguuauacaagauggaucaacaacucaucgcaaugaaccacaacaauggguacucccaucauauucaggaagaggcguacacaauguacaccuugcaccagcaguagcaccaacauuccccggagaacaacuacuauucuuccgaucaacaaugccagguuguucuggauauccaaacauggaucucgauugucuauuaccacaagaauggguucaacacuuuuaccaagaagcagcacccgcacaaucagauguagcauuacuacgauucguaaaccccgacacaggacgcgucuuauuugaaugcaaacuacacaaaucagguuacguaacaguagcacauacuggacaacacgaucuaguaauacccccaaauggauauuuccgauuugauucuuggguaaaucaauucuacacacuagcuccuauggguaaugguacagguagaagaagagccuuauaa

SEQ ID NO: 31973 - RNA, 1623 nt, Artificial Sequence
  derived and/or modified sequence opt6 from VP1__Norovirus__BAJ13657
augaaaauggcuuccaacgacgcaucaccaucagauggaucugcagcuaauuuaguaccagaaguaaacaaugaaguuauggcacucgagccaguaguaggagcagcuauagcagcaccagucgcaggacaacaaaauguaauagacccauggauaagaaauaauuuuguacaagcuccaggcggcgaauuuaccgucucaccaagaaaugcaccaggagaaauacuauggucugcuucccuaggaccagauuuaaauccauaucuaucucaccuagcccguauguacaacggauacgcuggaggauuugaaguacagguuauauuagcaggaaaugccuuuacagcaggaaaaaucauauucgcagcugucccuccaaacuuuccaacagaaggccucucaccaucacaaguaacuauguuuccucauauuauaguagacguaagacaauuagaaccaguucuuauaccuuuaccagaugucagaaauaauuuuuaccacuacaaucaaucuaaugacucaacaauaaaacuaauagcaauguuauauacuccacuuagagcuaauaaugcgggcgaagacguauuuacaguaagcuguagaguccuaacacgaccuucaccagacuuugacuucauauuucuaguaccaccuaccguagaauccagaaccaaaccuuucacagucccaauucuaacuguagaagaaaugacaaacucuagauucccaaucccacucgaaaaacuauucacaggacccucauccgcauuuguaguacaaccacaaaacggaagauguacaacagacggaguucuccuaggaacaacccaacuuucuccuguaaauauaugcacauucagaggugauguaacucauauagcaggaucaagaaauuauacaaugaaucuagcuucccuaaauuggaauaauuaugacccaacagaagaaauaccagcaccucuaggaaccccagauuuuguuggaaaaauucaagguguauuaacucaaacaacaaaaggugacggaucaacaagaggucacaaagccacaguauacaccgguucagcaccuuuuacaccaaaauuaggaucaguacaauucucaacugacacugaaaacgauuuugaaacacaccaaaauacaaaauuuacaccaguaggaguaauccaagacgguggaacaacacaucgaaaugaaccccaacaauggguccuaccaucauauucaggaagaaacguacaaaacguacauuuagcaccagccguugccccaacauuuccaggagaacaacuucuauuuuuucguucaaccaugccaggauguucuggauacccaaacauggauuuagauugccuauuaccacaagaauggguucaacauuuuuaccaagaagcagcaccugcacaaucagacgucgcauuacuacgauucguaaaccccgauacuggacgaguauuauuugaauguaaauuacauaaaagcggauauguaacuguagcacauacuggccaacacgaucuagucauaccaccaaauggauauuuucgauucgacucuuggguaaaucaauuuuacacauuagcacccaugggcaauggaacaggcagacgucgagcauuauaa

SEQ ID NO: 31974 - RNA, 1623 nt, Artificial Sequence
  derived and/or modified sequence opt6 from VP1__Norovirus__BAJ13660
augaaaauggcaucaaaugacgcuaacccauccgacggaucagccgcaaaucucguaccagaaguuaacaaugaaguuauggcacuagaaccagucguaggugcagccauagcugcaccaguagcuggacaacaaaauguaauagacccuuggaucagaaauaacuuuguccaagcaccaggaggagaauuuacuguauccccaagaaaugcaccaggugaaauuccauggucagcaccauugggaccugaucuaaauccauauuuaucacauuuagcacgaauguauaaugguuaugcaggcggcuucgaaguucaagucauuuuagcagguaaugcauucaccgcaggaaaaauaauauuugccgcaguucccccaaacuuuccaacagaaggacuaaguccaucacaaguaacaauguuuccacauaucauaguagacguaaggcaacuagaacccguacuaauaccacuaccagacguuagaaacaacuuuuaucacuauaaccaaucaaaugauucuacaaucaaacuuaucgccaugcucuacacaccauuacgcgcaaacaaugcaggugaagaugucuuuacagucaguugcagaguacuaacuagaccaucaccagacuuugacuuuauauuucucguuccacccaccgucgaaucgagaacaaaaccauuuacuguaccuauacuaacaguagaagaaaugacuaauucaagauuuccaauuccacuagaaaaauuauucacaggaccaucaucagccuuuguaguccaaccacaaaauggccgcuguaccacugacggcguauuauuggguacaacacaauuauccccaguaaauauauguacauuucguggagauguaacacacauagccggaucaagagauuauacuaugaaucuagcaucacuaaauuggaacaacuacgaccccacagaagaaauaccagcaccacuaggcacaccugauuuuguaggaaaaauacaagguguacugacacaaaccacaaaaggugaugguucuacucgaggacauaaagcaacaguauacacaggaucugcaccuuucaccccaaaauuaggaucaguaagauucucaacagauacagaaaacgauuucgaaacacaucaaaauacaaaauucacaccuguaggagucauccaagacggaucaacuacccacagaaacgaaccacaacaauggguacuuccaucauauucaggaagagacguacacaauguacaccuagcacccgcaguagcaccaacauuuccuggagaacaauuacuuuuuuuuagaucaacaaugccuggcugcucaggauacccaaacauggaucuagauugccuccucccccaagaauggguacagcauuucuaccaagaagcagcuccagcacaaucagacguagcucuuuuacguuuuguaaauccagauacaggacgaguauuauucgaaugcaaauuacacaaaucagguuauguaacaguugcucauacuggucaacacgaucuaguaauaccaccaaauggcuauuuuagauuugauucauggguuaaccaauuuuauacacuagcuccaaugggaaauggaacaggaagaaggagagcauuauaa

SEQ ID NO: 31975 - RNA, 1623 nt, Artificial Sequence
  derived and/or modified sequence opt6 from VP1__Norovirus__BAJ13663
augaaaauggcaucuaaugacgccaacccauccgauggaucagcagccaaccuaguaccagaaguaaacaaugaaggaauggccuuagaaccuguuguuggcgcagcaauagcugcaccagucgcaggacaaacaaauguaauagacccauggauaagaaauaacuuuguacaagcaccaggaggagaauuuacaguaucucccagaaaugcaccaucagaaauauuauggucugcgucacucgguccagaccuaaauccauaucuuucucaccuugcaagaauguauaacggauaugcaggaggauucgaaguacaaguaauauuagcaggaaaugcauuuacagcaggaaagaucauauuugcugcaguaccccccaauuuuccaacagaaggucuaucaccuucccaaguaacuauguuuccacauauaauaguugacguaagacaauuagaaccaguacucauuccacuacccgauguaagaaacaauuuuuaccauuauaaucaaucuaacgacuccacaauaaaauuaauagcaaugcuauauacaccauuacgagcgaauaacgcaggcgaagacguuuuuacaguaagcuguagaguacucacaagaccaucuccagacuuugacuuuaucuuuuuaguccccccaacagucgaaucaagaacaaaaccuuucacaguaccaaucuuaacuguagaagaaaugacuaacucaagauuuccgauaccacuagaaaaacuauuuacgggaccaucuggagcauuuguaguccaaccucaaaacggaagauguacuacagacggcguacuucuuggaaccacacaauuaucaccaguaaauauuuguaccuucagaggagauguaacacauaucgcaggaucucgaaacuauacaaugaauuuagccucucuaaauuggaauaacuaugaucccacagaagaaauucccgcaccacuaggaacaccugacuuuguaggaaaaauccaagguguacucacccaaacaacaaaagguaacggaucaacaagaggacacaaagcuaccguauacacaggaucagcuccauuuacuccuaaauuaggaagcguacaauuuucaacagacacagaaaaugauuucgaaacucaucaaaacacaaaauucacaccaguaggugucauccaagauggaucaacaacucauagaaacgaaccccaacaauggguauuaccaaguuacucaggaagaucaguacauaacguacacuuagcacccgcagucgcuccaacauucccuggagaacaacuacuauucuucagguccacaaugccuggaugcucugguuauccaaauauggauuuagacugcuuauuaccccaagaauggguacaacauuuuuaccaagaagcugcacccgcacaaucagauguagcauuacuacgcuucguaaaccccgacacagguagaguacuuuucgaauguaaacuacauaaaucaggcuaugucacuguagcucauacaggacaacaugaucuaguuauacccccaaacggauauuuucgcuuugauucuuggguaaaccaauuuuauacacucgcuccaaugggaaauggaacaggacggagaagagcauuauaa

SEQ ID NO: 31976 - RNA, 1623 nt, Artificial Sequence
  derived and/or modified sequence opt6 from VP1__Norovirus__BAJ13666
augaaaauggcaucaaaugacgccaacccauccgauggaucagcagcaaacuuaguaccugaaguaaacaacgaaguuauggcucuagaaccagucguuggagccgcaauagccgcaccaguagccggucaacaaaauguaauagacccauggauaagaaauaacuuuguacaagcaccaggaggagaauuuacaguauccccaagaaacgcaccuggcgaaauucuuuggucagcaccacuaggcccagaucuaaacccauauuuaucccacuuagcaagaauguauaauggauaugcaggaggauuugaaguacaaguaauauuagcaggcaaugcuuuuacagcaggaaaaaucauauuugcagcaguaccaccaaacuuuccaacagaaggacuuaguccaucacaagucaccauguuuccacacauuauaguagacguaagacaacuagaaccaguuuuaauuccacuaccugauguaagaaacaacuuuuaccacuauaaccaaucaaaugacucaacgauaaaauuaauagcuauguuauauacaccacuacgagcaaauaaugcaggugaagacguauuuacaguaucauguagaguauuaacaagaccuuccccagacuucgauuucauauuuuuaguuccaccaacaguagaaucccguaccaaaccauucacugucccaauccuuacaguugaagaaaugacaaacucuagauucccaauccccuuagaaaaacucuuuaccggaccuucgucagcuuucguaguucaaccacaaaacggcagauguacaacagauggaguauuacuagguacaacucaacuuuccccagucaauaucugcacauuuagaggcgacauuacacauaucgcugguucaagaaacuacacaaugaauuuagcaucacucaacuggaacaauuacgauccaacugaagaaauaccagcaccccuaggaacaccagacuuuguaggaaaaauacaagguguacuaacucaaaccacaaaaggagacggaucaacaagaggccacaaagcaacaguauacacaggaagugcaccauucaccccaaaacuuggcuccguacaauucaguacagauaccgaaaaugacuucgaaacacaucaaaauacaaaauuuacuccaguagguguaauacaagacggaaguacaacacaccguaaugaaccacaacaauggguacuaccaucauacucaggaagaaaugcacauaacguacaucuagcaccagcaguagcacccacauuuccuggugaacaauuauuauucuuccguucuacuaugccaggaugcucaggcuauccaaauauggaucuagauugcuuacuaccacaagaauggguacaacauuuuuaucaagaagcagcucccgcacaaucagacguagcauuacuacgauucgucaacccagacacaggaagaguauuauuugaaugcaaacuucauaaaagcggauacguaaccguagcacauacuggucaacaugaucuaguaauaccuccaaacggcuauuuccgauuugauuccuggguaaaccaauuuuacacauuagcaccaaugggcaacggaacaggacgaagaagagccuuauaa

SEQ ID NO: 31977 - RNA, 1623 nt, Artificial Sequence
  derived and/or modified sequence opt6 from VP1__Norovirus__BAJ13669
augaaaauggccucaaaugaugcaaacccuucugacggcucagcagccaaucucguaccagaaguaaauaaugaaguaauggcauuagaaccuguaguaggagcagcgauagcagcaccaguagcuggacaacaaaauguuauagacccauggaucagaaauaauuuuguacaagcacccggaggagaauuuacgguauccccaagaaaugcaccuggagaaauacuuuggucagcaccacucggucccgaucucaacccuuaccuaucacaccuagcaagaauguacaacggauaugcaggagguuucgaaguccaaguaauacuagcaggaaaugcauuuacggcaggaaaaauaauauuugcagcaguaccuccaaauuuuccaaccgaaggucuaucuccaucgcaaguaacaauguuuccgcacauaauuguagacguaagacaacucgaacccguucuaauaccacuacccgacguaagaaauaauuucuaucauuauaaccaaucuaacgacucuacaauaaaacuuaucgcaauguuauauaccccauuacgagcuaauaacgcaggagaugacguuuucacaguaucauguagaguuuuaacaagacccucacccgacuuugauuucauauucuuaguaccaccuacaguugaaucaagaacuaaaccauucacuguaccaauuuuaacaguagaagaaaugacaaacucaagauuuccaauaccacuugaaaaacuuuucacaggaccaucauccgcuuucguaguacaaccccaaaauggacguuguacaacagacggcguauugcuaggaacaacccaacuaucuccaguuaauauaugcacauuucgaggagacguaacacacauagcugguucaagaaacuauacaaugaaucuugcuucccuaaacuggaacaauuacgacccaacagaagaaauaccagccccacucggaacaccagacuuuguaggaaaaauacaaggaguuuuaacacaaacuacaaaaggagauggcuccacaagaggucauaaagcaaccguauacacaggaucagcugacuuuacaccaaaacuaggcucaguccaauuuggcacugacaccgaaaacgauuucgaaacacaucaaaauacuaaauucacacccguaggaguuauucaagacggaucuacaacucacagaaacgaaccccaacaauggguauuaccauccuauucaggaagaaauguacauaacguucaccuagcaccagcaguugcaccuaauuuuccaggagaacaacuauuauuuuucagaucaacuaugccaggaugcucuggauauccaaauauggauuuagauugccuauuaccucaagaauggguucagcacuucuaucaagaagccgcaccagcacaaucugacguagcuuuauuaagauuugucaaccccgauacaggaagaguauuauucgaaugcaaacuacauaaaucaggauauguaacaguagcacacacuggacaacacgacuuagucauuccaccuaauggcuauuucagauucgacucauggguaaaucaauucuacacacuagcaccuaugggaaacggaacaggaagacguagagcacuuuaa

SEQ ID NO: 31978 - RNA, 1623 nt, Artificial Sequence
  derived and/or modified sequence opt6 from VP1__Norovirus__BAJ13672
augaaaauggcuagcaaugaugcuaacagguccgauggaucagcagcaaacuuaguaccugaaguaaauaaugaaguaauggcacuagaaccugucguuggugcagcaauagcagcucccguagcuggacaacaaaacguaauagacccauggauucgaaauaacuucguacaagcuccaggcggcgaauucacaguauccccaagaaacgcaccaggagaaauauuauggucugcaccacuaggaccagaccuaaauccauauuuaucacaccucgcaagaauguauaacgguuacgccggaggauucgagguacaaguaauauuagcaggaaaugccuucacugcagguaaaaucauauucgcagcaguaccaccuaacuucccaacagaaggacuaucaccuucacaaguaacuauguucccacacauuauaguugacguuagacaacuagaaccuguucuaaucccucuacccgauguaagaaacaauuucuaucauuauaaccaaucaaaugauucuacaauaaaauuaauagcaauguuauacacaccacuccgagcuaacaaugcaggcgaagaugucuuuacuguaagcuguagagucuuaacacgaccaucacccgauuucgauuuuauauuccuaguuccucccacagucgaaucaagaacuaaaccauucacuguaccaauccuaacagucgaagaaaugacuaacucuagauuuccaaucccauuagaaaaacuauuuaccggaccaucauccgcauuuguuguacaaccucaaaacggaagauguacaacagauggugucuuacuaggaacaacccaauuaucaccaguuaauauauguacauucagaggcgacgucacucauauugcaggaucaagaaauuacacaaugaacuuagcaucacuaaauuggaacaauuacgauccaacagaagaaauaccggcaccacuuggaaccccagacuucguaggaaaaauacaaggugucuuaacacaaacaacaaaaggcgauggauccacuagaggacauaaagcaacaguauauacugguucagcaccauuuacacccaaauuaggaucaguccaauuuaguacagauacagaaaacgacuuugaaacacaucaaaacacaaaauucacaccaguuggaguaauacaagacgguagcacaacacauagauccgaaccccaacaauggguucucccuagcuauucaggucgaaauguaccuaacguacaucuugcaccugcaguugcaccuaccuucccaggagaacaacuacuauuuuucagaucaacuaugccaggaugcucaggauauccaaauauggaccuagauugucugcuaccacaagaauggguacaacacuuuuaucaagaagcagcccccgcacaaucagacguagcuuuauuaagauuugucaacccugacacuggaagaguacuauuugaauguaaauuacacaaaucaggauaugucacaguagcacacacaggacaacacgacuuagucauaccaccaaauggauauuuuagauucgauucuuggguaaaucaauuuuauacucuagcaccaauggguaauggcacaggcagaagaagagcauuauag

SEQ ID NO: 31979 - RNA, 1623 nt, Artificial Sequence
  derived and/or modified sequence opt6 from VP1__Norovirus__BAJ13675
augaaaauggcuucaaaugacgcaaacccaagugaugggucagcagcaaaccuuguccccgaaguuaacaaugaaguuauggcgcuagaaccaguaguuggagcugcaauagcagcaccaguagcaggacaacaaaaugucauagauccauggauacgaaauaauuuuguacaagcaccaggaggcgaauuuaccgucucaccaagaaacgcaccaggugaaaucuuauggucagccccacucggaccagauuuaaauccauauuuaucacauuuagcaagaauguacaacuccuacgcuggaggauucgaaguacaagucauauuagcagguaaugcauuuacagccggaaaaauaauuuuugcugcaguaccaccaaauuuuccaaccgaaggacuaucaccaucucaaguaacuauguucccacacauaauaguggauguaagacaacucgaaccaguacucauuccacuaccagaugucagaaauaacuuuuaccacuauaaucaauccaaugacucuacuauuaaauuaauagcaaugcuuuacacuccauuacgagcaaacaaugccggagaagacguuuuuacaguaucuugcagaguacuaacaagaccaucaccugacuucgauuucauauuucucguaccacccacuguagaguccagaacuaaaccuuuuacaguaccaauauuaacuguagaagaaaugacaaauucuagauuuccaauaccauuagaaaaauuauucacaggaccaucauccgcauucguaguacaaccacaaaauggaagauguacaacagacggaguauuauuagguacaacacaacuuagcccuguaaauauauguacauucagaggugauguuacacacauagcaggaucuaggaacuacacaaugaauuuagcaucgcuaaauuggaacaauuaugacccaacagaagaaauaccagcaccacuagguaccccagacuucguaggaaaaauacaaggagucuuaacacaaacaacaaaaggagacggaucaaccagaggccacaaggcaacuguauauacaggaucagcaccauuuacaccuaaauuaggcuccguacaauucucaacagauacagaaaacgauuucgaaacccaucaaaacacaaaauucacaccagucggaguaauccaagauggaggaacuacacauagaaaugaaccacaacaauggguauuaccuucauauucuggacgagauguacacaacguacauuuagccccagcaguugcaccaacuuuccccggagaacaacuacuauucuuuagaucuacuaugccaggcuguaguggauauccaaauauggaccucgacugucuacuaccacaagaauggguacaacauuucuaucaagaagcagcaccagcccaaucugacguggcacuucuaagauucguaaacccagauacaggaagaguacuauuugaaugcaaacuccauaaaucaggauacguaacaguagcacacacaggacaacacgaccucguuauaccaccaaacggauauuuuagauucgacucaugggucaaucaauuuuacacacuugcuccuauggguaauggcaccgguagaagaagagcauuauaa

SEQ ID NO: 31980 - RNA, 1623 nt, Artificial Sequence
  derived and/or modified sequence opt6 from VP1__Norovirus__BAJ13678
augaaaauggcaucaaacgaugcaaacccaucggaugguuccgcagcaaaccuugugccagaaguaaauaaugaaguuauggcauuagaaccagucguuggagcugcaauagcagcaccaguagccggacaaacaaauguaaucgacccuuggauacguaauaacuucguacaagcaccaggaggagaauuuacaguaucaccuagaaacgcaccuggagaaauacuauggagcgcaccacuaggaccagauuuaaaucccuacuuaucacacuuagcaagaauguacaauggauacgccggcggauuugaaguacaaguaauauuagcuggaaaugcauucacagcaggaaaaauaauuuucgcugcaguaccaccaaauuuuccuacagaaggacuaucaccaucucaaguaacuauguuuccccacauaauaguugacguaagacaauuagaaccaguacuaauaccauuaccagacguaagaaauaauuuuuaucacuauaaucaaucaaaugacucaacaaucaaauuaauagcaaugcuuuauacaccccuuagagcuaauaaugcaggagaagacguauuuacaguaucaugucgaguacuaacaagaccaucaccagacuucgauuuuauauuuuuaguaccaccaacaguagaaucucgaacaaaaccuuuuacaguaccaauuuuaacaguagaagaaaugaccaauucaagauucccaauaccucuagaaaaauuauuuacagggccaucaggcgcauucgucguacaaccucaaaacggaagauguacuacagacggaguauuacuuggaacuacacaacuaagcccaguuaauauauguacauuuagaggugacgucacccacaucgcaggaucuagagauuauacaaugaaucuagcaagcuuaaauuggaacaauuaugaucccaccgaagaaaucccagcacccuuaggaacuccagacuuuguaggaaaaauacaaggaguccuuacacaaacaacaaaaggagacgguuccaccagaggacacaaagcaacaguauauacaggcuccgcaccauuuacaccuaaacuagguucaguacaauucuccaccgacacagaaaacgauuucgaagcacaucaaaacacaaaauuuacucccguagguguaauacaagacgguucuacaacucaucgaaaugaaccccaacaauggguacuaccauccuauagcggcagaaauguacaaaauguacaccucgcaccagcagucgcuccaacauuccccggugaacaacuccuauucuuuagaucaacaaugcccggaugcuccgguuauccaaauauggaucuagauuguuuauuaccacaagaauggguccaacacuucuaucaagaagcagcaccagcacaaagugauguagccuuacucagauucguaaacccugacacugguagaguauuauucgaauguaaauuacacaaaucagguuacguaacaguagcacacaccggacaacacgaccuaguaauaccccccaacggauauuuucguuucgacucauggguaaaucaauuuuacacuuuagcaccuauggguaacggcaccggucgaagaagagcacuuuga

SEQ ID NO: 31981 - RNA, 1623 nt, Artificial Sequence
  derived and/or modified sequence opt6 from VP1__Norovirus__BAJ13681
augaaaauggcuuccaaugacgcaucaccuucagauggaucagcagcaaaccuaguaccugaaguaaauaaugaaguuauggcacuugaaccuguaguaggagcagcaauagcagcgccaguagcaggucaacaaaacguaauagaucccuggauaaggaauaacuuuguucaagcacccgguggagaauucacaguaucaccccgaaaugcaccuggugaaauauuauggagugcaccucuagguccagacuuaaaucccuaccuuagucauuuagcacgaauguauaacgguuaugcuggaggauucgaaguacaagucauauuagcaggaaaugcauuuacugcaggaaaaauaauauucgcagcagucccaccaaauuuuccaacagagggcuuaucaccaucacaaguaacaauguucccccacauaaucguagauguaagacaauuagaaccggugcuuauaccauuaccugauguaagaaauaauuuuuaucauuauaaucaaucaaaugacucaaccauaaaauuaauagccaugcuauacacaccacuuagagcaaauaacgcaggcgaagauguuuucacuguaucuugcagaguauuaacaagaccuucaccugacuuugauuucauauuccuaguaccuccuacaguagaaucaagaacaaaaccuuuuacaguuccaauacuaaccguagaagaaaugacaaauucacgauuuccuauaccacuagaaaaacuauuuacagguccaucaucugcauucguuguacaaccacaaaauggaagauguacaacagaugguguacuucuaggaacaacacaauuaagcccaguuaauauuugcacauuuagaggagauguaacacauauagccgguucuagaaauuacacaaugaacuuagcaucacuuaauuggaacaauuaugauccuacagaagaaaucccggcaccauuagguacaccugacuucguaggaaaaauacaaggaguauuaacacaaacuacaaaaggugauggaucaacacgaggacacaaagccacuguuuacacuggauccgcacccuucacuccaaaguuaggauccguacaauucuccacagacacagaaaaugauuucgaaacacaucaagauacuaaauuuacaccaguaggcguuauacaagauggcggaaccacucacagaaacgaaccucaacaauggguucuaccaucauacucagguagaaacguacaaaauguacacuuagcaccagcaguugcaccaaccuuuccaggagaacaacuauuauucuuuagaucaacaaugccaggauguucaggauaccccaacauggaccuagacuguuuacuaccucaagaauggguacaacauuucuaccaagaagccgccccagcacaaucagacguagcucuauuaagauuuguaaacccagacacaggucguguuuuauucgaauguaaauuacacaaaucaggauauguaacaguagcacacacuggccagcacgaucuaguaauuccaccaaauggauauuuuagauuugauuccugggucaaucaauuuuacacacuagcaccaauggguaacggaacaggccgaagaagagccuuauaa

SEQ ID NO: 31982 - RNA, 1623 nt, Artificial Sequence
  derived and/or modified sequence opt6 from VP1__Norovirus__BAJ13684
augaaaauggcuucuaaugacgcaaguccauccgaugguucagcagcaaaucuuguaccagaaguaaauaacgaaguaauggcguuagaaccaguagucggugcagcaauagcagcaccaguagcaggucaacaaaauguaaucgacccuuggauaagaaacaacuuuguacaagcuccaggcggagaauucacaguuuccccuagaaaugcaccuggcgaaauccuuuggucagcuccauuagguccagacuuaaauccauaucuaucacauuuagcuagaauguauaacggauacgcuggagguuucgaaguccaaguaauacuagccggaaaugccuuuacagcuggaaaaauaaucuucgcugccguaccaccaaacuuuccuacugaaggacuaucaccaucacaaguaacaauguuuccacacauuauaguagacguaagacaacuugaaccaguacuaauacccuuacccgacguaagaaacaacuucuaccacuacaaccaaucaaaugacucaacuauuaaacuaauagccauguuauacacaccacuaagagcaaacaaugcaggagaagauguauuuacagucucauguagaguacuaacuagaccuucuccagacuucgacuucauauuucuagucccaccaaccguagaaucaagaacaaaacccuucacuguacccauauuaacaguagaagaaaugacuaauucacgauucccaauuccacuagaaaaacuauuuacaggcccaaguucugcauuuguuguacaaccacaaaacggaagauguaccacagacggaguacuauuagguacaacucaauuaucaccaguaaauauuuguacauuucgaggagacguaacacauaucgcaggcagucgaaacuacaccaugaauuuaguuucauuaaauuggaacaauuacgauccuacagaagaaaucccugcaccacuaggaacaccagacuuugucggaaaaauucaaggaguauuaacacaaacaacaaaaggagaugguucuacaagaggucauaaagcaacaguuuauacagguucugcaccauuuacaccaaaauuaggaucgguacaauuuaguacagacacugaaaacgauuucgaaacacaucaaaauaccaaauucaccccaguaggaguaauucaagacgguaguacaacccaucgcaacgaaccccaacaauggguacucccauccuauucaggcagaaauguucauaacguacacuuagcaccagcagucgccccaacauuuccaggagaacaacuacuuuuuuucagaucaacaaugcccggaugcuccggcuacccuaauauggauuuagauugcuuacucccucaagaauggguacaacacuuuuaucaagaagcagccccagcacaaucagauguagcauugcuaagauucgucaaucccgauacaggacgaguauuauuugaaugcaaacuacauaaaucaggauauguuacaguagcauacaccggacaacacgaucuaguuaucccaccaaauggauacuuccgcuucgauucauggguaaaucaauuuuacacuuuagcuccaaugggaaaugguacuggcagaagacgagcauuauaa

SEQ ID NO: 31983 - RNA, 1623 nt, Artificial Sequence
  derived and/or modified sequence opt6 from VP1__Norovirus__BAJ13687
augaagauggcaucaaaugacgcaaacccuucagacggaucagcagcaaacuuaguaccagaaguuaacaacgaaguaauggcauuagaaccaguaguaggcgcagcuaucgcagcaccagucgcaggccaacaaaauguuauagaccccuggauaagaaacaauuucguacaagccccaggaggagaauuuaccguaucaccuagaaacgcaccuggagagauacuuuggagugccccccucggaccagaucuaaacccuuaccucucccacuuagcccgaauguauaauggauaugccggaggauucgaaguacagguaauccuagcgggaaaugcuuuuacagcugguaaaauuauauucgccgcugucccaccaaacuuuccaacggaaggcuuaucaccaucucaaguuacaauguucccacauauuauuguagacguaagacaauuagaaccaguacuuauaccauuaccagacguaagaaauaauuucuaucauuauaaucaaaguaaugacucuacaauuaaacuaauagcaaugcuauauacuccucuacgagcuaacaacgcaggugacgaugucuuuacaguaucauguagaguauuaacacgaccaucaccugacuuugauuucaucuuccuaguacccccaacuguagaaucaagaacuaaaccuuucacaguaccaauacuuaccguagaagaaaugacaaacucaagauuuccaauaccacuagaaaaauuauucacaggaccgucuuccgcauuuauaguccaaccacaaaacggaagauguacaacugauggaguacuacuagguacuacacaauuaaguccuguaaacaucugcacauuuagaggugauguaacacauauagcaggauccagaaacuacacuaugaacuuagcaucacuaaauuggaacaacuaugauccaacagaagaaaucccagcaccucuaggaacaccagacuuuguaggaaaaauacaaggaguucucacgcaaaccacaaaaggugaugguucuacuagaggacacaaagcuacaguauauacaggauccgcagacuucacaccuaaacucggaucaguacaauucggaacugacacagaaaacgauuucgaaacccaucaaaauacaaaauucacaccaguaggaguaauacaagauggaucaacaacacauagaaacgaaccucaacaauggguacuaccuucauacucagguagaaauguacacaacguacacuuagcaccagcaguagcaccaaauuuuccaggagaacaacuauuauucuuucgauccacaaugccagguugcucuggcuacccaaauauggaucuagacuguuuacuaccacaagaauggguucaacauuuuuaccaagaagccgccccagcacaaucugauguagcacuacuaagauuuguaaauccagauacaggaagaguacuauucgaaugcaaauuacauaaauccggauaugucacaguagcacacacaggccaacacgaucuaguaauacccccaaauggauauuuuagauucgauucauggguaaaccaauucuauacauuagcaccaaugggaaauggaacuggaagaagaagagcauuauaa

SEQ ID NO: 31984 - RNA, 1623 nt, Artificial Sequence
  derived and/or modified sequence opt6 from VP1__Norovirus__BAJ13690
augaaaauggcaucaaaugaugcuaauccaucagacggcucugcagcuaacuuaguaccagaaguaaauaacgaaguaauggcccuagaaccaguugucggcgcagcaauugcagcaccaguagcaggacaacaaaacguaaucgaccccuggauaagaaauaauuuuguacaagcuccagguggugaauuuacaguuucaccuagaaacgcaccaggagaaaucuuauggucagcaccuuuaggacccgaucucaauccauauuuaucucaccuagcaagaauguauaacggcuacgcaggaggauucgaaguccaaguuauauuagcagguaaugcauuuacagcaggaaaaauaauuuuugcugcuguaccaccaaacuucccaacugaaggacuaucaccaucccaaguaacaauguuuccucacauaauuguagacguuagacaacuugaacccguacucauuccauuacccgaugucagaaauaacuuuuaccacuacaaccaaagcaaugacucaacaauaaaacucauagcuaugcuuuauacaccacuacgagcuaacaaugcaggugacgaugucuuuacaguauccugccgaguauuaacaagaccaucaccagacuucgacuuuauauuucuagucccuccaacaguagaaucaagaacaaaaccuuucaccguaccaauacuaacaguagaagaaaugacaaauucaagauuuccaauaccacuagaaaaauuauuuacaggaccaucaucagcauucguaguccaaccacaaaacggaagaugcacaacagacggugucuuauuaggcacuacacaacuauccccaguaaauauauguacauuuagaggugauguaacccacauugcuggaucuagaaauuauacaaugaauuuagcaucauuaaauuggaauaacuacgauccaacagaagaaauaccagcaccauuaggcacucccgacuuuguaggaaaaauucaagguguauuaacucaaacuacuaaaggagacggaaguacacgaggccacaaagcaacagucuauacaggaucagccccuuuuacaccaaaauuaggaucaguacaauuuucuacugauacagaaaacgacuuugaaacccaccaaaauacaaaauuuacacccguaggagugauacaagacgguucaacaacucacagaaacgaaccucaacaauggguacuccccucuuauucaggucgcaacguccauaacguucaccuagcaccagcaguagcaccuacauucccaggugaacaacuacuauuuuuuagaucaaccaugccaggaugcucaggauaucccaacauggaucuagacugccuacuuccccaagaauggguacaacauuucuaucaagaagcagcaccagcucaaucagacguagcauuacuaagauucguaaacccugacacagguagaguauuauucgaauguaaacuacauaaauccggauacguuacuguugcacauacaggacaacaugaucuaguaauaccaccaaauggcuauuucagauuugacucuuggguaaaccaauuuuauacacuagcuccaaugggaaauggaacaggaagacgaagagcauuauaa

SEQ ID NO: 31985 - RNA, 1623 nt, Artificial Sequence
  derived and/or modified sequence opt6 from VP1__Norovirus__BAJ13693
augaaaauggcaucaaacgaugcaaauccuucugauggcucagccgccaaucuaguaccagaaguaaacaaugaaguaauggcauuagaacccguaguaggcgcagcaauagccgcacccguagcuggacaacaaaauguaauagacccauggauucgcaauaacuucguaaaagcaccuggaggagaauuuacuguaucaccaagaaauucaccuggugaaaucuuauggucagcaccauuagguccagauuuaaacccauauuuaucucauuuagcuagaauguauaacggauacgcaggaggauucgaaguccaagucauuuuagccggcaaugcauuuacugcuggcaaaauaauauuugcagcaguaccaccuaacuuuccaacggaagguuuaucaccuagccaaguaacuauguuuccacacauuauaguugacguaagacaauuagaaccaguauuaaucccacuuccugauguaagaaacaacuucuaucacuauaaccaaucaaaugacucuacaauaaaauuaauagcaaugcuauauacaccauuaagagcuaauaacgcaggagaugauguauucacaguauccuguagaguauuaacaagacccucuccagacuucgacuuuauauuuuuaguuccacccaccguagaaucaagaacaaaaccuuucacuguaccaauacucacagucgaagaaaugacaaauucacgauuuccaauaccacuagaaaaacuauuuacaggaccaaguucagcauuuauuguacaaccucagaacggcagguguacaaccgacggcgucuuauuaggcacaacucaacuaucaccaguaaacauuuguacauuuagaggagacguaacacacaucgcaggcucuagaaacuauacaaugaaccuagcauccuuaaauuggaacaauuacgauccaacagaagaaguaccagccccacuagguacaccagauuucgucgguaagauacaaggaguauuaacacaaaccacuaaaggagauggaucaaccagaggucacaaagcaacagucuauacaggaucagccgacuuuacaccaaaauuaggaucuguucaauuuggaacagauacagaaaaugauuucgaaacacaucaaaauacaaaauucacaccaguaggaguaauacaggacggauccacaacacacagaaaugaaccacaacaauggguauuaccaagcuauucaggaagaaauguacauaauguacacuuagcacccgcaguagcaccaaauuuuccaggagaacaacuauuauucuuucgaucuacuaugcccggauguucagguuauccaaauauggaccuagauuguuuacuuccacaagaauggguucaacacuuuuaucaagaagcagcaccagcacaaucagacguagcccuucuacgauucgucaacccugauacaggaagaguacuuuucgaauguaaacuacauaaaucagguuaugucacaguagcacacacaggccaacacgaucuaguaauaccaccaaacggauauuuucgauucgauuccuggguaaaucaauuuuacacauuagcaccaauggguaauggaacaggaagaagaagagcccuauaa

SEQ ID NO: 31986 - RNA, 1623 nt, Artificial Sequence
  derived and/or modified sequence opt6 from VP1__Norovirus__BAJ13696
augaaaauggcuucuaacgacgcaaacccaucagacggaucagcagcuaacuuaguaccagaaguuaacaacgaagucauggcuuuagaaccuguaguaggagcagcuauagcugcacccguugcuggacaacaaaauguaaucgauccuuggaucagaaauaauuuuguacaagcccccggaggagaauucacaguaucacccagaaacgcacccggugaaauuuuauggucugcaccacuaggcccagaucuaaauccauaucuaucacaccuugcaagaauguacaacggauaugcagguggcuuugaaguacaaguuauauuagcuggaaaugccuuuacagcaggaaaaauaauauuugcagccguacccccaaauuucccuacugaaggacuuucaccaucacaaguaacaauguucccacauauaaucguugauguacgacaacuagaaccaguucuaauaccauuaccagaugucagaaauaauuucuaucacuacaaucaaucaaacgauucaacgauaaaauuaauagccauguuauauacuccacuaagagcuaauaacgccggugaagauguuuuuacaguaucaugccgaguauuaacaagacccucaccagacuuugacuuuauauuucuaguacccccaacaguugaaucaagaaccaaaccuuucacaguaccuauccuuacagucgaagaaaugaccaauucaagauucccaauaccacucgaaaaacuauucacagguccaucuuccgcguucguaguccaaccacaaaacgguagguguacaacagauggcguacuuuuaggcacaacacaauuaaguccaguaaauauaugcaccuuuagaggagaugucacacacauagcuggcucaagaaauuacacaaugaauuuagcauccuuaaacuggaacaauuaugauccaacagaagaaauaccagcaccacuaggaacacccgacuuuguaggcaaaauacaaggaguauuaacccaaacuacaaaaggugaugguucaacaagaggacacaaagcuacuguuuacaccggaucugcccccuuuacaccaaaauuaggaucaguccaauucuccacugacaccgaaaaugauuucgaaacacaucaaaacacaagauucacacccguaggaguaauccaagacgguggcacaacucauagaaaugaaccccaacaauggguacucccuucauacucuggccgaaauguuccuaauguacauuuagcaccugcaguugcccccacauuuccaggagaacaacuuuuauucuuucgcucuaccaugccaggaugcuccgguuaucccaacauggauuuagauugucuucuaccacaagaauggguacaacacuucuaucaagaagcagccccagcacaaucagacguagcccuauuaagauuugucaacccagacacaggucgaguacuuuucgaauguaaacuucacaaaucaggauauguaacaguugcccacacaggacaacaugaccuaguaaucccaccaaauggauauuucagauucgauucguggguuaaucaauucuacacauuagcaccuaugggaaauggaacaggaagaagacgaguauuauaa

SEQ ID NO: 31987 - RNA, 1623 nt, Artificial Sequence
  derived and/or modified sequence opt6 from VP1__Norovirus__BAJ13699
augaaaauggcuucaaaugacgcuaacccaucugacggcucagccgccaauuuaguaccagaagucaacaacgaaguuauggcacuagaaccaguagucggagcugcaauagcagcacccguagcaggacaacaaaaugucauagacccuuggauaagaaauaacuuuguacaagcaccagguggugaauucacuguaucuccaagaaaugccccaggagaaauacuuuggucagcaccacuaggccccgaccuaaauccuuauuuaucacacuuagcucguauguacaauggauaugccggaggauuugaaguacaagucauauuagcuggaaaugccuuuacagcuggcaaaauaauuuuugcagcuguaccaccaaauuucccaacugaaggacucucaccaucucaaguaacuauguucccccacauaauaguugacgucaggcaacuagaaccaguacuaauuccauuaccagacguccgcaauaauuucuaccacuauaaccaaucaaaugacucaacaaucaaacuaauagccauguuauauacaccuuuaagagcuaacaaugcuggugaagauguauuuacaguaucuugcagaguacuuacaagaccaucaccagacuucgauuuuauauuccucguaccacccacaguagaaucaagaacaaaaccauuuacaguaccaauucuuaccguagaagaaaugacuaacucacgcuuuccaauaccauuagaaaaauuauuuacuggacccucaggagcauucguaguacaaccucaaaacggaagauguacuaccgaugguguauuacuaggaacaacacaacuuuccccaguaaauauaugcacauucagaggagacguaacccacauagcuggcucaagaaauuauacuaugaaucuagcagcauuaaauuggaauaauuaugacccaacagaagaaauuccagcuccauuaggaacaccagacuuuguggguaaaauacaagguguauuaacacaaaccacaaaaggagauggaagcacaagaggacauaaagcuacaguauacacaggaucagcugacuuuacaccaaaacuaggaaguguacaauucucaaccgauacagaaaacgacuucgaaacucaccaaaacacuaaauucacaccaguaggaguaauacaagacggaucaaccacacaccgaaaugaaccacaacaauggguauuacccucuuacuccgguagaaauguucauaacguacaucuagcuccagcagucgcaccaacauuuccaggagaacaacuauuauuuuucagaucuaccaugccaggcuguucuggcuacccaaauauggaucuugauuguuuaaucccacaagaauggguucaacauuucuaucaagaagcagcaccagcucaaucugacgucgcacuauuaagauuugucaauccugacacagguagaguacuuuuugaaugcaaauuacauaagucaggauacguaacaguagcucauacaggacaacacgacuuagucauuccaccaaaugguuauuuccgauucgauucauggguaaaucaauuuuacacacuagcaccaaugggcaauggugcaggacgcagacgagcucuauaa

SEQ ID NO: 31988 - RNA, 1623 nt, Artificial Sequence
  derived and/or modified sequence opt6 from VP1__Norovirus__BAJ13702
augaaaauggcaucaaaugaugcaaauccaucagauggcagugcagccaacuuagucccagaaguuaauaaugaaguaauggcacuagaaccagucguaggagccgcaauugcagcaccaguagcuggacaaacaaauguaauugacccuuggauaagaaauaacuuuguacaagcaccuggaggugaauuuacugucuccccaagaaacgcuccaggugaaauccuauggucagcaccacucgguccagaucucaauccuuaucuaucacaucuugcacgaauguacaacggauaugcaggagguuucgaaguacaaguuauauuagcugguaaugcauuuacugcaggcaaaauaauauucgccgcaguuccaccuaauuuuccuacagaaggauuaucuccaucacaaguaacaauguucccacauauuaucguagacguacgacaauuagaacccguauuaaucccacuaccagacguacgaaacaacuuuuaucacuacaaccaaagcaaugauuccacaauaaaauuaaucgcaauguuauauacaccacuaagagcaaauaaugcaggagaagacguauuuacagucucaugucgaguauuaaccagaccuucaccagacuuugauuucauauuccuaguuccaccuaccguagagucucgcacaaaaccauucacaguaccuauauuaaccguagaagaaaugacuaacuccagauuuccaauuccauuagagaaauuauuuacgggaccaagcggagcuuuuguaguacaaccacaaaacgguagauguacaacagacggcguacuauuaggaacgacacaacuaucacccguaaauauauguacauuuagaggagauguaacccacauagcaggaucaagaaauuacaccaugaaccuagcaucucuaaauuggaauaacuaugauccaacagaagaaaucccagcaccacucggaacaccugacuucgucggaaaaauacaaggagucuuaacacaaacaacaaaaggcgacggaucaacaagaggucacaaagcaacuguauauacagguucagcaccauuuacccccaaacuagguucaguacaauucaguacagauacagaaaaugauuucgaagcacaucaaaauacaaaguucaccccuguaggaguaauacaagacggcucaacuacccauagaaaugaaccacaacaauggguuuuacccucauauucaggaagaaaugcacaaaacguacacuuagcaccugcaguagcaccuaccuuuccaggggaacaacuauuauuuuucagaucuacuaugccaggaugcuccggauaucccaauauggaucuagacugucuacuaccucaagaauggguacaacacuucuaucaagaagccgcaccugcccaaagugacguagcauuacuaagauucguaaacccagacacuggaagaguccuauuugaguguaaacuacacaaauccggauauguaacaguagcucauacaggacaacaugaccuaguaauccccccaaauggcuauuucagauucgacucaugggucaaccaauuuuauacacuagccccaaugggaaacgguaccggaagacgaagagcacuuuaa

SEQ ID NO: 31989 - RNA, 1623 nt, Artificial Sequence
  derived and/or modified sequence opt6 from VP1__Norovirus__BAJ13711
augaaaauggcauccaacgacgcaaacccaucagacggcucagcugcuaauuuaguaccagaagucaauaaugaaguaauggcacucgaaccaguaguaggugcagcaauagcagcaccaguagccgcucaacaaaauguaauagauccauggauaagaaacaauuuuguccaagcaccaggaggagaauucacaguaucuccaagaaacgcaccaucagaaauacuauggucagcuccacuaggaccagaccuaaacccauauuuaagucacuuugccagaauguacaauuguuaugcagguggauucgaaguacaaguaauauuagcaggcaaugcauuuacagcugguaaaauaauauuugcagcaguaccaccaaacuucccaacagaaggacucucacccucacaaguaacaauguucccacacauuauagucgacguacgacaauuagaaccaguacuuauaccauuaccagacguaagaaacaauuucuaccauuacaaccaauccaacgacucuaccauuaaacuaauagcuauguuauacacaccccuuagagcuaacaaugccggagaagacguauucacaguaucaugcagaguacuaacaagaccauccccugacuuugacuucauauucuuagucccaccaaccguagaaucacgaacuaaaccauucacugucccaauacuaacaguagaagaaaugacaaacuccagauucccaauucccuuagaaaaauuauucaccggaccaucaucagcauuuguaguacaaccacaaaauggaagaugcaccacagauggaguccuacucggcacuacacaacuauccccaguuaauaucuguacauuccgaggagacguaacacacauagcuggcucaagaaacuacacaaugaaucuagccucucucaacuggaauaacuacgauccaacugaagaaauaccagcaccauuaggaacaccagacuuugucggaaaaauacaaggaguuuuaacccaaaccaccaaaggagacggaucaacaagaggccauaaggcaacuguauauacaggcuccgcaccauuuacccccaaauuagguucaguucaauuuucaacagauacagaaaaugauuuugaaacacaucaaaauacaaaauucacuccuguuggugucauucaagauggaggaacaacccacagaaacgaaccacaacaauggguacuaccaucauauucaggaagaaauguuccaaacguacaccucgcaccagccguagccccaaccuuuccaggugaacaacuacuuuuuuuuagaucaacaaugccaggaugcucugguuacccaaauauggaucuggauuguuuacuuccucaagaauggguacaacacuuuuaccaagaagcagcaccagcacaaucagauguagcuuuacucagauuuguaaaccccgacacaggucgaguacuauuugaaugcaaacuacacaaauccgguuauguaacuguagcucacacaggucaacacgaccucguaauaccacccaauggauauuuuagauucgacucuuggguaaaucaauuuuacacauuagcaccaauggguaauggaacaggaagaagaagagcauuauaa

SEQ ID NO: 31990 - RNA, 1623 nt, Artificial Sequence
  derived and/or modified sequence opt6 from VP1__Norovirus__BAJ13714
augaaaauggcaucaucugaugcaaaucccucagaugguucagcugccaaucuaguaccugaagucaacaaugaaguaauggccuuagaaccaguaguaggagcagcuauagcugccccaguugcaggccaacaaaauguaauugauccauggauucgcaauaauuucguacaagcaccaggaggagaauucacuguauccccucgaaaugcacccggagaaauacuuuggagugcaccacucggacccgauuuaaauccauaucuaucucaccuugcaagaauguauaacggauaugcaggaggcuucgaaguacaaguuauauuagcuggaaacgcauuuacagcaggcaaaauuauuuuugcagcaguuccaccaaacuuuccaacagaaggacucucaccaucucaaguaacuauguucccacacauaauuguagacgucagacaauuagaaccaguucuaauuccccuaccagauguaagaaacaauuuuuaucauuacaaccaauccaacgacuccaccaucaaacuuauagcaauguuauacacuccucuaagagcaaauaacgccggugaagaugucuuuacaguaucauguagaguucuuacaagaccauccccagacuuugacuuuauauuucuaguaccaccuacaguugaaucaagaacaaaaccauucacaguaccaauacuaacuguagaagaaaugacaaacucccgauuuccaauacccuuagaaaaauuauucacagguccaucuggagcauuuguuguacaaccacaaaacggacgaugcacaacagacggaguuuuauuagguaccacacaacuaucaccuguaaauaucuguacauuccgaggagauguaacccauauagcaggaucuagaaauuauacaaugaauuuagcaucauuaaacuggaacaacuacgauccaacagaagaaauaccagcaccauuaggaacaccagacuucguagguaaaauucaaggcaugcuaacacaaacaacuaaaggagacggaaguacaagaggacacaaagcaacugucuauacaggaucagcaccauuuacaccaaaacuagguucaguacaauucuccaccgauaccgaaaacgacuuugaaacccaccaaaauacaaaauuuacaccaguaggcguaauacaagauggaucgacaacccauagaaaugaaccacaacaauggguauuaccuuccuauucaggaagagauguccauaauguacacuuagcaccugccguagcaccaacauuuccaggagagcagcuauuauucuuuagaucaacaaugccaggaugcucuggauaucccaauauggauuuagauugcuuacuaccucaagaauggguacaacauuuuuaucaagaagcagcgcccgcacaaucagacguugcuuuacuaagauucguaaauccagacacaggaagaguauuauucgaauguaaauuacacaaaucuggauaugugacaguagcacacacaggacaacaugaucuagugauacccccaaaugguuauuucagauuugauuccuggguaaaucaauuuuacacacucgccccaaugggaaacggcacaggaagacguagagccuuauaa

SEQ ID NO: 31991 - RNA, 1623 nt, Artificial Sequence
  derived and/or modified sequence opt6 from VP1__Norovirus__BAJ13717
augaaaauggcauccaaugaugcuaauccaucagacggaucagccgcaaaccuaguaccugaaguuaacaaugaaguaauggcuuuagaaccaguuguaggagcugcaauagcugccccuguugcaggacaacaaaaugucauugauccauggauccgcaauaacuucguacaagcaccaggaggagaauuuacaguuucaccgagaaaugcaccaggagaaauacuauggucagcaccacuaggaccugacuuaaacccauauuuaucacaucuugcacgaauguauaacggauacgcaggaggcuuugaaguacaaguaauacuagccggaaaugccuucaccgcaggaaaaauaauauuugcugcuguacccccaaacuuuccaacugaaggauuaucaccaucucaaguuacaauguucccacauauuauuguagauguaagacaacuagaaccuguuuuaauaccacuacccgauguucguaacaacuucuaucauuauaaccaaucaaaugacucaaccauaaaauuaaucgcaauguuauauacaccuuuaagagcuaauaaugcaggagaagauguuuuuaccguaucaugccgaguccucacuagaccaucuccagauuuugacuuuauauuucuaguaccacccacaguagaaucuagaacaaaaccauucacaguuccaauucuaacugucgaagaaaugacaaacucaagauuuccaauaccccuagaaaaacuauuuacgggaccauccuccgccuucguaguacaaccucaaaauggaagaugcacaacagauggaguauuacuagguacaacccaacucucaccaguaaauauuuguacauuuagaggugauguaacacauguagcaggauccagaaauuauauaaugaacuuagcaucuuuaaauuggaacaacuacgauccaaccgaagaaaucccagcaccauuaggaacuccagacuuuguaggaaaaauacaaggaguauuaacacaaacaacuaaaggagacggcucuaccagaggucacaaagccacaguauauacaggauccgcaccuuucacaccaaaauuagguaguguccaauucucaacugauacagaaaacgauuuugaaacacaucaaaauacuaaauucacaccuguaggaguaauccaagacgguucaacaacccaucguaaugaaccacaacaauggguacuaccuucauauaguggaagaaauguacacaacguacaccuugcaccugcaguugcuccaacauuccccggagaacaacuacuauucuuccgaucuacaaugccaggaugcuccggauauccaaacauggaucuagauugccuacuaccacaagaauggguucaacacuuuuaccaagaagccgccccagcacaaucagacguagcacuacucagauuuguaaacccagacacgggacgaguacucuucgaauguaaacuacauaaaucaggauaugucacaguugcccauacaggacaacaugauuuagucaucccacccaauggcuauuuccgauucgauuccugggucaaucaauuuuauacacuagcucccaugggcaauggaacaggacguagacgugccuuauaa

SEQ ID NO: 31992 - RNA, 1623 nt, Artificial Sequence
  derived and/or modified sequence opt6 from VP1__Norovirus__BAJ13720
augaaaauggcuucaaaugaugcaaacccaucagauggaucugccgcuaaucuaguaccugaaguaaauaaugaaguuauggcacuugaaccaguaguaggagcagccaucgcagcaccaguugcuggacaacaaaauguuauagauccauggauacgcaauaacuucguacaagcaccaggcggagaauucacaguuaguccaaggaacgccccuggagaaauauuauggucugcaccacuaggcccagaccuaaaucccuaccuaucacaucuagcuagaauguauaaugguuaugcaggagguuucgaaguacaaguaauauuagcaggaaaugcauuuaccgcuggcaaaauaauauuugccgcaguaccaccaaacuuuccuacugaaggauuauccccuucacaaguuacaauguucccccauauaauaguugacguuagacaacuagaaccuguccuaauaccacuaccugacguuagaaacaauuuuuaccacuacaaccaaucaaaugauuccaccauaaaauuaauagcaauguuauacaccccacuaagagcuaacaacgcaggagaagauguauuuacaguaaguuguagaguucuaacucgaccaucuccagacuuugacuucaucuuucuaguaccaccaacaguugaaucuagaacaaaaccauucacaguaccuauacucacaguagaagaaaugacuaacagucgauuuccaauaccauuagaaaaacucuuuacaggcccaaguucagcauucguaguacaaccacaaaauggaagauguacaacagauggcguauuauuaggaacaacacaauuaucuccaguaaauguuuguacauuuagaggagacguaacccauauugcaggcucaagaaauuauacuaugaaucuagcuagcuuaaauuggaacaacuacgauccuacagaagaaauucccgcaccuuuaggcacuccagauuuuguaggcaaaauccaaggcgucuuaacacaaacaacaaaaggagacgguucaacuagaggacacaaagcaacaguuuauacagguagugcuccuuuuacucccaaacuaggaucuguccaauucaguacugacacagaaaaugacuuugaaacacaucaaaauacaaaauuuacaccaguuggaguaauucaagacggaggaacaacacaucgaaaugaaccacaacaauggguucugccaucuuauucaggacgagacguacccaauguacauuuagccccagccguagcaccaacauucccaggagaacagcuuuuauucuuccgaucaacaaugcccgguugcucuggauauccaaauauggaucuugauuguuuauuaccacaagaauggguacaacauuucuaucaagaagcagcuccugcucaauccgacguagcccuacuacgauuuguaaauccagacacuggccguguuuuauucgaauguaaauuacauaaaucagguuauguuaccguugcacacacuggccaacaugauuuaguaaucccacccaauggcuacuucagauuugacucuuggguaaaucaauuuuacacauuagccccuaugggaaauggaacaggacguagaagagcauuauaa

SEQ ID NO: 31993 - RNA, 1623 nt, Artificial Sequence
  derived and/or modified sequence opt6 from VP1__Norovirus__BAJ13723
augaaaauggcauccaaugaugccaauccaucagacggauccgcagcaaaccuuguaccugaaguuaacaaugaaguuauggcauuagaaccuguuguuggugcagcaauagcagcaccuguugccggacaacaaaauguaauagauccauggauaagaaauaauuuuguacaagccccagguggugaauuuacagucucuccucggaacgcaccuggagaaauacuauggucagcaccccuuggaccagauuuaaaucccuaccuaucccacuuagccagaauguauaauggauaugcaggagguuuugaaguacaaguaauucuagcaggaaaugcauuuacagcaggaaaaauaaucuucgcugcaguaccaccaaauuucccaacagaagguuuaucaccaucacaaguaacaauguuuccacacaucaucguagauguaagacaacuagaaccuguacucauacccuuaccagauguacgaaacaauuucuaucacuauaaccaaucaaaugacucaacaauaaaauuaauagcaaugcuauacacaccuuuacgagcaaauaacgcaggugaagauguauuuaccguaucuuguagaguauuaacaagaccaucacccgauuuugacuucauauuucuaguaccuccaacaguugagucaagaacuaaaccauuuacagucccaguauuaacaguagaagaaaugacaaacucccgauuuccaauuccauuagaaaaauuauucacuggaccaucuagugcuuucguuguacaaccccaaaauggacgaugcacuacagauggaguccuauuaggaacaacacaacuaucaccaguaaauauauguacauuuagaggagacguuacacacauugccggaucuagggauuauacaaugaaccuagcaucauuaaacuggaacaauuacgauccaacagaagaaauaccagcaccacuaggaacaccugacuuuguagguaaaauacaaggaguacuaacccaaacgacaagaggagacggcucaacuagaggacauaaagcaacugucuauacaggaucagcuccauuuaccccuaaauuaggaucaguacaauuuucaaccgauacagaaaacgauuucgaaacacaucaaaacacaaaauuuacaccaguaggcguuauacaagauggaggcacuacacaccgaaacgaaccucaacaauggguacuaccauccuauucagguagaaauguaccaaauguucaucuagcuccugcaguugcaccaacauuuccaggagaacaacuauuauucuucagaucaacaaugccaggcugcucaggauacccaaauauggaucuagacuguuuacuuccacaagaauggguacaacauuucuaucaagaagcagcucccgcucaauccgacguugcacuacugcgauucguaaauccagacacaggaagaguuuuauuugaaugcaaacuacauaaaucaggauacgucacaguagcacauacaggacaacacgaucuaguuauuccaccaaaugguuacuuccgauuugauucuuggguaaaucaauuuuauacauuagcuccaauggguaauggaaccggccgcagacgagcacuuuaa

SEQ ID NO: 31994 - RNA, 1623 nt, Artificial Sequence
  derived and/or modified sequence opt6 from VP1__Norovirus__BAJ13726
augaaaauggcaaguaaugacgcaaacccaucagauggaucugccgcuaacuuagucccagaaguaaacaaugaaguaauggcauuagaaccaguaguuggugcagcuauagcagcaccagucgcaggacaacaaaacgucaucgacccauggauaagaaauaauuuuguacaagcaccuggaggagaauuuacaguaucaccuagaaaugcaccaggagaaauauuauggucagcaccccuaggaccagacuuaaacccauaccuaagucaccuagcacguauguauaauggauacgcaggagguuucgaaguacaaguaauacuagcaggaaacgcauuuacagccggaaaaauaaucuuugccgcaguacccccuaauuuucccacagaaggauuaucaccaucccaaguaacaauguucccacacauaauaguagauguacgacaacuagaacccguauuaauaccauuaccagauguaagaaauaauuuuuaucauuacaaucaaaguaaugacuccacaauuaaacuuauagcaaugcuauacacaccucuucgcgcaaacaaugcaggcgaagaugucuuuacaguaaguugccgaguacuuacaagaccaucuccagauuucgacuucauauuuuuaguaccacccaccguagaauccagaacuaaaccauucacuguuccaauacuuacaguugaagaaaugacgaauuccagauuuccuauaccucuugaaaaacuauuuaccggaccgucuucagcauucguaguacaaccucaaaacggacgauguacaacagauggaguacucuuaggaaccacccaauuaucaccaguuaauauauguacauuccgaggagacguaacucauauagcagguucucgaaauuacaccaugaauuuagcuucauuaaauuggaacaacuacgauccaacagaagaaauaccagcaccucuaggaacaccagauuuuguagguaaaauacaaggagucuuaacacaaacaacaaaaggagacggcagcacacgaggacacaaagcuacaguauauaccgguucagcaccauucacaccaaaauuagguucaguucaauucuccacagauacagaaaacgauuuugaaacacaccaaaauacaaaauucacaccagugggcguaauacaagacggaggcacuacucacagaaaugaaccacaacaauggguacuuccaucauauagcggaagaaacguacauaauguacacuuagcaccagccguagcaccuacauuuccaggugaacaacucuuauuuuuucgaaguaccaugccuggauguaguggauauccaaauauggaccucgauugccuccuaccacaagaauggguccaacacuucuaucaagaagcugcaccagcacaaucagacguagcauuacuaagauuuguaaauccagauacaggaagaguucuauuugaauguaaacuacauaaaucaggcuauguaacaguagcacauacaggacaacacgaccuuguuauaccaccaaauggcuauuuuagauuugauuccugggucaaucaauuuuauacacuagcaccuaugggaaauggaacaggaagaagaagagcacuauaa

SEQ ID NO: 31995 - RNA, 1623 nt, Artificial Sequence
  derived and/or modified sequence opt6 from VP1__Norovirus__BAJ13729
augaaaauggcaucaucagaugcaaauccuucagacggauccgcagcaaacuuaguaccagaaguuaacaaugaaguuauggcucuugaaccagucguaggagcagcaauagcugcacccgucgcaggucaacaaaaugucauagacccuuggauuagaaacaacuucguacaagcaccaggaggcgaauuuaccguaucuccuagaaaugcaccuggagaaauacuguggucagccccucuaggaccagacuuaaauccauauuuaucacauuuagcaagaauguacaacggauacgcaggcggcuucgaaguccaaguaauucuagcaggaaaugcauucacagcagguaaaauuauauucgccgcaguucccccuaacuuccccacagaaggauuaucaccaucacaaguaacaauguucccccauaucaucguagacguuagacaauuagaaccaguacuaauaccacuacccgauguaagaaauaauuucuaccacuauaaucaaaguaacgacaguacuauaaaacuuauagcaauguuauacacaccauuaagagcaaauaacgcuggagaagauguauuuacuguaucaugucguguacuaaccagaccaagcccugauuuugauuuuauauuuuuaguaccucccaccguugaaucacgaacaaaaccuuucacuguaccaauauuaacuguagaagaaaugacaaacuccagauuuccaauaccacucgaaaaauuauuuaccggaccuagcggagcauuuguaguacaaccucaaaauggaagaugcaccacugacggaguauuacuuggaacaacccaauuaucaccuguuaauauauguacauuuagaggugacguaacacauauagcaggcucacgcaauuacacaaugaaucuagccucacuuaauuggaacaauuaugauccaacagaagaaauaccagcaccucuaggaacgccugauuucguugguaaaauccaaggcaugcuaacucaaacaacaaaaggagauggaucaacaagaggacacaaagcaaccguauauaccggaucugcuccauuuacaccuaaacuuggaucaguacaauucucaacagacacagaaaacgauuucgaaacccaucaaaauacaaaauucacaccaguaggaguuauacaagacggaucaacaacucaucgaaacgaaccucaacaauggguucuaccaucuuacucaggccgagauguacauaacguucacuuggcaccagcagucgcaccuacuuucccuggcgaacaacuauuauuuuucagaucaacaaugccaggcuguucugguuauccaaacauggaucuagauugcuuauuaccacaagaauggguucaacauuuuuaucaagaagcugcaccagcacaaucagaugucgcccuuuuaagauucgucaacccagacacaggaagaguacuauucgaauguaaacuacauaaauccggauauguaacaguagcacacacuggccaacacgauuuaguaauaccaccuaacggauauuuuagauuugauucuuggguaaaccaauuuuauacucuagcaccaaugggaaauggaacuggaagaagaagagcauuauaa

SEQ ID NO: 31996 - RNA, 1623 nt, Artificial Sequence
  derived and/or modified sequence opt6 from VP1__Norovirus__BAJ13732
augaaaauggcuucuucugacgcuaacccaucagacggaucuaccgccaauuuaguaccagaaguaaacaacgaaguaauggcauuagaaccaguaguaggagcagcaaucgcugcaccaguagcuggacaacaaaacguaauugacccauggauaagaaauaauuuuguccaagcuccaggaggagaauuuacaguuucccccagaaaugccccuggagaaauauuauggucggcaccccuaggaccugauuuaaaucccuauuuaagucacuuagcuagaauguauaauuccuacgcugguggauuugaaguacaaguaauacuugcuggaaaugcauuuacagcagggaaaauaauauucgcagcagucccaccaaacuuuccaacagaaggacuuaguccaucacaaguaacaauguuuccacauauaauuguugacguaagacaacuagaaccuguacucauaccauuaccagauguacgaaauaacuuuuaucauuacaaucaaucaaaugauccaacuauuaaacucaucgccaugcuauacacaccacuaagagcaaacaaugcaggagaugauguauuuacaguaucauguagaguacuaacgagacccaguccagacuuugacuuuauauuucuaguaccaccaaccguugaaucacguacaaaacccuucucaguaccaauccuaacaguugaagaaaugacaaacucaagauuuccaauaccauuagaaaaacucuuuacaggaccuaguucugcauucguaguacaaccucaaaauggaagaugcacaacagacggcguacuacuaggaacaacccaauuauccccaguaaauauauguacuuuucgaggugacguaacacauauugcuggaacacaagaauauacuaugaauuuagcaucacaaaacuggaacaauuaugacccuacagaagaaauaccagcaccauuaggaacaccugacuucguaggaaaaauacaaggaguuuuaacccaaacuacaagacgcgacggauccaccagaggacacaaagccacaguuucaacaggaucaguacacuuuacaccaaaauuaggucgaauacaauuuucaacagacacuucaaaugauuuugaaacaggucaaaacacacgauucacaccaguuggcguaguacaagauggcucuacaacucaucaaaaugaaccacaacaauggguuuuaccuaacuacucuggccgcgacagucauaauguacaucuugccccagcuguagcaccuucuuuuccaggagaacaacuccuuuucuuuagaucaacaaugccuggauguucaggauauccgaauaugaaucuugacugucuauuaccccaagaauggguacaacacuucuaccaagaagcagcaccggcacaaucagauguagcccuauuacgauucguuaacccagacacuggucgaguauuauucgaauguaaauuacauaaaucugguuauguaacaguugcacauacaggacaacacgaucuaguaauaccaccuaacggauacuuuagauuugauucauggguaaaucaauucuacacauuagcaccuaugggcaacgguacugguagaagaagagcacuuuaa

SEQ ID NO: 31997 - RNA, 1623 nt, Artificial Sequence
  derived and/or modified sequence opt6 from VP1__Norovirus__BAJ13738
augaaaauggcauccaacgaugcaaacccaucagauggaucagccgcaaaccuaguaccagaaguaaauaaugaaguaauggcacuagaaccaguaguaggagccgcaauugcagcacccgucgcaggacaaaccaauguaauagaccccuggauuagaaauaauuuuguacaagcaccagguggagaauucacagucucaccaagaaaugcaccaggcgaaauucuauggucagcuccacuagguccagaucuaaauccuuaccucucacacuuagcucgaauguauaauggauacgccggaggauuugaaguacaaguaauauuagcaggaaaugcauucacagcuggcaaaaucauauucgcugcaguaccaccuaacuucccuacagaagguuuaucacccucacaaguaacaauguuuccacauauaauagucgauguuagacaauuagaaccuguacuaauaccacuuccugacguaagaaacaacuucuaucauuauaaccaaucaaaugauagcacaauaaaacuaauagcaaugcuuuacacaccacuaagagccaauaaugcaggugaagauguauuuacuguaucauguagaguuuuaacaagaccaucaccagauuuugacuuuauauuccugguaccacccacaguagaaucuagaaccaaaccauuuacagucccaaucuuaacuguugaagaaaugacaaauucacguuuuccaauaccacuagaaaaauuauuuacaggcccaucaggagcauucgucguacaaccacaaaauggcagauguacaacagauggaguuuuauuaggaacaacacaauuaucacccgucaauauaugcaccuuuagaggagauguaacacauauagcagguucaagaaauuacacaaugaaucucgcaucauuaaacuggaauaauuaugauccaacugaagaaauacccgcaccacuggguaccccugauuuuguaggaaaaauucaaggaguauuaacucaaacuacaaaaggugacggaucaacaagaggacacaaagcaacaguuuauaccggauccgcuccauucacaccuaaauuagguuccguacaauucucaacugacacagaaaacgauuuugaaacccaccaaaauacaaaauucacgccuguagguguaauucaagacggaucaacuacacaccgaaacgaaccccaacaauggguacuaccgucauauucuggaagaaacguucauaauguacacuuagcaccagcaguagcaccuacauuuccaggggaacaauuauuauuuuuuagauccacuaugccaggcugcuccggauauccaaauauggacuuagacugcuuauuaccucaagaauggguucaacauuucuaccaagaagcugcaccagcacagucugacguagcauuauuacgauuuguaaacccagacaccgguagaguacuauuugaaugcaaauuacauaaaaguggauacguaacugucgcacacacuggccaacacgauuuaguaauuccaccaaauggauauuuuagauuugacucauggguaaaucaauucuacacucuagcaccaaugggcaauggaacaggaagacgaagagcauuauaa

SEQ ID NO: 31998 - RNA, 1623 nt, Artificial Sequence
  derived and/or modified sequence opt6 from VP1__Norovirus__BAJ13741
augaaaauggcuucaaaugacgccaauccuucagacggaucugcagccaacuuaguucccgaaguuaacaaugaagugauggcacuagaaccaguaguaggagcagcaauagcugccccagucgcaggacaacaaaacguaauagacccauggauaagaaauaauuuuguacaagcuccagguggagaauuuacuguuucaccacgcaaugcaccaggagaaauacuauggucagcaccacuagggccggaccuaaaucccuaucuaucacaccuugcaagaauguauaaugguuaugcagguggauucgaaguccaaguaauauuagcaggaaaugcuuuuacagcaggaaaaauaauuuucgcagcaguaccuccaaauuuuccaacagaaggacuaucgccuucccaagucaccauguuuccucacaucauuguagacguaagacaacuagaaccgguacuaauaccucuacccgacguuagaaacaacuucuaucacuauaaccaaucuaaugauucaacaauaaaguuaauagcaaugcucuacacaccauuacgagccaauaaugcaggagaagacguuuuuacaguuaguugccgaguacuaacucgaccaagcccagacuuugacuuuauauuucucguaccaccaaccguagaaagcagaacuaaaccauucacaguaccaaucuuaacuguagaagaaaugacaaauucaagauucccaauaccccuagaaaaauuauucacaggaccaucaggagccuucgucguacaaccacaaaacgguagauguacaacugacggaguauuacuaggaaccacacaauuaucacccguaaacauauguacauucagaggagauguaacacauauagcugguucccgaaauuacacuaugaauuuagcaucauuaaauuggaacaauuacgacccaacagaagaaauaccugcccccuuaggaacacccgacuucgucgguaaaauucaaggaguauuaacacaaaccacuaaaggugacggaucaacaagaggacacaaagcaaccgucuauacuggaucugcacccuucacaccaaaauuagguuccguccaauucagcacagauacagaaaacgauuucgaaacccaucaaaacacaaaauuuacaccagucggaguaauacaagauggaucaaccacacaucgaaaugaaccacaacaauggguacucccaucauauucaggaagaaacguacacaauguacacuuagcucccgcaguagcaccaaccuucccaggagaacaacuacuauuuuuucgaucuaccaugccaggaugcucugguuacccaaauauggaucuagauugcuuacuaccucaagaauggguccaacauuuuuaucaagaagcagcaccagcacaaucagacguugcauuacuuagauucgucaauccagacaccgguagaguauuauuugaaugcaaacuacauaaaucuggauauguaacaguagcccacacaggucaauacgacuuaguaauaccuccaaauggauauuucagauuugauucuuggguaaaucaauucuauacacuagcuccuaugggcaauggaacuggucgcagaagagcacuauaa

SEQ ID NO: 31999 - RNA, 1623 nt, Artificial Sequence
  derived and/or modified sequence opt6 from VP1__Norovirus__BAJ13744
augaaaauggcaucuaaugacgcaaacccuucugauggaucggcugcaaauuuaguaccagaaguaaauaacgaaguaauggcauuggaaccaguuguaggugccgcuauagcagcaccaguagcaggacaaacuaauguaauagauccauggaucagaaauaacuucguccaagcaccaggcggagaauuuaccguaucaccacgaaaugcaccaggagaaauucuauggagcgcaccuuuaggaccagaucuaaaucccuaccuaucacaccuagcaagaauguauaacggauaugcaggagguuuugaaguacaagucauacuagcgggaaacgcauuuacagccggaaaaauuauuuuugcagcaguaccaccuaacuucccuacagaaggcuuaucaccuucacaaguuacaauguucccacauaucauaguugacguaagacaauuagaaccaguacuaaucccacuacccgauguaagaaacaauuuuuaucauuauaaccaaagcaaugauagcacaauuaaacuaauagcaaugcuauauacucccuuaagagcaaacaaugcaggcgaagauguauuuacaguuucuuguagaguauuaacaagaccaucaccagacuuugauuuuauauuuuuaguuccaccgacaguugaaucaagaacuaaaccauucacagucccuauauuaacuguugaagaaaugacaaauucuagauucccaauaccacuagaaaaacucuuuacaggaccaucaggagcauucguaguacaaccccaaaacggaagauguacaacagacgguguauuacuaggaaccacacaauuauccccaguaaauauuuguacauuuagaggugacgucacacacauagcaggaucccgaaacuacacuaugaaucuagcauccuuaaacuggaacaacuacgauccaacagaagaaauaccugcaccucuagguacaccagacuuuguaggaaaaauacaaggaguauuaacucaaacaacaaaaggagacggaaguacucgaggccauaaagcaacagucuacacagguuccgcccccuuuacaccaaaacuaggcuccguacaauucuccaccgauacagaaaacgacuucgaagcucaucaaaauacaaaauucacaccaguuggaguaauucaagacggaucaacuacacacagaaacgaaccgcaacaauggguauuaccaucuuauuccggacgaaacguacaaaacguucacuuagcaccagcagucgcaccaaccuuucccggugaacaacuacuuuuuuucagaucaacaaugccaggaugcuccggauaccccaauauggaccuagauugucuacuaccacaagaauggguacaacacuuuuaucaagaagcagcaccagcccaaucugacguugcauuacuccgcuucgucaacccagacaccggaagaguacuauuugaauguaaacuacacaaaucaggauauguaacuguagcacauacuggucaacacgacuuaguaauaccaccaaacggauauuuuagauuugauucauggguaaaccaauuuuacacacuagcucccaugggaaacggcaccgguagaagacgcgcucuauaa

SEQ ID NO: 32000 - RNA, 1623 nt, Artificial Sequence
  derived and/or modified sequence opt6 from VP1__Norovirus__BAJ13747
augaaaauggccucaucugacgcaaauccuagcgauggaucgaccgcaaauuuaguucccgaaguaaacaacgaaguaauggcacuagaaccaguaguaggagcugcaaucgcugcaccuguagcaggacaacaaaauguaaucgacccuuggauuagaaauaacuucguccaagcaccugguggugaauucaccguaucaccaagaaaugcaccuggagaaauacuauggucagcuccccucggcccagaucuaaauccuuacuuaucacaccuagcacgaauguauaauggauaugcaggagguuuugaaguucaagucauauuagcaggaaaugcuuuuaccgcuggaaaaauaauauuugcagcaguaccaccuaacuuuccaaccgaaggucuaucuccaucacaaguaacaauguuuccacacauaauaguagauguccgacaauuagaaccuguacuaauaccucuaccugacguaagaaauaauuuuuaucacuauaaccaauccaaugacccaacaauuaaauuaauagcaaugcuauacacaccacuaagagcaaauaaugcaggagaugacguuuuuacaguaucaugccgcguacuuacaagaccuagcccagacuuugacuuuauuuuccuaguaccaccaacaguagaauccagaacaaaaccuuucucaguaccaauauuaacaguagaagaaaugacaaauucuagauuccccauaccacuagaaaaacucuuuacaggacccuccucagcauuuguaguacaaccacaaaaugguagaugcacaacagauggaguauuacucggaacaacucaacuaucaccaguuaauauuugcacauuuagaggugauguaacacauauaacaggaucaaggaauuacacaaugaacuuagcaacacaaaacuggaauaguuacgaccccacugaagaaauaccagccccacuaggaacuccagacuucguaggaaaaauucaaggaguacuaacacaaacaacccgagcagauggaucaaccagaggccacaaagcaaccgucuauacaggauccgcagacuuugcaccuaaauuaggccgaguacaauucgcaacagauacugacaaugacuucgaugcaaaucaaaauaccaaauucacacccguaggugucauacaagacggagacacagcacauagaaaugaaccucaacaauggguacuaccuucauauucaggaagaaacucacauaacguacaccuagcaccagcaguugcaccuacauuuccaggagaacaacuacuuuuuuucagaucaaccaugccaggaugcucaggauacccaaauauggaucuagauugccuauuaccucaagaauggguacaauacuuuuaucaagaagcagcuccagcacaaucagauguagccuuacuaagauucguaaacccugacacagguagaguauuauuugaaugcaaacuacacaaauccggauauguaacaguagcucauaccggacaacaugaccuaguaauaccuccaaauggauauuuucguuuugauuccuggguaaaucaauucuacacucuagcaccaauggguaauggcacuggcagaagaagagcccuauaa

SEQ ID NO: 32001 - RNA, 1623 nt, Artificial Sequence
  derived and/or modified sequence opt6 from VP1__Norovirus__BAJ13750
augaaaauggcuuccaaugaugcuaaccccagugauggaucagcagcuaaucuaguaccagaaguaaauaacgaaguuauggcuuuagaaccagucguaggagcagccauagcagcaccaguagcaggccaacaaaauguaauagauccauggauaagaaacaacuuuguccaagccccaggaggagaauucaccguaucaccaagaaaugcaccaggagaaauacucugguccgcaccuuuaggaccagaccuaaauccauaucuaucacacuuagccagaauguacaacggauaugcaggaggauucgaaguucaaguaauacucgcuggaaaugccuucacagcuggaaaaauaauuuucgcagcaguaccaccaaacuucccaacagaaggacuaaguccaucacaaguaacaauguucccacacauaaucgucgauguuagacaauuagaaccaguuuuaauuccacuaccagauguaagaaacaacuuuuaccauuauaaccaaucaaaugacuccaccauaaaacuaaucgcuauguuauacacuccacuuagagcaaauaaugcuggugaagauguauuuaccguaucaugccgagucuuaacaagaccauccccagacuuugacuuuauauuuuuaguaccuccaaccguugaaucaagaaccaaacccuuuaccguaccaauucuaacaguagaagaaaugacaaauucgagauuuccaauccccuuagaaaaguuauuuacaggaccaucuucagcauucguaguacaaccacaaaacggacgcugcaccacagacggaguauuauuaggcacaacucaacuaucuccaguaaauaucuguaccuuuagaggugacguaacacauauagcaggcucuagaaauuacacaaugaacuuagcaucccucaacuggaacaauuacgaucccacugaagaaauacccgcaccacuaggaacaccugacuucguaggaaaaauucaaggcguacuaacacaaaccacaaaaggagaugguucuacaagaggucauaaagcaacaguauacacagguucagccccauuuaccccaaaacuuggaucaguacaauuuucaaccgauacugaaaaugacuuugaaacccaccaaaauacaaaauucacaccaguaggaguaauacaagacggcggaacaacccauagaaacgaaccucaacaauggguucuaccaucauauucuggcagaaacguaccaaacguucauuuagccccagcagucgcaccaacauuuccaggagaacaacuacuauucuuuagaucaacaaugccaggaugcucuggauauccaaauauggaccucgauugccuauuaccacaagaguggguccaacauuucuaucaagaagcagccccagcacaaucugacguugcacuauuacgauuuguuaauccugauacaggacguguauuauucgaauguaaauuacauaaaucaggcuauguaacuguagcacacacuggacaacacgauuuaguaaucccuccaaauggcuauuuccguuucgauucauggguaaaccaauuuuauacacuagcuccaaugggaaacggaacaggcagaagaagagcacuauaa

SEQ ID NO: 32002 - RNA, 1623 nt, Artificial Sequence
  derived and/or modified sequence opt6 from VP1__Norovirus__BAJ13753
augaaaauggcauccucagaugcaaacccuucagauggaucaacagcaaaccuuguaccagaaguuaacaaugaaguaauggcacuugaaccagugguaggagcagcaauagcagcuccaguagcaggacaacaaaaugucauagauccuuggauaagaaauaauuucguccaagcaccagguggagaauucacaguaucaccaagaaacgcaccaggagaaauacuuuggucagcaccauuaggaccagauuuaaauccauacuuaucacaucucgcaagaauguacaacggcuacgcaggagguuuugaaguacaaguaauauuagccggaaaugcauuuacagcaggaaaaaucauauucgcagccguaccaccuaauuuuccuacagaaggucuaaguccaucacaaguuacaauguuuccucacauaauaguagacguaagacaacuagaaccaguauuaauaccacuaccagacguaaggaacaauuucuaucacuauaaccaaucuaacgacccaacaauaaaacuuauagcaaugcuuuauaccccauuaagagcuaauaaugcaggagacgacguauuuacaguaucauguagaguauuaacaagaccuuccccggauuuugauuuuaucuuuuuaguaccaccuacuguagaaucaagaaccaaaccauuuucaguaccaauacuaacagucgaagaaaugacuaauucaagauucccaauaccacuagaaaaacuauucacaggaccaucaucugcauucgucguucaaccacaaaacgguaggugcacuacagauggaguuuuauuagggacaacucaacuaucaccaguuaauauauguacauucagaggcgauguaacacauauaacugguucuagaaauuauacaaugaaccuugcaacacaaaauuggaacucauacgauccaacagaagaaauaccagcaccucucgguacacccgacuuuguaggaaaaauccaaggaguucucacccaaaccacacgagcugauggaaguacacguggacacaaagcuacuguauacacaggaucagccgacuuugcaccaaaacucggaagagugcaauucgcaaccgauacagauaacgauuuugaugcaaaucaaaauacaaaauucacacccguuggcguaauacaagacggcgauacagcacacagaaaugaaccccaacaauggguauuacccucauauucaggacgaaauucacauaacguacaucuagcaccagccguagcaccaaccuucccaggagaacaauuauuauuuuuuagauccaccaugccaggaugcucaggcuacccaaauauggauuuagacugucuauuaccacaagaauggguucaauacuucuaucaagaagcugcaccugcacaaucugacguagcauuauuaagauucguaaaucccgauaccggacgaguacuauucgaaugcaaacuacacaaaucugguuauguaacugucgcacacacaggacaacacgauuuaguaauaccaccaaacggauauuuucgauucgauaguuggguuaaccaauucuauacacuagcacccaugggcaauggaacaggacgacgacgagcacuuuaa

SEQ ID NO: 32003 - RNA, 1623 nt, Artificial Sequence
  derived and/or modified sequence opt6 from VP1__Norovirus__BAJ13756
augaaaauggccucaucagacgcaaacccaccagauggaucagccgcaaacuuaguaccagaaguaaacaaugaaguaauggcuuuagaacccguaguuggagccgcaauagccgccccaguagcaggucaacaaaacguuauagauccauggauaaggaacaauuuuguacaagcucccggaggcgaauuuacuguuucaccacguaaugcaccuggagaaauucuuuggucagcaccucuaggaccagauuuaaauccauauuuaucacaccucgcacgaauguacaacggauacgccggaggauucgaaguccaagucauacucgcaggaaaugcauuuacagcaggaaaaauuauauuugcagcaguuccaccaaacuucccaacagaaggccugucuccaucacaaguaacuauguuuccacacauaauaguagacguuagacaauuagaaccaguauuaauaccauuacccgacguacgcaacaauuuuuaccauuacaaucaauccaacgacucaacuauaaaauuaauagcuauguuguacacaccacuacgugcaaauaaugcaggagaagauguauuuacaguuucaugucgagucuuaacacgcccaaguccugauuuugauuuuaucuuucuaguaccaccuacaguagaauccagaacaaaaccauuuacaguccccauacugaccguagaggaaaugacaaacucccgauuuccaaucccacuugaaaaauuauuuacuggucccucaggagcauuuguaguacaaccacaaaacggaagaugcaccacagaugguguauuauuaggcaccacacaacuaucaccaguaaauauaugcacauuuagaggcgacguuacacauaucgcaggauccagaucuuauacuaugaacuuagccucuuuaaauuggaacaacuacgacccaacagaagaaauaccagcaccauuaggaacacccgacuuugucggaaaaauucaagguaugcuuacacaaacaacuaaaggagacggaucuacuagaggacacaaagcaaccguauacacaggaucagcacccuuuacaccaaaauuaggaucaguucaauucucaacagauacugaaaacgauuuccaaacacaccaaaacacaaaauuuacuccaguaggaguaauacaagauggcucaacaacacaucgaaaugaaccacaacaauggguacucccaucauacagcggcagggauguucauaauguacaccuugcaccagcaguugcacccaccuuuccuggagaacaauuauuauucuuucgaucaacuaugccuggaugcucaggauauccuaauauggaucuagauuguuuauuaccacaagaauggguucaacacuuuuaucaagaagcagccccagcucaaucagacguugcacuauuacgcuucguaaaucccgacaccggaagaguacuauuugaaugcaaauuacauaaaucaggauaugucacagucgcacacacaggccaacacgaccuaguuaucccaccuaauggcuauuucagauucgauaguuggguaaaccaauuuuacacacuagcuccaaugggaaauggaacaggaagaagacgagcacuauaa

SEQ ID NO: 32004 - RNA, 1623 nt, Artificial Sequence
  derived and/or modified sequence opt6 from VP1__Norovirus__BAJ13759
augaaaauggcaucuaacgaugcaaauccuagugacggauccgcagcaucucuagucccagaaguuucaaaugaaguaauggcauuagaaccaguaguaggcgcagcaaucgcagcuccaguagcaggacaacaaaacguaauugaucccuggauucgcaauaacuucguucaagccccuggaggagaauucacaguuuccccacgaaaugcuccuggugaaauauuaugguccgcuccacuaggcccagaucuuaauccauaucuaucacaccuagcaagaauguauaacggauaugcaggcgguuuugaaguccaaguaauacuugcuggaaacgcauuuacagcaggaaaaauaauauuugcugcaguaccccccaacuucccuacagaaggauuaucaccaucccaaguaacuauguuuccacacaucauaguagauguacgacaacuagaaccaguucuaaucccacuaccugacguaagaaacaauuucuaucacuauaaccaaucaaaugauucuacaauuaaauuaauugcaauguuauacacaccauuaagagcaaauaaugcaggagaagauguauucaccguaucaugcagaguuuuaacacgaccaucaccugacuuugauuuuauauuucuaguaccaccaaccguagaauccagaacuaaaccauucacaguaccuauacuuacaguugaagaaaugacuaauucucgauucccaauaccacuagaaaaacuauucacuggaccauccggagcauuuguuguacaaccccaaaauggucgauguacuacagauggaguccuacuaggaacaacacaauuaucucccguaaauauauguacauuuagaggugacguaacacauaucgcuggaucccgaaauuacacaaugaauuuagcaagcuuaaauuggaauaauuacgacccaacagaagaaauacccgcuccacuaggaaccccagauuuuguaggaaaaauccaaggaguauuaacacaaacuacuaaaggugauggaucaacaagaggucacaaagcaacaguauauaccgguucagcacccuucacaccaaaauuaggcucaguucaauuuucaacagacacagaaaacgauuuugaaacacaucaaaauacaaaauuuacaccaguagggguuauacaagacgguaguacuacacauagaaaugaaccacaacaauggguacuuccuucuuauucaggacgagauguacacaacguccaucucgcuccagcaguagcaccaacauuuccaggagaacaacuauuauuuuuccgaucuacaaugccaggauguucaggcuauccuaauauggaucuagauugcuuauuaccacaagaauggguacaacauuucuaucaagaagcagcuccagcucaaucagauguagcucuacuacgauucguaaauccagacacaggaagaguauuauucgaauguaaacuacauaaaucaggcuauguaacaguagcucacacaggccaacacgaccuaguaauuccuccaaauggauauuuuagauuugauucauggguaaaccaauucuacacacuagcaccaaugggaaacggaacaggcagacgacgagcauuauaa

SEQ ID NO: 32005 - RNA, 1623 nt, Artificial Sequence
  derived and/or modified sequence opt6 from VP1__Norovirus__BAJ13762
augaaaauggcauccaaugaugcaaauccuucagauggaucugcagcuaaccuaguaccagaaguuaacaaugaaguaauggcucuagaaccuguagucggagcagcaauagccgcucccguagcaggacaacaaaacguaaucgacccauggauacgaaacaacuuuguacaagccccaggaggcgaauuuacagucucaccaagaaaugcaccuggugaaauauuauggucagcaccucuuggaccugaucuaaacccauaucuuucucaccuagcaagaauguauaauggauaugcuggagguuucgaaguucaaguuauauuagcuggaaaugcauuuacagcaggaaaaauuaucuucgcagccgucccaccaaacuucccaacagaaggacuaucaccaucacaaguuaccauguuuccccauauaauagucgauguuagacaauuagaaccaguuuuaauaccucuccccgacguacgaaacaauuuuuaccacuauaaccaauccaaugauuccacaauaaaauuaauagcaaugcuuuacacuccacuaagagcuaacaaugcuggagaagauguauuuacaguuuccuguagaguacuaacaagaccaaguccugacuucgacuuuauauuccucguuccaccuacaguagaaagucgaacaaaaccauuuacagucccuauauuaaccguagaagaaaugacaaauucaagauuucccauaccacuagaaaaacucuuuacaggaccauccagugcauuuguaguacaaccccaaaacggaagauguacaacagacggaguacuacuugguaccacccaacuuucaccuguaaacauauguaccuuuagaggagacguaacccauauagcaggcucuagaaauuauacaaugaaucuagcuucauuaaacuggaauaacuacgauccuacugaagaaaucccagcaccauuaggcacacccgacuucguaggaaaaauucaaggagucuuaacacaaaccacaaaaggagacggcucuacacgaggucacaaagcaaccguauauacagguucugcaccauucacaccuaaauuaggaucaguacaauucucuaccgauacagaaaaugacuucgaaacacaucaaaauacuaaauucacaccaguuggaguaauacaagacggaggaacaacccacagaaaugaaccacaacaaugggucuuaccaucauauucuggacguaauguacccaauguucacuuagcuccagcuguagcacccacauuuccuggugaacaacuccuauuuuuuagaucaacaaugccaggcugcucagguuaucccaauauggaucuagauugccuauuaccacaagaauggguacaacauuucuaucaagaagcagcaccugcccaauccgauguagcacuauuaagauucgucaacccagacacaggaagaguucucuucgaaugcaaacuucacaaaucaggauauguaacaguagcacacacuggacaacaugaucuagucauaccaccaaauggcuauuucagauucgauucauggguaaaccaauuuuauacacuagccccaauggguaauggaacaggaagaagaagagcacuuuaa

SEQ ID NO: 32006 - RNA, 1623 nt, Artificial Sequence
  derived and/or modified sequence opt6 from VP1__Norovirus__BAJ13765
augaaaauggccucaaacgaugcaaacccuucagacggaucugccgcaaacuuaguccccgaaguuaacaaugaaguaauggcauuagaaccagucguaggagcagcaauagcagcgcccgucgccggucaacaaaauguaauugaccccuggauaagaaauaacuucguacaagcaccuggaggagaauuuacaguaagccccagaaaugcaccaggagaaauacuuuggucugcaccucuaggaccugaucuaaaucccuaucuaucacacuuagccagaauguacaauggcuacgccggaggauuugaaguacaaguaauacuagcaggaaacgcauucacugccggaaaaaucauuuuugcagcuguaccacccaauuuuccaacugaaggcuuaucucccucucaaguaaccauguucccacacauuauaguugauguacgacaacuugaacccguacuaauuccauuaccagauguaagaaacaacuucuaccauuauaaccaaucuaaugacucaaccauaaaauuaauagccauguuauacacaccucuaagagcaaacaacgcaggagaagacguauuuaccguaucaugcagaguacuaacaagaccaucaccagauuuugauuuuauuuuccuaguaccaccaacagucgaaucuagaacuaaaccauucacaguaccaauauuaacuguagaagaaaugacaaauaguagauucccaauaccuuuagaaaaacucuucacaggaccuagcucagccuuuguaguccaaccacaaaacggaagaugcacaacugauggagucuuacuuggaacaacucaacuuuccccaguaaauauaugcacauucagaggagauguaacacauauagcuggaucccgaaauuacacaaugaaccucgcuagccuuaauuggaacaauuaugaucccacugaagaaauaccagcaccucuaggaacaccagauuucguaggaaaaauacaaggaguccuaacacaaaccaccaaaggagauggcucaacaagaggccauaaagcaacaguauauacuggcucugcuccauuuaccccaaaacuaggaaguguacaauucucaacugauaccgaaaacgauuuugaaacccaccaaaauacaaaauuuacuccaguuggcguuauacaagacggcggcacaacccacagaaacgaaccucaacaauggguauuaccauccuacucaggacgcaauguaccaaauguccaccuagcaccagcaguagcaccaaccuucccaggcgaacaacuacuauucuucagauccacaaugcccgguuguucugguuacccaaacauggacuuagacugucuucuaccucaagaauggguucaacacuucuaucaagaagcagcaccagcacaauccgauguagcauuacuaagauuuguaaacccagacacaggccgaguacuauucgaauguaaacuacauaaaucaggauauguaacaguagcccauacaggacaacacgaucucguaauaccuccaaacggauauuuccgauucgauucauggguaaaucaauucuacacuuuagcaccaaugggaaacggaacuggacgcagacgagcacuauaa

SEQ ID NO: 32007 - RNA, 1623 nt, Artificial Sequence
  derived and/or modified sequence opt6 from VP1__Norovirus__BAJ13768
augaaaauggcaucaaaugaugcaaacccaagugauggcucagcagcaaacuuaguaccagaaguaaacaaugaaguaauggcacuagaaccaguugucggagcugcaauagcagcaccaguagcuggacaacaaaaugucauagaccccuggauaagaaacaacuucguacaagcaccuggaggagaauuuaccguaucaccacgaaaugcaccaggagaaauuuuauggucagcaccacuugguccagaucuaaauccauauuuaucacacuuagcaagaauguacaacgguuacgcaggugguuucgaaguacaaguaauacuagcaggaaaugcauuuaccgcaggaaaaauaauauucgcugcaguaccaccaaacuuuccaacagaaggacuaucaccaagccaagucaccauguucccacacauuauaguagacguaagacaauuagaacccguccuaauaccauuacccgacgucagaaauaacuucuaccacuauaaucaaucaaacgacagcacuauuaaacuaauagcaaugcuuuacacaccccuucgagcuaauaaugcaggcgaagauguauuuacuguuucaugucgaguacuaacacgaccuucaccugauuuugauuuuauauuccuaguaccuccaacaguagaaucuagaaccaaacccuuuacaguaccuauauuaacaguagaagaaaugacuaauucaagauuuccaaucccacuugaaaaauuauuuacaggucccucaagugcauuugugguacaaccccagaauggaagaugcacuacugacggaguauuacuaggaacaacacaauuaucaccaguuaauauauguacauuuagaggagaugucacacauaucgcaggaucaagaaacuauacuaugaaucucgcaucauuaaacuggaacaauuacgauccuacagaagaaaucccagccccacuaggaacaccagacuuuguuggaaaaauacaaggaguauuaacacaaacaacuaaaggagacggcucuacacgaggacacaaagcaacaguauauacagguagugcaccauuuacaccuaaauuaggcucaguacaauucuccaccgauaccgaaaacgauuucgaaacacaucaaaauaccaaauucacaccaguaggagucauucaagacggaggaacuacacauagaaacgaaccucaacaauggguucuuccuucauacucaggucgcaacguacacaacguccacuuagcaccugcaguagcaccaacauuucccggugaacaauuacucuucuuuagaucaacaaugccaggaugcucaggauacccaaacauggaucuagauuguuuauuaccacaagaauggguucaacauuucuaccaagaagcagcaccugcucaaucagacguagcuuuauuaagauucguaaauccagauacaggaagaguauuauucgaaugcaaauuacacaaauccggauauguuaccguugcacacacuggacaacacgacuuaguaaucccaccaaauggauacuucagauucgauucuuggguaaaucaauuuuauacucuagcaccgauggguaacggaacuggacgucgaagagcacuauaa

SEQ ID NO: 32008 - RNA, 1623 nt, Artificial Sequence
  derived and/or modified sequence opt6 from VP1__Norovirus__BAJ13771
augaaaauggcaucaaacgacgcaaacccaucagacggaucagcagcaaacuuaguaccagaaguuaacaaugaaguaauggcguuagaaccuguaguaggugcagcuauagcagcaccaguagcuggucaaacaaacgucauagaccccuggauaagaaauaauuucguucaagcuccaggaggagaauucacaguaucaccuagaaaugccccaggcgaaauauuauggucagcagcacuaggaccagauuuaaacccauaucuaucccacuuagcacgaauguacaacggauacgcaggaggauucgaaguccaagucauacuagcgggaaaugccuuuacagcagguaaaauuauauucgcugcaguaccaccaaauuucccaacagaaggacuuucacccucacaaguaacaauguucccacacaucaucguagauguaagacaacuagaaccuguacucauaccacuaccagauguaagaaacaauuuuuaccacuauaaucaauccaaugacucaacaauuaaauuaauagcuaugcuuuacacaccucuaagagcuaauaacgcaggagaagauguauuuacaguaaguuguagaguauuaacuagaccaucaccugacuuugacuuuaucuucuuagucccaccuacuguagaaucaagaacaaaaccauuuacaguaccaauuuuaacuguagaagaaaugacaaacuccagauuccccauaccauuagaaaaguuauucacaggccccucaggagccuucguaguacaaccacaaaacgguagauguacaacagacggagucuuacucggcacaacucaauugucaccagucaacauaugcacauuuagaggagacguaacacacauagccggcagccgaaacuauacaaugaauuuggcaucauuaaacuggaauaacuacgacccuacugaagaaauaccagcaccacuagguacaccagacuuuguaggcaaaauacaaggaguauuaacacaaacaacaaaaggugauggcucaacuagaggacacaaagcuacuguauauacaggaucagcaccuuuuaccccaaaauuaggcagcguccaguucagcacagacacagaaaacgauuucgaaacacaucaaaauacaaaauuuacaccaguuggaguaauacaagacgguucaaccacccauagaaaugaaccucaacaauggguucuuccuaguuacucaggaagaaacguucacaacguucaucuugcaccagcuguagccccaacauuuccaggagaacaauuacuuuucuucagaucaacaaugccaggaugcucaggauaucccaauauggaucuagauugccuuuuaccacaagaauggguacaacauuucuaucaagaagcugcaccugcacaaucagacguagcacuucuaagauuuguaaaucccgacacaggaagaguauuauuugaaugcaaauuacauaaaaguggcuauguaacaguugcccacacaggucaacaugaucuaguaauaccuccaaaugguuacuuuagauucgauagcugggucaaucaauucuacacauuagcaccuaugggcaauggaacuggaagaagacgagcauuauaa

SEQ ID NO: 32009 - RNA, 1623 nt, Artificial Sequence
  derived and/or modified sequence opt6 from VP1__Norovirus__BAJ13774
augaaaauggcauccaacgaugcaaaucccucagauggcucagccgcaaaccuaguaccugaaguuaauaaugaaguaauggcccuugaaccaguaguaggagcagcaauagcagcaccaguagcaggacaaacuaauguaauagacccuuggaucagaaauaauuucguacaagcaccaggaggagaauuuacaguuucaccaagaaaugcaccuggugaaauauuauggagcgccccacuaggaccagaccuaaauccauaucuuucccaucuugccagaauguauaauggauaugcuggugguuucgaaguacaaguaauacuagcuggaaacgcauuuacagccggaaaaauuauauuugcagcaguacccccaaacuucccaacagaaggacuaucaccaucccaagucacaauguuuccacacauaaucgucgacguaagacaacuagaaccaguucuuauaccacuaccagacguuagaaacaauuucuaucacuacaaccaaucuaaugacucaacaauaaaacuuaucgcaaugcucuauacaccauuaagagcaaauaacgccggagaagauguauuuacaguuuccuguagaguauuaacaagaccaucuccagauuucgacuucauuuuucuaguaccaccaacaguagaaaguagaacaaaaccauucaccguuccaauacuaacuguagaagaaaugacuaacucaagauuuccaauaccccuugaaaaacuauuuacaggaccaucaggagcauucguuguccaaccccaaaacgguagauguaccacagacggaguacuacuaggaaccacucaacuuucuccaguaaauauuuguacauuccgaggagauguaacccauauagcaggaucacgcaauuauacaaugaaccuggccagucuaaauuggaacaacuaugaucccacagaagaaauaccugcccccuuaggaaccccagauuuuguaggaaaaauacaaggaguucucacacaaacaacaaaaggagauggaucaacaagaggacauaaagcaaccgucuacacaggaucugcaccauuuacaccaaaacuagguucaguacaauuuucaacagacacagaaaacgauuuugaagcacaccaaaacacgaaauucacucccguaggaguaauacaagauggaucaacaacacauaggaaugaaccacaacaauggguauuaccaucuuauucaggacguaauguacaaaacguucaucuagcuccagcaguagcaccaacuuucccaggugaacaacuauuauuuuuuagaucuacuaugccaggcugcucagguuauccaaauauggaucuagauugcuuauuaccacaagaauggguacaacauuuuuaucaagaagcggcuccagcacaaagcgacguagcauuacuacguuucgucaacccagacaccggcagaguacucuucgaaugcaaacuacacaaaucaggauaugucaccguagcacacacuggacaacaugauuuaguaauaccaccaaauggauauuuccgauuugauagcuggguaaaucaauuuuauacacuagcgccaaugggaaacggaacaggaagaagacgagcuuuauaa

SEQ ID NO: 32010 - RNA, 1623 nt, Artificial Sequence
  derived and/or modified sequence opt6 from VP1__Norovirus__BAJ13777
augaaaauggcaucaaaugacgccaacccuagcgauggaucugcugcaaacuuaguaccugaaguuaacaaugaaguuauggcuuuagaaccuguaguaggagcagcaauagcugcaccagucgccggacaaacaaacguaauagacccauggauaagaaauaauuuuguucaagccccaggaggagaauuuacuguaucaccaagaaaugcaccaggagaaauccuauggucagcaccacuuggaccagauuuaaauccauacuuaucacauuuagcaaggauguauaauggauacgcugguggcuucgaaguccaaguuauccuagcgggaaaugccuucaccgccggaaaaaucauuuuugcagccguaccccccaacuuuccuacagaaggauuaucuccaagucaagucacaauguucccacacauuauaguugacguacgacaacuagaacccgucuuaauaccauuacccgacguaagaaacaacuuuuaccauuauaaucaaucaaaugacucaacuauaaaacuaaucgcaauguuauauacaccauuaagagcaaacaaugccggcgacgauguguucacagucuccugcagaguucuuacaagaccaucuccagacuuugauuuuauauuucuaguaccuccaacaguagaauccagaacaaaacccuuuacuguaccaauacuuacugucgaagaaaugacuaacucaagauuuccaauaccacuagaaaaacucuucacaggaccaucaggagcuuucguuguucaaccacaaaauggacgauguacaacagauggaguacuacuaggaacaacacaauuaucacccguaaauauaugcacauuuagaggagauguaacucauauagcaggaucaagaaacuacacuaugaacuuagcauccuuaaacuggaacaacuaugacccaacagaggaaauuccugcaccacucgguacuccagacuucguagguaaaauacaaggaguauuaacacaaacuacaaaaggugauggaucaacaaggggucacaaagcaacaguauauacugguucagcuccauucacaccaaaauuaggaucaguccaauuuuccacagauacagaaaaugauuucgaagcucaccaaaacacaaaauucacaccaguaggaguuauucaagacggaucaacgacacauagaaacgaaccccaacaauggguacuaccaucauauucagguagaaauguacaaaacguacauuuagcaccagcaguagcuccaacauucccaggugaacaauuacuauucuuuagaucaacuaugccagguugcucuggauauccaaauauggaucuugauuguuuauuaccucaagaauggguacaacauuucuaucaagaagcugccccugcacaaucagacguagcauuauuaagauuuguuaauccagacacaggaagaguacuuuuugaaugcaaauuacacaaaucaggauacguaacuguagcacauacaggucaacacgaucuaguaauaccaccuaaugguuauuuucgauuugauucuuggguaaaccaauuuuauacacuagcaccaauggguaacggcacuggaagacgaagagcauuauaa

SEQ ID NO: 32011 - RNA, 1623 nt, Artificial Sequence
  derived and/or modified sequence opt6 from VP1__Norovirus__BAJ13780
augaaaauggccucgaaugacgcuaaucccucagauggcucagccgcuaaccucguccccgaaguuaacaacgaaguaauggcacuagaaccaguaguaggcgcagcaauagcugcaccaguagcaggacaaacaaaugucauugacccauggauucgcaacaacuuuguacaagcaccaggcggagaauucacaguaucuccacguaaugcucccggagaaauacucugguccgcaccacucgguccugaucuuaacccauacuuaucacacuuagcacgaauguacaacggcuacgcaggcgguuucgaaguucaaguaauauuagccggcaacgcauucacagcaggaaaaauaauauuugcugcaguuccgccaaacuucccaacagaaggucuuucaccuucacaaguaacaauguucccucacauaauagucgacguaagacaauuagaaccaguacuaauccccuuaccagacguaagaaauaauuucuaucacuacaaucaaucaaaugauuccacuauaaaacuuaucgccaugcuuuacacuccacuaagagccaauaacgcuggugaagacgucuuuacaguaucaugucguguauuaacuagaccuucaccagacuuugacuuuauauuucuuguuccaccuaccguagaaucaagaacuaaacccuucacaguaccaaucuuaacaguagaagaaaugacaaacucaagauuuccaauuccacuugaaaaacuauuuacuggacccucuggcgccuuuguuguacaaccccaaaacggucgcuguacaacugauggaguuuuacuaggaacaacacaacucucacccguaaauauauguacauuuaggggagacgucacacauauagcagguagcagaaauuacacaaugaaucuagcuucacucaacuggaacaacuacgauccuacagaagaaauaccagcaccauuaggaacuccagacuuuguaggaaaaauccaaggagucuuaacacaaacuacuaaaggagauggaucuacacgaggccacaaagcaaccgucuacaccggaucagcaccauuuaccccuaaauuaggaucaguacaauucucuacugacacagaaaacgauuuugaagcacaccaaaacacuaaauuuacaccaguaggcguuauacaagauggcucaacaacccaccgaaaugaaccacaacaauggguccuaccuucuuauucagguagaaacguacaaaauguacacuuagccccagccguagcaccaacauuccccggagaacaacucuuauucuuuagaucaaccaugccuggaugcucaggauauccaaauauggauuuagauugccuacuaccucaagaauggguacaacacuucuaccaagaagcagcaccagcucaauccgacgucgcacuuuuaagauucguaaauccagauacagguagaguacuauucgaauguaaauuacacaaaucuggauacguaacaguagcucauacuggacaacacgaucuaguaauaccaccuaauggauauuuucguuuugauucaugggucaaucaauuuuacacacucgcuccaaugggaaacggaacaggaagaagacgagcacuauaa

SEQ ID NO: 32012 - RNA, 1623 nt, Artificial Sequence
  derived and/or modified sequence opt6 from VP1__Norovirus__BAJ13783
augaaaauggcaagcaaugaugcuaacccaucagauggaucugcagccaauuuaguaccagaaguaaauaacgaaguuauggcucuugaacccguaguaggagccgcuauagcagcaccaguugcuggccaaacaaacguaauugacccuuggauacgcaauaacuuuguacaagcacccgguggagaauucacagugucuccacguaaugcuccaggagaaauauuauggucugcaccuuuaggacccgaccuaaauccauacuuaucacacuuagcaagaauguauaauggauacgcuggagguuucgaaguacaaguaauacuagccggcaaugccuucaccgcaggaaaaauaauauucgcagcaguaccaccaaacuuucccacugaaggccuaucacccucacaagucaccauguuuccacacauaaucguagauguaagacaacuagaacccgucuuaauaccacuaccagauguaagaaauaauuucuaucacuacaaucaaucaaaugauucuacaauaaaacuaauagcaauguuauacacuccauuacgagcaaacaacgcaggagaagauguauucacuguaucuugucgcguacuaacaagaccaucucccgacuucgauuuuauauuucuaguaccaccaacaguagaaucaagaacuaaaccauucacuguaccaauacucacaguagaagaaaugacuaauucuagauuuccaauucccuuagaaaaacuauucacaggccccuccggagcauuuguaguccaaccccaaaacggucgaugcacuaccgacggaguucuccuagguacaacacaacuauccccaguaaacaucuguaccuuuagaggagaugugacacauauagcaggcucaagaaacuauacaaugaaucuagcauccuuaaauuggaacaauuacgauccuacagaagaaaucccagcaccauuaggcacacccgacuuuguaggaaaaauucaaggaguuuuaacucaaacaacuaaaggagacggauccacacgcggacacaaagcaacaguauauaccggaucagcaccauuuacaccaaaauuaggcucaguacaauuuuccaccgauacagaaaacgauuucgaagcacaccaaaauacaaaauucaccccaguaggcguaauccaagauggauccacaacacauagaaacgaaccacaacaauggguacugccauccuacucaggaagaaauguacaaaauguacauuuagccccagccguugcaccaacuuuuccuggagaacaauuacuauucuuucgaucuacaaugccaggaugcucaggauacccaaauauggaucuagauugcuuauuaccucaagaauggguacaacauuucuaccaagaagcagccccagcacaaucagauguagcacuuuuaagauucguaaacccagacaccggacgaguucuguucgaaugcaaacuccauaaaucaggauauguaacagucgcacauacuggacaacaugaucuaguuauuccaccaaauggauauuuucgauucgauuccugggucaaucaauucuacacacuagcucccaugggcaacggaacaggaagaagaagagcacuauaa

SEQ ID NO: 32013 - RNA, 1623 nt, Artificial Sequence
  derived and/or modified sequence opt6 from VP1__Norovirus__BAJ13786
augaaaauggcaucaaaugaugcaaacccaucagacggauccgccgcuaaccuaguacccgaaguaaauaaugaaguaauggcucuagaacccguaguuggagcagccauagcugccccaguagcaggacaacaaaacguaauugacccauggauacgaaauaauuuuguucaagcaccuggaggagaauuuaccguaucacccagaaaugcaccaggcgaaauacuauggucagcaccacucggaccagaucuuaacccauauuuaucccaucuugcaagaauguauaacggauaugcaggagguuucgaaguacaaguaauacuagccggaaaugcauucacugcaggaaaaauaauauucgcagcaguaccuccuaacuuuccaacagaaggccuaucacccucucaaguaaccauguucccucacauaaucguagauguucgacaauuagaaccaguacuuaucccacuaccagaugucagaaauaauuuuuaccacuauaaccaaucuaaugauucaacuauuaaauuaauagcaauguuauacacuccauuacgcgcaaacaaugcgggagaagauguauucacuguuagcuguagaguuuuaacaagaccaucaccugacuuugacuuuauuuuucuaguucccccaacugucgaaucaagaaccaaaccauuuaccguaccaauacuaaccguagaagaaaugaccaauucucgauuucccauaccacuugaaaaacuauuuacaggccccucaucagccuuuguaguucaaccccaaaauggaagauguacaaccgaugguguacuauuaggaacaacacaauuaaguccuguaaacauaugcacauuucgaggagauguuacacacauagcuggaucaagaaauuacacaaugaaccuagcuuccuuaaacuggaauaauuacgacccgacagaagaaauaccugcuccccuaggaaccccugauuuugucgguaaaauccaaggaguacuaacacaaacaacaaaaggagauggaucaacucgaggacauaaagcaaccguauauacaggauccgcuccauuuacuccaaaauuaggaucaguacaauuuucaacagauacugaaaacgauuucgaaacacaucaaaacacaaaauucacaccagucggaguaauacaagacggaggaacuacacauagaaacgaaccacaacaauggguccuaccauccuauuccggaagaaacgucccuaaugugcacuuagcaccagcaguagccccaacauuuccaggagagcaauuacuauucuucagaucaacaaugccaggaugcucuggauauccaaacauggauuuagauugccuacuaccacaagaauggguucaacauuuuuaccaagaagcagcccccgcacaaucagacguugcuuuacuuagauuuguaaacccugacacuggcagaguccuauuugaaugcaaauuacacaaaucaggcuauguuacaguagcacacacuggacaacaugauuuaguaaucccaccaaauggauauuucagauucgauucuuggguaaaucaauucuacacacuagcaccaaugggaaacggaacaggaagaagaagagcauuauaa

SEQ ID NO: 32014 - RNA, 1623 nt, Artificial Sequence
  derived and/or modified sequence opt6 from VP1__Norovirus__BAJ13792
augaaaauggccucuaacgacgcuaauccuucagacggaucugcagcaaauuuaguaccagaaguaaacaaugaaguuauggcacucgaaccaguaguaggagcagccauagccgcaccaguagcaggacaacaaaacguuauagacccauggauccgaaacaacuuuguacaagcaccaggaggagaauuuacaguaucacccagaaaugcaccaggagaaauauuauggucagcaccucucggcccagaccuaaauccauaucuaucccaucuagcaagaauguauaacgguuacgcuggcggauucgaaguacaaguuguuuuagcaggaaaugcauuuacugcuggcaaaguaauauucgcagcaguaccaccaaacuuuccuacagaaggacuaucaccaucucaagucacaauguuuccucauauaaucguagauguaagacaacucgaacccguccuaauaccacuaccugauguacgaaacaauuucuaucacuauaaucaaucaaaugacuccacaauaaaauuaauagccauguuauauacaccacuacgagccaauaacgcaggagaagaugucuuuacuguguccugucguguauuaacaagaccaucaccagacuuugacuucauauuuuuaguacccccuacaguagaaucaagaacaaaaccauucacaguacccauacuaaccguugaagaaaugacaaacucaagauucccgauaccauuagaaaaauuauucacaggaccaucaggagcauucguaguacaaccccaaaacggaagauguacaaccgacggaguccuacuagguacuacacagcucucaccuguaaacauauguaccuuucgaggagacguaacacauauagcaggaucucgcaacuacacgaugaaucuagcuagcuuaaauuggaacaauuacgacccaaccgaagaaauaccagcaccacuagggacaccugauuuuguaggaaaaauacaaggaguauuaacccaaaccacaaaaggugacggaucaacacguggccacaaagcaaccguguacacagguagcacaccauuuaccccaaaauuaggaucaguucaauuuucaacugacacagaaaaugauuuugaaaaucaccaaaauaccaaauucacccccguaggaguuauacaagaugggggcacaacacaucgaaaugaaccacaacaauggguacuaccaagcuacucugguagaaacguacaaaacguucauuuagccccugccgucgcaccaacuuuuccaggagaacaauuacuauucuuuagauccacaaugccagguuguucaggauacccaaacauggaucuagacugcuuacuaccucaagaauggguacaacauuucuaucaagaagcagccccagcacaaucagacguagcauuacuacgcuucguuaauccagauacaggaagaguacuauucgaaugcaaacuacauaaauccgguuacguaacaguagcacacacuggccaacacgaccuaguaaucccacccaauggauauuuccguuucgauucaugggucaaucaauuuuauacacuagcccccaugggaaauggcacagguagacgacgagcauuauaa

SEQ ID NO: 32015 - RNA, 1623 nt, Artificial Sequence
  derived and/or modified sequence opt6 from VP1__Norovirus__BAJ13795
augaaaauggcaucaaaugaugcuaacccauccgauggaucagccgcuaaccuaguaccagaaguaaacaacgaaguaauggcacucgaaccaguagucggagccgcaaucgcagcuccaguagcaggucaacaaaauguaauagacccuuggauacgaaauaacuucguacaagcaccaggaggagaauuuacaguaucaccacgaaacgcuccaggagaaauaccauggagcgcaccccuaggaccagaucuaaacccuuauuuaucucauuuagcucgaauguauaauggauaugcagguggcuuugaaguacaaguuguacuugcaggaaaugcauuuaccgcaggaaaaguaauauucgcagcaguccccccaaacuuccccacagaaggccuaucaccaucacaaguaaccauguucccacauauaauaguugacguacgacaacuagaaccaguauuaauaccauuacccgacguaagaaauaacuucuaucacuacaaucaaucaaaugacuccacaauaaaauuaauagcaaugcuauacacuccccuaagagccaacaacgcaggagaagacguauucacuguaagcugccgaguauuaacaagaccaucuccagacuuugacuuuauuuuucuuguuccaccuaccguagaaucaagaacuaaaccuuuuaccguaccaauucucacaguagaagaaaugacaaauucaagauuuccaauaccucuugaaaaauuauuuacaggcccaucaggagcauuuguaguucaaccucaaaacggaagaugcacaacagacggaguucuacuuggaacaacacaauuguccccuguaaauauauguaccuuuagaggagauguuacacauauagcuggauccagaaauuacacaaugaaccuugcaucauuaaauuggaacaauuacgacccgacagaagaaauaccagcaccucuuggaacaccugacuuuguuggaaaaauacaaggaguauuaacccaaaccacaaaaggagacggaagcacuagaggacauaaagcaacaguauauaccggaucaacuccauuuacaccaaaauuaggaucaguacaauuuuccacugauacagaaaacgauuuugaaaaccaucaaaacacaaaauuuacacccguaggcgucauacaagaugguggaaccacucauagaaacgaaccacaacaauggguacucccaucuuauucaggccgaaauguacaaaauguccauuuagcacccgcaguagccccuaccuuuccaggagaacaacuauuauucuuccgcucaacaaugccuggaugcaguggauacccaaacauggaucuagauuguuuacuuccacaagaauggguacaacauuuuuaucaagaagcagccccagcacaaucagacguagcacuacuuagauuuguaaacccugacacaggccgaguacuuuucgaaugcaaacuucacaaaucaggcuauguaacaguagcacacaccggacaacaugaccuaguaauaccaccuaacggcuauuuuagauuugacucaugggucaaucaauuuuacacacuagcacccaugggaaauggcacaggcagacgccgagcauuauaa

SEQ ID NO: 32016 - RNA, 1623 nt, Artificial Sequence
  derived and/or modified sequence opt6 from VP1__Norovirus__BAJ13801
augaaaauggcaucuaaugaugcaaaucccucagauggaagugcagcaaauuuaguccccgaagucaacaaugaaguaauggcacuagaaccagucguaggagcagcaauagcagcaccuguagcuggacaacaaaauguaauugacccauggauuagaaauaacuucguacaagccccaggaggagaauuuacuguaucaccaagaaaugcaccaggugaaauuuuauggucugcaccacuaggcccagacuuaaauccauauuuaucccauuuagcacgaauguacaacggcuacgccggcggauucgaaguacaaguaguacuagcaggaaacgcauucacagcaggaaaaauaauauucgcagcaguaccacccaauuucccaacagaaggauuaucaccaucacaaguaacaauguuuccacauauaauagucgacguaagacaauuagaaccaguauuaauuccauuaccugauguacguaacaauuucuaucacuauaaucaauccaaugacucaacaauuaaacucauagcaauguuauacacucccuuaagagcaaauaacgcaggugaagauguuuuuacaguaucuuguagaguacuuacuagaccaucacccgacuucgacuuuauauuuuuaguaccaccuaccguagaaucacguacaaaaccauucacuguaccuaucuuaacuguagaagaaaugacaaauucucgauuuccaaucccacuagaaaaauuauuuaccgguccaucaggugcauuuguugugcaaccacaaaacggucgcugcacaacagauggcguacuacuaggaacuacucaauuaagucccgucaauauauguaccuuuagaggagacgugacccauauagcaggaucuagaaauuacacaaugaaccuagcaucucucaauuggaacaauuaugauccaacagaagaaauaccagccccacuaggaacaccagauuuuguaggaaaaauacaaggaguacuuacccaaacaacuaaaggagauggauccaccagaggacacaaagcuaccguauacacaggauccacuccuuucacaccuaaauuaggaucaguacaauucucuacagacacagaaaacgauuuugaaaaccaucaaaacacaaaauucaccccaguaggaguaauacaagacggcgguacuacacaucgaaacgaaccacaacaaugggugcuaccaucauacucaggacgaaacguacaaaacguccaccuagcaccugcaguagccccaacuuuccccggcgaacaacuauuauucuucagaaguaccaugcccggaugcucaggcuacccaaauauggaccuagauugcuuauuaccacaagaaugggugcaacacuucuaucaagaagcagcaccagcacaaucagacguagcacuucuaagauuuguuaauccugauacaggaagaguauuauucgaauguaaauuacauaaauccggcuacgucacagucgcacacacaggacaacaugaucuuguaauuccuccuaaugguuauuucagauuugacuccuggguaaaccaauuuuacacauuagcuccgaugggaaauggaacagguagaagacgagcauuauaa

SEQ ID NO: 32017 - RNA, 1623 nt, Artificial Sequence
  derived and/or modified sequence opt6 from VP1__Norovirus__BAJ13804
augaaaauggcaucaaacgaugccaacccaucugauggaucagcugcaaaucuuguaccagaaguaaacaaugaaguaauggcacuagaaccaguaguuggagccgcaaucgcagcaccuguagcaggucaacaaaauguaauagacccauggauaagaaauaauuucguccaagcaccaggaggugaauucacaguaagcccaaggaaugcuccaggagaaauauuauggucugcaccacuagguccugaucuuaauccauacuuaucacacuuagcacguauguauaauggauaugcaggaggauuugaaguacaaguaauucuagccggcaaugccuuuaccgcaggaaaaauuauauucgccgcaguaccaccaaauuuuccaacugaaggacucucacccagucaaguaacaauguuuccacauauaauaguagacguaaggcaacuagaaccaguauuaauaccacuucccgauguacguaacaauuuuuaucauuauaaccaaucaaacgauucaacaauaaaacuaauagcuauguuauauacaccuuuacgagcaaacaaugcaggugaagauguauucacugucucuugcagaguucuaacacguccaucacccgauuuugacuuuauauuccuaguaccaccaacaguugaaucacgaacaaaaccguucacuguccccauucuuacaguagaagaaaugacaaauucacgauucccaauaccacuugaaaaacuauucacaggaccaucaucagcauuuguaguccaaccacaaaacggaagaugcacaacugacgggguauuauuaggaacaacacaacuuuccccaguaaauauuugcacauucagaggagacguaacccauauagcuggaucaagaaauuacacuaugaaucuagcaucauuaaacuggaauaauuacgacccaacagaagaaauaccagcaccacuaggaacaccagacuuuguuggcaaaauacaagguguauuaacacaaacuacaaaaggagacgguagcacuagaggacauaaagccacugucuauacaggaucagcucccuuuacccccaaacuagguucaguccaauucucuacagauacagaaaaugacuucgaaacacaucaaaacacaaaauucacaccaguaggaguuauacaagacgguggcacaacacacagaaaugaaccccaacaaugggucuuaccaucauauucuggaagaaacguacaaaacguacaucuagcaccagcaguagccccaacauuuccaggagaacaacuacuauuuuuucgaucuacaaugccaggaugcagcggcuacccaaauauggaccucgauuguuuacuaccacaagaauggguccaacauuucuaucaagaagccgcaccagcucaaucugauguugcacuauuacguuucguuaaccccgacacaggaagaguuuuauucgaaugcaaacuacacaaaucaggguauguaacugucgcacacacuggacagcacgauuuagucauaccaccaaauggauacuuucgauucgacucauggguaaaucaauucuacacacuagcccccauggguaacggaacaggcagaagaagagcacuauaa

SEQ ID NO: 32018 - RNA, 1623 nt, Artificial Sequence
  derived and/or modified sequence opt6 from VP1__Norovirus__BAJ13807
augaaaauggcaucuaaugacgcaaaucccucagauggcucagcagcuaaucuagucccagaaguuaacaacgaaguaauggcuuuagaaccaguaguaggcgcagcaaucgcagcuccaguagccggacaacaaaaugucauagaccccuggauucguaauaacuucguacaagcacccggaggugaauuuacaguauccccaagaaaugcaccaggugaaauacuauggucagcacccuuaggaccagaucuuaauccauaucuaucccaccuagcaagaauguauaacggauacgcaggcggauuugaaguacagguuauacuagcuggaaaugcauuuacagccggaaaaaucauauucgcugcaguuccaccaaacuuucccacggaaggccuaucaccaucucaaguuacaauguucccacacaucauaguugacguaagacaacuagaacccguacucauaccauuaccagacguucgaaauaacuuuuaucauuacaaccaaucaaaugacucgacuauuaaauuaauagcuaugcuauacacaccauuaagagcaaacaacgcaggugaagacguauucaccguaaguugcagaguacuaacaagaccaagcccugacuucgacuuuauauuucuagucccacccacaguagaaucaagaacaaaaccuuucaccguaccaauacuaaccgucgaagaaaugacaaauucaagauuucccauaccauuagaaaaacuauucaccggaccaucaucagcuuuugucguacaaccacaaaacggaagauguacaacagauggaguauuacuaggaacuacacaacuaucaccaguaaauauaugcaccuucagaggagacgucacccacauagcaggauccagaaauuauacuaugaaccuugcuucacucaacuggaacaacuacgacccaacagaagaaauaccagcaccacuaggaacaccagauuuuguuggaaaaauacaaggaguacuaacccaaacuacuaaaggagacggcucaacaagaggacauaaagccacaguauauaccggaucagcucccuuuacuccaaaauuagguucaguacaauucucaaccgauacagaaaaugauuuugaaacacaccaaaauacaaaauuuacaccaguugguguuauccaagauggcggaacaacccacagaaacgaaccucaacaaugggucuuaccuucuuacucaggaagaaauguuccuaacguacauuuagcaccagcaguagcuccaacauuucccggugaacaacuacuuuucuuucgcucaacaaugccaggaugcucagguuacccaaacauggauuuagauuguuuauuaccacaggaauggguucaacacuucuaucaagaagcagcaccagcccaauccgauguagcacuacuacgauuuguuaauccagacacaggacgaguacuauuugaauguaaauuacacaaauccggcuacguuacaguugcacacacaggacaacacgacuuaguaaucccaccaaauggauauuuucgauucgauucaugggucaaucaauuuuauacacuagcaccaauggguaaugguacaggcagacgacgagcucuauaa

SEQ ID NO: 32019 - RNA, 1623 nt, Artificial Sequence
  derived and/or modified sequence opt6 from VP1__Norovirus__BAJ13810
augaaaauggcaagcaaugacgcuaauccaagcgacggaucagcugcaaaucuagucccagaaguaaacaacgaaguaauggcacuagaaccuguuguuggagcugcaauugcugcaccagucgcaggccaacaaaauguuauagacccuuggauacguaauaauuuuguacaagcaccaggaggagaauuuacaguaucaccaagaaaugcuccaggagaaauuuuauggucagcucccuuaggaccugaucuaaauccauauuuaagucacuuagcccgaauguacaauggauacgcaggaggauucgaaguacaaguaauccuagcaggcaaugcauucacagcaggaaaaauaauuuucgcagcaguuccaccaaacuuuccaacagaaggacuuucaccaagucaaguaacaauguuuccacacauuauaguugacguacgacaacuagaaccaguacuaauaccuuuaccagauguucggaauaauuuuuaucacuauaaccaaagcaaugacucaacuauaaaauuaauugcaaugcuauauacuccauuaagagcaaacaaugcaggcgaagaugucuuuacaguaucaugcagaguacuaacacgaccuucuccagauuuugacuuuauauuuuuaguaccuccaaccguagaaucuagaacaaaaccauucacaguaccaauauuaacaguugaagaaaugacaaauuccagauuuccuauacccuuagaaaaauuauucacagguccaucuuccgcauuuguuguccaaccacaaaacgguagauguacaacagacgguguacuccuaggaacaacacaacuaucuccaguaaauauauguaccuuuagaggagauguaacccauauagcuggcucacguaauuacacuaugaauuuagcaucauuaaacuggaauaacuacgacccaaccgaagaaauaccagcaccauuaggaacaccagacuuuguaggaaaaauucaaggaguauuaacacaaacaacaaaaggcgauggaucuacaagaggacauaaagcaacaguauauaccggcucugcacccuucacuccaaaauuaggaucgguucaauucuccaccgauaccgaaaaugauuucgaaacacaucaaaacacaaaauucacaccaguuggcguaauacaagauggagguacaacacauagaaacgaaccacaacaauggguacuaccuagcuauucaggaagaaacguacaaaauguucacuuagccccagcaguugcaccaacauucccaggcgaacaguuauuauuuuuuagaucaacaaugccaggaugcucuggcuaucccaacauggaucuagauugccuauuaccacaagaauggguacaacauuuuuaucaagaagcagcaccagcacaaucugacguagcauuguuacgauuuguaaacccagacacaggucgaguauuauucgaauguaaacuucauaaaucaggauauguaaccguagcccacacaggccaacaugacuuaguaauaccuccuaaugguuauuuucguuucgauucuuggguaaaucaauuuuacacucuagcuccaaugggcaauggaacaggaagaagaagagcucuuuaa

SEQ ID NO: 32020 - RNA, 1623 nt, Artificial Sequence
  derived and/or modified sequence opt6 from VP1__Norovirus__BAJ13816
augaaaauggccucuaacgacgcuaauccaucagacggauccgcagcaaaucuaguaccugaaguaaauaacgaaguaauggcacuagaaccuguagugggagcagcuauagcagcaccagucgcaggacaacaaaaugucauugacccauggauaagaaacaacuuuguacaagccccaggaggagaauuuacaguaucaccaagaaacgccccaggagaaaucuuauggucugcaccacuaggaccagaucuaaauccauaccucucgcauuuagcacgaauguauaacggauacgcaggaggcuucgaaguacaaguaauacuagcuggaaacgccuuuacagcaggaaaaauaauauuugcagcaguuccaccaaacuuuccaacugaaggacuaucaccaucucaaguaacaauguucccacauauaauaguagacguacgacaauuagaaccaguucuaauaccacucccagacguaagaaacaauuucuaucauuauaaccaaucuaaugacucaacaauuaaacuaauagcaaugcuauauacacccuuacgagcaaauaaugcaggugaagaugucuuuacaguuucuuguagaguccuuacacgaccaagcccagacuucgacuuuauauucuuaguaccacccacagucgaaucuagaacaaaaccuuuuacaguacccauauuaaccguugaagaaaugacaaacaguagauuuccaauuccauuagaaaaauuauuuacugguccaaguuccgcauucguaguccaaccacaaaacggacgaugcacaacagacggaguacuacucggaacaacucaacucaguccaguaaacauuuguacauuuagaggagauguaacccauauagcaggaucacgaaauuauacuaugaaccuagcaucauuaaauuggaacaacuacgauccaacagaagaaauucccgcaccucuaggaaccccagacuucguaggaaaaauacaaggcguacuuacacaaacaacaaaaggagacggaagcacuagaggacacaaagcaacagucuacacaggaucagcaccauucacaccaaaacuuggcucuguacaauuuucaacagauacugaaaaugauuuugaaacacaccaaaauacaaaauuuacacccguuggaguaauacaagauggaggcaccacacauagaaaugaaccacaacaauggguauuaccaucauacucaggaagaaauguacagaauguacaccuugcaccagcagucgcaccuacauuuccaggugaacaacuacuuuucuuuagaucaacaaugccugguugcucaggcuaucccaauauggaucuagauugccucuuaccucaagaauggguacaacauuuuuaucaagaagcugcaccugcacaaucagauguagcauuacuacgcuuuguaaacccagacacaggacgcguauuauucgaauguaaacuucauaaaucaggauaugucacaguagcucauaccggacaacacgauuuaguaauacccccaaaugguuauuucagauuugauucauggguuaaccaauuuuacacacucgcaccaaugggaaauggcacaggacgaagacgugcuuuauaa

SEQ ID NO: 32021 - RNA, 1623 nt, Artificial Sequence
  derived and/or modified sequence opt6 from VP1__Norovirus__BAJ13819
augaaaauggcaucaaaugacgcuaacccaagugauggaucagccgcaaacuuaguaccagaaguuaauaaugaaguaauggcacuagaaccaguagucggugccgcaauagcagcaccaguagcaggacaacaaaauguuauagacccauggauaagaaacaauuuuguccaagcuccagguggagaauuuacagucucaccacgaaaugcaccaggagaaauauuaugguccgcaccacuagguccagaccuaaauccauaucuuagccaucuagcaaggauguauaauggauacgcaggagguuuugaaguccaagucauacuugcaggaaaugcauucaccgcaggcaaaauaauuuucgcugccguaccaccaaauuuuccuacugaaggauuaucaccaucucaaguaacaauguucccccauauuauaguagacguuagacaauuagaaccaguauuaauaccauuaccagauguuagaaacaacuucuaucauuauaaucaaucaaaugacucaacaauaaaacuuaucgcaauguuauacacaccacuucgagcuaauaaugcaggagaagacguauuuacugucucauguagaguauuaacaagaccaucacccgacuuugauuuuauauuccuaguaccuccaacagucgaaucaagaacuaaaccuuucacagucccaauacuaacuguagaagaaaugacaaacucuagauuuccaauaccauuagaaaaacuauuuacaggaccaucuggugcauuuguuguccaaccacaaaauggaagaugcacaacagauggagucuuauuaggaacuacccaacuuucaccuguaaauaucugcaccuucagaggagacguaauacacauagcaggaucaagaaauuacacaaugaaucuagcagcuuuaaacuggaacaauuacgacccaacugaagaaauaccagcaccuuuaggaacaccagacuuuguuggaaaaauacaaggaguacucacucagacaacaaaaggagauggaagcacaagaggacacaaagcaacagucuauacuggcucugcagacuuuacaccuaaacucgguucaguacaauucucaaccgauacggaaaacgauuuugaaacacaucaaaauacaaaauuuacuccaguaggagucauacaagauggcucaacaacccauagaaaugaaccucaacaauggguacuccccuccuauucaggaagaaacguacauaauguacaccuugcaccagccguugcuccaacauuuccaggugaacaauuauuauucuuuagaucaacaaugccaggaugcaguggauauccaaauauggacuuagauugccuacucccacaagaauggguacaacacuucuaccaagaggccgcacccgcacaaagugacguagcuuuacuaagguuuguaaacccagacacaggcagaguauuauuugaaugcaaacuacacaaaucuggauauguaacaguugcucauacaggacaacacgauuuaguaauaccacccaauggauacuucagauuugauucauggguuaaucaauucuauacucucgccccaaugggaaacggcacaggcagaagaagagccuuauaa

SEQ ID NO: 32022 - RNA, 1623 nt, Artificial Sequence
  derived and/or modified sequence opt6 from VP1__Norovirus__BAJ13822
augaaaauggcuucuaacgaugcaaacccauccgauggcucugcagcaaacuuaguaccagaaguaaacaacgaaguaauggcacuugaaccaguagucggugcagcaauagccgcacccguagcaggccaacaaaauguaauagacccauggauaagaaauaauuuuguacaagcaccaggaggagaauuuacaguauccccacgaaaugcccccggagaaauauuaugguccgccccucuaggcccagaccuuaaucccuaucuaucucacuuagcacgaauguacaacggcuacgcagguggauucgaaguccaagucauauuagccggaaaugccuucacagcuggaaaaauaauuuuugcagccguacccccaaauuucccaacagaaggccuuucuccaucucaaguaacuauguucccucacaucauagucgauguuagacaauuagaaccuguacucauaccauuaccagauguaagaaauaauuucuaucacuacaaccaauccaaugacucuacaauaaaacuaauagcuaugcucuauaccccauuacgugcaaacaaugcaggcgaagauguauuuaccgucucauguagaguauuaacuagaccauccccagacuucgauuucauauuucuuguuccaccaacuguagaaucucgaacaaaaccauuuacaguaccaauauuaacaguugaagaaaugacaaacucaagauucccaauacccuuagaaaaacuuuucacaggccccuccucagccuuuguaguacaaccucaaaacggaagaugcacaaccgaugguguacuuuuaggcacaacccaauuauccccaguaaacaucuguacauuccgaggagacguuacacauauagccggaagcaggaacuacacaaugaaucuugcuucuuuaaacuggaauaacuacgaucccacagaagaaauaccagcaccacucgguacacccgacuucguaggcaaaauacaaggcguauuaacacaaacaacaaaaggagauggaucaacacguggucauaaagcaacaguauauacugguucagcacccuuuacuccaaaacuuggaucaguucaauuuucuacagauacagaaaacgauuuugaaacacaccaaaacacaaaauucacuccaguuggaguuauacaagacgguggaacaacccauagaaaugaaccacaacaauggguucuaccaucauauucaggaagaaacguacaaaacguucauuuagcaccagcaguagcucccacauuucccggagaacaacuuuuauucuuuagauccaccaugccaggcugcuccggauacccaaauauggauuuagauugucuuuuaccucaagaauggguccaacauuuuuaccaagaagcugcuccagcacaauccgacguagcuuuacuaagauucguaaaccccgacaccggaagaguacuauuugaauguaaacuacauaaaucuggcuacguuacagucgcacacacuggacaacacgaccuaguuauacccccaaauggauauuuuagauucgauucauggguaaaucaauuuuacacauuagcaccaaugggaaaugguacagguaggcgucgcgccuuauaa

SEQ ID NO: 32023 - RNA, 1623 nt, Artificial Sequence
  derived and/or modified sequence opt6 from VP1__Norovirus__BAJ13825
augaaaauggcaucaaaugaugcaaauccaucagacggcucugccgcaaaucuaguacccgaaguaaacaacgaaguuauggcacuagaaccagucgucggagcagcaauagcagcaccaguagcaggacaaacaaacguaauugauccauggauaagaaauaacuuuguacaagcaccaggaggggaauuuacugucucuccaagaaaugcuccaggagaaauacuauggucagccccccuaggcccagauuuaaauccuuaccuaagucaccucgcaagaauguauaacggauacgcaggaggcuucgaaguacaaguaauucuagcaggaaacgccuuuacagcaggcaaaauaauauuugcagcaguaccaccaaacuuuccaacagaaggacuuucaccaucacaaguaaccauguucccgcacaucauaguagacguacgacaacuagaaccaguacuaauaccacuaccagauguacgaaacaauuucuaccauuauaaucaauccaaugacagcacgauaaagcuaauagcaauguuauacacaccacuuagagcuaacaaugcaggagaagaugucuucaccguaucauguagaguucuaacaagaccuucuccagacuucgauuucauauucuuaacaccgcccacaguagaaaguagaacuaaaccauucacaguacccauacuuacuguagaagaaaugacaaacucuagauucccuauaccguuagaaaaacuauucacagguccauccggagcauucguuguacaaccucaaaacggaagaugcacaacagacggaguacuacuaggcacuacacaauuaucaccaguaaauauuuguacauuucgaggagaugucacacauaucgcaggcucaagaaacuauacuaugaaucuugcuucauuaaacuggaacaauuacgauccaacagaagaaauaccagccccacuaggaacaccagauuuuguaggaaaaauucaaggaguacuaacacaaacaacaaaaggcgacggaucuacaagaggacacaaagcuacagucuauaccggaagcgcaccauucacaccaaaacuaggaaguguucaauucucuacagauacugaaaacgacuucgaagcacaucaaaauacaaaauucacaccaguuggcguaauacaagacggauccacuacucaucgcaaugaaccacaacaauggguacuaccaucauacuccggaagaaauguacaaaacguacaucuugcaccugcaguugcaccuacauuuccuggagaacaauuacuuuuuuuuagaucuacaaugccuggaugcucaggauauccaaauauggacuuagauuguuuauuaccccaagaauggguacaacacuuuuaucaagaagcagcacccgcacaaucagaucuagcuuuacuaagauucguuaacccagacacgggaagaguacucuuugaaugcaaauuacauaaauccgguuauguaacuguagcacacaccggccaacacgaucuaguuauaccaccaaauggauauuuuagauucgacucuuggguaaaccaauuuuacacucuagcaccaaugggaaacggaacaggaagaagaagagcauuauaa

SEQ ID NO: 32024 - RNA, 1623 nt, Artificial Sequence
  derived and/or modified sequence opt6 from VP1__Norovirus__BAJ13828
augaaaauggcaucaaaugacgcuaaccccucagauggaucagcagcaaauuuaguccccgaagucaauaacgaaguaauggcacuagaaccaguagucggugcagcuauagcugccccugucgcaggacaacaaaauguaaucgauccuuggauacgaaauaacuuuguccaagccccaggcggagaauuuacaguaucaccacgaaaugccccuggugaaauccuauggucagcaccacuuggcccugaucucaaccccuaucuaucacaccuagcucggauguauaauggauacgcagguggauuugaaguccaaguaauacuagcaggaaaugcauucacagcaggcaaaauaauauuugcugcaguaccacccaauuucccaacagaaggacuaucacccucacaaguuacaauguuuccacacauaauaguagacguacgacaauuagaaccaguucucauacccuuacccgaugucagaaauaacuucuaucacuacaaucaaagcaaugacucuaccauaaaacuuauugccaugcuauacacucccuugagagcaaacaaugccggagaagauguauuuacagucucauguagaguauuaacaagaccuucaccagacuuugacuuuauauucuuaguaccuccaacuguagaaucacgaacaaaaccuuucaccgucccaauuuuaacaguagaagaaaugacuaacucaagauuuccaauuccacuagaaaaacuuuuuacaggaccaucuagcgcauuuguuguucaaccucaaaauggaagauguaccacagacggcguauuacuaggaaccacacaauuaucaccagucaauauauguacauuccgaggagauguuacucacauagccggaucacguaauuauacuaugaacuuagcuucccucaauuggaacaauuacgauccaaccgaagaaauaccagcaccucuaggaacacccgacuucguaggcaaaauccaaggcguccuaacccaaacaaccaaaggcgaugguucaacaagaggucauaaagcaaccguauauacagguucagcaccauuuacacccaaacuaggaucaguccaauucuccaccgacacagaaaacgauuucgaaacacaucaaaauacaaaauucacaccaguaggaguaauacaagauggugguacaacacaucguaaugaaccacaacaauggguacuucccucauacucaggacgaaacguucccaacguucaccuugcaccagcagucgccccaacauuuccaggagaacauaguuuauacuuuagaucaacaaugccagguuguuccggauauccaaauauggaucuagauugcuuacuaccucaagaauggguacaacauuucuaucaagaagcagcaccagcccaaucugacguagcccuuuuacguuucguaaacccagacacagguagaguacuauucgaaugcaaacuacacaaauccggauauguaacaguagcucauacaggacaacacgaucuaguaauaccaccaaauggauauuuuagauuugauucuuggguaaaucaauuuuacacauuagcaccaaugggaaaugguacaggccgacgacgagcacuuuaa

SEQ ID NO: 32025 - RNA, 1623 nt, Artificial Sequence
  derived and/or modified sequence opt6 from VP1__Norovirus__BAJ13831
augaaaauggcuaguaaugaugcaaacccauccgaugguucagccgcaaauuuaguaccugaaguuaacaaugaaguaauggcacuagaacccgucguaggagcagcaauugcagcacccguagcaggacaacaaaauguaauugacccauggauucggaacaauuuuguacaagcaccuggaggagaauucacaguaucaccuagaaacgcuccaggagaaauauuauggucagccccacuuggaccagaccuaaauccauaucuaucucaccucgcaagaauguauaacggauacgccggaggauucgaaguucaaguaauacuagcuggaaaugcauuuacugcaggaaaaauaauuuucgcagccguuccacccaauuucccaacagaaggacucuccccaucccaaguaacuauguucccacacauaauaguugauguaagacaacuagaaccaguacuaauaccacuaccagaugucagaaacaauuuuuaucacuacaaccagucuaaugacucaacaauaaaauuaauagcaaugcuauauacacccuuaagagccaacaacgcaggcgaagacguauuuacaguuucauguagaguacuaaccagaccuucaccagauuucgauuuuauauuuuuaguccccccuacaguagaaucuagaacaaaaccauucacaguaccaauauuaacaguugaagaaaugacaaacucaagauuuccaauuccacuagaaaaacuauuuaccgguccauccucugcauuuguaguacaaccccaaaacggaagaugcacaacugauggaguccuucuaggcacuacacaauuaucacccguaaauauauguacauuuagaggcgacguaacacauauagcaggaucaagaaauuauacaaugaaccucgccucacuaaacuggaauaauuacgauccaacagaagaaauaccagcaccucuagguacaccagacuuugucggaaaaauacaagguguauuaacacaaacaaccaaaggagacggaucuaccagaggucacaaagcaacagucuauaccggaucugcuccauuuacaccaaaauuaggaucuguucaauucucaacagauacagaaaacgauuuugaaacacaucaaaauacaaaauuuacucccguaggaguaauucaagacggaggaacuacccaucguaacgaaccccaacaaugggucuuaccauccuacucuggacgaaacgucccaaauguacaccuagccccugcaguagcaccaacauucccuggagaacaacuauuauucuuuagaucaaccaugccaggcuguucaggcuacccaaauauggaccucgauugcuuacucccucaagaauggguccaacauuucuaccaagaagcagcaccggcacaaucagacguagcacuauuaagauucguaaacccagacacaggacgaguauuauuugaaugcaaauuacacaaaucaggauauguaacaguugcccauacaggacaacacgauuuaguuauaccaccaaauggauacuuuagauuugauucauggguaaaucaauuuuacacacuagcgcccauggguaauggaacaggaagaagaagagcauuauaa

SEQ ID NO: 32026 - RNA, 1623 nt, Artificial Sequence
  derived and/or modified sequence opt6 from VP1__Norovirus__BAJ13834
augaaaauggccucaaaugaugcuaaucccucugacggcagcgcugcaaaucuuguaccugaaguuaacaacgaaguaauggcacucgaaccaguugucggagcugcaauagccgccccaguagcaggacaaacaaauguaauagacccauggaucagaaacaauuucguacaagccccaggcggagaauucacaguaucaccaagaaaugcuccaggugaaauauuauggagugccccucuaggaccagacuuaaaccccuaucuaucacaucuugccagaauguacaauggauaugccggaggauuugaaguacaaguuauacuagcaggcaaugcauuuacagcaggaaaaaucauauuugcagcugucccaccaaauuucccaacagaaggacucucaccaucacagguaacaauguuuccucacauaauagucgauguuagacaacucgaaccuguacuaaucccauuaccagauguccgcaacaacuucuaucacuauaaucaaucaaaugacucaacuauuaaacuuauagcaauguuauauacaccacuacgagcaaauaacgcaggagaagaugucuuuacaguaucaugucgaguucuuacuagaccaucaccugacuuugacuuuauauuuuuaguucccccaacaguugaaagucguacuaaaccauucacaguaccaauauuaacaguagaagaaaugacuaauucaagauuuccaauuccauuagaaaaauuauuuaccggcccaucaggagcauuuguaguacaaccacaaaauggacgauguacaacagacgguguacuucuaggaacaacacaauuaucuccagugaauauauguacauuucgaggagacguaacacauauagcuggaucaagaaauuauacaaugaacuuagcaucacucaauuggaacaauuacgauccaacagaagaaauacccgcaccauuaggcacacccgacuuuguuggcaaaauacaaggcguacuuacacaaacaacuaaaggagacgguucuacucgaggacauaaagcaacaguauacacaggaucugcaccuuuuaccccuaaauuaggaucaguacaauucucaacugauacagaaaaugauuucgaaacucaucaaaacacaaaauuuacuccaguaggagugauucaagacggaucuacaacacauagaaaugaaccucaacaauggguuuuaccuucuuacuccggaagaaauguacacaauguacaucuagcaccagcaguugcaccaacauuucccggagaacaacuuuuauuuuuucgaucaacuaugcccgguugcucaggauauccaaauauggauuuagauugcuuauuaccacaggaauggguacaacauuuuuaucaggaagcagcuccagcacaauccgacguagcauuauuacgauuuguaaacccagauacagguagaguauuauucgaauguaaauuacauaaaucaggauauguaacaguagcucauacaggacaacacgauuuaguaauaccccccaauggauauuuuagauuugauuccuggguaaaucaauuuuauacauuagccccaauggguaaugguacaggcagacgacgagcacuauaa

SEQ ID NO: 32027 - RNA, 1623 nt, Artificial Sequence
  derived and/or modified sequence opt6 from VP1__Norovirus__BAJ13837
augaaaauggcgucaaaugacgcgaacccuucagauggaagcgcugcaaacuuaguuccugaaguaaacaacgaaguuauggcacuagaaccaguaguuggagccgcaauagcugcaccuguagcaggacaacaaaauguaauugacccauggauaagaaauaauuucguacaagcaccaggaggagaauuuacuguaucaccacgcaaugcaccuggagaaauauuauggucagcacccuuaggaccagauuuaaacccauaucuaucacacuuagcaagaauguacaauggauacgcaggaggcuucgaaguacaaguaauauuagcaggaaaugcauuuacagccgguaaaaucaucuuugcagccgucccaccaaacuuuccaacagaaggacuaucaccaagccaaguaaccauguucccccacauuauuguagacguaagacaauuagaaccagucuuaauaccacuaccagacguaagaaauaauuucuaccauuauaaccaaaguaaugacucaacuauaaaacuaauagcuauguuauauaccccucuaagagcuaacaacgcuggagaagaugucuucacaguuucauguagaguuuuaacacgacccagccccgacuucgacuuuauuuuuuuaguacccccaaccguagaaucaagaacaaaaccauucacaguaccaauauuaaccgucgaagaaaugacaaacucacguuuuccaauaccucuagaaaaacuauucacaggaccaucauccgcauucguuguacaaccacaaaauggccguugcacaacugauggaguacuacuaggaacuacucaauuaucaccaguaaauaucugcaccuuuagaggagacguaacacacauagccggaucaagaaauuauacaaugaacuuagcaaguuuaaacuggaacaauuacgacccaacagaagaaauaccagcaccucuaggaacuccggauuuuguuggaaagauacaagguguauuaacacaaacaacaaaaggagauggauccacacgaggccacaaagcaacagucuacacagguagcgcaccauuuacuccaaaauuaggauccguccaauuuucaacagacacagaaaacgacuuugaaacacaucaaaauacaaaauuuacaccaguagguguaauacaagacgguggaacaacacauagaaaugaaccacaacaauggguacuaccaucauauuccggcagaaauguaccaaacguacaucuagcaccagcaguagcaccuacauuuccaggagaacaauuauuauucuucagaucaaccaugccuggaugcucuggauauccaaauauggaucuggacugcuuauuaccccaagaauggguucaacauuucuaucaagaagcagcaccagcacagucagacguagcauuauuaagauucguaaacccagacacagguagaguccuauucgaaugcaaauuacauaaaucagguuauguaacaguagcacacacaggacaacacgauuuaguaaucccacccaauggcuauuuuagauuugauuccuggguaaaucaauuuuauacuuuagcaccuaugggaaacggaacaggacgaagacgcgccuuauaa

SEQ ID NO: 32028 - RNA, 1623 nt, Artificial Sequence
  derived and/or modified sequence opt6 from VP1__Norovirus__BAJ13840
augaaaauggcaaguaaugacgcaucaccuucagacggauccgcagcaaauuuaguccccgaaguaaacaaugaaguaauggcccuagaacccguaguaggagcagcaauagcagcaccaguagcagggcaacaaaauguaauagacccuuggauaagaaacaacuuuguacaagcaccaggcggagaauucacaguuucaccacgcaaugcaccaggagaaauucuauggucugcaccacucggaccagaucuaaauccauauuuaucacauuuagcaagaauguacaacggauaugcuggcggauuugagguacaaguaauacuagcaggcaaugcuuuuacagcuggaaaaauaauauucgcagcaguacccccaaauuuuccaaccgaaggacuaucaccaucacaaguaacaauguuuccacacauaauaguugacguaagacaauuagaacccguauuaauaccccuucccgauguaagaaacaauuuuuaucacuacaaucaaucaaacgauucaacaaucaaacuaauagcaaugcuauacacaccauuacgcgcaaacaaugcaggcgaagacguauuuacaguuucaugucgaguacuuacaagaccgucaccugauuucgauuuuaucuuccuagugccaccuacaguagaauccagaacaaaaccuuucacaguaccaauauuaacugucgaagaaaugacaaacuccagauucccaauaccacuagaaaaacuauucacagguccaaguggagcauucguuguccaaccucaaaauggacgauguacaacugauggaguacuacuaggcacaacccaacuaucgccaguaaacaucuguacauucagaggagacgucacacauauagcaggaucaagaaauuacacuaugaaucuugcugccuuaaauuggaauaauuaugauccuacugaagaaauaccagcaccucuaggaaccccagauuuuguuggaaaaauucaaggcguacuuacucaaacaacuaaagcagacggaucaacaagaggucauaaagcaaccguauacacaggauccgcaguauuuacaccaaaauuaggcucgguacaauuuucaacugacacagaaaaugauuucgaaacccaccaaaacaccaaauucacuccaguaggaguaauacaagacggaucaacaacacauagaaaugagccacaacaauggguacuuccuucauauucugguagaaauguacauaacguacaccuagcaccugcaguagcaccaacauucccaggagaacaauuauuauucuuucggucuacaaugcccggaugcucaggauauccuaacauggaccuugacugucuucuaccacaagaauggguacaacauuucuaccaagaagcagccccugcacaaucagacguugcuuuacuaagguucgugaacccagacacuggacgcguauuauucgaaugcaaacuccauaaaucaggcuauguaacaguagcacacacaggacaacaugaccuaguaaucccaccuaauggauauuucagauuugauuccuggguaaaucaauucuauacucuagcaccuaugggaaauggcacuggaagaagacgagcauuauaa

SEQ ID NO: 32029 - RNA, 1623 nt, Artificial Sequence
  derived and/or modified sequence opt6 from VP1__Norovirus__BAJ13843
augaaaauggcaucaaaugacgcaaauccuucagaugguucagcagcaaauuuagucccagaagucaacaacgaaguaauggcauuagaaccagucguaggagcagcuauagcagcaccaguagcaggccaacaaaacguaauagacccauggauaagaaauaauuuuguacaagcaccaggaggagaauuuaccguuucaccucgaaaugcaccaggcgaaauauuauggucagcaccucuuggaccagauuuaaauccauaccuaucacauuuagcaagaauguauaacggauacgcuggaggauucgaaguacaagucauacuugcugguaaugcuuucacagcagguaaaauaauauuugcagcaguuccaccaaacuucccaacugaaggacuaucuccaucacaaguaacaauguucccucacaucauaguagacguacgacaacuagaaccuguauuaauaccauuaccugacguacgaaacaauuuuuaccauuauaaccaaagcaacgacaguacaauaaaacuaauugcuaugcuuuauacaccuuuaagagcuaauaaugccggagaagauguauuuacaguaucuugcagaguucuaacaagacccucuccugacuucgacuucauuuucuuaguaccacccacaguagaaucucguaccaaaccauuuaccguuccaauacuaacaguugaagaaaugacaaauagucgcuuccccauaccuuuagaaaaacucuuuacaggacccucuucugcauuuguuguccaaccacaaaauggaagaugcacaacagauggaguacuacuagguacaacucaacuaucuccaguaaacauauguaccuucagaggcgauguaacacacauagcaggcuccagaaauuacacaaugaauuuagcaucacuaaacuggaauaacuacgacccaacugaagaaauacccgcaccccucggaacaccagacuuuguagguaaaauccaaggcguacucacacaaacaacgaaaggagacggaucaacuagaggacauaaagcaacaguauacacuggaagcgcaccauuuaccccaaaauuaggaucaguacaauuuucuacugauacugaaaaugacuucgaaacacaucaaaacaccaaauuuacacccguugguguuauucaagauggaggaacaacccaucguaaugaaccacaacaauggguauuaccgucauauucuggaagaaaugucccuaacguacaucuugcaccagcaguugcaccaacuuuuccgggugaacaauuacuauucuuucgaucuacaaugcccggcuguucaggcuaucccaauauggaucuagauugccuacuaccacaagaauggguacaacauuucuaucaagaagcagcaccagcacaaucugacgucgcccuacuaagauucgucaacccugauacugguagaguauuauuugaauguaaacuacauaaaucuggcuacguaacaguagcccacacaggacaacacgauuuaguaauaccaccaaacggcuauuucagauucgauuccuggguaaaucaauuuuacacacuagcuccaaugggaaauggaacagguagacguagggcacuuuga

SEQ ID NO: 32030 - RNA, 1623 nt, Artificial Sequence
  derived and/or modified sequence opt6 from VP1__Norovirus__BAJ13846
augaaaauggcaucaaacgaugcuaaucccucagacgguucagcagccaauuuaguaccugaaguaaacaacgaaguaauggcucuagaaccuguagucggagcagccauugcagcaccaguagcaggccaacaaaacguaauugacccauggauaagaaauaacuucguacaagcaccuggaggagaauucacuguaucaccacgaaacgcaccaggagaaauccuuuggucagcaccacuaggaccagauuuaaauccauaucucucacaccuagcaagaauguauaacggauaugcaggaggauucgagguacaagucauacuagcuggaaaugcauuuacagcaggaaaaauaauauucgcugcaguaccaccaaacuuuccaacugaagguuuaucaccaucacaaguaaccauguuuccacacauaauaguagacguaagacaacuagaacccguuuuaauaccauuaccagacguaagaaacaacuuuuaccauuauaaccagucaaacgacucaaccaucaaauuaauagcaaugcuauacaccccauuaagagcaaacaaugcaggagaagauguguuuacaguuucaugucgaguauuaacacgaccaaguccagauuucgacuuuauauuccuaguacccccuaccguagaaagucgaacuaaaccauucacuguuccaauauuaacagucgaagaaaugacaaauucaagauuuccuaucccucuugaaaaauuauucacaggcccaucaucagcauucguaguacaaccacaaaacgguagauguacaacugaugguguauuauuagguacaacacaacuauccccaguaaacauauguacauuuagaggagacguuacacauauagcgggaucacgcaauuacacuaugaauuuagcaucauuaaauuggaauaauuacgauccaacagaagaaauaccagcaccuuuaggaacaccggacuuuguaggaaaaauacaaggaguccuaacccaaacuacuaaaggagaugguucuacaagaggacauaaagcaacuguauauacugguucagcacccuuuacaccaaaauuagguucaguacaauucagcacagauacagaaaacgacuucgaaacucaccaaaacacaaaauucacaccaguaggcguaauccaagacggaggaacaacucacagaaacgaaccacaacaauggguauuaccaucauauucaggacgaaauguacccaacguacaccuugcaccagcaguagcaccuacauuuccaggcgaacaacuacuauucuucagaucaacaaugcccggauguucagguuaccccaacauggauuuagauuguuuacuuccacaagaauggguacaacauuucuaucaagaagcggccccagcacaaucagacguagcauuauuaagauucguuaacccagacacaggacgaguauuauucgaaugcaaauuacacaaaucuggauauguaacaguugcacacacaggacagcacgaucuaguuauaccacccaaugguuauuucagguucgauuccuggguaaaucaauucuauacccuagcuccaauggguaauggcacaggacgaagacgagcacuauaa

SEQ ID NO: 32031 - RNA, 1623 nt, Artificial Sequence
  derived and/or modified sequence opt6 from VP1__Norovirus__BAJ13849
augaaaauggcuucaaaugacgcaaauccuagcgaugguucugcagcaaauuuaguaccagaaguaaacaacgaaguaauggccuuagaaccaguugucggagcagccauagcagcaccuguagcaggacaacaaaacguaauagauccauggauuagaaauaauuucguucaagcaccgggaggugaauuuacaguuucaccacgcaaugccccuggagaaauacuauggucugcaccucuaggaccagaucucaaccccuaucuaucccacuuagccagaauguacaauggauaugcaggcggauucgaaguccaaguaauucuagcaggaaaugccuucaccgcaggaaaaauaaucuucgcagcaguuccaccaaacuucccaacagaaggucuaagcccaucacaaguaacaauguuuccacacaucauaguugauguuagacaauuagaaccaguucuaaucccauuacccgauguacgcaacaauuuuuaucacuacaaccaaucaaacgacucaaccauaaaacuuauagcaauguuauacacuccauuaagagcaaauaacgcaggagaagauguauuuacagucucaugccgcgucuuaacacgaccuucaccagacuuugauuucauauuucuaguccccccaacaguagaaucgagaacaaaaccauuuacaguccccauacucacaguugaagagaugacaaacucaagauuuccaauucccuuagaaaaacuauucaccggaccaaguucagcauuugucguacaaccccaaaacgguagaugcacuacugauggaguccuacucggaaccacacaacuauccccuguaaacauaugcaccuuucguggagacguuacacauauagcaggaucuagaaauuacaccaugaaucuagcauccuuaaauuggaacaauuacgauccaacugaagaaauaccugcaccacuaggaacaccugauuuuguaggaaaaauacaaggcguauuaacccaaacaacaaaaggagacggauccacuagaggucacaaagcaacuguauauaccggcucugcuccauuuacaccaaaacuagguuccguacaauucucaacugacacugaaaacgacuuugaaacacaucaaaauacaaaauucaccccaguugguguaauacaagacggugguacaacacaucgaaaugaaccacaacaauggguucuuccuucauauucaggucgaaauguaccuaauguacacuuagcucccgcaguugcccccacauuuccaggugaacaacuacuuuuuuuuagaucaaccaugccuggaugcucuggauacccaaacauggaucuugauugccuuuuaccacaagaauggguacaacauuuuuaucaagaagcugcuccugcucaauccgacguagcauuacuccgauuuguaaacccagacacaggaagaguauuauuugaauguaaacuacauaaaucuggauauguaacuguagcucacacuggacaacacgaucuuguaauuccaccaaauggauacuuucgauuugauagcuggguaaaucaauuuuauacacuagcuccaauggguaauggaacuggacgaagaagagcauuauaa

SEQ ID NO: 32032 - RNA, 1623 nt, Artificial Sequence
  derived and/or modified sequence opt6 from VP1__Norovirus__BAJ13852
augaaaauggcuucaaaugacgcaaauccaucagacgguucugcagcaaauuuaguacccgaaguaaauaaugaaguaauggcauuagaaccaguugucggagccgcaauagcagcaccaguagcuggacaacaaaauguaauagacccauggauccgcaauaacuuuguacaagcaccaggcggagaauucacuguuucaccacgaaaugcaccuggggaaauauuauggucugcaccauuagguccugacuuaaaucccuaucuaucacacuuagcacguauguauaauggauaugcgggaggcuucgagguacaaguuauauuagcaggaaacgcauuuacagcaggaaaaauaauauucgcagcaguuccaccuaacuuuccaacagaaggccuaucuccaagccaaguuacaauguucccacauauaauaguagacgucagacaauuagaaccaguacuuauaccacuaccagauguacguaauaauuucuaucacuacaaccaaucaaaugacucaacaauuaaacuaauagcaaugcucuauacaccauuaagagcuaacaacgcaggagaagauguauucacaguaucaugcagaguauuaacuagaccaucaccagauuucgauuucauuuuuuuaguaccaccaacuguagaaucccgaaccaaaccauuuacaguaccaauauuaacaguagaagaaaugacaaacucacgauuuccaauaccacuagaaaaauuauuuacagguccaucauccgcuuuugucguacaaccacaaaacggacguuguacaaccgaugguguauuacucggaacuacacaauuaucuccaguaaauauauguacauuuagaggugauguaacccauauagcaggaucuagaaauuacacaaugaauuuagccucauugaacuggaacaauuacgauccaacagaagaaauaccagcaccacuuggcacaccagacuuuguaggaaaaauacaaggaguucucacacaaacaacaaaaggagauggaucaacuagaggucauaaagcaacagucuacacaggaucagcuccuuuuacuccaaaacuaggaucaguacaauuuuccacagacacagaaaacgauuuugaaacacaccaaaacacaaaauuuacucccguaggaguuauacaagauggagguacaacacauagaaaugaaccacaacaauggguuuuaccaucauauagcggaagaaacgucccuaacguacaccuagcaccugcaguagcacccacauuuccaggugaacaauuacucuucuuucguucaaccaugccaggauguagcggauauccaaauauggauuuagauugccuuuuaccucaagaauggguucaacacuucuaucaagaagcagcaccagcgcaaucagacguagcauuacuacguuucguaaacccugauacaggucguguauuauucgaaugcaaacuacauaaacccggauauguaacagucgcacauacaggacaacacgaucuaguaauaccaucuaacggauauuucagauuugauucauggguaaaucaauuuuauacacuagcuccaaugggaaauggaacaggaagacguagagcucuauaa

SEQ ID NO: 32033 - RNA, 1623 nt, Artificial Sequence
  derived and/or modified sequence opt6 from VP1__Norovirus__BAJ13855
augaaaauggcaucuaaugacgcuaacccaagugacgguagugcagcaaaccuaguaccagaaguaaauaaugaaguaauggcacuagauccaguaguaggagcagcaauagcagcuccaguagcaggacaacaaaauguaaucgaccccuggauaagaaauaacuuuguacaagcaccaggaggugaauuuacaguuucaccacguaaugcgccaggagaaauauuauggucagcaccccuagguccugacuuaaauccauaucuuucucaccuagcaagaauguauaauggauaugcaggaggauuugaaguucagguaaucuuagcaggaaacgcuuuuacagcaggcaaaauaauauuugcagcaguaccaccaaacuuuccaaccgaaggauuaagcccaucacaaguuacaauguuuccacauauuauaguagacguacgccaacuagaaccaguauuaauaccauuaccagacguacguaauaacuucuaccacuauaaccaaucaaaugacuccacaauaaaacucaucgcaauguuauacacaccauuaagagccaacaaugcaggagaagauguauuuacagucucuuguagaguuuuaaccagaccuucuccagacuuugauuuuaucugccuaguccccccaacaguagaauccagaacaaaaccauuuacaguaccuauauuaacaguugaagaaaugacaaacucacgcuuucccauucccuuagaaaaacuauuuacaggacccucuucagcauuuguaguacaaccacaaaacggaagauguaccacagacggaguauuacuaggaacaacacaacuaucaccaguaaauauuugcacauuuagaggcgacguaacacacauagcuggauccagaaacuacacaaugaacuuagcaucacuaaacuggaauaacuaugaucccacugaagaaauuccagcaccucuaggaacaccagacuuugucgguaaaauucaaggagugcuaacccaaacaaccaaaggagacggauccacaagaggacauaaagcaacaguauacacaggaucagcaccauuuaccccaaaacuuggcucaguccaauucucuacagacacagaaaaugauuuugaaacacaccaaaauacaaaauucacaccaguuggcguuauccaagauggcggaacaacccauagaaaugaaccacaacaauggguuuuaccaucauacucaggaagaaauguaccaaacguucacuuagcaccagcaguugcacccacauucccaggugaacaacuauuauucuucagauccacaaugccggguuguucaggauacccaaacauggauuuagacuguuuacugccucaagaauggguacaacauuuuuaucaagaagcagcaccagcacaaucugauguagcucuauuaagauucguaaacccagauacaggacguguauuauucgaaugcaaauuacacaaaaguggauauguaacuguagcacacacaggccaacaugaucuuguaauaccaccaaauggauauuucagauucgauuccuggguuaaucaauuuuauacccuagcuccuauggguaauggcacaggacgaagaagagcacuauaa

SEQ ID NO: 32034 - RNA, 1623 nt, Artificial Sequence
  derived and/or modified sequence opt6 from VP1__Norovirus__BAJ13858
augaaaauggcaucaaaugaugcaaacccaucugauggauccgccgcaaacuuaguaccagaaguuaauaacgaaguuauggcacuagaaccaguagucggagcagcaauagcagcccccguagcaggacaacaaaauguuaucgacccauggauaagaaauaacuuuguacaagcaccuggaggugaauuuacaguuucaccaagaaaugccccuggagaaauauuauggucugccccacucggaccagaucuaaauccauaccuaagucacuuagcacgcauguacaacgguuacgcaggagguuucgaaguacaaguaauauuagcaggaaacgcuuuuaccgcuggaaaaauaauauuugcagcaguaccaccaaacuuuccaacugaaggucuaucuccaucacaaguaacaauguucccucacauaauagucgacguacgacaacuagaaccaguacuaauuccacucccagacguuagaaacaauuuuuaucacuauaaucaaucaaaugauucuacuauaaaauuaauagccaugcucuacacacccuuaagagcaaauaaugccggagaagauguauucacaguaucaugucgaguccuaaccagaccaucaccugauuuugacuucauuuuccuaguuccaccaacuguagaaucccguacaaaaccauuuacaguaccuauacuaacagucgaagaaaugacaaacaguagauuuccaauuccauuagaaaaacuauuuacaggaccuucaucagcauuugucguacaaccacaaaacggcagauguacuacagacggaguauuacuagguacaacacaacuaucaccuguaaauauauguacauuuagaggugacguaacacacauugcaggaucacgcaauuauacaaugaauuuagcaucauuaaauuggaauaauuaugacccaacagaagaaauccccgcacccuuaggaaccccagacuuugucggcaaaauacaaggaguccucacacaaacaacaaaaggagaugguucaacaagaggucauaaagcaacaguauacacaggaucagcaccauuuaccccaaaauuaggcucaguucaauuuagcacagacacagaaaacgauuucgaaacacaucaaaauaccaaauucacuccuguaggaguuauacaagacggaucaacuacacauagaaacgaaccacaacaauggguacuaccuucuuauucaggucgaaacguccauaacguacauuuagcaccugcaguagccccaacauuuccaggcgaacaauuacuuuuuuucagaucaacaaugcccgguuguucaggauacccaaauauggaucuagauugccuauuaccucaagaguggguacaacacuucuaccaagaagcagccccagcacaguccgauguugcauuacuacgauucgucaauccugacaccggaagaguauuauucgaaugcaaacuacauaaaucaggauauguaacaguagcccacacaggacaacaugacuuaguuauuccaccaaauggcuauuucagauuugacucuuggguuaaucaauucuacacauuagcaccuauggguaauggaacaggacgaagaagagcacuauaa

SEQ ID NO: 32035 - RNA, 1623 nt, Artificial Sequence
  derived and/or modified sequence opt6 from VP1__Norovirus__BAJ13861
augaaaaugaggucaagugaugcuaauccuucagauggauccacagcuaacuuaguaccagaagucaauaaugaaguuauggcacuagaaccaguaguaggagccgcaauagcagcaccaguagcaggacaacaaaacguaaucgacccauggauuagaaauaauuucguacaagcaccaggaggcgaauuuacaguaucaccaagaaaugccccaggagaaauucuauggucugcaccuuuaggaccugacuuaaauccauaucuaucacaucuagccagaauguauaauggauacgcaggagguuucgaaguucaaguaauacuagccgguaaugcauuuacagcaggcaaaauuauauucgcagcuguaccacccaauuuuccaacagaaggucuaucucccucacaaguaaccauguuuccacacauaauuguagacguuagacaauuagaaccaguucuaauaccacuuccugacguacgaaauaacuucuaucauuauaaccaaucaaaugacccaacaauaaaauuaauugcaaugcuauauacaccauuaagagcaaacaacgcaggagaugacguauuuacaggaucaugccgugucuuaacuagaccaucaccugauuucgauuucauauuuuuaguaccucccaccguugaaucaagaacaaaaccauuuucgguaucauucuuuaccggugaagaaaugacaaacucaagauuuccaauacccuuagagaaacuauucacaggucccucaucagccuucguuguacaaccacaaaauggucgauguacaacugauggaguacuucuaggaacaacacaauuaucaccaguaaauauauguacuuuccgaggagacgucacgcacauaacaggaucuagaaacuauaccaugaaccuagcaacacaaaacuggaacucauaugauccaacagaagaaauuccagcaccauuaggaaccccagacuuuguaggaaaaauacaaggaguacuuacacaaaccacuagagcugacggcaguacacgcggacacaaagcuacaguuuacacuggaucagccgacuucgcaccaaaacuaggaagaguacaauuugcuacagacacagauaaugauuucgaugcaaaucaaaacacuaaauuuacuccuguaggaguuauacaagacggagacacugcacauagaaaugaaccucaacaauggguacuuccuucauauucaggcagaaauucacauaauguacacuuagcaccugcaguagcacccacauuucccggugaacaacuccuauuuuuuagaucaacaaugccaggaugcucaggcuauccaaauauggaucucgacugucuuuuaccacaggaauggguacaauauuucuaucaagaagcugcaccagcucaaucagacguagccuuauuaagauucguaaacccagacacaggaagaguauuauucgaauguaaacuacacaaauccggcuacguuaccguagcacauacuggccaacacgauuuaguaauuccaccaaacgguuacuuuagauuugauucaugggucaaccaguucuauacucuugcaccaaugggcaacggaaccggucguagacgagcuuuauaa

SEQ ID NO: 32036 - RNA, 1623 nt, Artificial Sequence
  derived and/or modified sequence opt6 from VP1__Norovirus__BAJ13864
augaaaauggcuucaaaugacgcuaacccaucagauggaucagccgcaaaucuaguaccagaaguaaacaaugaaguaauggcauuagaacccguagucggagcagcaaucgcagcaccaguagcuggacaacaaaauguaaucgacccauggauaagaaacaauuuuguacaagcaccaggcggugaauuuacagucucaccccgcaacgcaccuggagaaauacuauggucugcaccacuaggacccgaucuuaauccauaucuaagccacuuagccagaauguacaauggauacgcagguggcuucgaaguacaaguuauccuagcaggaaacgcuuuuacagcaggaaaaauaaucuuugccgcaguaccuccaaauuucccaacagaaggacucucaccuucacaaguaacaauguucccccauauaauaguugacguaagacaacuagaaccaguacuaauaccacuaccagauguacgcaauaauuuuuaucacuauaaucaaucaaaugacaguacaauaaaacucaucgcaaugcuauacacaccacuccgagcaaacaaugcaggagaagaugucuuuacaguaucuugccgaguacucacuagaccaagcccugacuucgauuuuauauuucuaguaccuccaaccguagaaucuagaacaaaaccauucacaguaccaauauuaacaguugaagaaaugacuaacagucgauucccaauacccuuagaaaaacuauucacaggaccauccagcgcauucguaguccaaccucaaaacggaagauguacaacagacggaguacuacuuggaacaacacaacuuucaccaguaaauauauguacauuucgaggcgauguuacacacauagcuggauccagaaauuacaccaugaaccuugcaucacuuaacuggaacaauuacgauccaaccgaagaaauuccugcaccucuuggcaccccugauuuuguaggcaaaauacaaggaguacuaacucaaacaacuaaaggugacggcucaacaagaggacacaaagccacaguauacaccggcucagcaccauuuacaccaaaauuaggauccguacaauuuucaacagauaccgaaaacgauuucgaaacacaucaaaacacuaaauuuacacccguaggaguaauacaagauggaaguacuacacaccguaaugaaccacaacaauggguucuaccaucauauucaggacguaauguacauaauguucaucucgcaccagcaguagcaccaacauucccaggagaacaauuauuauuuuuuagaucaacaaugcccggcugcuccggcuaccccaauauggacuuagauugccuauuaccacaagaauggguucaacauuucuaucaagaagcugccccagcacaaucagacguagcacuacuucgauucguaaaccccgacacaggcagaguauuauucgaaugcaaacuacauaaaucaggauauguuacaguagcacauacuggacaacacgaucuaguaauaccaccaaauggauacuuccgauucgauucauggguaaaccaauuuuacacacuagccccaaugggcaauggaacaggacgaagacgugcacuuuaa

SEQ ID NO: 32037 - RNA, 1623 nt, Artificial Sequence
  derived and/or modified sequence opt6 from VP1__Norovirus__BAJ13867
augaaaauggcaucaucagacgcaaauccaagugauggcaguacagcaaaucuagucccagaaguaaauaaugaaguaauggcacuagaacccguaguaggagcagccauagcagcacccgucgcuggacaacaaaauguaaucgauccauggauaagaaauaacuuuguccaagcaccagggggagaauuuacaguaucaccccgaaaugcaccaggagaaauacuauggagugcaccgcuaggaccagaccuaaauccauacuuaucacaucuugcccgcauguauaauggauaugcaggaggauuugaaguucaaguaauucucgcuggaaaugcauuuacagcaggaaaaaucauauucgcugcaguuccucccaauuucccuacagaaggacuaagcccaagucaaguaacaauguucccucauauaauaguagauguaagacaauuagaaccaguacuaauuccacuaccagauguacgaaacaauuucuaucauuacaaucaaucaaaugauccaacaauaaaauuaauugcaauguuauauacuccacuacgagcuaauaaugcaggagacgacgucuuuacuguuucauguagaguauuaacuagaccaucaccagauuuugacuguauauuagauuuaccuccaacaguugaaucaagaaccaaaccuuucagcguaccaauauuaacaguugaagaaaugacaaauucacgauuuccaauuccacuugaaaaauuauuuacaggacccucaucagcauucguaguacaaccacaaaacggaagauguaccacagacggaguacuacucgguacaacacaacuaucacccguuaauauaugcacauuuagaggcgauguaacacauauaacaggaucaagaaacuacacaaugaaccucgcaacacaaaauuggaacucuuacgacccuacagaagaaauucccgcaccucuaggaacuccagacuucguagggaaaauacaaggagucuuaacacaaacaaccagagcagauggaucaacacgaggacacaaagcaacaguauauacaggaucagcugauuucgccccaaaauuaggaagaguacaauuugcaacugauacugacaaugacuuugaugcuaaucaaaacaccaaauucacaccaguagguguaauacaagacggagacacagcucaccgaaacgaaccucaacaauggguuuuacccucauauucaggucgaaauucccauaauguacauuuagcaccagcaguggcaccaacauuuccaggagaacaauuauuauuuuuuagaucuacaaugccaggauguucaggauauccaaacauggauuuagauugucuacuaccacaagaauggguucaauacuuuuaucaagaagcagcaccagcccaaucugacguugcauuauuaagauucguaaacccagacacuggcagaguccuauucgaaugcaaacuacauaaaucuggauauguaaccguugcacacacaggacaacaugaucuaguaauaccaccaaaugguuacuuuagauuugacucuuggguaaaccaauucuacacacuagccccaaugggaaauggcacuggaagacgcagagcauuauaa

SEQ ID NO: 32038 - RNA, 1623 nt, Artificial Sequence
  derived and/or modified sequence opt6 from VP1__Norovirus__BAJ13873
augaaaauggcuucauccgaugcaaaucccucugacggaucagcagcaaaucuaguaccagaaguaaauaacgaaguaauggcucucgaaccaguugucggagcagcuauugcagcaccaguagcaggacaacaaaauguuauugacccauggauaagaaauaauuuuguacaagccccuggaggagaauucacaguaucaccacgaaacgcaccuggagaaauacuauggucagccccucuuggaccugacuuaaauccauaccuuagucaucuagcaagaauguauaacggauacgcaggaggauuugaaguccaaguaauacuagcagguaaugcauuuacugcaggcaaaauaauauucgcagcaguaccaccaaauuuuccaaccgaaggccuaucuccaucccaagucacgauguucccacauauaauaguagacgucagacaauuagaacccguccuuaucccacuaccugaugucagaaacaacuucuaccacuauaaucaaucaaacgacucaacaauaaaauuaauagccaugcuauauacuccauuaagagcaaauaaugcaggugaaguuguauuuacaguauccuguagagucuuaacaagaccaucaccagauuuugacuucauaugcuuaguaccucccacaguagaaucuagaacaaaaccauuuaccguaccuauuuuaacaguagaagaaaugaccaacucccgauucccaauaccacucgaaaaacucuuuacagguccaaguucagcuuucguaguacaaccgcaaaacggcagauguacaacagacggaguucuacuuggaacaacacaauuaucacccguuaacaucugcacauucagaggagauguuacacauauugcuggaagcagaaacuauacaaugaauuuggccucacuaaacuggaacaacuaugacccaacagaagaaauaccagcuccuuuaggaacaccagacuuuguagguaaaauacaagguguccuaacucaaacuacaaaaggagacggaucuacaagaggccauaaagccacaguauauacuggaucagccccuuuuaccccaaaauuaggcagcguacaauuuucaaccgauacagaaaacgacuuugaaacacaucaaaauacaaaauuuaccccuguaggaguaauccaagaugguggaacuacacauagaaacgaaccucaacaauggguucuaccaucauacucagguaggaacguacccaauguacaucuugcaccugcaguagcuccaaccuuuccaggagaacaacuauuauuuuuuagaucuacuaugccaggaugcucuggcuauccuaauauggacuuagauuguuuacuaccacaagaauggguacaacauuuuuaccaggaagcagccccagcucaguccgauguagcauuacuuagguuuguaaacccagacacaggacgaguacuauuugaauguaaauuacauaaacccggauauguuacuguggcucauacaggacaacacgaucucguaauaccaucaaacggauacuucagauucgauucuuggguaaaucaauuuuacaccuuagcuccaaugggaaauggaacaggaagaagaagagcauuauaa

SEQ ID NO: 32039 - RNA, 1623 nt, Artificial Sequence
  derived and/or modified sequence opt6 from VP1__Norovirus__BAJ13876
augaaaauggcaucuaaugaugccaaccccucagacggaagcgcagcaaacuuaguaccagaaguaaauaacgaaguaauggcccuagaaccaguaguaggagcagcuaucgcagcaccuguagccggacaacaaaacgucauagacccauggauacgcaauaacuuuguucaagcaccagguggagaauuuacuguaucaccaagaaaugcaccuggagaaauauuauggucagcaccacuuggaccugaucuuaauccauauuuaucacauuuagcaagaauguauaacgguuaugcaggaggauuugaaguccaaguaauacuagcuggcaacgcauuuacagcaggaaaaauaaucuuugcagcaguaccaccaaauuucccaacagaagguuuaucucccucccaaguuacaauguucccccauauaauaguagauguuagacaauuagaaccaguacuaauaccauuaccagaugucagaaacaauuucuaucauuacaaucaaucuaaugacucuacaauuaaauuaauagcaauguuauacacaccauuacgagcaaauaacgccggagaagauguauucacagucucauguagaguauuaaccagaccaucaccagacuucgauuuuauauuccuaguacccccaacuguagaaucacgaacaaaaccauucacagucccaauacuaacuguagaagaaaugaccaacucuagauuuccuauuccacuagaaaaacuguuuacuggacccucaggagcuuuuguaguacaaccacaaaacgguagaugcacaacagacggaguacuucuaggcacuacucaauuaucaccugucaacauuuguacauucagaggagaugucacccacauagcaggaucacguaauuauacaaugaaccucgcugcacuuaauuggaacaauuacgacccaaccgaagaaauaccugcaccauuaggaacaccagacuuuguaggaaaaauacaaggaguauuaacccaaaccacaaaaggagacggaagcacaagaggacauaaagcaacagucuauacaggaucugcagacuuuacaccuaaauuaggaucaguacaauucucaacagacaccgaaaacgauuuugaaacacaccaaaacaccaaauucacaccuguaggaguaauacaagaugguuccacaacucacaggaaugaaccacaacaauggguacuaccauccuacucaggccgaaauguacacaacguacacuuagcaccugcaguagcaccuacauuuccuggagaacaacuacucuucuuuagauccacuaugccaggaugcucuggauauccuaauauggaucuagauugucuucuaccucaagaauggguucaacacuuuuaccaagaagcagcaccagcucaauccgauguagcacuacucagauuuguaaacccagacacaggcagaguauuauucgaauguaaacuacauaaauccggauauguaacaguagcacauacuggacaacacgaucuaguuauaccaccaaauggauacuuccgauuugauucauggguuaaccaauuuuauacacuagcccccaugggaaacggaacuggcagaagaagggccuuguaa

SEQ ID NO: 32040 - RNA, 1623 nt, Artificial Sequence
  derived and/or modified sequence opt6 from VP1__Norovirus__BAJ13879
augaaaauggcaucuaaugacgcuaacccaucugacggcucagccgcaaacuuaguaccagaaguaaauaaugaaguuauggcccuagaacccguaguaggagcagcaauagccgcaccaguagcaggacaacaaaacguaauagacccauggauaagaaauaauuuuguacaagcaccaggcggagaauuuacaguaagcccaagaaaugcgccuggagaaauacuauggucagcaccauuaggaccagaucugaacccauaccuuucacauuuagcaagaauguauaacgguuacgccggaggauucgaaguacaagucauauuagcaggaaaugcauuuacagccgguaaaauaauauucgcagccguccccccuaacuuuccaacugaaggucuaucaccaucacaaguaacaauguuuccacacauaauaguugacguuagacaacuagaaccugucuuaauaccguuaccugauguccgaaauaauuucuaccacuauaaccaaucaaaugauucaacaauuaaacuuauagcaauguuauacacaccuuuaagagcaaauaaugcaggagaagacguauuuaccguuucaugcagaguauuaacuagacccucuccagacuuugacuuuauauucuuagucccaccaacaguagaaucuagaacuaaaccauuuaccguacccauacuuacaguagaagaaaugacaaauucaagauucccaauaccacuagaaaaacucuuuacaggcccauccuccgcauuuguuguacaaccacaaaacggccguuguacaaccgauggaguacuacuugguacaacccaauuaaguccaguaaauaucuguacauuuagaggagauguaacucacaucgccggaucacgcaauuacaccauggacuuagcuucacuaaauuggaauaacuacgacccuacugaagaaaucccagcaccacuaggcaccccugauuuuguuggaaaaauacaagguguacuaacacaaacaacaaaaggagauggaucaaccagaggucacaaagcaacaguauacacaggaucagcaccauuuaccccaaaauuaggcucuguacaauucucgacagacacagaaaacgacuuugaaacacaccaaaacacaaaauuuacuccaguuggaguuauacaagacggaggaacaacccauagaaaugaaccucaacaauggguuuuaccaucuuacucuggucgaaauguaccaaacguacaccuagcaccugcaguagcacccacauuuccuggugaacaauuauuauucuuuagaaguacaaugccugguugcucaggcuauccaaauauggaucuagacuguuuacuaccacaggaauggguccaacauuucuaucaagaagcagcaccagcucaaucagauguugcccucuuacgcuucguuaacccugauaccggacguguacuuuucgaauguaaauuacauaaaucaggauauguaaccguagcucacacuggacaacacgauuuagucauaccaccuaauggauauuuccgauuugauucauggguaaaucaauuuuacacauuagcacccauggguaauggaacaggcagaagaagagcauuauaa

SEQ ID NO: 32041 - RNA, 1623 nt, Artificial Sequence
  derived and/or modified sequence opt6 from VP1__Norovirus__BAJ13882
augaaaauggcaucaaaugaugcuaacccaucagauggaucagcagcaaauuuaguaccugaaguaaauaacgaaguaauggcccuagaaccaguaguuggagcugcaauagcagcaccuguagccggacaaacaaauguaauagauccuuggaucagaaacaauuuuguacaggcacccggcggugaauuuacagucucaccuagaaaugccccaggagaaauauuauggucagcaccacucggaccagacuuaaacccauaccuaagucaccuagcaagaauguacaauggcuaugcugguggcuucgaaguacaaguaauauuagcaggaaacgcauucaccgcaggaaaaauaauauuugcagcaguuccaccaaacuuuccaacagaaggacuaucuccaagucaagucacuauguucccacauauaauaguugauguacgucaacuagaacccguucuaauaccauuaccagauguaagaaacaauuucuaucauuacaaccaaaguaaugacucaacaauaaaauuaauagcuauguuauauacaccuuuaagagcuaacaaugcaggcgaagacguauuuacgguaucaugucgaguuuuaacaagaccaagucccgacuuugauuuuaucuuuuuaguaccaccaacaguugaaucaagaacaaaaccauuuacaguaccaauauuaacaguagaagaaaugacaaacaguagauuuccaauaccauuagaaaaauuauuuaccggaccaucuggcgcauuuguuguacaaccacaaaacggcagaugcacaacagacgguguuuuacuaggcacaacacaacuauccccaguaaacauauguacauucagaggagauguaacacauauagcaggaucacgaaauuacacuaugaaccuagccucccuaaauuggaacaacuaugauccaacugaagaaauaccagcuccacuugguaccccagacuucguuggaaaaauccaaggaguacuaacacaaaccacaaaaggcgauggaucaacuagaggacacaaagcaacaguauacacaggaucagcuccauuuacaccaaaacuaggaucaguucaauucucaacagauaccgaaaaugacuuugaaacacaucaaaauacaaaauuuacaccagucggaguaauacaagauggaucaaccacacaccgaaacgaaccccaacaauggguacuaccuucauacaguggaagaaauguacauaacguucacuuagcuccagccguagcaccaacauucccaggagaacaauuacuauucuuuagaucuaccaugccaggaugcucaggauacccaaauauggaucuagauuguuuauuaccucaagaauggguacaacacuuuuaucaagaagcagcuccugcccaaucagacgucgcacucuuaagauucguaaacccagacacaggaagagucuuauucgaaugcaaauuacacaaaucaggauauguaacaguagcacacaccggacaacacgaucucguaauaccaccaaacggauauuuccgauucgacucauggguaaaccaauuuuauacucuagcaccaaugggaaaugguaccgguagacgacgagcccuuuaa

SEQ ID NO: 32042 - RNA, 1623 nt, Artificial Sequence
  derived and/or modified sequence opt6 from VP1__Norovirus__BAJ13885
augaaaauggcaucauccgaugcaaacccaucagacggaucaacagcaaacuuaguaccagaaguaaauaaugaagucauggcacuagaacccguuguaggcgcagcaauagcagcuccagucgcaggacaacaaaauguaauagaccccuggauacgaaauaacuuuguacaagcgcccggaggagaauucacaguuucaccaagaaacgcaccuggagaaauacuuuggucugccccacuaggaccugauuuaaacccauaucuaucacacuuagcccgcauguacaaugguuacgcaggaggauucgaaguucaaguuauauuagcaggaaaugcuuucacagcaggaaaaaucauauuugcagcuguuccaccaaauuuuccaacagaaggauuauccccaucucaaguaacaauguuuccacauauaauaguugacguuagacaacuagaaccaguacucauaccauuaccagauguacgaaacaauuucuaccacuauaaccaauccaacgacccaacaauaaaauuaauagcaauguuauauacaccuuuaagggcaaauaaugccggagaugauguauuuacaguaucaugucgaguacuaacacgaccuucaccagacuuugauuuuauauuucuaguaccaccaacaguagagucaagaacuaaacccuuuucaguaccuauacucacaguagaagaaaugacaaacucucgauucccuauaccauuagaaaaacuauuuacaggcccaucuucugcauucguaguacaaccacaaaacggacgaugcacaaccgaugguguacuacucggaacaacacaauuauccccaguaaauauauguaccuuuagaggugacguuacacacauaacuggaucaagaaauuacacaaugaaucuugccacccaaaauuggaauuccuacgauccgacagaagaaauaccagcuccauuagguacaccagacuucguuggcaaaauucaaggaguauuaacucaaacaacuagagccgacggaucaaccagaggucacaaagcuaccguauauacaggaucagcagauuuugccccaaaauuaggaagaguacaauucgcuacugauacggacaacgauuuugacgcaaaucaaaacacaaaauuuacaccaguaggggucauacaagauggaaauacagcacacagaaaugaaccacaacaauggguccuaccaucauauucaggaagaaauucacacaacguacauuuagccccagcaguagcaccaacauucccuggagaacaauuacuauucuucaggucaacaaugccaggcuguuccggauaccccaauauggaucuagauugcuuauuaccacaagaauggguucaauauuucuaucaagaagcagcaccagcacaaucagacguagcacuucuaagauucgucaauccagacacaggccgaguccuauucgaauguaaacuacauaaaucuggcuauguuacaguagcacacacaggacaacaugaucuaguaauaccaccaaauggauauuuucgcuucgauucauggguaaaccaauucuauacacucgcaccgaugggaaacggaacaggacgaagaagagcacuauaa

SEQ ID NO: 32043 - RNA, 1623 nt, Artificial Sequence
  derived and/or modified sequence opt6 from VP1__Norovirus__BAJ13891
augaaaauggcaucaucagacgcuaacccaagugacggcucuacagcaaauuuaguaccagaaguaaacaaugaaguaauggcacucgaaccaguaguaggagcugcaauagcagcaccaguagcaggucaacaaaaugucauagacccauggauuagaaauaauuuuguacaagcaccaggaggagaauuuacaguaagcccaagaaaugcuccuggagaaauccuuuggucagcaccauuaggaccagauuuaaacccauaucuaucacauuuagcaagaauguacaauggauacgcaggaggauucgaaguccaaguuauacucgcaggaaaugcauucacagcaggcaaaauaauuuucgcagccguacccccaaauuuuccaacagaaggauuaucaccaucacaagucacaauguuuccacacauaauaguagacguaagacaacuagaacccguacuaauaccacuaccugacguuagaaacaauuuuuaccauuauaaccaauccaacgacccaacaauaaaacuaaucgcaaugcuuuauaccccauuaagagcaaacaacgcaggcgacgauguauucacagucagcuguagaguauuaaccaggccuucaccagacuuugauuuuauuuuuuuaguacccccaacuguagcaucacgaacuaaaccauucucuguaccuaguguaacaguugaagaaaugacaaacagcagauuuccaauaccacucgaaaaauuauuuacagguccauccagcgcauucguuguacagccacaaaacggaagauguacgacagacgguguucuacuaggaacaacacaacuuucuccaguaaauauauguacauuccgcggagacguuacacacauaacaggaucuagaaauuauaccaugaauuuagcuacccaaaauuggaauucuuacgaucccacugaagaaauaccugcaccccucggaacuccagauuuuguaggcaaaauacaaggaguacuaacacaaacaacaagagcagacgggaguacacgaggacauaaagcaacaguauauacaggaucagcagauuuugcaccaaaauuaggaagaguacaauucgccacagauacagacaacgauuuugaugcaaaccaaaauaccaaauuuacacccguaggaguaauacaagacggcgacacagcacaucgaaaugaaccacaacaauggguuuuaccaucauacaguggaagaaauucacauaacguacacuuagccccaaccguagcuccaacauucccaggagaacaacuauuauucuuucgaaguacaaugccaggaugcucuggauauccaaauauggaucuagacugcuuacuaccacaagaauggguacaauacuuuuaccaagaagccgcaccugcucaaucagacguagcacucuuaagauucguaaauccugauacaggaagaguauuauucgaaugcaaacuacauaaaucaggauacguaacuguugcacacacaggacaacacgacuuagucauuccacccaauggauauuuuagauuugauuccuggguaaaccaauuuuacacacuagcaccuaugggaaacggaacaggaagaagaagagcauuauaa

SEQ ID NO: 32044 - RNA, 1623 nt, Artificial Sequence
  derived and/or modified sequence opt6 from VP1__Norovirus__BAJ13894
augaaaauggcaucaaacgacgcaaauccaucagaugggucaacagcaaauuuagucccagaaguuaacaaugaaguuauggcacucgaaccaguuguuggagcagccauagcagcaccaguagcaggucaacaaaaugucauugacccauggauaagaaauaacuuuguacaagccccaggaggagaauuuacaguaucaccacaaaacgcacccuccgaaauauuauggucugcaccccuuggacccgaucuuaacccauauuuaucccaccuagcuagaauguauaacgguuaugcaggaggauucgaaguacaaguaauucucgcaggaaaugcauuuacagcaggaaaaauaauauuugcugcaguaccaccaaacuucccaaccgaaggauuaucacccucacaaguaacaauguuuccacauauaauaguugacguacgacaacuagaaccaguauuaauacccuuaccagauguaagaaauaauuuuuaucacuauaaccaaucaaaugaccccacaauaaaacuaauagccaugcuuuauacuccacuccgagcuaacaacgcgggagacgauguauuuacaguuucaugcagaguauuaacacgacccucaccagacuuugacuuuauauuuuuaguaccaccaacaguagaaucacgaacuaaacccuuuacagucccaaucuuaacaguagaagagaugacaaacucuagauuuccaauaccuuuagaaagauuauauacaggacccucaucagcauucgucguacaaccacaaaacggaagauguaccacagacggaguccuccuaggaacuacacaauuaagcgcaguaaauauuuguacauuucgcggagacguaacucauauagcaggaucaagaaauuauaccaugaauuuagcuucacaaaauuggaauaauuacgauccuacugaagaaauaccagcuccucucgguacaccagacuucguaggaaaaauacaagguauguuaacucaaacaacaagaucagauggauccacacgaggccauaaagcaacaguacuaaccggaucugcagacuuugcaccaaaauuaggcagaguucaauuugcaacagacacugauaaugauuucgaaagcggacaaaacacaaaauuuacuccugucggcguaauucaagacggaucaacaacucauagaaaugagccacaacaauggguauuaccaaacuacucuggaagaacaggacauaauguacacuuagcaccugcuguagcacccaccuauccaggagaacaacuacuuuucuucagaucuacaaugccaggauguucaggcuacccaaauauggauuuagauugucuacuaccacaagaauggguucaacauuuuuaccaagaagcagcacccgcucaaucugauguagcauuacuaagauucguaaacccagacacaggaagaguuuuauuugaaugcaaacuacauaaaucaggguauguaacugucgcacauaccggacaacaugauuuaguaaucccaccaaauggcuacuucagauucgacuccuggguaaaucaauuuuauacucuagcucccaugggaaacgguacaggaagaagaagagcaguauaa

SEQ ID NO: 32045 - RNA, 1623 nt, Artificial Sequence
  derived and/or modified sequence opt6 from VP1__Norovirus__BAJ13897
augaaaauggcaucaagcgaugcgaauccuucagauggcucaaccgcaaaucuugucccagaaguaaacaacgaaguaauggcauuagaaccaguuguuggugcagcuauagcagccccagucgcaggacaacaaaacgucauagaccccuggauaagaaauaacuucguacaagcaccuggcggcgaauuuacaguauccccaagaaaugccccaggagaaauacuauggucugcgccacuggggccagaucuuaauccauaucuaucacauuuagcuagaauguauaauggauacgcaggcgguuuugaaguacaaguaauauuagcaggcaaugcauuuacagcaggaaaaauaauauucgcagcaguaccaccuaauuucccaacagaagguuuaucuccaucccaaguaacaauguuuccucauauaauaguagaugucagacaauuagaaccaguauuaauuccuuuaccagauguaagaaacaauuucuaucauuacaaccaaucaaaugauccaaccauaaaauuaauagccaugcuauacacaccacuacgagcaaacaaugcuggagacgauguauucaccguaucaugcagaguucuaacacgaccuuccccagacuuugacuuuauauuccuuguacccccuacaguugaaaguagaacuaaaccauucucgguaccaauauuaacaguagaagaaaugacuaauucacgauuuccaauuccacuagaaaaacuauucacugguccaucaucagcauucguaguacaaccacaaaacggaagauguacaaccgauggaguacuuuuagguacaacucaacuaucuccaguuaauauauguacauuuagaggugacguaacccacauaacuggcucaagaaauuauacuaugaauuuagcaacgcaaaauuggaauucauacgaucccacugaagaaauuccagcacccuuaggaacaccagauuuuguaggaaaaauacaaggaguauuaacacaaacuacaagagcagacggcucaacccgaggucauaaagcaacaguauauacugguucagccgacuucgcaccuaaacuaggaagaguacaauuugcaaccgauacugauaacgacuucgaugcaaaucaaaauaccaaauucacaccaguagguguaauacaagauggagacacagcacauaggaacgaaccucaacaauggguacuaccaaguuauucaggacgaaauagucauaacguucaccuugccccuacaguugcuccaacauucccaggugaacaacuuuuauuuuuuagaucaacaaugccaggauguucaggauaucccaacauggauuuagauugucuacuaccacaagaauggguucaauauuuuuaucaagaagcagcaccagcacaaucugacguagcacuccuucgauuuguaaacccagacacaggaagaguucuauuugaauguaaacuacauaaaucaggauauguuacaguagcucauacaggacaacacgaucuuguaauaccaccaaauggauacuucagauucgauaguuggguaaaucaauucuacacuuuagcuccaauggguaauggcacuggaagaagacgagccuuauaa

SEQ ID NO: 32046 - RNA, 1623 nt, Artificial Sequence
  derived and/or modified sequence opt6 from VP1__Norovirus__BAJ13900
augaaaauggcuucaaaugacgcaaacccaucagacggaucaacugcaaaucuaguuccagaaguaaauaaugaaguuauggcacuagaaccaguuguaggagcagcaauagcagcaccaguagcaggacaacaaaauguuauugacccauggauacguaacaacuucguucaagcuccaggaggcgaauuuacaguaucccccagaaacgccccaggagaaauauuauggucagcaccuuuaggaccagacuuaaauccuuaccuuucacacuuagcaagaauguauaauggauaugcaggaggauucgaaguacaaguaauucuagcaggaaaugccuuuacagcaggaaaaauaaucuucgcugcaguacccccaaauuuuccuacugaaggacuaucaccaucucaaguaacaauguuuccacauauuauaguagauguuagacaauuagaaccuguuuuaauaccauuaccagacguuagaaacaauuuuuaucauuauaaccaaucuaaugauccuacaauuaaacuaauugcaaugcuauacacuccuuuaagagcaaacaacgccggagacgacguauuuaccguaagcugcagaguucucacaagaccaucaccagacuuugacuuuauauuuuuaguuccaccaacuguugaaucaagaacaaaacccuucacuguaccaauauuaacaguugaagaaaugacuaauuccagauucccaauuccuuuagaacgucuuuauacaggucccagcucagcauucguuguucaaccacaaaacggaagauguacaacagacggcguauuacucggaacaacacaacuaucagcuguaaacauaugcacauuuagaggagacguaacacauauagcaggaucacgcaauuauacuaugaauuuagcaucacaaaauuggaacaacuacgauccaacagaagaaauaccagcaccacuaggaacucccgacuuuguaggaaaaauacaaggaaugcuuacacaaacaacgagaagugauggaucaacacgaggucacaaagcuacaguucuaacaggaucagcugauuucgcaccaaaacuaggacguguacaauucgccacugauacggacaacgauuucgaaucaggucaaaauacaaaauucacaccugucggcguaauacaagacggcucaaccacacauagaaaugaaccucaacaauggguauuaccaaauuauuccggaagaacuggucauaacguacaccuagcaccagcuguagcaccaacauacccaggagaacaauuauuauuuuuucgaucaacaaugccaggauguucaggauauccaaauauggauuuagauugucuucuaccacaagaauggguacaacauuucuaucaagaagcagcaccagcacaaagugacgucgcacuacuaagauucguaaauccagauacaggaagaguacuauucgaauguaaacuacauaaaucaggauacguuacuguagcacacacaggccaacacgaccuuguaauaccuccaaacggauacuucagauucgauucauggguaaaucaauucuauacauuagcuccaaugggaaacgguacuggccgaagaagagcaguauaa

SEQ ID NO: 32047 - RNA, 1623 nt, Artificial Sequence
  derived and/or modified sequence opt6 from VP1__Norovirus__BAJ13903
augaaaauggcaucaaaugaugcuaauccuucagauggaucugcagcaaauuuaguaccagaaguaaacaacgaaguaauggcccuagaaccuguuguaggagcugcuauagcugcaccuguagcuggacaacaaaacguuauagacccauggauucgaaauaacuucguacaagccccaggaggagaauuuacuguuucacccagaaaugcaccuggugaaauacuauggucugcaccauuaggacccgaucucaauccauaucuaagccaucuagcaagaauguacaacggauacgccggaggauuugaaguccaaguaauacuggcaggaaacgcuuucacagccggaaaaauaauauuugcugccguaccuccaaacuucccaacugagggacucucuccuucccaagucacaauguucccccacauuauuguagaugucagacaacuagaacccguacuaauacccuuaccagauguacgaaauaauuuuuaucacuauaaucaaaguaaugacucuacaauaaaauuaauagcaauguuauacacaccauuaagagcaaacaaugcaggagaagaugucuucacaguaaguugcagaguauuaaccagacccucacccgauuuugacuuuauauuucuaguuccaccaacagucgaaucaagaacaaaaccuuucacuguaccaauacuaacagucgaagaaaugacaaacuccagauuuccaauaccccuugaaaaauuauuuacaggaccuucaggagcauucguaguacagccccaaaauggaagauguacaacugaugguguauuauuaggaacaacacaacucucaccuguaaacauauguacauucagaggagauguaacacauauagcaggaucccgaaacuacacaaugaauuuagcagcauuaaauuggaacaauuaugauccaacagaagaaauuccagcaccacuaggaacucccgacuucguagguaaaauacaggguguacuaacacaaacaacuaaaggcgacgguucgacaagaggacacaaagcuacuguauauacaggauccgcagauuuuacaccaaaauuaggcaguguacaauucucaacagauacugagaacgauuuugaaacacaucaaaauacaaaauuuacuccaguuggaguaauacaagauggcuccacaacucauagaaaugaaccacaacaauggguccuuccaucauacuccggaagaaauguccauaacguacacuuagccccagcaguagcaccgacauuuccaggugaacaauuauuauuuuuuagaucuacaaugccaggauguucuggauaucccaauauggaccuagacugccuacucccacaagaauggguccaacauuucuaucaagaagcagcucccgcacaaucagacguugcacuuuuaagauuuguaaacccagauacaggacgaguacuauucgaaugcaaacuacauaaaucaggauauguaaccguugcacacacaggacaacaugaccuugucauaccaccaaacgguuauuuuagauuugauucauggguaaaucaauuuuacacuuuagcaccaaugggaaaugguacaggaagacgacgagcauuauaa

SEQ ID NO: 32048 - RNA, 1623 nt, Artificial Sequence
  derived and/or modified sequence opt6 from VP1__Norovirus__BAJ13906
augaaaauggcuucuaaugacgcuaacccgucagaugguagcacagcaaaccuuguacccgaaguaaacaacgaaguaauggcauuagaaccaguugucggugcagcaauugcagcacccguagcaggacaacagaauguaauugacccauggauacguaauaacuucgugcaagcuccuggaggagaauucaccguaucuccaagaaaugccccaggagaaauacuaugguccgcaccacuaggaccugaucuaaauccuuauuuaucacaccuagcccgaauguauaacggauacgcaggagguuucgaaguacaaguuauuuuagcaggcaacgcauucacagcagguaaaauaaucuuugcagcagucccacccaacuuccccacugaaggacucucaccaucacaaguaacaauguucccucacauaauaguugauguaagacaauuagaaccaguguuaauaccuuuacccgacguaagaaacaauuucuaucacuauaaccaaagcaaugacccaaccauaaaacuaauagcaaugcucuauacaccauuaagagcuaauaaugcaggugacgauguauuuacaguaucauguagaguacucacacgaccauccccagauuuugacuuuauauuccuaguaccaccaaccguagaaaguagaacaaaaccauucaccgucccaauacuaacaguugaagaaaugacaaacucaagauuuccaauuccccuagaacgauuauacacaggcccaaguucagcauucguaguccagccacaaaauggacgaugcacaacagacggaguccuacuaggaacaacacaacuuucugcaguaaauauauguacauuucgaggugacguaacacauauugcuggaucaagaaauuauacaaugaauuuagcuucacaaaacuggaacaacuacgauccaacagaagagauaccagcaccccuaggaacaccagauuuuguaggcaaaauacaaggcaugcuuacacaaacaacaagaucagacggauccaccagaggacacaaagccacaguacuuacaggaucagcagacuuugcaccuaaauuaggaagaguacaauuugcaaccgauacagauaaugacuuugaaucaggacaaaauacaaaauuuacccccguagguguaauacaagacggaucaacaacccauagaaacgaaccccaacaauggguccuaccaaacuauucuggucgaacuggccauaauguucacuuagcaccagcaguagcuccaacauauccaggcgaacaacuacuauucuuucguucaacaaugcccggaugcucuggauauccaaauauggaccuagauuguuuacuuccacaagaauggguacaacauuuuuaucaagaagccgccccagcacaaucagacguagcccuucuacgauuuguaaacccagacacaggaagaguauuauucgaaugcaaauuacauaaaagcggauauguaaccguugcccauacuggacaacacgaucuaguaauaccaccuaauggauacuuucgauuugauucauggguaaaccaauuuuauacauuagcaccaaugggcaacggaaccggaagacgacgagcaguuuaa

SEQ ID NO: 32049 - RNA, 1623 nt, Artificial Sequence
  derived and/or modified sequence opt6 from VP1__Norovirus__BAJ13909
augaaaauggccaguaaugacgcaaacccuucagauggcagugcugcaaacuuaguaccagaaguaaacaacgaaguaauggcacuagaaccuguaguaggagccgccauagcagcuccagucgcaggacaacaaaauguaauugaccccuggauaagaaacaacuuuguacaagcaccuggaggagaauuuacagucucaccaagaaaugcaccaggagaaauuuuaugguccgcaccacuaggacccgaucuaaauccauaccuaucccaucuagcaaggauguauaacggauacgcaggcggauucgaaguucaaguaauucuagcaggaaacgcauuuacagcugggaaaauaauauucgccgcuguacccccaaacuuuccaaccgaaggacuaucaccaucccaaguaacaauguuuccacauauaauagucgacguuagacaauuagaaccaguacuaauaccauuacccgauguaagaaacaauuuuuaucacuauaaccaauccaaugacagcaccauaaaauuaauugcaaugcuauacacaccauuaagagcuaauaacgcaggcgacgauguuuucaccguaucuuguaggguauuaacuagacccucaccggacuuugauuuuaucuuccucguuccaccaacuguagaaucuagaacaaaaccauuuacuguaccaauacuaacaguagaagaaaugacuaauucccgauuccccauaccauuagaaaaacuguuuacagguccaucaucagcauuuguuguacaaccacaaaauggaagauguaccacagacggaguuuuacucggaacaacucaacuaucaccaguaaauaucuguacuuuuagaggugauguaacccauauaacaggcucaagaaauuauacuaugaaccuagcauccuuaaauuggaauaacuaugaucccacagaagaaauaccagcaccauuaggaacaccagacuuuguaggaaaaauacaaggaguacuaacacaaacaacaaaaggcgacggaucaacccgaggccauaaagcaacuguauauacaggaucagcugauuuuacaccuaaacuuggaucaguacaauucgcaacagacacugaaaacgauuucgaaacacaucaaaauacaaaauucacaccaguaggaguaauacaagauggcggaacuacacauagaaaugaaccacaacaauggguauuaccuucauacucaggaagaaacguacacaacguacacuuagcaccugcaguagccccaaauuuuccaggagaacaauuacuauucuuuagaucaacaaugccagguuguucaggauauccaaacauggaucuagauugcuuauuaccacaagaauggguacaacauuucuaucaagaagcagcucccgcacaauccgauguagcucuucuaagauucguuaauccugauacuggaagaguacuuuuugaauguaaacuacauaaaagcggauauguuacgguagcacacacuggccaacaugaucuaguaauaccaccaaauggauacuucagauuugauucauggguaaaccaauucuauacauuagccccaaugggaaacggaacaggaagaagacgugcauuauaa

SEQ ID NO: 32050 - RNA, 1623 nt, Artificial Sequence
  derived and/or modified sequence opt6 from VP1__Norovirus__BAJ13912
augaaaauggcaucaaacgacgcaaaccccucugauggcucugccgcaaaccucguuccagaaguuaacaaugaaguaauggcauuagaaccaguaguaggagcagcaauugcugcacccgucgcaggucaaacgaacgucauagacccuuggauaagaaauaauuucguucaagcaccaggcggagaauuuacuguaucaccccgaaaugcuccaggcgaaauacuauggucugccccauuagguccagacuuaaauccauaucuaagucacuuagcuagaauguauaacggauacgcagguggauuugaaguacaagucauuuuagcaggaaacgcauuuacagcugguaaaauaaucuucgcagcagucccuccaaauuuuccuacagaaggucuuucaccaucccagguaacuauguuuccucauauuauaguagacguaagacaauuagaacccguacuaauaccacuaccagauguacgaaauaauuuuuaucacuauaaccaaucaaaugauucaacaauaaaguuaaucgcuauguuauacacuccuuuaagagcaaauaaugcaggugaagacguuuuuacaguaucuuguagaguuuuaacuagaccaucaccagauuucgacuucaucuuuuuaguaccaccuacaguagaaucuagaacaaaacccuuuacaguaccaauacuuacaguagaagaaaugacaaauucaagauuuccaauaccacuagaaaaacuauuuacaggucccuccggagcauuugucguacaaccacaaaauggaagauguacaaccgacggaguacuacuuggcacaacacaacuauccccaguaaauauaugcacauucagaggagacguaacacauauagcaggaucacgaaauuauacaaugaaucucgcaucacuaaauuggaauaauuacgacccuacugaagaaauaccugcaccauuaggaacaccagacuuuguaggaaaaauacaaggaguauuaacacaaacaacuaaaggcgacgguucaacacgaggacacaaagccaccguauacacaggaucugcaccuuuuacaccaaaacuaggaucaguacaauucaguaccgauacagaaaacgauuuugaaacacaucaaaauacaaaauuuacaccaguugguguuauccaagacggaucaacuacacaucgaaaugaaccacaacaauggguccuaccaaguuacucaggacguaauguacauaacguccacuuagcaccugcuguagcaccaacauuuccaggugaacaacuacuauuuuuucgaucaacaaugccagguugcucaggauauccuaauauggaucuagauugucuauuaccccaagaauggguccaacacuucuaucaagaagcagcaccagcucaauccgacguagcuuuacuacgauucguaaauccagauacaggaagaguacuauucgaaugcaaacuccauaaaucaggauauguaacaguagcacacacaggacaacaugaucuagucauaccccccaauggauauuuucgauucgauucauggguuaaucaauuuuauacacuagcacccaugggaaacgggacaggaagaagaagagcacuuuaa

SEQ ID NO: 32051 - RNA, 1623 nt, Artificial Sequence
  derived and/or modified sequence opt6 from VP1__Norovirus__BAJ13918
augaaaauggcuucuaaugacgcaaauccuucagauggaucagcagccaaucuaguaccagaaguaaauaacgaaguaauggcacuagaaccaguaguuggcgcagcaauagcugcuccagucgcaggucaacaaaauguaauagauccauggauaagaaauaauuucguacaagcaccaggcggugaauuuacaguaucaccaagaaaugcuccuggcgaaaucuuauggucagcaccccuaggaccagacuuaaaccccuaucucucucaccuagcacgaauguauaacggguacgcaggaggauuugaaguacaagucauucuugcaggaaacgcauucacagcagguaaaaucauauuugcagcaguacccccaaacuucccaacagaaggucuaucaccaagccaaguuacuauguucccccauauuauaguagacguuagacaacuagaaccaguacuaauaccauuaccagacguacgcaauaauuuuuaucacuauaaucaaucuaacgauucaacaauuaaauuaauagcaauguuauauacaccacuuagagcuaacaaugcaggagaugauguauucacugucucauguaggguauuaacaagaccauccccugacuucgauuuuauauuccuuguuccacccaccgucgaaucaagaacaaaaccuuucacaguucccauacuuaccguagaagaaaugacaaacucucgauuuccaauaccauuagaaaaacuauuuacuggaccaucaucagcauucguaguacaaccccaaaacggaagaugcaccacagauggaguauuacuuggaacaacacaauuaucaccagucaauaucuguacuuuuagaggagacguuacccacauugccggaucacguaauuacacuaugaauuuagcaucauuaaacuggaauaacuaugauccaacagaagaaauaccagcaccacuaggaacaccagacuuugucggaaaaauacaaggaguauuaacacaaaccacaaaaggcgacggauccacacguggacacaaagcuacaguauauacaggaucugcagauuuuacuccaaaguuaggaucuguacaauucgguacagacacugaaaaugauuucgaaacccaccaaaauacuaaauucacacccguaggaguaauacaagauggaucaaccacacaucgaaaugaaccacaacaauggguauuaccauccuauucuggucgaaauguacauaauguucaccuagcaccagccguagcaccaaacuuuccuggugaacaauuacuuuucuucagaucaaccaugccaggauguucagguuauccaaauauggaucuagacugccuauuaccacaagaauggguccaacauuuuuaccaagaagccgcacccgcacaaucagacguagcauuacucagauuuguaaacccagacacaggcagaguacuauucgaauguaaauuacauaaauccggauacguaacagucgcccauacuggucaacaugaucuaguaauaccuccaaauggcuauuuccgauuugauuccuggguaaaucaauuuuauacacuagcuccaaugggaaacggaaccggcagaagacgagcccuauaa

SEQ ID NO: 32052 - RNA, 1623 nt, Artificial Sequence
  derived and/or modified sequence opt6 from VP1__Norovirus__BAJ13924
augaaaauggcuaguaaugacgcaucaccauccgauggauccgccgcaaacuuaguaccagaaguaaauaaugaaguuauggcccuagaaccaguaguaggagcugcaaucgcggcaccaguagcaggacaacaaaacguaauagauccauggauacgcaacaacuuuguacaagcaccuggaggagaauuuacgguaaguccucgaaaugcaccuggcgaaauauuauggucugcaccauuaggacccgaucuaaauccauauuuaucucaccuggcucgaauguauaauggauaugcaggaggauuugaaguacaaguaauacuagcuggaaaugcauuuacagcaggaaaaauaauauuugcagcaguaccaccaaacuuuccuacagaaggucuaucaccuagucaagucacaauguuuccacacauaauugucgacguaagacaacuagaaccaguuuuaauaccuuuaccagauguaagaaacaauuuuuaucacuacaaccaaucaaaugacucuacuauaaaacuaauugcaauguuauauacaccccuaagggcuaacaacgccggagaagacguauuuacaguaucaugcagaguuuuaacaagaccuucuccagauuucgauuuuaucuuucuagucccaccuacaguagaaucacgaacaaaaccguuuacagucccaauacuuaccguagaagaaaugacaaauucaagauucccaauaccuuuagaaaaacuauuuacuggaccaucaucugcauucguaguucaaccucaaaauggaagaugcacuacagauggcguauuauuaggaacuacacaauuaucaccaguaaauauauguacauuucgcggagacguuacacauauagcaggaucucgaaauuacacaaugaaucucgccucauuaaacuggaacaacuaugacccaacagaagaaaucccugcaccucuagguacaccagacuuuguaggaaaaauacaaggaguacuaacccaaaccacaaaaggcgaugguucaacacgagggcacaaagcaaccguuuauacaggaucagcaccauuuacaccuaaacuaggaucaguacaauucuccacagauacugaaaacgacuucgaaacucaucaaaauacuaaauucaccccagucggagucauucaagauggcggaaccacacauagaaacgaaccacaacaauggguauuaccauccuauucaggaagaaacguacaaaacguacacuuagccccagcagucgcucccaccuuuccaggagaacaacuacuauucuuucgaucgacuaugccaggauguucaggcuacccuaacauggaucuagauugccuucuaccacaagaauggguacaacauuucuaccaagaagcagcaccagcucaaucugacgucgcacuauuaagauucguaaacccagauacaggaagaguucuauucgaaugcaaauuacauaaaaguggauauguaacagucgcacacacuggacaacaugaucuaguaauaccaccuaacggauacuuccgauucgauucuuggguuaaucaauuuuacacauuagcaccaaugggaaaugggacaggaagacgaagagcccuauaa

SEQ ID NO: 32053 - RNA, 1623 nt, Artificial Sequence
  derived and/or modified sequence opt6 from VP1__Norovirus__BAJ13927
augaaaauggcuaguaaugaugcaaacccaucagauggauccgcugcaaacuuaguaccagaaguuaauaacgaagucauggcacucgagccuguaguaggagcagcaaucgcagccccaguagcaggacaaaccaacguaauagacccuuggauuagaaauaauuuuguucaagcuccuggaggagaauucacaguaucaccaagaaaugcaccuggcgaaauauuauggucugcaccacugggaccagauuuaaauccauaucuaucacaccuagcaaggauguauaaugguuacgcaggagguuucgaaguucaaguaauauuagcaggcaacgcauuuacagccggaaaaauaauauucgcugccguaccaccaaauuuuccaacagaaggacuaucaccuucacaaguaacaauguucccacacauaauuguagacgucagacaauuagaaccaguacuuauaccacuaccagacguacgaaacaauuucuaucauuauaaccaauccaaugacucaacaauaaaauuaauagcaauguuauacacuccacuaagagcaaauaacgcaggcgaagauguauuuacagucucauguagaguuuuaacaagaccaucaccagacuuugacuuuauuuuucuaguacccccaaccguagaaucccguacaaaacccuucacagucccaauacuuacuguagaagaaaugacuaauuccagauucccaauaccacuagaaaaacuauuuaccggaccgucaggcgccuuuguaguacaaccacaaaaugguagauguacaacagacggaguacuacuaggcacaacacaauuaucaccagucaauauauguacauuuagaggcgacguaacacauaucgcuggcucaagaaauuauacuaugaaucucgcaucucuuaauuggaacaauuaugauccuacagaagaaauuccugcaccccuugguacaccagauuuugucggaaaaauacaaggaguauuaacacaaacuacaaaaggagauggaucaacgagaggacauaaagcuacuguauacacuggaggcgccccauuuacaccuaaacuaggcuccgcccaauucuccacagauaccgaaaacgacuucgaaacacaucaaaauacaaaauucacaccaguuggaguaauccaagacggcggaacaacacauagaaacgaaccacaacaauggguacuaccauccuacucaggaagaaauguucauaauguacaccuagcuccugcaguagcuccaacauucccaggcgaacaacuucuuuucuuccgaucuacaaugccagguuguucugguuauccaaauauggacuuagauugccuucuaccucaagaauggguacaacauuucuaucaagaagcugcaccugcacaauccgacgucgcauuacuaagauuuguaaacccagacacaggcagaguccuauucgaauguaaauuacauaaaucaggauauguaacaguugcacauacaggacaacaugauuuagucauaccaccaaauggauauuucagauucgacucauggguaaaucaauucuacacauuagcaccuaugggaaacggaacaggaagaagaagagcacuauaa

SEQ ID NO: 32054 - RNA, 1623 nt, Artificial Sequence
  derived and/or modified sequence opt6 from VP1__Norovirus__BAJ13930
augaaaauggccucuaacgaugcaaacccaucagacggaucugcagccaacuuaguaccugaaguaaauaaugaaguuauggcacuagaacccguuguaggagccgcuauagcugcacccguagcaggccaacaaaacguaauagacccauggauaagaaauaauuucguucaagccccaggaggagaauuuacuguaucaccacgaaaugcaccuggcgaaauauuauggucagcaccacucgauccagaucuaaaccccuauuuaucacaacuugcaagaauguauaacgguuacgcagguggcuuugaaguacaagucauauuagcaggcaaugcuuuuacagccggcaaaauuauauucgcugcuguaccaccaaauuuuccaacagaaggacuauccccaucucaaguaacuauguucccacauauaauugucgaugucagacaacuggaaccuguucuaaucccacuaccugauguaagaaacaacuucuaucacuauaaccaaucaaaugacaguacaauaaaacuaauagcaaugcuauacacaccacuaagagccaacaaugcaggagaagauguauuuacaguaucuugucgaguauuaacaagacccagcccagacuuugacuuuauuuuuuuaguaccaccaacaguagaaucaagaacaaaaccauuuacaguaccuauuuuaaccgucgaagaaaugacaaauucaagauucccuauaccguuagaaaaacuauuuaccgguccaucuucagcauucguaguacaaccacaaaauggaagauguaccacugacgguguauuacuaggaaccacccaauuaucaccaguuaauaucugcacauucagaggugacguaacacacauagccggcucaagaaacuacacaaugaaucuagcaucacuuaauuggaauaauuacgaucccacagaagaaauaccagccccacucggaacucccgauuuugucggcaaaauacaaggaguacucacacaaacaacaaaaggcgacggcuccacaagaggccauaaagccacaguauauacagguucagcaccuuuuacaccuaaauugggaucaguccaauucucaacagauacagaaaacgauuuugaaacacaucaaaauacaaaauucacaccaguaggaguaauacaagauggcggaacaacucauagaaacgaaccacaacaauggguacuaccaucauauucaggaagaaacguacccaacguacaccuagcaccagcagucgcccccacauuuccaggugaacaacuauuauuuuuuagaucuaccaugccaggauguucuggauauccuaacauggaccuagauuguuuacucccacaagaauggguacaacauuucuaccaagaagcagcaccugcccaaucagacguagcauuauuaagguucgucaauccugacacaggaagaguacuuuucgaaugcaaacuacauaaaucaggcuaugucacuguagcccacacaggacaacacgaccucguuauaccaccaaauggauauuuuagauuugauucaugggucaaucaguucuauacacucgcaccaaugggcaauggaacagguagacgccgagcauuauaa

SEQ ID NO: 32055 - RNA, 1623 nt, Artificial Sequence
  derived and/or modified sequence opt6 from VP1__Norovirus__BAJ13933
augaaaauggcaucaaaugaugcuaaccccucagacggaucagcagcaaauuuaguaccagaaguaaauaaugaaguaauggcauuagaaccaguaguaggugcagcaauugcagccccaguagcaggacaacaaaacgucauagauccauggauaagaaauaacuuuguccaagcaccuggaggcgaauucacagucagcccacguaaugcaccaggugaaauauuauggucugcuccauuagguccagauuuaaaucccuaucuaucacauuuagcacguauguauaauggauaugcaggcgguuucgaaguacaagucauucuagcuggaaacgccuuuaccgcaggaaaaauuauauuugcagcaguacccccaaacuucccaacugaagguuuaucuccuucacaaguaacaauguucccacacauaauaguagacguacgacaauuagaaccaguucuaauuccauuaccagacguuagaaauaacuucuaucauuauaaucaaucaaaugacucaacaauaaaauuaauagcaaugcuauauacaccauuaagagccaacaaugcaggcgaagauguauucacaguaucgugccgaguacucacacgcccuucacccgacuucgacuuuauuuuccuaguuccaccaacaguugaaagucgaacuaaaccauucaccguaccaauuuuaacugucgaagaaaugacaaacucaagauucccaauaccccuagaaaaauuauucacggguccuucuuccgcuuucgucguacaaccacaaaaugguagaugcacaacugaugguguucuauuaggaacaacccaacuaucaccaguaaauauuuguacuuuucgcggagaugucacacacaucgcaggaucaagaaauuacacaaugaaccuagccucccucaacuggaauaauuacgaucccacagaagaaauaccagcaccauuaggaacaccagacuuuguaggcaaaauacaaggaguacuaacacaaacaacaaaaggagacggaucaacacgaggacacaaagccacaguauauacaggaucugcuccuuucacucccaaacuuggaucaguucaauucucaacagauacagaaaacgacuucgaaacacaccaaaauacaaaauucacucccguuggaguaauacaagacggaucaacaacccacagaaaugaaccacaacaauggguucuacccaguuauucaggaagaaacguccauaacguacauuuagcaccagcaguggcaccaacauuuccaggagaacaauuauuauucuucagaaguacuaugccaggaugcucuggauauccaaacauggaucuugacugcuuacuuccccaagaauggguccaacauuuuuaucaagaagccgcaccagcucaaagugacguagcauuacuucgauucguuaacccagauacaggacguguuuuguucgaaugcaaacuccacaaaucaggauauguaacaguagcucacacaggacaacaugaccuaguuauuccaccaaauggauauuuucgauucgacuccuggguaaaucaauuuuauacacucgcuccaaugggaaacggcacuggacgaagacgugcucuauaa

SEQ ID NO: 32056 - RNA, 1623 nt, Artificial Sequence
  derived and/or modified sequence opt6 from VP1__Norovirus__BAJ13936
augaaaauggccagcaaugaugcuaacccaucagacggauccgcagcaaaucuagugccagaagugaacaaugaaguaauggcacuagaaccaguaguaggagcagcuaucgcagcaccaguugcaggccaaacuaauguaauagacccauggaucagaaauaacuucguacaagcaccugguggagaauuuacaguaucaccaagaaaugcaccuggugaaauauuauggucagcucccuuaggacccgaucuaaauccauaucuuagucaccucgcaagaauguauaacgguuaugcaggaggcuucgaaguacaaguuauauuagcuggaaaugcauucacagcaggcaaaauaauauucgcugcuguaccgccaaacuucccaacagaagguuuaucuccuucacaaguaacuauguucccccacauaauaguagacguaagacaauuagaaccaguuuuaauaccauuaccagauguaagaaauaauuuuuaccacuauaaccaaucaaaugauucaacaauuaaauuaauagcuaugcuauacaccccacuaagagcaaacaaugcuggagaagauguauucacuguaucaugucgaguacuuacuagacccucuccagacuuugacuuuauauucuuaguaccaccaacaguagaauccagaacaaaacccuuuacaguaccaauacuaacagucgaagaaaugacaaauagcagauuuccuauaccccuugaaaaacucuucacaggaccaucaggcgcuuuugucguccaaccacaaaacggaagaugcaccacagacggaguacuauuaggcaccacucaauuaucuccaguaaauaucugcacauuucguggagauguaacacauauagcaggaucaagaaacuacacaaugaaucuagcuuccuuaaacuggaacaauuacgauccaaccgaagaaauaccagcaccacuaggaacacccgauuucguaggaaaaauacaaggaguauuaacacaaaccacaaaaggagacggaucaacacgaggacauaaagcaacugucuacacaggaagcgcaccuuuuacaccaaaauuaggcaguguacaauuuucaacagauacagaaaaugauuuugaaacucaccaaaacacaaaauucacaccaguagguguaauccaagacgguuccaccacucaccgaaacgaaccucaacaauggguucucccaaguuauucuggaagaaauguucauaauguacaucucgcaccagcaguugcaccaacauuuccaggagaacaauuacuuuucuuuagaucgaccaugcccggaugcuccgguuauccaaacauggaccuagauugucuauuaccacaagaauggguucaacacuucuaucaagaagcugcuccugcucaauccgacgucgcauuacuaagauucgucaaccccgacaccggacgaguacuuuucgaaugcaaacuccacaaaaguggauacguaacaguugcccauaccggacaacacgacuuaguuauaccaccaaacggauauuuuagauucgacucauggguaaaucaauuuuauacacuagcaccaaugggcaauggaacuggccgaagaagagcauuauaa

SEQ ID NO: 32057 - RNA, 1623 nt, Artificial Sequence
  derived and/or modified sequence opt6 from VP1__Norovirus__BAJ13939
augaagauggcaucaaacgaugcaaacccaucugacggaucagcagcaaaccuaguaccagaagucaacaacgaagucauggcauuagaaccaguuguaggagccgcaauagcagccccuguugcaggacaacaaaauguaauagacccauggauaagaaauaacuucguccaagcaccaggcggugaauucacaguuagcccaagaaaugcaccaggagaaauauuauggucagcaccacuaggcccagaucuaaaucccuauuuaagccaccuagcaagaauguauaacgguuacgcaggaggauuugaaguccaaguaauacuagcaggaaaugcauuuacagcaggcaaaaucauauucgcagcaguaccaccaaacuuccccacagaaggacuaucaccaucacaaguaacaauguuuccacacaucaucguugacguacgccaauuagagcccguacucauaccacuaccugacguuagaaauaacuucuaucauuacaaccaaucuaacgauucaacaauaaaacuaauagcaauguuauacacaccauuaagagcaaacaacgcaggagaagacguauuuacaguaucaugucgcguacuaacaagaccaucuccagacuuugacuuuaucuucuuaguuccaccuacaguagaaucaagaacuaaaccauucaccguaccaauacuaaccguagaagaaaugacaaacucaagauuuccaauaccauuagaaaaacuauucaccggccccucuucagcauucguaguacaaccacaaaauggccguuguacuacagaugguguucuucuaggaacaacacaacuaagcccuguaaauauauguacuuuuagaggagacguaacacauauugcaggcucucgaaacuacacaaugaauuuagcaagucuuaauuggaauaacuacgacccaacagaagaaauaccugccccuuuaggaacaccagauuuuguagguaaaauacaaggagucuuaacccaaaccacuaaaggagacggcucaacuaggggacauaaggcuacagucuacacaggaucagcaccuuucacaccuaaauuaggauccguacaauucucuacagacacagaaaacgauuuugaaacucaccaaaacacaaaauucacaccaguagguguaauacaagauggaggcacuacacacagaaaugaaccacaacaauggguacuuccaucuuauucagguagaaacguaccaaacguacauuuagcaccugccguagcuccaaccuuuccaggcgaacaacuccuauucuuucgcuccaccaugccaggaugcucuggauacccaaacauggauuuagauugccuacuuccacaagaauggguccaacauuuuuaccaagaagcagccccagcucaaucagacguagcauuauuaagauuuguaaacccagacacugguagagucuuauucgaauguaaauuacacaaaucaggauacgucacaguagcucacacuggacaacaugaucucguaauaccaccaaauggauauuucagauucgauagcuggguaaaucaauuuuacacacuagcacccaugggaaauggaacuggaagacgaagagcauuauaa

SEQ ID NO: 32058 - RNA, 1623 nt, Artificial Sequence
  derived and/or modified sequence opt6 from VP1__Norovirus__BAJ13942
augaaaauggcauccaacgacgcaaacccuuccgacggaucugcagccaauuuagucccagaaguaaacaaugaaguuauggcacuagaaccaguaguaggagcagccauagccgcaccaguugcuggccaaacaaauguuauagauccauggauaaggaauaacuucguacaagcaccuggaggggaauuuaccguaagcccaagaaaugccccaggcgaaauauuauggucagcaccacuaggaccagaucuaaauccauauuuaagucacuuagcaagaauguauaauggcuacgcugguggauucgaaguacaagucauacuugcaggaaacgccuuuacagcaggaaaaauuauauuugcagcagucccacccaacuucccaacugaaggacuaucaccaucacaagucaccauguucccucauauaauaguagacguacgccaauuagaacccguacuuauuccauuaccagauguaagaaauaacuucuaucacuauaaccaaucaaaugauuccacaauaaaacuaauagcaauguuauacacaccacucagagcaaauaacgcaggagaagauguauuuacaguuuccugcagaguacuaacccgaccaucaccagauuuugauuuuauauucuuaguaccaccaacaguagaaucuagaacaaaaccuuuuacaguaccaauauuaacagucgaagaaaugacaaacuccagauuuccaauacccuuagaaaaacuauuuacaggaccaucuggagcauuuguaguucaaccacaaaacggaagguguacaacagacgguguacuacuaggaacaacacaauuaucuccagucaauauuuguaccuucaggggcgacguaacccauauagccggaucuagagacuauacaaugaauuuagcaucacucaacuggaauaauuacgauccaacagaagaaauaccagccccauuaggcaccccagacuuuguaggcaaaauacaagguguauuaacucaaacuacaaaaggcgacggaucaacacgaggacauaaagccaccguauauacaggaucagcaccauuuacaccaaaacuuggcucuguacaauucuccacagacacagaaaacgacuuugaaacacaucaaaauacaaaauucacaccaguaggagucauacaagaugguggaacaacacaucgaaacgaaccucaacaauggguccuaccauccuauucaggaagaaauguucauaacguacaccuagcaccagcaguugccccaacauuuccaggugaacaauuacuauucuuuagaucaacaaugccagguuguucagguuaucccaauauggaccuagacuguuuacuuccacaagaauggguccaacauuucuaucaagaagcagcaccagcacaaucagacguagcauuauuacgauucguaaacccagauacaggcagaguacuuuuugaaugcaaacuacauaaaucaggauacguaaccguagcacacacaggacaacacgaucuugucauaccacccaauggauacuuucgauuugacagcuggguaaaucaauuuuacacucuagcacccaugggaaauggcacaggacgaagacgagcauuauaa

SEQ ID NO: 32059 - RNA, 1623 nt, Artificial Sequence
  derived and/or modified sequence opt6 from VP1__Norovirus__BAJ13945
augaaaauggcaucaaacgacgcaaacccaagugauggauccgcagcuaacuuagucccagaaguaaauaacgaaguaauggcacuagaaccaguugucggcgcagcaauagcugcaccaguagcuggccaacaaaauguaauagacccauggauaagaaauaacuuuguacaagcaccagguggugaauuuacaguaucaccucgaaacgcaccaggagaaauauuauggucagcuccacuaggaccagaucuaaauccauaucuaucucauuuagcacguauguacaacggcuaugccggaggauucgaaguacaaguuauucuagcuggcaaugcauucaccgcaggcaaaauaaucuucgcugcagucccuccaaacuuuccaacagaaggcuuaucaccaagucaaguaaccauguucccacacaucauaguugaugucagacaauuagaaccaguacuaauuccauuaccagacguaagaaacaacuucuaucacuauaaccaaucaaacgacucuacaauaaaauuaaucgcaaugcuauauacaccauuaagagcuaacaaugcaggugaagauguauucacaguuucauguagaguacuaacaagaccuuccccagauuuugacuuuauauuccuuguaccaccaacaguagaaucacgaacuaaaccauucacaguaccaauacuaaccgucgaagaaaugacaaacucacgauuuccuauaccacuagaaaaacuuuucacuggaccuucaagugcuuucgucguacaaccacaaaauggacguugcacaacugacggcguauuauuaggcacuacacaauuaucacccguaaacauauguacauuuagaggugacguaacacauauugcaggcucccgcaacuauacaaugaauuuagcaagcuuaaauuggaacaauuaugauccaaccgaagaaauaccugcaccuuuaggaacaccugacuucgucggcaagauacaaggaguacuuacucaaacgacaaaaggagauggauccacucgaggacacaaagcaaccguauauacaggaucagcaccauucacaccaaaacucgguuccguacaguucucaacagauacagaaaaugauuucgaaacacaccaaaauaccaaauuuacuccagucggugucauacaagaugguggcacuacacauagaaacgaaccacaacaauggguacuaccauccuauucaggaagaaauguacaaaacguacaccuagccccagccguagcaccaacauuuccaggagaacaacuucuauucuucagauccacaaugccaggaugcucagguuaucccaauauggauuuagauugucuuuuaccacaagaauggguucaacacuuuuaucaagaagcagcaccagcacaaucagauguagcauuacucagauuuguaaauccagacaccggaagaguacuauucgaaugcaaauuacauaaaucaggcuauguaaccguagcacacacuggacaacacgacuuaguaauaccaccaaauggauauuucagauucgauucauggguaaaucaauuuuacacacuugcuccaaugggcaauggcacuggaagacgaagagcauuauaa

SEQ ID NO: 32060 - RNA, 1623 nt, Artificial Sequence
  derived and/or modified sequence opt6 from VP1__Norovirus__BAJ13948
augaaaauggcaucaaaugacgcaaacccaucagacggcucagcagccaauuuaguucccgaaguaaacaaugaaguaauggcacuagaaccaguuguuggcgcagcuauugcagcaccuguagcaggucaacaaaauguaaucgacccauggauaagaaauaauuuuguacaagcacccggaggcgaauuuacuguauccccaagaaaugcacccggagaaauuuuauggucagcaccacucggaccagaucuaaauccuuaucucucucacuuagcaagaauguacaacggauacgcaggcggauuugaaguacaaguaauacuagcagguaacgcauuuacagcaggaaaaauaauauuugcugccguaccaccuaacuucccuacagaaggucuuuccccaucccaaguaacaauguuuccacacauaauaguagacguccgccaauuagaaccaguacuaauaccccuaccagauguaagaaacaauuucuaccacuauaaccaaucaaaugauucaacaauuaaacuaauagcaauguuauauacuccacuaagagcuaacaacgcaggcgaagacguauucaccguaucaugcagaguacuuaccagaccaucaccagacuuugacuuuauauuuuuaguacccccuacaguagaauccagaacaaaaccuuucacugugccaauacuaacaguagaagaaaugacaaacaguagauuuccaauccccuuagaaaaauuauucaccgguccaucuuccgccuucguaguacaaccacaaaacggucgauguacaacagacggaguucuccucggaaccacacaacuuucaccuguaaacauauguacauuuagaggagacguaacccauauagcaggaucccguaauuauacuaugaacuuagcuucacuaaauuggaacaauuaugacccaacagaagaaauaccagcaccucuaggaaccccugauuuuguuggcaaaauucaagguguccuaacacaaacaacuaaaggagaugguucuacccgaggucauaaagccacaguauauacaggauccgccccauuuacacccaaauuaggaucuguacaauucucaacugauacagaaaacgauuucgaaacacaucaaaauacuaaauuuacuccugucgggguuauccaagauggaaauacaacccauagaaaugaaccacaacaauggguauuaccaucauacucaggaagaaauguacaaaacguacaccuagcaccagcaguugcaccaacauuuccaggagaacaacuucuauuuuucagaucuacaaugccagguuguucuggauauccuaauauggauuuagauugccuucugccacaagaauggguucaacauuuuuaccaagaagccgcaccugcacaaucugacguagcauuacuacgauucguaaaucccgauaccgguagagucuuauucgaauguaaacuacauaaaucuggguauguaacaguagcacacacuggacaacacgauuuaguuauaccuccaaauggauacuuuagauucgacucauggguuaaucaauucuauacucuagcacccaugggaaacggcacaggaagaagacgagcacuauaa

SEQ ID NO: 32061 - RNA, 1623 nt, Artificial Sequence
  derived and/or modified sequence opt6 from VP1__Norovirus__BAJ13951
augaaaauggccucgaacgacgccaacccuucagacggcucagcugcaaauuuaguuccugaagugaacaacgaaguaauggcacuagaaccaguaguaggagcagcaauagcugcaccugucgcaggacaacaaaauguaauagauccuuggauaagaaauaauuuuguccaagcaccagguggagaauuuacaguaucaccacguaaugcaccaggcgaaauauuaugguccgcaccacuaggacccgacuuaaauccauaucuaucacaccuagcacguauguacaacggauacgcaggagguuucgaaguccaaguaauauuagcaggaaacgcauucaccgccggaaaaauaauauuugcagcuguuccaccaaauuuuccaacagaaggacuaucaccuucucaaguaacaauguucccucacauaauaguagacguaagacaacuugaaccaguacuuaucccccuaccugaugucagaaauaacuuuuaucauuacaaucaaaguaaugacucaaccauaaaauuaauagcuauguuauacacaccacugcgagcaaacaaugcuggugaagauguuuucaccguaucuuguagaguacuaacacguccuuccccagacuuugacuuuauauuuuuaguuccuccuacaguugaaucaagaacaaaaccauuuacaguaccaaucuuaaccguagaagaaaugacaaacucaagauuuccaauaccccucgaaaaacuauucacaggaccuucaucagcuuucgucguucaaccucaaaacggaaggugcaccacugacggagucuuacuagguacaacacaauuaucaccaguuaacauuugcacuuucagaggagauguaacacauauagcaggauccagaaauuacacuaugaauuuagcaucauuaaauuggaauaauuaugaucccacagaagaaaucccagcuccauuagguacaccagauuuugucggaaaaauacaaggaguauuaacacaaacuacaaaaggagacgguucaacccgaggacauaaagcaacugucuacaccgguucugcaccuuuuacaccaaaacuaggcucuguccaauucucuacugauacagagaaugacuuugaaacacaccaaaacacaaaauuuacaccaguagguguaauacaagauggauccacaacccaccgaaacgaaccccaacaauggguacuuccaucauacucuggacguaauguccauaauguacacuuagcuccagccgucgcaccuacauuuccaggugaacaauuacuuuucuuuagaucaacaaugccaggaugcucuggauaccccaauauggacuuagacugucuccucccacaagaauggguacaacacuuuuaucaagaagcagccccagcucaaucagacguugcacuacucagauuuguaaauccagauacaggccguguauuauuugaaugcaaacuucauaaaaguggauacgucacaguagcacacaccggacaacaugaccuaguuauaccaccaaaugguuauuuuagauuugacaguuggguuaaucaauuuuauacacucgcaccuaugggcaauggaacaggaagaagaagagcacuauga

SEQ ID NO: 32062 - RNA, 1623 nt, Artificial Sequence
  derived and/or modified sequence opt6 from VP1__Norovirus__BAJ13954
augaaaauggcauccaaugaugcuaaccccucagacggaucagcagcaaaucuagucccagaaguuaauaaugaaguaauggcccuagaaccaguaguaggagcagcaaucgcagccccaguagcaggccaacaaaaugucauugauccauggauacgcaauaauuuuguacaagccccaggaggagaauucacaguaucaccacgcaaugcuccaggagaaauccuuuggucagcaccccuagguccagauuuaaauccauaucucucucaucuagcaagaauguauaauggauacgcuggcgguuuugaaguacaaguaauacucgcuggaaacgccuuuacggcaggaaaaauaauauucgccgcaguacccccaaauuucccaacagaaggacuuucaccaucucaaguuacuauguucccacacauaauaguugaugucagacaacucgaacccgucuuaauaccacucccagauguucguaauaacuuuuaucauuauaaccaaaguaaugauucuacaauuaaacuaauagcaauguuauacacaccuuuaagagcaaauaaugcuggagaagauguauucacaguuucaugcagagucuuaacaagaccaucaccagacuuugauuuuauauuucucguaccaccaacuguagaaagucgaacaaaaccauucacaguaccaauauuaacuguagaagaaaugacuaacucaagauuuccaauaccacuugaaaaacuauuuacaggccccucuucagcauuugucguacaaccacaaaacggaagauguacuacugacggaguacuauugggaacaacacaacuuaguccaguuaauauauguacauuuagaggagacguaacucauauagcaggaucuagaaauuacacaaugaaucuugcaucacuaaacuggaacaauuaugauccaacugaagaaauaccagcaccacucggaacaccagacuuuguagguaagauacaaggaaugcuaacccaaacaacaaaaggagacggaucaacaagaggccacaaagcaacagucuauacuggaucugcaccauuuacuccaaaacuaggaucaguacaauuuucuacagauacugaaaacgacuuugaaacacaccaaaacacaaaauucacaccagucggaguaauacaagauggaaacacaacacacagaaacgaaccacaacaauggguuuuaccaucauacucugguagaaauguacaaaacguacaccuagccccagccgucgcacccacauucccaggcgaacaauuacuuuucuucagaucaacuaugccagguugcucuggcuacccaaauauggauuuagacuguuuauuaccacaagaauggguacaacauuucuaccaagaagccgcccccgcacaauccgauguugcacuacucagauuuguuaacccagacacaggacgaguacuuuucgaauguaaauuacauaaaucagguuaugucaccguagcacacacuggucaacacgaucucguaauucccccaaauggauauuuuagauuugacucauggguaaaucaauucuacacacuagcaccuaugggaaacggaacuggacgcagaagagcacuauaa

SEQ ID NO: 32063 - RNA, 1623 nt, Artificial Sequence
  derived and/or modified sequence opt6 from VP1__Norovirus__BAJ13957
augaaaauggcauccaaugaugcaaauccuucagauggcucagcagcuaaccucguaccagaaguuaacaaugaaguaauggcacuagaaccaguaguaggagcagcaauugcagcaccggucgccggacaaacuaacguaauagauccauggauaagaaauaacuucguccaagcaccuggaggagaauuuacuguaucacccagaaaugcaccaggagaaaucuuauggucugcaccaucaggaccagaucuaaacccuuaucucucacacuuagccagaauguuuaacgauuaugcaggaggcuucgaaguacaagucauuuuagcuggcaaugcauuuaccgcaggaaaaauaaucuuugcagcaguuccaccuaacuuuccuaccgaaggauuauccccaucacaaguaacaauguuuccucauauaauaguagacguaagacaauuagaaccugucuuaauaccauuaccugauguacgcaacaauuucuaccacuacaaccaaucgaaugacucaaccauaaaauuaauagcaaugcuauacacaccacuacgugcaaacaaugcaggcgaagauguauucacagucucaugcagaguacuuacaagaccauccccagauuuugauuuuauauuucuuguaccaccaacaguagaaucacgcacaaaaccauucacaguaccaauauuaacuguagaagaaaugacuaacucacguuucccaauaccauuagaaaaauuauucacgggaccaucaggugcauuuguaguacaaccacaaaacggcagauguacaacugauggaguauuacuaggaacaacacaauuaucuccaguaaacauauguacauucagaggagauguuacacacauagcuggaucuagaaauuacacaaugaacuuagcaucauuaaauuggaauaacuacgauccaaccgaagaaauaccagcuccauuaggaacaccagacuuugucgguaaaauccaaggcguacucacacaaacaacuaaaggugauggcuccacacgaggacacaaggcaacaguauauacaggcucagcaccauuuacaccuaaacuuggaucuguacaguucucuacugacacagaaaacgauuucgaagcacaucaaaauacuaaauucacaccaguagguguuauucaagacggauccacaacacacagaaaugaaccacaacaauggguucuaccauccuauucaggacgaaacguucaaaacguacaccuagcaccagccguagcccccacauucccuggagaacaacuauuauucuuccgaucaacaaugccaggaugcucagguuauccaaauauggauuuagauugucuucuaccucaagaauggguacaacacuucuaucaagaagccgccccagcacaaucagauguugcauuacuacgcuucguaaacccugacacaggaagaguccuuuucgaaugcaaacuacauaaaucagguuaugucacaguugcacacacaggucaacacgacuuaguaauuccucccaauggauauuuucgauucgauucauggguaaaucaauuuuacacucuagcaccaaugggcaauggaaccggucgaagacgagcacuuuaa

SEQ ID NO: 32064 - RNA, 1623 nt, Artificial Sequence
  derived and/or modified sequence opt6 from VP1__Norovirus__BAJ13960
augaaaauggcaucuaaugacgcaaacccaucugauggaucagcagcuaacuuagucccagaaguaaacaaugaaguaauggcauuagaaccaguaguaggcgccgccauugcagcacccguagcaggacaacaaaauguaauagacccuuggauaagaaauaauuuuguacaagcacccgguggagaauuuacagucucccccagaaaugcaccaggagaaauauuauggucagcaccucuaggaccagaucuaaaucccuaucuaucacaucuagcaagaauguauaacgguuaugcaggaggauuugaaguccaaguaauacuagcaggcaaugcauuuacagcaggaaaaaucauauuugcagccguaccaccaaauuuuccaaccgaaggauuaucaccaucacaaguaacaauguucccacacauaauaguagacguaagacaacucgaaccuguauuaauaccauuaccagaugucagaaacaauuucuaccacuacaaccaaucaaacgacucaacaauaaaacuaauagcaaugcuauauacuccuuuaagagccaauaacgcaggagaagauguauuuacuguaucauguaggguccuaacaagaccaucaccugacuuugacuuuauuuuuuuaguacccccaacuguagaaagcaggacaaaaccauucacuguuccaauacuaacuguagaagaaaugacaaacuccagauucccuauuccacuagaaaaauuauucacaggaccaucaucugcuuucguaguccaaccacaaaacgguagauguacuacagacgguguacucuuaggaaccacucaauuaucaccaguaaacauauguacauuuagaggagacguuacucauauagcaggaucaagaaauuauacaaugaaucuagcuucauuaaacuggaacaauuacgaccccacagaagaaaucccagcaccccucggaacaccugauuucguaggaaaaauucaggguguacuaacacaaacaacaaaaggagauggaucaacuagaggucauaaagcaacagucuacacuggaucugcuccauucacaccaaaacuaggaucuguccaauucuccacagauacugaaaaugauuuugaaacacaucaaaacacaaaauucaccccaguaggagucauacaagauggugguacuacacauagaaaugaaccccaacaauggguauuaccaucauauuccggaagaaacguaccaaacguacauuuagcaccagcaguagcaccuacauuucccggcgaacaauuacucuucuuccgaucuacaaugccuggaugcaguggauauccaaauauggaucucgacugcuuauuaccacaagaauggguacaacacuucuaucaagaagcagcaccagcacaaucagauguagcauuacuucgauuuguaaacccagacacaggaagaguacuauucgaauguaaacuacauaaaucaggauauguaacagucgcgcacacaggucaacaugaccuuguuauuccaccaaauggauauuuucgauucgauucauggguaaaucaauuuuauacgcuagcaccaaugggaaacgguacaggaagaagacgagcauuauaa

SEQ ID NO: 32065 - RNA, 1623 nt, Artificial Sequence
  derived and/or modified sequence opt6 from VP1__Norovirus__BAJ13963
augaaaauggcuuccaaugaugccaacccaucugauggaucagcagcuaacuuaguaccagagguuaauaaugaaguaauggcauuagaacccguaguaggcgcugcaauagcagcaccuguagcaggacaacaaaaugucaucgauccauggauacgcaauaauuuuguucaagcaccuggaggugaauuuaccguauccccuagaaacgccccaggagaaauacucugguccgcuccauuagguccugauuuaaacccauauuuaucacauuuagcacguauguacaacgguuacgcaggaggauucgaaguacaaguaauucuugcaggaaaugcauuuaccgcaggaaaaaucauauucgcagcaguaccaccuaacuucccaacagaaggauuaucacccucccaaguaacaauguucccacauauuauaguagacguacgucaacuagaaccuguauuaaucccauuaccagauguaagaaacaauuuuuaucacuauaaucaaucaaacgacucaacaauuaaauuaauugcuauguuauauacuccauuacgcgcaaacaaugccggagaagaugucuucacaguauccuguagaguauuaacucguccauccccagauuuugauuuuauauuuuuaguacccccaacaguagaaucaagaacaaaaccauuuacugucccaauauuaacaguagaagaaaugacuaacaguagauuuccaauuccauuagaaaaacuauuuaccggaccaucaucagcuuuuguaguacaaccacaaaacggaagauguaccacagauggaguuuuauuagguacaacacaauuaucaccaguaaauauauguacauuccgcggagauguaacacacauugcuggaucaagaaauuacacaaugaauuuagcaagucucaacuggaacaauuaugauccuacagaagaaaucccagcaccauuagguacaccggauuucgucggcaaaauacaaggaguacuaacacaaacuaccaaaggugacggcucaacuagaggacauaaagcaacuguauauacaggaucugcaccauuuacaccaaaauuaggcucuguucaauuuucaacagacacugaaaaugauuucgaaacacaucaaaauacaaaauucacaccaguagguguaauucaagacggaggaacaacucauagaaaugaaccacaacaauggguauuaccaaguuauagcggaagaaauguacccaauguucacuuagcaccagcaguugcaccaacuuucccuggagaacagcuguuauucuuuagaucaacaaugccaggaugcagcggauauccaaacauggaucuagauugcuuauuaccacaagaauggguacagcauuucuaccaagaagcagcaccagcacaaucagacgucgcacucuuacgauuuguaaauccagauacaggacgagucuuauucgaaugcaaacuacacaaaucaggauauguaacaguugcccauacaggccaacacgaccuuguaauaccaccaaaugguuauuucagauuugauucauggguaaaucaauuuuauacccuagccccaauggguaacggaacaggcagaagacgagcacuauaa

SEQ ID NO: 32066 - RNA, 1623 nt, Artificial Sequence
  derived and/or modified sequence opt6 from VP1__Norovirus__BAJ13966
augaaaauggcaucaaaugacgcaaauccauccgacgguucagcagcaaauuuagucccagaagucaauaaugaaguaauggcuuuagaaccaguaguaggagccgcaauagcagccccugucgcaggucaacaaaauguuaucgacccuuggauaagaaacaauuucguccaagcuccaggaggagaauuuaccguaaguccacgaaacgcaccaggugaaauucuauggucggcaccucuaggacccgaccuaaauccauaccuaucacaccuagccagaauguauaauggauacgccggaggauuugaaguccaaguaauacuagcaggaaacgccuuuacggcuggaaaaauuauauuugccgcaguaccaccaaacuuuccaacagaaggucuaucucccucacaaguuacaauguucccucacaucauaguugacguuagacaauuagaaccaguacuaauuccacuaccagauguccgaaacaacuucuaucauuacaaucaaucaaaugacuccacaaucaaauuaaucgcuaugcuauacacaccauuaagagcaaacaaugcuggcgacgauguuuuuacagucuccuguaggguucuaacacgccccucaccagauuuugacuucauauuuuuaguuccaccaacaguagaaucaagaacaaaaccauucaccgucccaauauuaacaguagaagaaaugacaaauucucgauuuccaauaccucuagaaaaacuuuuuacaggacccucaucagcauucguaguucaaccucaaaacggaagauguacaacagacgguguucuuuuagguaccacacaauuauccccaguaaacauaugcacguuucgaggcgacguaacacacauagcuggcucaagaaacuacacaaugaacuuagccucacuaaauuggaauaauuaugauccuacagaagaaauaccagcaccucuagguacuccugacuuuguagguaaaauacaaggaguacucacacaaacuacuaaaggugacggaucaacaagaggccauaaagcaacagucuacacaggaucagcugacuucacaccaaaacucggaucuguucaauucggaacagauacagaaaacgacuucgaaacacaucaaaauacaaaauuuacaccuguaggaguaauacaagauggaagcacaacacauagaaacgaaccacaacaauggguacucccauccuauucaggacgcaauguacauaacguacacuuagcaccagcaguagcuccaaauuuuccaggugaacaauuauuauucuuucgcucaaccaugcccggaugcucuggauacccaaauauggacuuagauugcuuauuaccacaagaaugggugcaacauuucuaucaagaagcagcuccagcacaaucagauguagcccuacuaagauucguaaauccagacacuggaagaguacuauuugaaugcaaacuacacaaaucuggauauguaacaguugcucacacaggacaacaugaucuaguaauaccaccaaauggauauuuucgauucgauucauggguaaaucaauuuuauacacuagccccaaugggaaacggcacaggaagacgcagagcacuauaa

SEQ ID NO: 32067 - RNA, 1623 nt, Artificial Sequence
  derived and/or modified sequence opt6 from VP1__Norovirus__BAJ13969
augaaaauggccucaaaugacgcaaauccaucagauggauccgcugcuaacuuaguaccagaaguaaacaaugaaguaauggcauuagaaccaguaguaggagcagcaauagcugcacccguugcaggacaaaccaacguuauagauccauggauacgaaauaauuuuguacaagccccaggaggagaauucaccguaucaccuagaaaugcuccaggagaaaucuuaugguccgccccauuaggcccagaucuuaauccauauuuaucacauuuagcacgaauguauaacgguuacgcuggaggcuucgaaguacaaguuauacuagccggaaaugcauucacagcaggaaaaauaaucuucgcagcagucccacccaacuuuccaacagaaggacuaucaccaucccaagucacaauguucccacauauaauaguagauguuagacaauuagaaccaguauuaauaccacuacccgauguucgaaacaauuuuuaucacuauaaccaaucaaaugacucaacaauaaaacucauagcaaugcuuuacacaccauuaagagcuaacaaugcaggagaagauguauuuacaguaucaugucgaguucuaacacgaccaucaccagauuuugauuuuauauuccuaguaccaccuacaguugaaucaagaaccaaaccauucacaguaccaauacuuacuguagaagaaaugacuaacucaagauuuccaauaccauuagagaaacuauucacuggcccaucaggugcauucguaguacaaccacaaaacggccgauguacaacugauggcguauuauuaggaacaacucaacucucuccaguaaauauauguacuuuuagaggugacguuacccauauagcuggaucacgaaauuacacaaugaaucucgcaucucuuaacuggaacaauuacgaccccacagaagaaauacccgcaccauuaggaacaccagacuuuguagguaaaauacaaggaguacucacucaaacuacuaaaggagacgguuccacaagaggucauaaagcaacaguuuacaccgguuccgcccccuuuacaccaaaauuaggaucuguccaauucucaacagauaccgaaaacgauuuugaaacccaccaaaauacuaaauuuacaccaguaggaguaauacaagacgguaguaccacacauagaaaugaaccucaacaauggguacucccaucauauucaggacgaaauguacacaacguucaucuagcaccagccgucgcaccaacauucccaggcgaacaacuauuauuuuuuagauccaccaugcccggauguucaggauacccuaauauggaucuagauugucuccuaccucaagaauggguacaacauuucuaucaagaagcagcaccagcacaaucagacguagcauuacuuagauucgucaacccagacacgggacgcguacuauucgaaugcaaacuacauaaaucaggauauguaacaguugcacauacaggccaacacgauuuaguaauaccuccaaauggauacuucagauuugauucauggguaaaucaauucuacacccucgcaccaaugggaaacggaacuggaagaagacgagcauuauaa

SEQ ID NO: 32068 - RNA, 1623 nt, Artificial Sequence
  derived and/or modified sequence opt6 from VP1__Norovirus__BAJ13972
augaaaauggccucaaaugaugcaaacccaucagauggaucagcagcaaacuuaguaccagaaguaaauaaugaaguuauggcacuugaaccagucguaggugcagcaauagccgcacccguugccggacaacaaaauguaauagaucccuggauacgaaauaacuuuguucaagccccaggaggagaauuuacugucucaccuagaaaugcaccaggagaaauacuauggucagcaccauuaggaccagauuuaaauccauacuuaucacaccucgcuagaauguauaacgguuacgcaggcggcuuugaaguacaaguaauacuagcaggaaaugcauucacagccggaaaaauaauauucgcugccgucccuccaaacuuuccuacagaaggucuaucaccaucacaaguaacaauguuuccacacauaauaguugacguacgucaauuagaaccaguacuaauaccauuaccagauguacgaaauaauuucuaucauuauaaucaaucuaaugauucuacuauuaaauuaauugcaaugcuauauacucccuuaagagcaaacaaugcaggugaagaugucuuuacaguaaguugucguguacuuacacgcccaucaccagauuucgauuuuauauuucuaguuccaccuaccguugaaucaagaacaaaaccauuuacaguuccaauacuaacuguagaagaaaugacuaacucacgauucccaauaccucuagaaaaacuauuuacaggaccauccggagcuuucgucguacaaccacaaaauggacgauguacaacagauggugucuuacuuggaacuacgcaauuaucacccguuaacauauguacauucagaggagauguaacccacauagcaggaagucgagauuacacaaugaaccuagcaagucuaaacuggaauaauuaugaucccacagaagaaauuccagcaccacuaggaaccccagacuucguagguaaaauacaaggaguucuaacucaaacaacuaaaggagaugguucaacacgaggacauaaagcuacaguauacacaggaucaguaccauuuacaccuaaauuaggaucaguacaauucucuacagacacagaaaaugacuucgaaacacaucaaaacacuaaauuuacaccagucggcguuauacaagacggcucaacaacacauagaaacgaaccacaacaauggguucuacccucuuauucaggaagaaacguacauaauguucauuuagcuccagcaguugcaccaacauuuccaggcgaacaacuauuauuuuuucgaagcaccaugccagguugcucaggauauccaaacauggauuuagacugucuauuaccacaagaauggguacaacauuucuaucaagaagccgcuccagcgcaauccgacguagcacuacuccgauucguaaaccccgacacaggucguguuuuauucgaaugcaaauuacauaagucuggauauguaacuguagcacauacaggacaacaugaucuaguaauaccuccaaacggauauuuucgauuugacucuuggguuaaucaauuuuauacacuagccccaaugggaaacgguacuggucgacguagagcauuauaa

SEQ ID NO: 32069 - RNA, 1623 nt, Artificial Sequence
  derived and/or modified sequence opt6 from VP1__Norovirus__BAJ13975
augaaaauggcaucaaacgaugcuaacccaucagacggaucagccgcaaaccuaguaccugaaguaaauaaugaaguaauggcacuagaaccaguaguaggagccgcaauagcagcuccaguagcaggacaacaaaacguaauagauccauggauaagaaauaauuuuguacaagccccuggaggagaauucaccgucuccccaagaaacgcuccuggagaaauauuaugguccgcaccucucggacccgacuuaaacccauauuuaucucauuuagccagaauguacaaugguuacgcagguggauuugaaguccaaguuauucucgcuggaaacgcauucacagcaggaaaaauaauauuugcagcaguacccccgaacuucccaacagaaggacuuucucccucacagguuacaauguucccacacauaauuguugacgucagacaauuagaaccuguauuaauaccccuaccagauguaagaaacaauuuuuaucacuacaaucaaucuaaugacucgacaauaaaacuaaucgccaugcuauacacaccacuaagagccaacaacgccggagacgauguauuuacaguauccugucgcguucuaacaagaccuucccccgacuucgacuuuauauuuuuaguaccaccaacaguagagucaagaaccaaaccuuucacaguaccaauauuaaccguugaagaaaugacaaacucaagauuuccuauaccucuugaaaaacucuuuacaggcccaucuucagcauuuguuguacaaccacaaaacggaagauguacaacggacggaguauuauuaggcaccacacaacuuucaccaguaaauauaugcacauuuagaggagacguaacacacaucgccgguucaagaaauuauacuaugaaucuugcaucauuaaauuggaauaauuacgacccaacagaagaaauaccugcaccauuaggaacaccugacuucguaggaaaaauucaaggaguacuaacccaaacaacaaaaggugacggaucaaccagaggacauaaggcaacaguauauacaggaucagcagacuucacaccaaaauuaggaaguguccaauucgcaaccgauacagaaaaugauuucgaaacacaccaaaauacaaaauucacaccaguuggaguaauacaagauggagggacaacacauagaaacgaaccacaacaauggguacucccaucauacucaggaagaaauguacauaacguucauuuagcuccagccguugccccaaacuuuccaggagaacaauuauuauuuuuuagaucuacaaugcccggcugcucuggcuauccaaauauggaucuagauugccuacuaccucaagaauggguccaacacuuuuaccaagaagcagcacccgcacaaucugacgucgcacuccuaagauucguuaacccagauacagguagaguuuuauucgaauguaaacuccauaaaucaggauauguaacaguugcacacacaggacaacacgaccuaguaauccccccaaauggauauuucagauucgauucaugggucaaccaauuuuacacuuuagcuccaaugggaaauggaacaggccgaagaagagcacuuuaa

SEQ ID NO: 32070 - RNA, 1623 nt, Artificial Sequence
  derived and/or modified sequence opt6 from VP1__Norovirus__BAJ13978
augaaaauggcauccaacgacgcaaauccaagugaugguucagcagccaacuuaguccccgaaguaaacaacgaaguaauggcucuagaaccgguuguuggagcagcaauugcugccccaguagcuggacaacaaaauguaauagacccauggauuagaaauaauuuuguccaagccccaggaggagaauuuacaguaucaccuaggaaugcaccaggagaaauacucuggucagcacccuuaggacccgaucucaacccauaucuaucacacuuagcaagaauguacaauggauaugcagguggcuuugaaguacaaguuauauuagcaggaaacgcuuuuacagcagguaaaauaauauucgcagcuguuccaccuaauuuccccacagaaggacuaucaccaucccaaguaaccauguucccucauauaaucguagacguacgacaacucgaaccaguacuaauaccccuuccagauguuagaaacaauuuuuaucacuacaaccaaucaaaugauucaacaauaaaacuuauagcaaugcucuacacaccucuucgcgcaaacaacgcuggagaagaugucuuuacuguaucauguagaguacuuacaagaccaucaccagacuucgacuuuauauucuuagucccaccaacaguggaaucaagaacuaaaccauucaccguaccaauuuuaacuguagaagaaaugacaaacucuagauuuccaauaccacuugaaaaauuauucacagguccaucaggagcuuucgucguacaaccccaaaauggcagaugcacuacagaugguguauuacuaggaacaacucaacuuucaccuguuaauauauguaccuuuagaggagacguaacacauauugcuggcucaagaaacuacacuaugaaucuagcauccuuaaauuggaacaauuacgauccaaccgaagaaauuccugccccucuagguacaccagauuucguaggaaaaauucaaggaguguuaacgcaaaccacaaaaggagacggaucaacaagaggacauaaagccaccguauacacaggcucuaccccuuucacacccaaauuaggaucuguacaauuuucgaccgauaccgaaaacgauuucgaaacacaucaaaacacaaaauuuacaccuguagguguaauacaagauggaucgacaauacaucgaaaugaaccacaacaaugggucuuaccuaguuacucagguagaaauguccaaaauguacaccuagcaccagcaguagcacccacauucccaggagaacaauuacuauucuuccgauccacuaugccuggcuguucugguuauccaaacauggauuuagacuguuuacuaccucaagaauggguacaacauuucuaucaagaagcagcaccugcucaaagcgauguagcauuauuaagauucguaaauccagauacaggaagaguacuauucgaauguaaauuacauaaauccggauacguaacaguagcccauacaggacaacacgacuuaguuauaccaccaaacggauauuuuagauucgauuccuggguaaaucaauucuacacauuagcacccauggguaauggaacaggucgcagaagggcauuauaa

SEQ ID NO: 32071 - RNA, 1623 nt, Artificial Sequence
  derived and/or modified sequence opt6 from VP1__Norovirus__BAJ13981
augaaaauggcuucaaaugacgcaaauccaucagauggcagcgcagcuaaccuaguacccgaaguuaauaaugaaguuauggcauuagaacccguuguaggagcagcaauugccgcacccguagcaggacaacaaaacguaauagauccauggauaagaaauaacuucgugcaagccccaggcggagaauuuacaguaucaccacgcaaugcaccuggagaaauauuauggucagcaccacuaggaccagauuuaaaccccuaucuaucccaucuagcucgaauguauaauggauaugcaggaggauuugaaguccaaguaauacucgcaggaaaugcuuuuacagccggaaaaauuauuuucgcagcaguaccaccaaacuucccaaccgaaggacuaagccccucacaaguaacaauguuuccucauauaauaguagacguccgccaauuagagccuguauuaauaccacucccagacguaagaaauaacuucuaucauuauaaucaaucaaaugacuccacaauaaaacuaauagcaauguuauacacaccauuaagagcuaacaaugcaggcgaagauguauucacaguuucauguagaguacuaacaaggcccucaccagacuuugauuuuaucuucuuagucccuccaacagucgaaagucgaacaaaaccuuuuacuguaccaauauuaacuguagaagaaaugacaaacaguagauuucccauaccauuagaaaaacuauucacaggaccaucaucagcauucgucguucaaccacaaaacgggcgauguaccacagauggaguauuacuaggaacaacacaacuaucaccaguaaauauauguacauuuagaggugacguuacucauauagcagguucaagaaauuacacaaugaacuuagcaagcuuaaauuggaacaauuacgauccaacagaagaaauaccagcaccucuaggaacuccugauuuuguaggaaaaauacaaggaguauuaacacaaacaaccaaaggagacgguucaacaagaggacacaaagcaacaguauauaccggaucagcaccauuuacaccaaaacuaggaucaguacaauucucaacagacacagaaaacgacuuugaaacacaccaaaacacuaaauucacaccaguaggggucauacaagauggagguacuacacaucgaaaugaaccucaacaaugggucuuaccaucauacucaggaagaaauguaccaaacguacauuuagcaccagccgucgcaccaaccuucccuggagaacaauuauuauucuuuagaucaacuaugccaggauguucaggauacccaaauauggauuuagacugucuauuaccacaagaauggguacaacacuuuuaucaagaagcagcaccagcucaaucugacguugcacuacuaagauucguaaauccugacacgggacgcguucuauucgaaugcaaauuacacaaaucaggauauguaacuguagcacauacaggacaacacgaucuaguaaucccacccaaugguuauuuuagauuugauucauggguaaaucaauuuuacacacucgccccaauggguaauggaacugguagacgacgagcacuuuag

SEQ ID NO: 32072 - RNA, 1623 nt, Artificial Sequence
  derived and/or modified sequence opt6 from VP1__Norovirus__BAJ13984
augaaaauggcauccaaugaugcaaauccuagugauggaucagcagcaaaccuuguuccagaaguaaacaaugaaguaauggcauuagaaccaguuguaggugcagcaaucgcugcaccuguugcuggacaaacaaauguaaucgacccuuggauuagaaacaacuuuguacaagcacccgguggagaauuuacaguuucaccacgcaaugcuccaggugaaauauuaugguccgcuccacuuggcccagacuuaaaucccuaucuaucucacuuagcaagaauguauaauggauacgccggaggcuuugaaguacaaguaauacuagcaggaaaugcauuuacagcuggaaaaauaauauucgccgcaguuccuccuaacuuuccuacagaaggucucucaccaucacaaguuacaauguucccacacauaauaguagacguccgucaauuagaaccagucuuaauaccauuacccgauguuagaaauaacuucuaccacuauaaccaauccaaugauucuaccauaaaacucaucgcaaugcuauacaccccauuaagagccaacaaugcaggcgaagaugucuucacagucucaugucgaguauuaacaagaccaucaccagacuucgacuucauauuccuuguaccacccacaguagaaucaagaacaaaaccauucaccguacccauuuuaaccgucgaagaaaugacaaauucucgauuuccaauuccauuagaaaaacucuuuacuggaccaucaggagcauucgucguacaaccacaaaacgguagauguacaaccgauggaguacuacuagguacaacccaacuaucaccuguaaauauauguacauuucguggcgacguuacacauaucgcagguucaagaaauuacacaaugaaucuagcaucacuuaacuggaacaauuaugauccaacagaagaaauaccugcuccuuuagguaccccugauuuuguuggaaaaauccaaggaguauuaacccaaacaacaaaaggagauggaucaacacgcggacauaaagcaacaguauauacuggaucagcaccauucacaccaaaacuuggaucaguacaauuuucaaccgauaccgaaaacgacuucgaaacacaucaaaacacaaaauuuacaccaguaggaguaauacaagaugguucaacuacacacagaaaugaaccacaacaauggguccuaccaucauauucaggucgcaacguccacaauguacacuuagcaccagcaguagcaccuacauuuccaggcgaacaacuacucuucuuuagaucaacaaugccaggaugcuccggauauccaaacauggaccuagauugcuuacucccccaagaauggguccaacauuuuuaucaagaagccgcaccugcacaaucagacguagccuuacuaagauuuguuaauccagauacugguagaguauuauucgaaugcaaacuccacaaaucuggauauguaacaguagcacacacuggccagcacgauuuaguaauaccacccaauggauauuucagauucgauuccuggguaaaccaauuuuacacauuagccccaaugggcaauggaacugguagaagaagagccuuauaa

SEQ ID NO: 32073 - RNA, 1623 nt, Artificial Sequence
  derived and/or modified sequence opt6 from VP1__Norovirus__BAJ13987
augaaaauggcauccaacgacgcaaauccaucagauggaagugcagcaaaccuuguaccagaaguaaacaaugaaguaauggcacuagaaccaguuguuggcgccgccauagcagcaccuguagcuggacaaacaaacgucaucgauccauggauaagaaacaacuuuguacaagcaccaggaggcgaauuuacaguaucacccagaaaugcacccggcgaaauauuauggucugcaccuuuagguccagauuuaaauccuuaucucucacauuuagcaagaauguauaacggauacgcuggaggauucgaaguacaaguaauauuagcaggaaaugcauucacugcaggaaaaaucauauucgcugccguuccaccaaauuuuccaacugaaggacuaucaccuucccaaguuacaauguuuccacauauaauaguagauguaagacaauuagaacccguccuaauuccacucccagacguaagaaauaauuucuaccauuauaaucaaucaaacgacucaacaauaaaauuaauugcuaugcuauacacaccacuacgagcaaacaacgccggagaagauguauuuacaguaucuuguagaguacucacaagaccaucaccagacuucgauuucauauuucuaguacccccaacaguugaauccagaacuaaaccauucacaguaccaauauuaacaguagaagaaaugacaaacucacgauuucccauuccucuagaaaaacuauuuacaggucccucuggagcuuuuguaguccaaccacaaaacggacgcuguacaacagauggaguacuuuuaggaaccacacaguuauccccuguaaacauaugcacauuuagaggugauguaacacacauagcaggauccagaaauuacacuaugaaccuagcaucacuaaauuggaauaauuaugauccaacagaagaaauaccugcuccuuuaggaacaccagacuucguuggaaaaauacaaggaguacuaacacagacaacaaaaggugacgguuccacucguggccacaaagcaaccguauacacaggaucagcaccauucacuccaaaacuagguaguguacaauucucuacagauaccgaaaacgacuuugaaacccaucaaaauacaaaauucacacccguaggaguaauccaagacggaucaacuacccacagaaaugaaccccaacaauggguacuucccucauauucuggaagaaauguacacaauguacaccuagcaccugcaguagcaccaacauuccccggagaacagcuauuauucuuuagaucuacaaugccuggcugcucaggauaucccaauauggacuuagacugcuuauuaccacaagaauggguacaacauuucuaucaagaagcagcaccagcacaaucagacguugcauuacuacgauucguaaauccagauacaggaagaguacuauucgaaugcaaauuacauaaaucagguuauguaacuguagcacauacaggacaacaugauuuaguaauaccaccuaauggcuauuucagauucgauuccuggguaaaucaauucuacacauuagcaccaaugggaaacggaacaggccgaagaagagcacucuaa

SEQ ID NO: 32074 - RNA, 1623 nt, Artificial Sequence
  derived and/or modified sequence opt6 from VP1__Norovirus__BAJ13990
augaaaauggcuuccaaugacgcaucaccuucagauggaucugccgcaaaccuuguuccagaaguuaauaaugaaguaauggcacuagaaccagucguuggagcagcaauagcugcaccuguugcuggccaacaaaacguaaucgacccauggauaagaaacaauuuuguucaagcaccaggaggagaauuuaccguuagcccaagaaaugcaccaggagaaaucuuauggucagccccucucggcccagauuuaaaucccuaucuaucucauuuagcccgaauguauaacggauacgcagguggauucgaaguucaaguuauucuugcuggaaacgcauuuacagccggaaaaauaauauucgcagccguaccaccaaacuuuccaacagaaggccuuucaccaucacaagucacaauguuuccacacauuaucguugacguuagacaacuagaaccaguacuaauaccacuacccgauguuagaaacaauuuuuaccauuauaaucaaucaaaugacuccaccauaaaguuaauagcaaugcucuacacaccuuuaagagcaaacaaugcaggugaagacguauuuacuguaucuuguagaguacuaacuagacccucaccagacuucgacuucauauuucuaguaccaccaaccguagaaucacgaaccaaaccauuuacuguaccaauauuaacaguagaagaaaugacaaacuccagauuuccaauaccccuugaaaaacuuuuuacuggcccauccucagcauucguaguacaaccacaaaauggaagaugcacaacagacggaguacuacuaggcacaacucaacuaucaccagucaauauauguacauuuagaggagauguaacacacauagcuggaucuagaaacuacacuaugaaucuagcuucucuaaacuggaauaauuacgacccaacugaagaaauaccagccccacuugggaccccugacuuugucgguaaaauacaaggaguauuaacacaaacaacaaaaggagauggaucuaccagaggacauaaagcaaccguauauacaggcucagccccauuuacacccaaacuaggaucuguacaauucucaacugauaccgaaaaugacuucgaaacucaucaaaauacaaaauucacuccaguuggaguaauccaagacggaggaacaacacaucgaaaugaaccacaacaauggguucuacccucauauucaggaagaaauguaccaaauguacaucuagccccugccgucgcaccuaccuucccaggagaacaacuauuauucuuuagaucaacaaugccaggauguucuggauauccaaacauggaccucgauugucuuuuaccacaagaauggguacaacauuucuaccaagaagccgcaccagcacaaucagauguagccuuacuacgauuuguuaaccccgauacaggaaggguauuauuugaaugcaaacuccacaaaucaggauaugucacaguagcacacacuggucaacacgauuuaguaauaccuccaaacggauauuuccguuucgacucaugggucaaucaauucuauacacuagcaccuaugggaaauggaacaggaagacgacgagcauuauaa

SEQ ID NO: 32075 - RNA, 1623 nt, Artificial Sequence
  derived and/or modified sequence opt6 from VP1__Norovirus__BAJ13993
augaaaauggcaucuaaugaugcaaauccaucugauggcucagcugccaaccuaguaccagaaguaaacaaugaaguaauggcauuagaaccaguaguaggugcagcuauagcagcaccaguagcaggacaaacaaauguaaucgauccauggauacgaaacaauuucguccaagcaccuggaggagaauuuacaguuuccccaagaaaugcaccaggagaaauacuuuggucagcaccacuaggaccagauuuaaauccauaucuaagucacuuagcuagaauguauaacggcuaugcuggaggcuuugaaguucaagucauauuagcaggaaaugcauuuacagcaggaaaaauaauauucgcagcuguuccuccaaauuuuccaacagaaggauuaucaccaucacaagucaccauguuuccacacauaaucguugacguaagacaacuugaaccaguucuaauaccauuaccagauguccgaaacaauuuuuaucacuauaaccaaucuaaugacucaacaaucaaacucauagccauguuauauacaccauuacgagccaauaacgcaggggaagacguauuuaccguaagcugcagaguacuaaccagaccuucaccagacuuugacuucauauuucuaguaccaccaacugucgaaucccgcacuaaaccauucacaguaccaauauuaacaguagaagaaaugacuaacucaagauuuccaauaccacuagaaaaauuauuuacaggaccuaguggagcauucguaguccaaccacaaaacggccgaugcaccacagacggaguacuucucggaacaacccaauuaucuccuguaaauauuuguacauuucgcggagacguaacucacauagcaggaucacgaaauuauacaaugaaccuagccucacuaaacuggaauaacuacgauccaacugaagaaauccccgcaccauuaggaaccccagauuuuguaggaaaaauucaagguguacuaacacaaacaacaaaaggagauggaucaacaagaggacacaaagcuacaguauauacaggaagcgcuccauuuacaccaaaauuaggaucuguucaauuuucuacagacaccgaaaaugauuucgaaacacaucaaaauacuaaauucacucccguaggaguaauucaagacgguaguacaacacaccgaaaugaaccacaacaauggguauuacccucauauuccgguagaaauguucauaauguucaucuagcacccgcaguugcuccaacuuuuccuggugaacaacuauuauuuuuccgcucaacaaugccagguugcaguggauacccaaauauggauuuagauugccuacuaccacaagaauggguccaacauuucuaucaagaagcugcacccgcacaaucagacguugcacuacuacgcuucgucaacccagacacagguagaguauuauucgaaugcaaacuccauaaauccggauauguuacagucgcacacaccggacaacacgaucuuguaaucccaccaaacgguuauuuuagauucgacucaugggucaaccaauucuacacuuuagccccaauggguaauggcacuggcagacgaagagcccuauaa

SEQ ID NO: 32076 - RNA, 1623 nt, Artificial Sequence
  derived and/or modified sequence opt6 from VP1__Norovirus__BAJ13996
augaaaauggccucaaaugacgcaaauccaucagacggaucagcagcaaaccuuguaccugaaguaaacaaugaaguuauggcacuugaaccaguaguaggagcagcaauagcagcaccagucgcaggacaacaaaacguuauagauccauggauacgaaauaacuuuguacaagcaccuggaggagaguucacaguaucuccuagaaaugcuccaggagaaauucuauggucagccccucuagguccagaucuaaacccauaucuuucucaucuagcacgaauguauaacgguuacgcaggcggguucgaaguacaaguaauacuagcaggcaaugcauuuacagcaggaaaaauaauuuucgcagcaguaccacccaauuuuccuacagaaggauuaucaccaagucaaguuaccauguucccucacauaauaguagacguacgacaacuagaacccguauuaauuccacuuccugauguacgaaauaauuuuuaucacuacaaccaaucaaaugacucaacuauaaaacuuauagcaauguuauacacaccacuaagagcaaauaaugcaggagaagauguauucacaguuaguuguagaguuuuaacuagaccaucaccagacuuugacuuuauauuucuaguaccuccaacagucgaaucaagaacaaaaccauucaccguuccaauauuaacugucgaagaaaugacaaacucuagauuccccaucccacuagaaaaacucuucacuggaccuucaucagcauuuguaguucaaccacaaaauggacgcugcacaacagaugguguauuacugggaacaacacaauuaucaccagucaacauuuguacauuuagaggagacguaacccacauagcaggaucaagaaauuacacaaugaaucucgcaucacuaaauuggaacaacuacgaucccacagaagaaaucccagcaccacuaggaacaccagacuucguaggaaaaauacaaggaguacuaacccaaaccacaaaaggagaugguucaacaagaggacacaaagccacaguauauacaggaucagcaccuuucacaccuaaauuaggaagcguacaauucucuacagauacagaaaacgacuucgaaacacaccaaaacaccaaauucaccccaguuggaguuauacaagacggagguacaacacaccgcaacgaaccucaacaauggguacuaccaucauauucaggaagaaauguucaaaacguacauuuagccccagcuguagccccaacauuuccaggagaacaauuacuuuucuuucgcaguacaaugcccggaugcucaggauacccaaauauggaccuagauugccuauuaccacaagaauggguucaacacuuuuaccaagaagcagcuccagcacaaucagacguugcacuucuccgcuucguuaacccagauacuggccgaguacucuuugaaugcaaacuacauaaaucaggauauguuacugucgcacacacaggacaacaugauuuaguaauacccccuaauggauauuucagauuugauuccuggguaaaucaauuuuacacuuuagcaccaaugggaaacggcacaggaagaagacgagccuuauaa

SEQ ID NO: 32077 - RNA, 1623 nt, Artificial Sequence
  derived and/or modified sequence opt6 from VP1__Norovirus__BAJ13999
augaaaauggcaucaucagacgcaaacccauccgacggcucagcagcaaauuuaguuccagaaguaaauaaugaaguaauggcacuagaaccaguugucggugccgcaauugcugcaccaguagcaggacaacaaaacguaauagauccauggaucagaaacaauuuuguucaagcaccugguggagaauuuaccguuuccccuagaaacgccccuggcgaaauauuauggucagcaccuuuggguccagaccuaaacccuuaucuuucacaccuagcaagaauguauaacggauacgcagguggauucgaaguacaaguaauucuagcaggaaaugcauuuacugcagguaaaauuauuuucgcagcagucccaccaaacuucccaacagaaggacuaucaccuucacaaguaacaauguucccacacauuauaguagacguaagacaauuagaaccaguacuaauaccauuaccagauguaagaaauaauuucuaucauuauaaccaaucaaacgacucaacuaucaaauuaauagcaauguuauacacaccccuaagagcaaauaaugcaggagaagacguauucacaguaucaugucgcguucuaacuagaccuagcccagacuuugacuucauauuuuuaguaccaccaacagucgaaucuagaacaaaaccauuuacaguaccaauacuaacuguagaagaaaugacaaacucuagauucccaauaccacuugaaaaacuauuuacaggccccucaggagcauuuguaguucaaccacaaaacggaagauguaccacugacggaguauuacucggaacaacacaauuauccccaguuaacauaugcaccuuuagaggcgacguuacucauauagcaggcucaagaaacuacacaaugaauuuagcaucacuuaacuggaacaauuaugauccuacagaagaaauacccgcuccccuaggaaccccagacuuuguagguaaaauacaaggaaugcuaacacaaacgacaaaaggagauggcucaacaagaggacacaaggcaacagucuacacaggaucagcacccuuuacaccaaaauuaggaucaguccaauucucaacagacacagaaaacgauuucgaaacacaucaaaauacaaaauucacaccuguaggaguaauccaagauggauccaccacacaccgcaaugaaccacaacaauggguauuacccucuuauucaggacgugauguacacaauguucauuuagcaccugcaguagcaccuacuuuccccggagaacaacucuuauuuuucagaucuacaaugccaggauguucaggcuaucccaauauggauuuagacugucuacuaccacaagaauggguacaacauuuuuaucaagaagcagccccugcacaaucugauguagcuuuauuacguuuugucaacccagacaccggcagaguuuuauucgaaugcaaacuacacaaaucaggauauguaacuguagcacauacaggacaacaugauuuaguaauaccaccaaauggauacuucagauuugauucuugggucaaucaauucuacacauuagcaccaaugggaaacggaacuggaagaagacgagcacuauaa

SEQ ID NO: 32078 - RNA, 1623 nt, Artificial Sequence
  derived and/or modified sequence opt6 from VP1__Norovirus__BAJ14002
augaaaauggcaucaaaugaugcuaauccauccgacggaucagcagcuaauuuagucccagaaguaaauaacgaaguaauggcacuagaaccaguaguaggagcagcaauagccgcaccaguagcuggacaacaaaacguaauagacccauggauaagaaacaacuuuguucaagcaccaggaggagaauuuacaguaucaccaagaaaugcaccaggagaaauuuuauggucagccccauuaggaccagauuuaaauccauaucuaucacaucuugcaagaauguacaacggauaugcaggagguuucgaaguacaagucauucuagcaggcaaugccuuuacagcuggcaaaaucauauuugcagcaguaccuccaaauuuuccaacagaaggacuaucaccaucacaaguuacaauguuuccacacauaaucguagacgucagacaauuagaaccuguccuuauuccacuaccagacguaagaaacaauuuuuaucauuauaaucaaucaaaugacucaacaauuaaauuaauugcuauguuauacacaccacuuagagcaaacaaugcaggagaggauguuuuuacaguaucaugccgcgucuuaacuagaccaucucccgauuuugacuucauauuucuaguaccaccaaccguagaaucaagaacaaaaccauuuacaguaccaauauuaacuguugaagagaugacuaacucuagauucccuauaccauuagaaaaacuauucacuggaccaucuucagcauucguaguacaaccccaaaaugguagauguacuacagaugguguauuacuaggaacaacucaacuuucccccguaaauauaugcacauucagaggugauguaacacacauagcuggaucaagaaauuacacuaugaauuuagcaucauuaaauuggaacaauuaugaccccacugaagaaauaccagccccauuaggaaccccagauuuugucggaaaaauacaagguguacucacacaaacaacaaaaggagacggauccacacgaggucacaaagcuacagucuacacaggaucagcaccauuuacuccaaaauuagguucaguacaauucucuacagauacagaaaacgauuucgaaacacaucaaaacacaaaauucaccccagucggugucauccaagauggaggaacaacccauagaaaugaaccucaacaauggguacuaccaucauacucaggacgaaauguccaaaacguacauuuagcaccagcaguagcaccaacauucccuggagaacaacuauuauuuuuuagauccacaaugccuggaugcucugguuacccaaauauggaucucgauuguuuacucccucaagaauggguacaacauuucuaucaagaagcagcaccugcccaauccgacguagcucuacuuagauuuguaaacccagauacagguagaguauuauucgaaugcaaacuacauaaaucaggauauguuacaguagcucauacaggacaacacgacuuaguaauuccuccaaacggauauuucagauuugauucauggguaaaucaauuuuacacacuagccccaaugggaaaugguacagguagaagaagagcacuauga

SEQ ID NO: 32079 - RNA, 1623 nt, Artificial Sequence
  derived and/or modified sequence opt6 from VP1__Norovirus__BAJ14005
augaaaauggccucaaaugaugcaaacccauccgauggcucagcagccaauuuaguaccugaaguaaacaaugaagucauggcuuuagaaccaguagucggugcagcuauagcagccccaguagccggacaacaaaacguuauagauccauggauaagaaauaacuucguacaagcaccuggaggggaauuuacaguaucaccaagaaaugcaccaggcgaaauacuauggagugcacccuuaggcccagaccuaaaucccuaucucucacacuuagcaagaauguauaacggauaugcaggaggauuugaaguccaaguaauacuagcuggaaaugcauucacagcagguaaaauaauuuucgccgccgucccaccuaacuucccuacugaaggacuaucaccaucccaaguaacaauguucccucacauaauaguagacguucgacaacucgaaccuguacucauaccccucccagacguaagaaauaauuucuaucauuacaaccaaucaaacgauucaacaauaaaacucauagccaugcuauacacacccuuacgagcaaacaaugcaggagaagauguauuuaccguaucauguagaguacuaacacgaccaucacccgauuuugauuuuauauuuuuaguuccaccaacaguugaaaguagaaccaaaccauucacaguucucauuuuaacaguugaagaaaugacaaacucacgcuuucccauaccccuugaaaaauuauucacaggaccaucuucagccuucgucguacaaccacaaaacggcagauguacuacagauggaguccuauuaggaacaacgcaauuaucuccaguaaacauauguacauuucgaggagauguaacacauauagcaggaucaagaaacuacacaaugaaucuagcaucacuaaauuggaacaauuacgauccuacagaagaaauaccugcaccacuaggaacaccagauuuuguagguaaaauacaaggcguccuaacacaaaccaccaaaggagacggaucaacaagaggacacaaagcaacaguauauaccggaagugcaccauucacaccaaaauuagguucaguucaauucucaacagauacagaaaacgauuucgaaauccaucaaaacacuaaauucaccccaguaggaguuauacaagauggaucaacaacacaccgaaaugaaccucaacaauggguacuaccaucauauucagguagaaacguccauaauguacacuuagcuccagcaguagcaccaacauucccaggcgaacaauuauuauuuuuuagaucaacaaugccagguugcucuggauacccuaauauggaucuagauuguuuauuaccccaagaaugggugcaacauuucuaucaagaagccgcacccgcucaaucagaugucgcuuuauuacgauucgucaacccagacacaggcagaguauuauucgaaugcaaacuccacaaaucaggauacguaaccguagcauacacuggacaacaugauuuaguaauaccaccaaauggauacuucagauucgauucuuggguaaaucaauuuuacacuuuagccccaaugggaaauggaacaggcagaagaagagcacuauaa

SEQ ID NO: 32080 - RNA, 1623 nt, Artificial Sequence
  derived and/or modified sequence opt6 from VP1__Norovirus__BAJ14008
augaaaauggcaucuaaugacgcaaacccuucagauggaucagcagcuaauuugguaccugaaguaaauaaugaaguaauggcauuagaaccaguuguaggagccgcuaucgcagcaccaguagcaggacaaacaaauguaauagauccauggauuagaaauaauuucguacaagcaccgggaggagaauucacaguaucuccuagaaaugccccaggagaaauucuauggagugcaccacuaggaccugaucuaaacccauaccuaucacacuuagccagaauguauaacgguuaugccggaggauuugaaguacaaguaauauuagcuggaaaugcuuucacagcuggaaaaaucauauuugcagcaguaccaccaaacuucccaacugaaggacuaucucccucucaaguaacaauguucccacacauaauuguagacguaagacaauuagaaccaguucuaaucccacuaccagauguaagaaacaacuucuaccacuacaaucaaaguaacgauucaaccauuaaacuuauagcuaugcuuuacacuccacuccgagcaaacaaugcaggagaagaugucuuuacaguaucuuguagaguucuaacacgcccuucaccugacuucgauuucauauuuuuaguaccucccacugucgaaucaagaacuaaacccuucacaguaccuguacuaacaguugaagaaaugaccaacagucgauuuccaauucccuuagaaaaauuauuuacagguccaucaggggccuucguaguucaaccacaaaauggaagaugcaccacugacggaguauuauuagguacaacacaacuaaguccaguaaacauauguacauuuagaggagacguaacacauauagcuggauccagaaauuauaccaugaaucuagcuucacuuaacuggaacaauuacgauccaacagaagaaauaccagcaccuuuaggaacaccugacuuuguaggaaaaauccaaggaguacuaacacaaacaacaaaaggagacgguuccacucgaggacacaaagcaacuguauacaccgguucugcacccuucacaccaaaacuuggaucaguacaauucucaacagacacagaaaaugauuucgaaacacaucaaaacaccaaauucacacccguagguguaauacaagacgguuccacaacacacagaaaugaaccacaacaauggguauuaccuucauauucaggcagaaauguacauaacguacaccuagcaccugcuguagcaccuacauuuccaggagaacaacucuuauuuuuccgaucaacgaugccaggauguucaggauauccuaacauggauuuagauugccuacuaccucaagaauggguucaacauuuuuaucaagaagccgcuccagcucaaucugaaguugcucuauuaagauucguuaaccccgauacaggacgaguauuauucgaaugcaaauuacauaaaucaggauacguaacuguagcccauaccggacaacaugacuuagucauacccccuaauggauacuuccgauuugacucauggguaaaucaauuuuacacacuagcaccaauggguaauggaacaggaagaagacgagcauuauaa

SEQ ID NO: 32081 - RNA, 1623 nt, Artificial Sequence
  derived and/or modified sequence opt6 from VP1__Norovirus__BAJ14011
augaaaauggcaucaaaugacgcaaauccuucugacggcucagcagcaaaucucguaccugaaguaaacaaugaaguaauggcacucgaaccuguuguaggagcagcaauagcagcaccaguagcaggacaacaaaauguaauagacccauggauucgaaacaauuuuguccaagccccaggaggugaauucacaguaucuccacgaaaugcaccaggcgaaauauuauggucugcaccuuuaggaccagacuuaaacccauaucuaucacacuuagcacgaauguauaacggauaugcaggagguuuugaaguacaaguuauauuagcagguaacgcauucacagcaggaaaaaucauauuugccgcaguuccuccuaacuuuccuacagaaggacuauccccaucacaaguuacuauguucccacauauaauaguugacguacgacaauuagaacccguuuuaauuccauuaccagauguccguaauaacuucuaucacuauaaccaaucaaaugacucaacaauuaaauuaaucgcaaugcuauacacuccacuaagagcuaauaaugcaggagaagauguauuuacuguaucaugucgaguacuaaccagaccaucaccagacuuugacuucauauuucuaguaccaccaacaguagaaucaagaacuaaaccauucacagucccaaucuuaacaguagaagaaaugacaaacucucgauuuccuauaccauuagaaaaacuauucacaggaccaucuucagcuuucguaguacaaccucaaaauggucgauguaccacagacggaguuuuacuuggaacaacucaauuauccccuguaaacauauguacauuuagaggagacguaacacauaucgcaggaucaagaaauuacacuaugaaccuugcaucccuaaacuggaauaauuaugauccaaccgaagaaauaccagcuccucuaggaacaccagacuucgucggaaaaauccaaggaguucuuacacaaacaacaaaaggagauggaucaacaagaggacacaaagcaacaguuuauacaggaucagcuccuuuuacaccaaaacuuggaucuguacaauuuagcaccgacacagaaaacgauuuugaaauacaccaaaauacaaaauucacuccuguaggcguuauacaagacggauccacaacacauagaaacgaaccacaacaauggguacuaccaucauauagcggcagaaauguacauaauguucaccucgcaccggccguagcuccaacauuuccaggagaacaacucuuauucuucagaucuacaaugccaggaugcucagguuauccgaacauggaucuagacuguuuauuaccacaagaauggguacaacauuucuaccaagaagcagcaccagcacaaucagacgucgcauuacuuagauucgucaaucccgauacaggacguguacuauuugaauguaaacuacauaaaucuggauauguaacaguagcauauacaggucaacacgaccuaguuaucccaccaaaugguuauuuuagauuugauagcuggguaaaucaauuuuacacucuagcuccuaugggaaauggaacaggacgucgaagagcucucuaa

SEQ ID NO: 32082 - RNA, 1623 nt, Artificial Sequence
  derived and/or modified sequence opt6 from VP1__Norovirus__BAJ14014
augaaaauggcaucaaaugacgcuaacccuucagacggaucagcagcaaaccuaguaccagaaguaaauaaugaaguuauggcccuagaacccguaguaggagccgccauagcagcaccagucgcuggacaaaccaauguuauagauccuuggauucgaaacaacuuuguccaagcaccuggaggugaauucacaguaucaccccgaaacgcaccaggagaaauacucuggucagccccacuaggaccagaucuaaacccauacuuaucacauuuagcaagaauguauaacggauacgcuggaggauuugaaguacaaguaaucuuagcuggcaacgccuuuacagcaggaaaaaucauauucgccgcaguaccaccaaacuucccaacugaaggccuaucuccaucacaaguaaccauguuuccacauaucaucguugacguaagacaacuagaaccaguacuaauaccauuaccagauguaagaaacaauuucuaucacuauaaccaaagcaacgauucaacaauaaaacuaauagcaaugcuauacacaccacuuagagccaacaaugcaggagaagacguuuucacaguauccuguagaguacuaacaagaccaucacccgacuuugacuucauauucuuaguuccaccaaccguagaaagccgaacuaaaccauuuacagucccaauucuaacaguagaagaaaugaccaauucaagauucccaaucccuuuagaaaaacuauuuacaggaccaucaggagcuuucguaguacaaccccaaaauggacguugcacuacagacgguguuuuacuagguacuacucaauuaucaccaguuaauauaugcacauuuagaggagauguuacacauauagcaggaucuagaaacuacacaaugaaucuugcaucauuaaacuggaauaauuacgacccaacagaagaaaucccagcaccccuaggaacaccugauuuuguaggaaaaauacaaggaguuuuaacacaaacaacaaaaggugaugggucaacacguggacacaaagcuacaguauauacaggaagugcaccauucacaccuaaauuaggcucaguccaauuuucaaccgacacugaaaacgacuucgaaacucaucaaaauacaaaauucacuccaguuggaguaauacaagauggaucaacaacacaucguaaugaaccacaacaauggguacuuccuucauacucuggaagaaacguacacaauguacacuuagccccagccguagcaccuacauucccaggagaacaguuauuauuuuuucgaucaaccaugccaggaugcucaggauauccaaauauggaucuagauugucuacuaccacaagaauggguacaacacuuuuaccaagaagccgccccagcucaaucagacguagcuuuauuaagauuuguuaacccagauacaggcagaguauuauucgaaugcaaacuacauaaaucaggauauguaacaguagcacauacaggacaacacgaucucguaaucccuccaaacggauacuuccgcuuugacucauggguaaaucaauuuuacacuuuagcaccuaugggcaaugguacaggacgucgucgagcauuauaa

SEQ ID NO: 32083 - RNA, 1623 nt, Artificial Sequence
  derived and/or modified sequence opt6 from VP1__Norovirus__BAK43269
auggcaucuaaugaugcagcaccaucaaccgauggagcugcuggccuugucccagaaucaaacaaugaaguuauggcuuuagaacccguagccggagcugcgcucgcagcaccuguuacaggacaaacaaacaucauagauccuuggauaagagcaaauuucguccaagcuccuaauggagaauuuacaguauccccaagaaaugcaccaggagaaguacuauuaaaucuagaauuaggaccugaauugaacccauaccucgcacaccuagcacgucuauauaaugguuaugcagguggaauggaaguacaaguaauguuggccggaaaugcauuuacagcaggaaaacuaguauuuccagcuguaccaccucauuucccuauugaaaaucuuagcccccaacaaauuacuauguuuccccacguaauaauugaugucagaacauuagaaccgguacuacuaccacuaccagauguaagaaauaacuucuuucauuauaaucaaaaagaugacccuaaaaugagaauaguugccauguuauacacaccauuaagaaguaaugguucuggagaugacguuuuuacaguaucaugccgaguacuuacacgaccaucucccgauuuugauuucacuuaucuuguaccaccaacaguagaaucuaaaacaaaaccauucacacuucccauccuaacacuaggagaauuaucaaauucuagauucccaguuucaaucgaccaaauguauacauccccuaaugaaguaaucucaguacaaugucaaaauggaagauguacuuuagacggagaauuacaaggaacaacacaacuucaaguuucaggaauaugugcauuuaaaggugaaguuaccgcacaccuacaugauaacgaucauuuguauaacauaacgauaacaaaucuaaauggaucaccuuuugauccauccgaagacauuccagcaccacuagguguaccagauuuucaaggacgaguauuuggaauuauuucacagagagacaaacauaauucaccaggccauaaugaaccagcaaacagagggcacgacgcaguaguaccaacauauacagcacaauacacaccaaaacuaggccaaauucaaauagguacuuggcaaacagacgauuuaacaguaucccaaccaguaaaauuuacaccuguaggauuaaaugauauagaacauuuuaaucaauggguaguuccaagauaugcaggagcauuaaaucuaaacacaaauuuagcuccauccguagcuccaguauucccuggagaaagacuuuuauucuuuagauccuauauacccuuaaaaggaggauaugguaacccugcuaucgauugccuauuaccucaagaauggguucaacacuuuuaucaagaagcugcaccaucaaugucugaagucgcucuaguacgauauauaaauccagauacuggaagagcauuauucgaagcaaaauuacauagagccggauuuaugaccguaucuucaaacacaagugcaccaguagucguacccgcaaacggauauuuuagauucgauucauggguaaaucaauuuuauuccuuagcaccuaugggaacaggaaauggccgaagaagaguacaauaa

SEQ ID NO: 32084 - RNA, 1623 nt, Artificial Sequence
  derived and/or modified sequence opt6 from VP1__Norovirus__BAK43272
augaaaauggccucuaaugacgcaaacccauccgauggaagcgccgcaaacuuaguaccagaaguaaacaaugaaguaauggcauuagaaccuguagucggugcagcaauagccgcaccagucgcuggacaacaaaauguuaucgacccuuggauaagaaauaacuuuguacaagcaccuggaggagaauuuacaguuucuccaagaaaugcacccggugaaauacuauggucagcaccacucggacccgacuuaaauccauauuuaucucaccuagcacgaauguauaacggauacgcagguggauuugaaguacaaguaauauuagcaggaaaugcauuuacagcuggcaaaauaauuuucgcagcaguacccccuaauuuuccaacagaaggauuaaguccaucccaaguaacuauguuuccacauauaauuguagauguaagacaauuagaaccaguuuuaauuccauuaccagacguacguaacaacuucuaccacuauaaccaaucaaaugacucuaccaucaaauuaauagcuaugcuauauacaccauuaagagcuaauaaugcaggagaagauguauucacaguaucaugucgaguccuaacaagaccaucaccagauuuugacuuuauauuucuaguuccaccuaccguagaaaguagaacaaaacccuucacugugccaaucuuaaccguagaagaaaugacaaauagccguuucccaaucccuuuagaaaaacuauuuacugguccauccuccgcauucguaguacagccacaaaauggacgaugcaccacagacggaguuuuacuaggaaccacucaauuaucuccaguaaacauaugcacauuuagaggcgauguaacccauauagcaggaucacgaaacuacacaaugaauuuagcaucucuuaacuggaauaacuaugauccaacagaggaaauaccagcaccacuagguacacccgacuucgucggaaaaauacaaggaguacuaacacaaacaacaaaaggagauggaucaacaagaggccacaaagcaacaguuuauacaggcucagcaccuuuuaccccaaaacuagguucaguacaauucuccacugauacacaaaaugauuuugaaacacaucaaaauacaaaauuuacuccuguaggagucauccaagacggaggaacaacucauagaaaugaaccacaacaauggguauuaccauccuauagcggacgcaauguaccuaauguacauuuagcuccagcaguagcaccaacauuucccggagaacaauuauuauucuuuagauccacaaugccaggauguucuggauauccaaauauggauuuagauugcuuacuaccacaagaauggguucaacacuucuaccaagaagcagcaccagcacaaagcgacguagcucuccuccguuuuguaaauccagacacuggaagaguauuauuugaaugcaaacuacauaaaucacguuacgugacagucgcacauaccggacaacacgaucuaguaauaccaccaaacggauauuucagauucgauucauggguaaaucaauucuauaccuuagcuccaaugggaaaugguacaggaagaagaagagccuuauaa

SEQ ID NO: 32085 - RNA, 1647 nt, Artificial Sequence
  derived and/or modified sequence opt6 from VP1__Norovirus__BAK43275
augaaaauggcuucuaaugaugcagccccuuccaaugauggggcagcaggacuaguuccagaaauaaauaacgaagcaauggcauuagaaccaguugcuggagcagcaauagcagcaccauuaacuggccaacaaaauauaauugauccauggauaaugaacaacuuuguacaagcuccaggaggagaauuuacuguaucuccucgaaauucaccaggagaaguacuauuaaauuuagaacuagguccugaaauaaauccauacuuagcacaccuugcccgaauguauaacggauacgcaggaggauuugaaguacaaguagucuuagcaggcaacgccuuuaccgcagguaaaauaauauuugcagcuauaccccccaacuuuccaauagauaauuuaucagcagcucaaauaacaauguguccacaugucauaguagacguacgucaauuagaaccuguaaaucuaccaaugcccgacguacgaaacaauuuuuuccauuacaaccaaggaucagauucuagacuacgauuaguugcaaugcuauacacuccauuaagagcaaauaauucaggcgacgauguauuuacaguuucaugucgcguauuaacacgaccauccccagauuucuccuuuaauuuucuagucccuccaacaguagaaucaaaaacaaaaccuuucacauuaccaauauuaacuauaucagaaaugucuaacucaagauuccccguaccaauagauucacuacacacaucuccaaccgaaaauauaguaguacaaugccaaaauggcagaguaacccucgauggugaacuaaugggaacaacacaacuauuaccaagucagauaugcgccuuuagaggaguacuaaccagaucaaccaguagagcaagugaccaagcagacacagcaacaccaagauuauuuaacuauuacuggcauauucaacuagcuaaccuaaauggcaccccuuacgauccagcagaagauauaccagguccauuaggaacaccagauuuccguggcaaaguuuuuggaguugcaugucaacgaaauccagacuguacaacaagagcacacgaagcaaaaguagacacuacugcaggaagauuuacacccaaauuagguucauuagaaauuucaacagaaagcggugauuucgaucaaaaucaaccaacccgauuuacaccaguugguauagguguagaucaugaagcagauuuucaacaauggucacuaccagacuacucuggucaguuuacccauaacaugaacuuagcaccagcuguagcaccaaauuuucccggagaacaauuauuauuuuuuagaagucaauuacccuccucaggcggacgcagcaauggaauauuagauugcuuagucccucaagaauggguacaacacuuuuaucaagaaucagcaccagcacaaacucaaguagcauuagucagauauguaaaccccgauaccgguagaguacuauucgaagcuaaacuccauaaauuaggauuuaugacaauagccaaaaacggagauucaccaauaacagucccaccuaauggauauuuuagauucgaaucauggguuaaccccuuuuacacucuagcaccaauggguacaggaaaugguagacgaagaauccaauaa

SEQ ID NO: 32086 - RNA, 1623 nt, Artificial Sequence
  derived and/or modified sequence opt6 from VP1__Norovirus__BAK43278
augaaaauggcaagcagcgacgcaaacccuucagauggaucuaccgccaaucuaguuccagaaguaaauaaugaaguaauggcacuugaaccuguaguaggagcugcaauagcugcaccuguugcuggacaacaaaauguaaucgacccuuggauaagaaacaacuuuguccaagcccccggaggagaauuuacuguaucaccuagaaacgcacccggcgaaauacuauggucagcaccacucggacccgaucuaaauccauaucucucacaccuugcaagaauguauaacgguuaugcuggaggauucgaaguucaaguaauacuagcaggaaaugcuuuuacugcuggcaaaauaauauucgcagcaguaccaccaaacuuuccaacugaaggccucucucccucacaaguaacaauguucccacacauuaucguagacgucagacaauuagaacccguucuaaucccucuaccagauguaagaaauaauuucuaucacuacaaccaaucaaaugacccuacaaucaaauuaauagcaauguuauacaccccccuaagagcaaacaaugccggugaugaugucuuuacaguuuccugucgaguacuaaccagaccauccccugacuuugacuucauauuccuaguuccaccuaccguagaauccagaacaaaaccauucucuguuccaguuuuaacaguugaagaaaugaccaauucaagauuucccauaccauuagaaaaauuauucacaggcccaucauccgcuuucguaguacaaccacaaaacgggcguuguacaacagauggaguucuccuuggaaccacucaacuaucaccaguaaacauauguacuuuucguggagacguaacacacauaucaggaucaagaaauuacaccaugaauuuagcuagucaaaacuggaauucauaugauccuaccgaagaaauaccugcaccauuaggaacuccugauuuugucggaaaaauucaagguguacuuacccaaacaacaagaacaaauggaucaacuagaggacauaaagcaaccguauauacaggaucagcagauuuuucaccuaaguuaggaagaguacaauucgcaacagacacagacaaugauuucgaaacaaaccaaaauacaaaauuuaccccaguaggaguaauccaagacggcucuacaacacccagaaaugaaccacaacaauggguauuaccuucuuauucaggacgaaauacacauaacguacaccuugcuccagccguagcaccgaccuuuccuggcgaacaauuauuauucuuuagaucuacaaugccaggaugcagcggauauccaaauauggaucuagauugcuuauuaccucaagaauggguacaauauuuuuaucaagaagcagcaccugcacaaucugacgucgcauuauuacgauuuguaaauccagacacuggaagagucuuauuugaauguaaacuacacaaaucuucauauguaaccguagcacacaccggucaacacgaucucguuaucccaccuaacggcuacuuucgauuugauuccuggguaaaucaauuuuauacacuugcaccuaugggaaauggaacuggaagaagacacgcacuuuaa

SEQ ID NO: 32087 - RNA, 1623 nt, Artificial Sequence
  derived and/or modified sequence opt6 from VP1__Norovirus__BAK43284
auggcaucaaaugaugccgcaccaucaaccgauggcgcagcaggauuaguuccugaaaguaauaaugaaguaauggcccuugaaccaguugcaggugcagcccuagcagcaccaguaacaggccaaacaaauauaauagauccauggauaagagcuaauuucguucaagcaccaaacggagaauuuacuguaucaccacgaaaugcaccuggagaagucuuauuaucuuuagaauuaggcccagaauuaaacccauacuuagcacauuuagcaagaauguacaauggcuaugcaggaggaauggaaguacaaguaaugcuugcaggcaaugcauucacagcagguaaacuaguauucgcagcaguuccuccacacuuuccaguugaaaaccuaucaccacaacaaauuaccauguucccacaugucauaauagacguacgcacacuagaacccguucuacucccauuaccugauguaagaaauaacuucuuucauuauaaucaaaaagaugaucccaaaaugagaauaguagccauguuauauacaccacuaagaagcaaugguucuggagacgacguauuuacaguuucauguagaguauuaacaagaccaucaccagauuuugacuucacauaucuaguaccaccaacuguagaaucuaaaaccaaaccuuuuacauuaccaauauuaacacuaggagaauuaaguaacagucguuuuacuguauccauagaccaaauguauacaucauuaaaugaagucauaucaguacaaugucagaauggacgaugcacuuuagauggagaauuaagaggaacaacacagcuccaaguuucaggcauuugcgcuuuuaaaggagaaguaacugcucauguacaugacaaugaucaucuauacaauguaacaauaacuaacuuaaauggaucaccauuugaucccucagaagacguuccagcaccacuagguguacccgacuuucaagggagaguauuugguauuauaucucaaagagauaaacacaauucuccaggucauaacgaaccugcuaauagaggccaugaugcaguaguaccuacauauacagcacaauauacacccaaacucggacaaauucaaauaggaacuuggcaaacagaugaucuuacaguaaaucaaccaguaaaauuuacaccagucgguuuaaaugauacagaacauuucaaucaauggguagucccuagauacgcaggagcauuaaacuuaaauacaaaucucgcaccaucagucgcaccagucuuuccaggagaaagacuacuauucuuuagaucuuauguuccauuaaaaggugguuaugguaacccagccauugauugccuauuaccacaagaauggguccaacauuuuuaccaagaagcugcuccauccaugucagaaguugcacuaguaagauacauuaacccagacacaggaagagcacucuuugaagcaaaauuacauagagcaggcuuuaugacuguaucaucaaacacuagugcaccagucgucguuccagcaaauggauauuucagauuugauagcuggguuaaccaauuuuacagccuagcaccuaugggaaccgguaauggcagacguagaguacaauaa

SEQ ID NO: 32088 - RNA, 1644 nt, Artificial Sequence
  derived and/or modified sequence opt6 from VP1__Norovirus__BAL14785
augaaaauggcaucaaaugaugcagcaccaucuaacgacggagcagcaaaucucguaccagaagcaaauaaugaaguuauggcacuugaacccguaguuggagcuuccauugcagcaccuguuguaggucaacagaacauaaucgauccauggauaagagaaaauuuuguccaagccccacaaggcgaauucacagucagccccagaaauucaccaggagaaaugcuuuuaaaccuagaacuagguccugaacuaaacccauacuuaucacauuuaucaagaauguauaacggcuaugcugguggaaugcaaguacaagucguauuggcaggaaacgcuuuuacagcaggaaaaauaauuuuugcagccguaccaccacacuucccagucgaaaauauuucagcagcacaaaucaccauguguccucauguuauuguagacguccgacaacuagaaccaguauuauuaccccuaccugacauaagaaauagauucuuucauuauaaccaagaaaauacaccaagaaugagauuaguagcaaugcucuauacucccuuacgagcaaacucaggagaagauguauuuacuguuucaugucgcguacuaacccgcccugcaccagauuuugaauuuaccuuuuuaguuccacccacaguagaaucaaaaacgaaaccauucacauuaccaauauuaacauuaggagaacuaucuaauucuagauuuccugcacccauagauaugcuauauacagauccaaaugaagguauaguuguacaaccacaaaauggaagauguacucuagacggaacccuacaaggaacuacacaacuaguaccaacacaaauaugugcuuuuagaggaacacuuauaggacaaacauccagaagcucugacucaacggacuccgcuccaagaagaagagaucacccccuccauguacaacuaaaaaaucuugacgguacacaauaugauccuacagaugaaguaccagcaguauuaggagcaauagauuuuaaaggaacagucuuuggaguagcaucucaacgagauguaucaggacaacaaguaggagcaacuagagcacaugaaguacacauaucaacaacugauccaagauauacuccaaaacuaggaucaauacuaaugagaucagaaucagaugauuucguaacaggacaaccagucagauucacaccuauaggaaugggagacaaugacuggcaucaaugggaauuaccugacuauaguggucacuuaacacuuaacaugaauuuagccccagcaguugcaccagcauuuccaggagaaagaauacuauuuuucagaucuaugguacccucugcagguggcuaugguucaggacaaauagauugucuaauaccacaagaauggguacaacauuuuuaccaagaggcagcccccucacaaucugcaguagcacuuauaagauacgucaacccagacacaggacguaacauuuucgaagcuaaacuacaccgcgaaggauucauaacaguagcaaacucuggaaacaauccuauaguaguaccaccaaauggauauuuuagauuugaagcauggguuaaccaauuuuauacauuaacuccaaugggaacuggccaaggacgccgacgcaaccaauaa

SEQ ID NO: 32089 - RNA, 1749 nt, Artificial Sequence
  derived and/or modified sequence opt6 from VP1__Norovirus__BAR88157
augaaaauggcuuccucagaugcagcuucuccaucaucagacggagccgcaaacuuaguuccugaaauaaauaaugaaguaauggcacuugaaccaguagcaggugcacaacuagcugcuccaguugcagaccaauuuaacgcaauagaccccuggauaagacaaaauuuuguacaagcucccgaaggagaauucacaguauccccuagaaaugcaccaggagaaauucuuuuaaauuuagaacuaggcccacacuuaaauccauuccuacaacauuuagcccaaauguauaaugcauacgcugguggaauggaaguucaaguuguacuagccggaaacgccuuuacagcaggaaaaauaauauuugcagcaauaccuccucacuuccccccagaaaggcuauccgcugcacaagccacgcaauucccgcauguuauuauugacguacgccaauuagaaccaauaguccuaccuuuaccagacguaagacauaaucuuuuccauuucaaccaacaaaaugacgaaagaaugagauuaguggcuuuuuuauauacaccccuuagagcuaauucagguaguggagaugacguauucaccguaucaugucgaguacuaacaagaccaucaccugacuuugaauucauguuucuaguuccaccaacaguagaaaggaaaacaguggcauuuucucuaccacaacuaaccguuggugaaaugucaaauucaagauggccagcaagaauuacuacaaugauagcagacccacaucuaccacaaguacuaagaauccaaaauggucgauguacauuagacggaacacuuaugggaaccacccaauuaaauccaaaugauauaugcagaguaagaggauauuucagcaauagcagaccacaaguuaugugugaaggagaagaugaugcauuagaucaagcauccuuaggcgcagaaccaauaagagaucaagcaccaggauuacgaacacaagcaagauccacagaaaggugguuugcaguaacagaacucaauggacaagcauaugacccauuuggagaccagcccgcuccauuaggaguacccgauuuugaggccagaauaguaggagcuuuagucagacuacccggaacaaauccaacaucuaauucaagauuugaagacgccuggauugacacaaauaaccaaaccacuuaugcuccugccgccgguaugguagcgaucacuacaucagaugauucaucauccaauuaugccaaugaucaaguaugugaguuucuaccauuaggcguagacauaacaaauucaacgcccuauaacgaauuugaucuaccuucauacgguggaucagcaucuucaggaaauagaaaucuugcaccaacaguagcaccaacauuuccaggagaaauaguacuacuauuugggucaaauaugccuguacaaaauagaagcgcaggaacuucaaauaaagaaauaagaugcuuacuuccuaaugaguauauucaacacuuauacgauacacaagcuccaucauuaagugauguagcuuuaguaagauauaucaacccagauacaggaagaguacucuuugaagcuaaacuucacagagauggauucaugacaguaaaugcuuccgcuacuacggucuuaccaguugauggacauuucagauucgacucuuggguaaaccaauuuuaugcacucucaccaguagguaaugcauccggaagacgaggacgaaaucgaagaguagacuaa

SEQ ID NO: 32090 - RNA, 1623 nt, Artificial Sequence
  derived and/or modified sequence opt6 from VP1__Norovirus__BAS29993
augaaaauggccucaaaugacgcuaacccaucagacggaagcgcagcaaaccuagucccagaaguaaacaacgaagucauggcacuagaaccaguagucggagcagcaaucgcagcaccaguagcaggccaacaaaacguaauagacccauggauacgaaacaacuuuguacaagcacccggaggagaauuuacaguauccccuaggaaugcaccaggagaaauauuauggucugcccccuuagguccagacuuaaacccauaccucucucauuuagcccgaauguauaacggcuacgcaggagguuucgaaguccaaguaauacuagccggaaaugcauucacagcaggaaaaauaauauuugcagcaguacccccaaauuuucccaccgaaggcuuaagcccaucucaaguaacaauguucccucacauaauaguagacgucagacaauuagaacccguacuaauaccauuaccugauguucgaaauaacuucuaucauuauaaucaaucaaaugauaguacaauuaaacuaaucgcaaugcuuuacacuccacuaagagcuaacaaugcaggagaagauguauuuacaguaucauguagaguucuaacaagaccaucuccugacuucgacuuuauauuccuaguaccacccaccguugaauccagaacaaaaccauucacaguaccaauauuaaccguagaagaaaugacaaacagucgauuucccauuccauuagaaaaauuauuuacagguccuucaucugcauuuguaguacaaccccaaaacggcagauguacaacugacggaguauuauuaggaacuacacaauuaucaccaguaaauauauguacauucagaggagacguaacacauauagcaggaucuagaaacuauacaaugaacuuagcaucacuuaacuggaacaauuaugaucccacagaagaaaucccagcaccacuaggaacaccagacuucgucgguaaaauacaaggaguauuaacacaaacaacgaaaggagacggcucaacaaggggacauaaagcaacugucuacacaggauccgccccauuuacaccaaaacuaggauccguacaauuuucaacagauacagaaaaugauuucgaaacacaucaaaacacaaaauucaccccuguuggaguaauucaagacggcggcacaacacaucgcaacgaaccucaacaauggguacuaccaucauauucaggaagaaauguaccuaacguucaccuagcaccugcaguagcaccuacauuuccaggugaacaacuucuauuuuucagaucaacaaugccuggauguucuggauaucccaacauggauuuagacugcuuacuaccccaagaauggguacaacauuuuuaucaagaagcagcaccagcacaaucagacgucgcauuacuaagauucguaaacccugacacuggaagagucuuauucgaaugcaaauuacauaaaucuggauacgucacaguagcucauacuggacaacacgauuuaguaauaccaccaaacggcuauuucagauuugacucauggguaaaccaauuuuauacacuagcuccaaugggaaacgguaccggaagaagacgagcacuuuaa

SEQ ID NO: 32091 - RNA, 1623 nt, Artificial Sequence
  derived and/or modified sequence opt6 from VP1__Norovirus__BAS29996
augaaaauggccucaaaugacgcuacaccuucagacggaucagccgcaaaucuaguaccagaaguaaacaacgaaguaauggcacuagaaccuguuguuggugcugcaauugccgcaccaguagccggacaacaaaaugucauugaccccuggaucagaaauaauuucguacaagcgccaggaggagaauuuaccguuucaccaagaaaugcaccaggagaaauucuauggucugcaccacuagguccagaccuaaacccauaucuaucacaccucgcaagaauguauaauggcuacgccggcggcuucgaaguacaaguaauacuagcaggaaacgcauuuaccgcaggaaaaauaauuuuugcugcaguuccaccaaauuuuccaacugaaggauuauccccuucucaaguaaccauguucccacauauaauagucgacguucgacaauuagaaccuguucucauucccuuaccugauguuagaaauaauuucuaucauuacaaucaauccaaugacucuaccaucaaauuaauagcaaugcuauacacuccacuaagagcuaauaacgcaggugaagauguauuuacaguaucauguagaguauuaacuagaccaaguccugauuuugacuucauauuucuaguucccccaaccguagaaucucgaacuaaaccauucacaguaccaauuuuaacagucgaagaaaugacaaacagucguuucccaauaccacucgaaaaauuauuuacaggaccauccucugcauucguuguucaaccacaaaaugguagauguacgacagacggaguauuauuaggaaccacacaacuaucaccaguaaacauauguacauuucgcggagacguaacucauauugcaggauccagaaauuacacaaugaaccuagccucuuuaaacuggaacaauuaugacccaacagaagaaauuccagcaccccuaggaacaccugauuuuguaggcaaaauacaaggaguccuaacacaaacaacaaaaggcgacgguuccacaagaggacacaaagcaacaguauauacuggaucagcaccauuuaccccaaaauuaggaucaguccaauuuucaaccgauacugaaaacgauuuugaaacccaucaaaauacaaaauuuacaccaguaggaguaauacaagacggugguacuacccacagaaacgaaccacaacaauggguacucccuucauacuccggaagaaauguuccaaacguacaccuagcaccugcaguagcuccuaccuuucccggagaacaacuauuauucuuuagaucaacaaugccaggcuguucuggauauccaaauauggauuuagacugccugcucccccaagaauggguacaacauuuuuaccaagaagcagcucccgcacaaucagacguagcauuacuaagauucguaaacccagacacaggcagaguauuauucgaaugcaaacuucauaaaucaggauacgucacugucgcacacacuggucaacaugaucuaguaaucccaccuaauggauauuucagauuugauucguggguaaaccaauucuauaccuuagccccaauggguaacggaacaggacgaagacgugccuuauaa

SEQ ID NO: 32092 - RNA, 1623 nt, Artificial Sequence
  derived and/or modified sequence opt6 from VP1__Norovirus__BAS29999
augaaaauggccucaaaugacgccaacccaucagacggaucagccgcaaaucuagugccagaagucaacaacgaaguaauggcauuagaaccaguaguaggugcagcaauagcugcaccuguagccggacaacaaaauguaauugauccauggauaagaaacaauuuuguucaagcaccaggcggagaauuuaccgucucaccaagaaacgccccaggcgaaaucuuauggucugcaccacuaggacccgauuuaaaucccuauuuaucucaccuagcacgaauguacaacggauaugccgguggauucgaaguacaagucauacuagcaggaaaugcauucaccgcaggcaaaauaauuuucgcagcaguaccacccaacuuccccacagaaggauuaucaccaucacaaguaacuauguucccacauauuauaguagacguaagacaauuagaaccaguacuaauacccuuaccagauguaagaaacaauuucuaucacuacaaucaaucaaaugacucaaccauaaaacucauagcaauguuauacacuccauuacgugcaaauaaugccggagaagacgucuucaccguaaguugccguguucuaacccgcccauccccagauuuugacuucauuuuuuuaguaccaccuacaguugaaucaagaacaaaaccauucacagucccaauccuaacaguugaagaaaugacaaacuccagauuuccaaucccucuugaaaaauuauucaccggaccuucaagcgcauucguuguccaaccacaaaauggaagauguacaacagacgguguacuuuuaggaaccacacaacucucaccagucaacauuuguacauuucgaggagauguaacucauauagcuggauccagagauuauacaaugaauuuagcuuccuuaaacuggaacaauuaugauccaacagaagaaauaccugcaccucuuggaacaccagacuuugucgguaaaauacaaggaguuuuaacucaaacaacuaaaggcgauggauccacuagaggacauaaagcaacagucuauacaggauccgcaccuuucacaccaaaacuaggaucaguucaguucucaacagacacagaaaacgacuuugaaacacaccaaaauacuaaauucacuccaguuggaguaauacaagacggaggaacaacucauagaaaugaaccacagcaauggguauuaccaucauauucaggcagaaauguacccaacguacacuuagcuccagcaguugcaccuacauuuccuggagaacaauuacucuuuuucagaucaacuaugccagguugcucuggcuauccaaauauggauuuagacuguuuacuaccucaagaauggguacaacauuucuaucaagaagcugcaccagcacaaucagaaguugcauuacuacguuucguaaacccagauacuggacguguccuuuuugaaugcaaacuccacaaaucaggauauguaacagucgcacacaccggacaacaugauuuaguaauaccaccaaauggauacuucagauucgauucauggguaaaucaauuuuauacuuuagcuccaaugggaaaugguacuggacguagaagagcacuauaa

SEQ ID NO: 32093 - RNA, 1623 nt, Artificial Sequence
  derived and/or modified sequence opt6 from VP1__Norovirus__BAS30005
augaaaauggccucaaacgacgcuaacccuucugauggaagcgcugcaaaccuaguacccgaaguuucaaacgaaguaauggcacucgaaccaguuguuggagcagcaauagcagcacccguagcaggccaacaaaauguaauugacccauggauuagaaauaauuuuguacaagcaccaggcggagaauuuacugucucacccagaaaugcaccuggagaaauauuauggucugccccucuaggaccagacuuaaaucccuaucuaucacaccuagcuagaauguacaauggauacgcaggcgguuucgaaguucaaguaauucucgcaggaaaugcauuuacagcaggcaaaauaauauucgcagcaguuccucccaacuuuccaacagaaggauuaucaccaucacaaguaacaauguucccacacauaauaguagacguuagacaauuagaaccaguauuaauucccuuaccagauguuaggaacaauuuuuaucauuauaaucaauccaaugacagcacaauaaaacuuauagcaauguuauacacaccacuaagagcaaauaaugcaggugaagacguauuuacaguauccugcagaguacuaacaagaccaaguccagacuuugacuuuauauucuuaguaccaccaaccguagaaucuagaaccaaaccauuuaccguaccaauauuaacaguugaagaaaugacaaacucacgauuccccauaccccuugaaaaauuauuuacaggcccaucgggagcauuuguaguacaaccccaaaauggccgaugcacaacagacgguguacuauuaggcacaacacaacuaucaccagucaauauauguacauuuagaggagauguuacucauaucgcaggaucuaggaacuacacaaugaaucuagcaucauuaaauuggaauaauuaugauccuaccgaagaaaucccagcaccauuaggaacaccagacuuuguugguaagauucaaggaguauuaacccaaacaacaaaaggcgacggaucuacucgcggacauaaagccacaguauauacaggaucagcacccuucacaccaaaauuaggcucaguacaauuuucuaccgacaccgaaaaugauuucgaaacacaucaaaacacaaaauucacaccaguagguguaauucaagauggaucaacaacacauagaaaugaaccacaacaaugggucuuaccaucauauucuggucgagauguccauaacguacaucuugcucccgcaguagcaccaacauuucccggagaacaauuauuauuuuuccgaucaacaaugccagguuguucuggauacccuaacauggaccucgauugccuuuuaccacaagaauggguccaacacuucuaccaagaagcagcccccgcacaaucagacguugcacuccuacgcuuuguuaacccugacacaggaagaguauuauucgaauguaaacuacacaaauccgguuaugucacaguagcacauacuggacaacacgauuuaguaauuccaccaaauggauauuuuagauuugacucuuggguuaaucaauucuauacacuagcaccaaugggaaacggaaccggccguagacgagcauuauaa

SEQ ID NO: 32094 - RNA, 1623 nt, Artificial Sequence
  derived and/or modified sequence opt6 from VP1__Norovirus__BAS30008
augaaaauggcaucaaaugacgccaacccuuccgauggaucagcagcaaacuuaguccccgaaguaaauaaugaaguaauggccuuagagccaguagucggugccgcaauagcagcaccagucgcaggucaaacaaacguuauagacccauggauuagaaauaauuucguucaagcaccugguggcgaauuuacaguaucaccaagaaacgcccccggugaaauauuauggucagcaccacuaggaccagaccuaaacccauaccuuucccacuuagcacgcauguacaacggauacgcuggcggauuugaaguacaaguaauauuagcuggaaaugcuuucacagcaggcaaaauaauauucgcagcagucccaccuaacuuuccaacugaaggacuuucacccucacaaguaacaauguucccucauauaauaguagacguacgccaacuagaacccguacuaauuccacuaccagacguacgcaauaauuuuuaucauuauaaucaaucaaacgauucaaccauaaagcuuauagcuauguuauauacaccuuuaagagcaaacaaugccggugaagaugucuuuacaguaucauguagaguacuaaccagaccuucaccagacuucgacuucaucuuucuaguccccccuacaguugaauccagaacaaaaccuuuuacugucccaauauuaacaguugaagaaaugacaaauucuagauuuccaauuccccuagaaaaauuauuuaccgguccaucaggagcauucgugguacaaccacaaaacggaagauguacaacagaugguguauuauuaggaacaacucaauuaucaccaguuaauauaugcacauuucgaggugauguaacacauauagcaggaucaagaaauuacacaaugaauuuagcaucauuaaauuggaacaauuaugacccaaccgaagaaauuccagcaccucuagggacaccagacuuuguaggaaaaauacaaggaguacuaacccaaacaacuaaaggagacggaucaacccgaggacacaaagcaacugucuauacaggaucggcaccuuuuacaccaaagcuuggcucaguucaauucucaaccgauacagaaaacgacuucgaagcacaucaaaacacaaaauucacuccaguuggaguaauccaagacgguucuacaacucacagaaaugaaccacaacaauggguacucccuucuuacucuggaggaaacguacaaaauguucacuuagccccagcaguugcaccaacauucccaggcgaacaacuuuuauuuuuucgaucaacaaugccaggauguucaggauaucccaauauggaucuagauugccuacuaccacaagaauggguacaacauuuuuaucaagaagcugcuccagcucaaucagauguagcccuucuaagauucgucaacccagacacaggaagaguauuauuugaaugcaaacuacacaaaucugguuauguuacaguagcacacacaggucaacacgaucuagucauaccaccaaacgguuacuucagauuugacucauggguaaaucaauuuuacacacuagcaccaaugggaaauggaacagguagaagaagagcucuuuaa

SEQ ID NO: 32095 - RNA, 1623 nt, Artificial Sequence
  derived and/or modified sequence opt6 from VP1__Norovirus__BAS30011
augaaaauggcaucaaaugacgcaaauccuucagacggaucagcugcaaacuuaguaccggaaguaaauaacgaaguuauggcauuagaaccaguaguuggagcagcaauagcagcaccaguagcaggacaaacaaacgucauagauccauggauacgaaauaauuuuguacaagcaccuggaggagaauuuacuguaucaccacgaaacgcaccaggagaaauccuuuggucagcaccuuuaggaccagauuuaaauccauaucuaucacacuuagcuagaauguauaacggauaugccggagguuuugaaguacaaguaauucuugcuggaaaugcauuuacagcuggaaaaauaauauucgcggcuguacccccaaauuuuccaacagaaggucuaucucccucacaaguaacaauguuuccucauauaauaguagacguaagacaauuagaaccaguucuaaucccacuuccagauguacgaaacaauuucuaucacuauaaccaaucaaaugacucaacaauuaaauuaauagcaauguuauacaccccauuaagagcaaacaaugcaggagaagauguauuuacaguaucauguagaguccuaaccagacccuccccugacuuugacuuuauauuccuagucccaccuacuguagaaucaagaacaaaaccauuuacaguucccauacucacaguagaagaaaugacaaauuccagauuuccaauaccacuugaaaaacuauucacuggaccaucuggagcuuucguuguacaaccacaaaauggucgcuguacaacagacgguguucuccuaggaaccacacaauuaucacccguaaacauauguacauuuagaggagauguuacucacauugcaggaucacgaaauuauacaaugaaucuagcaucacuuaauuggaacaacuaugacccaacagaagaaauucccgcaccucuaggaaccccugauuuuguaggaaaaauucaaggaguauuaacucaaacaacaaaaggugaugguuccacacgcggacauaaagcaacaguuuauacaggaucugcaccauucaccccaaaauuaggcucgguccaauucucuacagauacagaaaacgacuuugaagcacaucaaaauacaaaauuuacaccagucggagucauacaagacggaucuaccacacauagaaaugaaccacaacaauggguauuacccucuuacucaggaagaaauguccaaaauguacaccuagcacccgcaguagcaccaacauuuccaggagaacaguuauuauucuuuagauccacaaugccaggauguagcggauaccccaauauggaucucgauuguuuauuaccacaagaauggguacaacauuucuaucaagaagcagccccugcacaaucagacguagcuuuauuaagauucguuaauccagauaccgguagaguacucuuugaaugcaaacuacauaaaucuggauaugucacaguagcacacacuggacaacacgacuuaguuauaccaccaaauggauauuuccguuuugauaguugggucaaucaauuuuauacacuagcaccaaugggaaacgguacaggacgaagaagagcauuauaa

SEQ ID NO: 32096 - RNA, 1623 nt, Artificial Sequence
  derived and/or modified sequence opt6 from VP1__Norovirus__BAS30014
augaaaauggcaucuaaugaugcuaacccauccgauggaucugccgcuaacuuaguaccagaaguuaacaaugaaguaauggcgcuagaaccagucguaggagcagcuauagccgcacccguagccggccaacaaaauguaauugacccauggauuagaaauaacuuuguacaagcaccuggaggagaauuuaccguaucaccaagaaaugccccaggagaaauuuuauggucagcaccacuaggaccagaucuaaaccccuaucucucacacuuagccagaauguauaacggauaugcaggagguuucgaagugcaagucauacuagcaggaaaugcauuuacagcagguaaaauaauauucgcagcaguaccaccuaauuuuccaacagaaggauuaucaccaucacaaguaacaauguucccacauauaauuguagauguaagacaacuugaacccguacuaauaccacuaccagauguacgaaacaauuuuuaccauuauaaccaaucaaaugauuccacuauaaaacuaauagcgaugcuauacacaccauuacgagcaaacaaugcaggagaagacguauuuacaguauccuguagaguauuaacaagacccucccccgauuuugacuuuauuuuuuuaguuccaccaacaguagaauccagaacaaaaccuuucacaguaccaauacuaacagucgaagaaaugacuaacucuagauuucccauaccacuugaaaaauuauucaccgguccaucauccgcauuuguuguacaaccucaaaauggaagaugcacaacagauggugucuuauuagguacuacacaacuaucaccaguaaacaucuguacauuccgaggcgauguaacacauaucgcaggaucaagaaauuacacaaugaauuuagcaucguuaaacuggaacaauuaugacccaacugaagaaauacccgcaccacuaggaacaccagauuucguuggcaaaauccaagguguacuaacacaaacaacaaaaggagaugguucaacaagaggucacaaagcuacugucuacacagguucagcuccauuuacaccaaaauuaggaucaguacaauuuucuacagauacagaaaaugacuucgaaacacaucaaaauacuaaauuuacaccaguaggagucauacaagauggcggaacuacucauagaaaugaaccccagcaauggguauuaccaucuuauucuggcagaaauguuccaaauguucaccuagcaccugcaguagcaccaauuuucccaggagaacaacuuuuauucuuuagaaguaccaugccugguuguucaggauauccaaacauggaucuugauugcuuacuaccacaagaauggguacaacauuuuuaucaagaagccgcaccagcacaaagugacgucgcacuacuuagauuuguuaacccagauaccggcagaguucuauucgaaugcaaacuacauaaauccggauacguaacaguagcccauacaggacaacaugauuuaguaauaccucccaacggauauuucagauuugauuccuggguaaaccaauuuuauacacuugcaccaaugggaaaugguacaggaagacgaagagcacuauaa

SEQ ID NO: 32097 - RNA, 1623 nt, Artificial Sequence
  derived and/or modified sequence opt6 from VP1__Norovirus__BAS30017
augaaaauggcuucaaaugaugccaacccaucagauggaucagcagcuaauuuaguuccagaaguaaauaaugaaguaauggcauuagaaccaguaguaggcgccgcuauagcagcaccuguagcaggacaacaaaauguaauugauccauggauaagaaauaacuuuguucaagcaccuggaggagaauuuacagucucuccaagaaaugcaccaggagaaauauuauggucugcaccucuaggcccugauuuaaauccauaucuaucacacuuagcccgaauguauaaugguuacgcaggaggauuugaaguacaaguaauuuuagcagguaaugcauuuacagcuggaaaaauaauuuuugcagcaguaccaccaaacuucccuaccgaagguuuaucuccaucacaaguuacaauguuuccucauauaauagucgacguaagacaauuagaaccaguccucauaccacuaccagauguaagaaauaauuucuaucacuacaaccaaucaaacgacucuacaauaaaauuaauagcaaugcuauacacucccuuaagggccaacaaugcaggagaagaugucuuuacaguuucauguagaguccuaacacgaccauccccugacuuugacuuuauauuucuaguuccaccaacagucgaaucacgaacaaaaccuuuuacaguaccaaucuuaacaguagaagaaaugacaaacucacgcuucccaauuccuuuagaaaaauuauuuacaggucccucuucuacauucguaguccaaccacaaaauggaagauguacaacagacgguguucuucucggaacaacacaauuaucaccagucaauaucugcacauuuagaggugacguaacacacauagcaggcucaagaaauuacacaaugaaucuugccucacuaaauuggaauaauuaugacccaacagaagaaauaccagcaccucucggaaccccagacuuuguagguaaaauucaaggcguauuaacccaaaccacuaaaggagauggaucaacucgaggacacaaagcaaccguauauacugguucagcucccuucacaccaaaauuaggaucaguacaauucggaacagauacagaaaacgauuucgaaacacaccaaaauacaaaauucaccccaguuggaguaauacaagauggugguacaacccauagaaaugaaccucaacaauggguauuaccaucauauucugguagaaacguaccaaacguacauuuagcuccagcaguugcacccaccuuuccaggagaacaauuacuauuuuuucgaucaacaaugccaggaugcucuggcuaucccaacauggauuuagauugcuuacuaccacaagaauggguacaacacuuuuaucaagaagcagcaccagcccaaucagauguagcccuccuucgauucguaaauccagauacaggccgaguucuuuucgaauguaaacuacauaaaucaggauacgucacaguagcacauacuggucaacacgaucuaguaauaccacccaauggauacuuuagauuugacaguuggguaaaccaauuuuacacucuggcucccaugggcaacggaacaggacguagaagagcauuauaa

SEQ ID NO: 32098 - RNA, 1623 nt, Artificial Sequence
  derived and/or modified sequence opt6 from VP1__Norovirus__BAS30023
augaaaauggccagcaacgacgcaaaccccucggauggaucagcagcaaauuuaguaccagaaguaaacaaugaaguuauggcacuagaaccaguagucggagcagccaucgcugccccaguagcuggacaacaaaauguaauagauccuuggaucagaaauaacuuuguccaagcaccaggaggugaauucacuguaucuccaagaaaugcaccuggcgaaauauuauggucagcaccccuaggaccugauuuaaaucccuaucuaucucacuuagcaagaauguauaacgguuaugccgggggauuugaaguccaaguaauacuugcaggaaaugcauucacggcaggaaaaauaauauucgcagcaguucccccaaacuuuccuauagaaggacuaagcccaucacaaguaacaauguucccacauaucauaguagauguaagacaacucgaacccgucuuaauaccauuaccugacguacgaaacaacuucuaccacuauaaucaaucaaaugauaguacaaucaaacuuauagcaaugcuuuacacaccacuacgagcaaauaacgcaggagaagauguauucacaguaaguuguagaguacuaacuagaccaucccccgauuuugauuuuauauuucuaguaccacccacagucgaaucaagaacuaaaccauucacggucccuauauuaacagucgaagaaaugacaaacucaagauuuccaauaccauuagaaaaacuuuuuacaggaccaucuucagcauucgucguacaaccacaaaacggacguuguaccacugauggaguauuacuugguacaacacaauuaagccccguaaauauauguacauuuagaggugaugucacacauauagcagguuccagaaacuacacaaugaaccuagcaagcuuaaauuggaauaauuacgacccgacagaagaaauaccagcaccucuaggaacuccagauuuuguaggcaaaauacaagguguauuaacccaaacgacaaaaggagacggaucaacacgaggucacaaagccacaguauacacagguucagcuccauuuacuccaaaguuaggaaguguacaauucucaacagauaccgaaaacgacuuugaaacacaccaaaauacaaaauucacgccaguaggaguaauacaagauggaggaacaacccaucgaaaugaaccacaacaaugggucuuaccaucauacucaggcagaaacguucccaauguccacuuagcaccugcaguugcaccaacauucccaggagaacaauuacuauucuuuagaucuacuaugcccgguuguucaggauaccccaauauggaucuagauuguuuauuaccacaagaauggguacaacacuucuaucaagaagccgcaccagcacaaucugacguugcucuauuacgauuuguuaacccagauacaggaagaguacuauuugaaugcaaacuacauaaaucuggauauguaacuguagcacauacagggcagcacgaucuaguuauaccaccaaauggcuacuuccguuuugacucauggguaaaucaauuuuauacacucgcaccaaugggaaauggaacuggacgacguagagcacuuuaa

SEQ ID NO: 32099 - RNA, 1623 nt, Artificial Sequence
  derived and/or modified sequence opt6 from VP1__Norovirus__BAS30026
augaaaauggcaucaaaugaugcaaauccaucagauggcucagcagcaaaucucguaccagaaguaaacaaugagguaauggcacucgaaccaguaguuggcgccgcaauugcagcucccgucgccggucaacaaaacguaauagacccauggauaagaaauaauuucguucaagcuccaggaggagaauucacagucucaccaagaaacgcaccaggagaaauauuauggucugcaccacucgguccagauuuaaauccuuaucuaucacauuuagcaagaauguauaauggauaugcaggaggauucgaaguacaaguaaucuuagcuggaaaugcauuuacagcaggaaaaaucauauucgcugcaguccccccuaauuucccuacagaaggacuaucuccaucacaaguaacuauguuuccucauaucauagucgacguuagacaauuagaacccguauuaauaccucuacccgacguaagaaacaauuuuuaucauuacaaccaaagcaaugauucaacaauaaaauuaauagcaauguuauacacacccuuaagagcaaauaacgcaggagaugacgucuucacaguaucaugcagaguauuaacccgaccuucaccagacuuugacuucauauuuuuaguaccaccuacuguagaaucccguacuaaaccauucaccguaccuaucuuaacaguagaagaaaugacaaacucuagauuccccauuccauuagaaaaacuauuuacaggacccucaucagcauucguaguccaaccccaaaacggaagauguacaacugacgguguauuacuuggaacaacccaguugagcccuguuaauauauguacauuuagaggagacguaacccauauagcaggaucaagaaauuacacuaugaaucuagcaucccuaaauuggaacaauuacgacccaacagaagaaauuccagcaccacuagguacaccagacuuuguagguaaaauucaaggaguauuaacacaaacaacaaaaggagauggauccacaagaggacacaaagcuacaguuuauacaggaucugcugacuuuacaccaaaauuagguucaguacaauuuggaacagauacagaaaaugacuucgaaacacaccaaaacaccaaauuuacaccaguuggaguuauacaagacggcuccacuacacaccgcaacgaaccacaacaauggguacuuccaaguuacucaggaagaaauguucauaacguacacuuagcaccagccguagcaccuaacuuuccaggagaacaacuccuauuuuuuagaucaacuaugccaggauguucugguuauccaaacauggaccuagauugcuuauuaccccaagaauggguacaacauuucuaucaagaagcagcucccgcacaauccgacguagccuuauuaagauucguaaacccagacacuggaagaguacuauucgaaugcaaauuacacaaaucaggauauguaacaguagcucauaccggacaacacgaucuaguuauacccccaaauggauacuucagauuugauucaugggucaaucaauuuuacacucuagcaccaaugggaaacggcacaggaagacgaagagcacuauaa

SEQ ID NO: 32100 - RNA, 1623 nt, Artificial Sequence
  derived and/or modified sequence opt6 from VP1__Norovirus__BAS30029
augaaaauggcauccaaugacgcauccccaucagauggaucagcagcaaacuuaguaccagaaguaaauaaugaaguaauggcacuagaaccuguaguaggagccgcaauagcagcacccguagcaggacaacaaaacguuauugacccauggauucguaacaacuuuguacaagcaccugguggcgaauuuacuguuucuccaagaaacgcaccuggcgaaauacuauggucugcaccacuaggacccgaccuaaaucccuacuuaucucaccuagcaagaauguauaacgguuaugcaggagguuuugaaguacaaguaauauuagccggcaaugcauuuacugcaggaaaaauaauauucgcugcaguuccaccaaacuuuccuacagagggauuaucaccaucacaaguuacaauguucccacauauaauaguagauguaagacaauuagaaccagucuuaauaccccuuccagauguccgaaauaacuucuaccacuauaaucaaucaaacgauuccacaauaaaauuaauagcaaugcuauauacuccuuuaagagcaaacaacgcuggagaagaugucuuuaccgucagcugucguguucuaacacguccaucaccugacuuugauuuuauuuuccucguaccuccaacaguugaaucgagaacaaaaccauuuacaguucccaucuuaaccguagaagaaaugacaaauucaagauuuccaauaccauuagaaaaacuuuuuacagguccaucaucagcauuuguaguucaaccacaaaacggaagaugcaccacagauggaguacuauuaggaacaacacaacuaucuccaguaaacauauguacauucagaggugacguaacacauauugcuggaucucguaauuauacaaugaaucucgccucucuaaacuggaauaauuaugauccuaccgaagaaauuccagcaccacuaggaacaccugauuuuguugguaaaauacaagguguacuaacacaaacaacaaaaggagacggaucaacuagaggacacaaagcaacaguauauacaggaucagcaccuuuuacaccuaaauuaggcucaguacaauucucaacagauacagaaaacgauuucgaaacucaucaaaauacaaaauuuacaccuguaggagucauucaagauggcggaaccacucaucgcaaugaaccacaacaauggguccuaccaucauauucaggacgaaauguacauaauguccauuuagcaccugcuguagcaccuaccuuuccaggugaacaauuacucuucuucagauccacaaugccuggauguucaggcuaucccaauauggaucuagauugccuacuuccacaagaauggguacaacauuuuuaccaagaagcugcacccgcacaaucagacguagcacuccuacgauucguaaauccagacacaggcagaguccuauuugaaugcaaacuacauaaaucagguuauguaacaguugcacauacaggacaacacgaccuuguaauaccucccaauggguauuuccguuucgauuccuggguaaaucaauuuuauacacuagcaccaauggguaauggaacaggcagaagaagagcauuauaa

SEQ ID NO: 32101 - RNA, 1623 nt, Artificial Sequence
  derived and/or modified sequence opt6 from VP1__Norovirus__BAS30035
augaaaauggcuucaaacgacgcuaauccuucagacggaucagccgcuaaucuaguuccagaaguaaauaacgaaguaauggcuuuagaaccgguaguaggagccgcaauagccgcaccuguagcaggacaacaaaauguaauagauccauggaucagaaacaauuucguucaagcaccaggaggagaauucacaguaaguccacgaaaugcucccggagaaauauuaugguccgcaccacucgguccagaccuaaacccauaucuuucacaucuagcacgaauguauaacggauacgccggaggauucgaaguacaaguaauacuagcaggaaaugcauuuacugcuggaaaaauaauauucgccgcaguaccuccuaauuuuccaacagaagguuugaguccaagucaaguuacaauguucccacacauaauaguagacguaagacaauuagaaccaguauuaauaccauuaccagauguuagaaauaauuuuuaccacuacaaccaaucaaaugauuccacuauaaaacuaauagcuauguuauauacaccauuaagagcaaauaacgcaggagaagauguauuuacaguuucuuguagaguucuaacaagaccaucaccagacuuugauuuuauauuuuuaguacccccaaccguugaaucucgcaccaaaccauucacugucccaauauuaacaguugaagaaaugacuaacucacgauuuccaauaccacuagaaaaauuauucaccggaccaucuagcgcauuuguaguacaaccucaaaauggaaggugcacaaccgaugguguacuauuaggaacuacacaacuuucgccaguuaauauauguacauuuagaggagauguaacacauauagcuggcucacgaaauuacacaaugaacuuagcaucauuaaacuggaacaauuacgacccaacagaagaaaucccagcuccauuaggaacaccagacuuuguaggaaaaauacaaggaguauuaacacaaacaacaaaaggcgauggauccacaagaggccauaaagccacuguauacacagguucugcuccauucacaccaaaacuagguucaguacaauuuggaacagacaccgaaaacgauuuugaaacacaccaaaauaccaaauuuacaccaguagguguaauacaagacggagguacaacacauagaaacgaaccucaacaauggguacuaccaucauacucaggacgcaauguuccaaauguacacuuagcaccagcuguagcaccaacauuuccaggagaacaauuacuauucuucagaucuacaaugccaggcugcucaggauauccaaauauggauuuagauugccuucuaccacaagaauggguacaacacuucuaucaagaagccgcaccagcucaaucagaugucgcuuuacuaagauucguaaacccagacacaggaagaguguuauuugaaugcaaauuacauaaaucaggauacguaacaguagcucauacaggccaacacgaucuaguaauaccaccaaacggcuauuucagauucgauuccuggguaaaucaauuuuauacauuagcaccuaugggaaauggaacaggaagaagaagagcacuuuaa

SEQ ID NO: 32102 - RNA, 1623 nt, Artificial Sequence
  derived and/or modified sequence opt6 from VP1__Norovirus__BAS30038
augaaaauggcauccaaugacgcaaauccaagugauggaucugcagcaaauuuaguaccugaaguaaacaaugaaguaauggcucuagaaccaguaguaggagcagcuauagccgccccagucgcuggacaacaaaauguaauugauccauggauaagaaacaacuucguccaagcuccaggaggagaauucacaguuucacccagaaaugcaccuggagaaauacuauggagcgccccacuaggaccagaccuaaauccauauuuaucacaccuagcaagaauguacaaugguuacgccggaggauuugaaguucaaguaauucuagcuggaaaugcauuuacugcuggcaaaauaauuuucgcagccgucccaccuaacuucccaacagaagguuuaucaccaucacaagucacaauguucccacacaucauaguagaugucagacaacuugaacccguacuaauacccuuaccagauguaagaaacaauuucuaucauuauaaucaaucaaaugauuccacaaucaaacuaauagcaaugcuauacacaccucuaagagcaaacaaugcaggagaagaugucuuuacagucuccugcagaguucucacccgaccaucaccagauuucgauuuuauuuuucucguuccaccuacuguagaaucaagaaccaaaccauucaccguacccauauuaacaguagaagaaaugacaaacucaagauuuccaauaccacuagaaaaacuauucacagguccaucaucagcauucguuguccaaccacaaaacggaagaugcacaacagacgguguccuauuaggaacaacucaacuaucacccguuaauauuuguaccuuucgaggugacguaacacauauagcaggauccagaaacuacacuaugaauuuagcaucacuaaauuggaacaauuacgacccaacagaagaaauuccagcaccacucggaacaccugauuuuguaggaaaaauacaaggaguacuuacacaaacaacaaaaggagauggaaguaccagaggacacaaagcaacaguauauacaggauccgcaccauuuacaccaaaauuaggauccguacaauuuggaacagauacugaaaacgauuucgaaacacaccaaaacacaaaauuuacacccguaggagucauccaagauggaggaacuacacauagaaaugaaccucaacaauggguauuaccaucauauagugguagaaauguaccuaacguucacuuagccccagcaguagcaccaaccuuuccaggcgaacaauuauuauucuucagaaguacaaugcccggauguucaggcuacccaaauauggaucuagauugccuacuaccccaagaauggguucaacauuucuaucaagaagcagcaccagcacaaucugacguagcacuauuaagauuuguaaacccugauaccgguagaguccuauucgaaugcaaauuacauaagucaggauauguaaccguagcacacacaggacaacacgauuuaguaauaccacccaaugguuauuuccgauuugauuccuggguaaaucaguuuuauacacucgcaccaaugggaaauggcacaggaagaagaagagcccuauaa

SEQ ID NO: 32103 - RNA, 1623 nt, Artificial Sequence
  derived and/or modified sequence opt6 from VP1__Norovirus__BAS30041
augaaaauggccuccaaugacgcaaauccaucagacggaucagcagcaaaccugguaccagaaguuaauaacgaaguaauggcauuagaaccaguaguuggagcagcuaucgcagccccagucgcaggacaacaaaauguuauagauccauggauacgaaacaacuuuguacaagcaccaggcggagaauucacaguaucacccagaaacgcacccggugaaauucuauggucagcaccacuaggaccagaucuaaaucccuaucuaagucaccuagcaagaauguacaacgguuacgcagguggauucgaaguucaaguuauucucgccggaaacgcauucacagcaggcaaaauaauauucgcagcuguaccaccuaauuuucccauagaagguuuaucaccaucacaaguaaccauguucccacacauaauuguagauguucgacaacuagaaccaguccuaauaccccuaccagauguaagaaacaacuucuaucacuauaaccagucaaaugauuccacaauaaaacuaauagcaaugcuauacacaccccuucgagcaaacaacgccggagaagauguauuuaccguaucaugcagaguauuaacaagaccaucuccagacuucgauuuuauauuucuaguucccccaacaguagaaucaagaacaaaaccauuuacaguuccaauauuaacaguagaagaaaugacaaacucacgcuuucccauaccacuugaaaaauuauuuacagguccaucaucugcauuuguaguacaaccccaaaauggacguuguaccacagacgguguacuacuaggaaccacacaacuuaguccaguuaauauaugcaccuuuagaggagauguaacacacauagcaggaucuagaaacuauaccaugaacuuagcaucacuaaacuggaacaauuacgacccuacagaagaaauaccugccccauuaggaacaccagauuuugucggaaaaauucaaggaguacuaacacaaacaacaaaaggagauggcucaacacgaggacacaaagcaacaguauauacaggaucugcaccauuuacaccaaaacucgguucaguacaauuuucuaccgauacagaaaacgauuucgaaacccaccaaaauacaaaauucaccccaguaggaguaauacaagacggaggaacaacucaccgaaacgaaccccaacaauggguuuuaccaucauauucaggaagaaauguaccuaacguccauuuagcccccgcaguagccccgacuuuuccuggagaacaacuauuauucuuuagaucaacaaugccaggaugcucaggauauccaaauauggaccuugacuguuuauuaccacaagaauggguacaacauuuuuaucaagaagcagccccagcacaaucagacguagcccuacuacguuuuguuaaccccgacacagguagagucuuauuugaaugcaaacuccauaaaucaggauacgucacaguagcacacacuggacaacaugaucuaguaauaccacccaauggauacuucagauuugauuccuggguaaaucaauuuuacacauuagccccuauggguaauggcacaggccgaagaagagcccuauaa

SEQ ID NO: 32104 - RNA, 1623 nt, Artificial Sequence
  derived and/or modified sequence opt6 from VP1__Norovirus__BAS30044
augaaaauggcaucaaaugacgcuaacccuucagacggauccgcagcaaaucuaguaccagaaguuaacaaugagguaauggcucuagaacccguagucggugcagccauagcagccccaguugcaggacaacaaaauguaauagacccuuggauaagaaacaacuuuguacaagccccaggaggcgaauucacaguaucaccacgaaaugcacccggcgaaauacuauggucagaaccacuuggaccagaucuaaauccuuaccucucacacuuagcaagaauguacaacggauacgcaggcggcuucgaaguccaaguaauacucgcaggaaaugcuuuuacagcaggaaaaauaauauucgcugcuguuccaccaaacuuucccacagaaggauuaucaccuucacaaguuacaauguucccacacauaauaguagacguaagacaacuagaaccaguucuuauaccauuaccagaugucagaaacaauuucuaccacuauaaucaaucaaaugacagcacaauaaaauuaauagcaaugcuauacacaccuuuaagggcaaacaaugcaggugaagacguauucacaguuucauguagaguuuuaaccagaccaucaccugauuuugacuuuauauuucuaguacccccaaccgucgaaucccgaaccaaaccauucacuguaccaaucuuaaccguagaagaaaugacaaacucaagauuuccaauaccacuugaaaaacuauucacaggacccucaucagcauucguaguacaaccacaaaacgguagauguacaaccgauggaguauuacuaggaacaacccaauuaaguccuguaaauauauguacauuuagaggagauguaacacauauagcaggauccagaaauuacaccaugaauuuagcuagcuuaaacuggaacaacuaugacccaaccgaagaaauccccgcaccauuaggaacaccagauuucgucggcaaaauacagggaguuuuaacacaaacuacaaaaggagacggaucaacgagaggucacaaagcuacaguauacaccggaucagcuccauuuacaccaaaacuaggaucuguacaauucucaacagauacagaaaacgauuucgaaacacaucaaaauacaaaauucacaccaguaggaguaauacaagauggcggcacaacccauagaaaugaaccacaacaauggguuuuaccuucauauucaggcagaaacguuccaaacguucaucuagcaccagcaguugccccuacauuuccaggagaacaacuauuauuuuucagaucuaccaugcccgguuguaguggauauccuaacauggauuuagacugucuccuaccucaagaauggguacaacauuuuuaucaagaggcugcaccagcccaaucagauguagcauuacuacgcuucgucaauccagauacuggacguguauuauucgaauguaaauuacauaaaucaggauauguaacaguagcccacacaggacaacaugauuuaguaauacccccaaauggauacuucagauuugauuccuggguaaaucaauuuuauacuuuagcacccaugggaaacggcaccggaaggagaagagcacuauaa

SEQ ID NO: 32105 - RNA, 1623 nt, Artificial Sequence
  derived and/or modified sequence opt6 from VP1__Norovirus__BAS30047
augaaaauggcaucaaaugacgcaaacccuucugauggaucagcagcaaaucuuguaccagaaguaaauaaugaagucauggcauuagaaccuguaguaggcgcagcaauagcagccccaguagcaggucaacaaaauguaauagauccuuggauacgaaauaauuuuguacaagcaccuggaggagaauuuacuguaucaccaagaaacgccccaggagaaauuuuauggagugcaccacuagggccugauuuaaauccuuauuuaucacaccuugcacguauguauaacggauaugccggaggcuucgaaguucaaguaauuuuagcagguaacgccuucaccgcaggaaaaauaauauucgccgcaguaccaccuaacuuuccaacagagggauuaucaccaagucaagucacaauguuuccccacauaauaguugacguaagacaacuagaaccaguauuaaucccacuuccugacguacgaaauaacuuuuaucacuauaaccaaucaaaugacucuacaauaaaacuaaucgcuauguuauacacuccacuuagagcuaauaaugcaggagaagauguauuuacagucucauguagaguuuuaacaagacccuccccagacuucgauuucauauuuuuagugccaccaacaguagaaucaagaacaaaaccauucacaguaccuauauuaaccgucgaagaaaugacaaacucucguuucccaauaccacuagaaaaauuauuuaccgguccaucuuccgcauuuguaguacaaccucaaaauggacguuguacaacagacggaguacuacuuggcacaacacaauuaucaccagucaauauauguaccuuccgaggagacguaacacauaucgcaggcucuagaaacuacacuaugaaccuagcaucauuaaacuggaacaauuacgauccaacagaagaaauaccagcaccacuaggaacaccagauuuugucgguaaaauucaaggaguauuaacucaaacaacaaaaggugacggaagcacuagaggucauaaggcaacagucuacacaggaucagcuccauuuaccccuaaacuaggaucuguucaauuuuccacagauacugaaaacgauuucgaaacacaucaaaacacaaaauucacacccguaggaguuauacaagauggcggcacuacacacagaaacgaaccacaacaauggguucuaccaagcuauucaggaagaaauguaccaaauguacacuuagcaccugcaguagcaccuaucuucccaggugaacaauuauuauuuuuucgcucaacaaugccagguuguucuggguaucccaauauggaucuugauugucuacucccacaagaauggguacaacauuucuaucaagaagcugcuccagcucaaucagacguugcacuacuaagguucguaaacccagacacaggaagaguauuauucgaaugcaaauuacauaaaucaggauaugucaccguagcacacacaggucaacacgaucuaguaaucccaccaaauggauauuucagauucgauagcuggguaaaucaauuuuacacauuagcaccuaugggaaauggaacaggccgacgaagagcacucuaa

SEQ ID NO: 32106 - RNA, 1623 nt, Artificial Sequence
  derived and/or modified sequence opt6 from VP1__Norovirus__BAS30050
augaaaauggcaucaaacgacgcuaaucccucagauggcagugcagcuaacuuaguaccagaagucaacaacgaaguaauggcauuagaaccagucguaggagccgccaucgcugccccuguagcuggacaacaaaacguuauagacccauggaucagaaauaacuucguccaagcaccagguggagaauuuaccguaucaccacgaaaugcaccaggagaaaucuuauggucggcaccuuuaggacccgaccuaaacccauauuuaucacacuuagcaagaauguauaauggauaugcaggagguuuugaaguccaaguaauacuugcaggaaaugcuuucacagcaggcaaaauaauuuucgcagccguaccaccaaauuuuccaacagaaggccuaucaccaagucaaguaacaauguuuccacacauaaucguggauguaagacaacuagaacccguauuaauuccccuccccgauguaagaaacaauuuuuaucacuauaaccaaucaaaugauucaacaauuaaacuuauagcuauguuauacacuccacuuagagcaaauaaugcuggagaagauguauucacaguaucauguagaguacuaacacgacccucaccagacuucgauuuuauauuucuuguuccaccuacaguagagucaagaaccaaaccauuuacaguaccuauacuaacaguagaagaaaugacaaacucacgauucccaauaccucuagaaaaacuauucacaggaccuucaagugcauucguaguacaaccucaaaauggaagaugcacaacagacggaguauuacucggaacaacacaacuaagcccaguaaauaucuguacauuuagaggagacguaacacauauagcaggaucaagaaacuacacaaugaaccuagcaucucuaaauuggaauaauuacgacccaaccgaagaaauaccagccccauuaggaacaccagauuuuguagguaaaauucaagguguccuaacacaaacaacaaaaggcgauggaaguacuagaggacacaaagccacaguauauacagguucagccccauuuacaccaaaacuaggaucuguccaauuuucaacagacaccgaaaaugauuucgaaacacaccaaaacacaaaauucacaccaguaggugucauacaagauggaggaacaacacacagaaaugaaccacaacaauggguauuaccauccuacucugggcgaaauguuccaaauguacaucuagcaccagcaguagcaccaacauuuccaggagaacaacuauuauucuuucgaucuacaaugccaggaugcuccggauauccaaacauggaucuagacugccuacuuccacaagaauggguucaacauuucuaucaagaagcugcaccugcccaaagcgauguagcauuacuacgauuuguaaacccagacaccgguagaguccuauucgaauguaaauuacauaaaucaggcuauguaacaguagcucacacaggccaacacgacuuaguaauaccacccaauggcuauuucagauuugacucauggguuaaucaauuuuacacacuugcuccaaugggaaacgguacagguagaagaagagcacuauaa

SEQ ID NO: 32107 - RNA, 1623 nt, Artificial Sequence
  derived and/or modified sequence opt6 from VP1__Norovirus__BAS30053
augaaaauggcaucaaacgacgcaacaccaagcgauggaucugcagcaaaccuuguacccgaaguaaauaacgaaguaauggcacuagaaccuguaguaggagcugcuauugcugcaccaguagcaggccaacaaaauguaauagauccauggauaagaaacaacuuuguacaagcuccaggcggugaauuuacaguaucccccagaaaugcaccaggagaaauacuauggucagcaccucuaggaccagauuuaaauccauaucuaucacaccuagcacgaauguacaacggauacgcaggcggauuugaaguacaaguaauacucgccggaaaugcauuuaccgcaggcaaaauaaucuucgcagccguaccuccaaacuuuccaaccgaaggacuaucaccaucucaagucacaauguucccacauauaauaguagacguaagacaacuugaaccaguauuaauaccacucccagacguaagaaacaacuuuuaccacuauaaucaaucuaaugacucuacaauaaaacuaauagcuauguuauacaccccauuacgcgcuaacaaugccggagaagauguauuuaccguauccuguagaguacuaacacgaccuucaccugacuuugacuucauauucuuaguaccaccaacuguagaaucaagaaccaaacccuucacaguaccaauauuaaccguagaagaaaugacaaauucaagauuuccaauaccauuagaaaaacuauuuacaggaccaucauccgcauucguuguacaaccacaaaacggcagauguacaacagaugguguauuacuaggaacaacucaacuaucaccuguaaauaucuguacauuuagaggugacguaacucauauagcaggcagcagaaauuauacaaugaaucuagccuccuuaaauuggaauaauuacgauccgacagaagaaauaccagcaccucuaggaaccccugacuuuguaggaaaaauacaaggaguacuaacacaaacaacuaaaggagacggauccacucgaggacacaaagcuacaguauauacaggcucagcaccauuuacacccaaacuugguucaguucaauuuaacacagauacagaaaacgacuuugaaacacaccaaaacacaaaauucacaccagucgguguaauucaagacggaucaacaacacauagaaaugaaccacaacaauggguauuaccaucuuacaguggaagaaaugucccaaacguacaccucgcuccagccguagcaccuacauucccaggagaacaacucuuauuuuuuagaucaacaaugccaggaugcuccggauauccaaauauggauuuagacugccuauuaccacaagaauggguacaacauuucuaucaagaagcugcuccugcacaauccgauguugcucuauuaagauucguaaacccagauacaggcagaguauuauuugaguguaaacuucauaaaucuggauacguaacaguagcacauacaggacaacacgaucuuguaauaccaccaaaugguuacuucagauuugauucauggguaaaucaauucuacacccuagcccccaugggaaauggaaccggcagaagacgagccuuauaa

SEQ ID NO: 32108 - RNA, 1623 nt, Artificial Sequence
  derived and/or modified sequence opt6 from VP1__Norovirus__BAS30056
augaaaauggcaucaaaugacgcaaacccaucagauggaucagcugcaaaccuuguaccagaaguaaacaaugaaguaauggcucuagaaccgguaguaggugcagccauugccgcaccaguagcaggacaacaaaacguaauagaccccuggauaagaaacaacuuuguacaagcaccaggaggagaauucacaguaucacccagaaaugcaccuggagaaauacuuuggucagcaccacucgguccugaucuaaacccauaucucucccacuuagccagaauguauaacggauaugcagguggcuucgaaguacaagucaucuuagcaggcaaugcuuuuacagcaggaaaaauaauauucgcagcggucccacccaacuucccaauagaaggauuaucaccaucacaagucacaauguucccacacauuauaguagauguacgacaauuagaacccguucuaauaccuuuaccagacguacgaaacaauuucuaucauuauaaccaaucaaacgacucaaccauuaaauuaaucgcaaugcuauacacuccacuaagagcaaacaacgccggcgaagaugucuuuacuguaucaugcaggguuuuaacuagaccaucaccagauuuugacuuuauauuuuuaguuccgccaacagucgaaucuagaacuaaaccauuuacagucccuauuuuaacaguagaagaaaugacaaacucaagauucccuauaccacuagaaaaauuauuuaccggacccucaagugcuuucguaguacaaccacaaaacggaagauguacaacagacggaguauuauuaggaacaacacaacuaucaccagucaauauaugcaccuuuagaggagacguaacccacauugcaggaucaagaaauuacacaaugaauuuagcaagucuaaauuggaauaauuaugauccuacagaagaaauuccagcaccuuuaggaaccccagauuuuguuggaaaaauacaaggaguauuaacacaaacaaccaaaggagacggaucaacacgaggacauaaagcaacaguauauacaggaagcgcaccuuucacaccaaaauugggaucaguacaauuuucuacagacacagaaaacgauuuugaaacacaccaaaauacaaaauuuacaccagucggcgucauccaagauggaggaacaacccaucguaaugaaccccaacaauggguauuaccaucauauagcggaagaaacguaccaaauguacacuuagcaccugcaguagcaccaacauucccuggcgaacaacuucuuuucuuuagaucuacaaugccuggaugcucagguuacccaaacauggaccuagauugccuucuaccacaagaauggguucaacauuucuaccaagaagcagcaccagcacaaucugacguagcucuccuaagauucgugaauccagauacuggaagaguauuauucgaaugcaaauuacauaaaucaggauacguaacaguagcacacacaggucaacaugauuugguuauaccacccaauggauauuucagauucgauagcuggguaaaccaauuuuauacauuagcaccaaugggaaauggaaccggaagacgcagagcccuauaa

SEQ ID NO: 32109 - RNA, 1623 nt, Artificial Sequence
  derived and/or modified sequence opt6 from VP1__Norovirus__BAS30059
augaaaauggcaucuaaugaugcaaauccaucagauggaucagcagcaaaccuaguaccagaaguaaacaacgaagucauggcauuagaaccaguuguaggagccgcuauagcugcucccguagcaggacaacaaaacguaauagacccauggaucagaaauaacuucguacaagcaccaggaggagaauuuacaguaucaccaagaaacgccccaggagaaauacuauggucagcuccacuaggucccgaucuaaauccauacuuaucacauuuagcacgaauguacaacggauaugcagggggauucgaaguacaaguaauucuagcaggcaaugcauucacagcaggcaaaaucauuuuugcagccguacccccaaauuuuccuacagaaggccuuagucccucccaaguaacaauguuuccccacauaaucguugauguaagacaauuagaaccaguacucauaccucuaccagauguacgaaauaauuucuaucauuauaaccaaucaaaugacucuacaauaaaacuaauagcaaugcuuuacaccccauuaagagccaacaaugcaggagaagauguauuuacaguaagcuguagaguacucacaagaccaucuccagacuuugauuuuauauuuuuaguuccaccaacaguugaaaguagaacaaaaccuuucacaguaccaauccuaaccguagaagaaaugacaaauaguagauuucccauaccacuagaaaaacuauuuacagguccuuccucagcauucguuguacaaccacaaaauggucgauguacuacugauggaguacuacuaggaaccacacaauuaucaccuguaaauauaugcaccuuccgaggagauguaacacauauagcaggaucaagaaauuauacaaugaauuuagccucauuaaauuggaacaauuacgauccaacagaagaaauaccagcaccacuagguacacccgacuuuguuggaaaaauacaaggaguucuaacacaaacaaccaaaggagaugguucaacaagaggacauaaagcaacugucuacacgggauccgcaccauuuacaccuaaacuuggaucaguacaauucucaaccgauacagaaaaugauuucgaaacacaccaagauaccaaauucacucccguuggaguaauacaagacggcgguacaacacauagaaaugaaccacaacaauggguauuaccuucauauucaggaagaaauguccccaacguucacuuagcaccagccguugcaccuacauuuccaggagaacaacucuuauucuuucgaucaacuaugccaggaugcucuggauauccaaauauggacuuagacuguuuacucccucaagaauggguacaacauuucuaucaagaagcagcccccgcucaaucugauguagcacuucuacgauucguaaacccugacacuggacgcguccuauuugaaugcaaacuacauaaaucaggauacguaacaguagcucacacaggacaacaugacuuaguaauaccaccaaaugguuauuuccgauuugauucaugggucaaucaauuuuacacacuagccccaauggguaauggaacaggaagacgaagagccuuauaa

SEQ ID NO: 32110 - RNA, 1623 nt, Artificial Sequence
  derived and/or modified sequence opt6 from VP1__Norovirus__BAS30062
augaaaauggccagcaaugaugcuaaccccucugacggaucagcagccaacuuagucccagaaguaaacaaugaaguaauggcacucgaaccaguaguaggagcagcaauagccgcuccaguagccggucaacaaaauguaauagacccauggaucagaaacaauuuuguacaagccccaggaggcgaauuuacaguuucaccacgcaacgcaccaggcgaaauacuuuggucagcaccauuaggaccagaucuaaaucccuaucuaucacaccuugcacgcauguauaacggauacgcaggaggauucgaaguacagguaauauuagcaggaaaugcauucacugcaggaaaaaucauuuucgcagcuguaccaccaaacuuucccacagaaggacuaucaccaucacaaguuacaauguuuccacacauuauaguagacguuagacaacucgaaccaguauuaauuccauugcccgauguuagaaauaacuucuaucauuauaaccaaucaaaugacucaacaauaaaacuuauagcaauguuauacaccccccuaagagccaauaacgccggagaagaugucuuuaccgucucuuguagaguauuaacaagaccaucaccugauuucgauuucauuuuuuuaguaccuccaacaguagaaucaagaacaaaaccauucacuguacccauacuaacaguagaagaaaugacuaauucacgauuuccaauuccacuagaaaaauuauuuacagguccaucaagcgcauucgucguccaaccacaaaacggaagaugcacuacagacgguguuuuacucggaacuacacaauuaucaccaguaaacauuugcacuuuucgaggagacguaacccauauugcaggaucucguaauuacacuaugaauuuagcaucccuaaauuggaauaauuaugauccaacagaagaaauaccugccccauuaggaacuccugauuuuguaggcaaaauccaaggaguauuaacucaaaccacuaaaggagauggaucaaccagaggacauaaagcgacagucuauacuggcucagcuccauuuacuccaaaauuaggcucuguacaauuuucaaccgacacagaaaacgacuuugaaacacaucaaaauacaaaauucacaccugucggaguaauccaagauggaggaacuacacaccgaaacgaaccacaacaauggguucuaccuuccuacuccgguagaaauguccaaaacguucacuuagcaccagcaguagcaccgacauuuccaggcgaacaacuucucuuuuucagaucaacaaugccagguugcucagguuacccaaauauggacuuagacugccuacuaccacaagaauggguacaacacuuuuaccaagaagcagcaccagcucaaucagauguagcucuauuacgauuuguaaacccagacacaggaagaguuuuauucgaaugcaaauuacauaaaucaggcuacguaacaguagcucacaccggccaacaugaccucguaaucccaccaaauggauauuuuagauucgauuccuggguuaaccaauucuacacacuugcaccaaugggaaauggaacagguagaagacgagcauuauaa

SEQ ID NO: 32111 - RNA, 1623 nt, Artificial Sequence
  derived and/or modified sequence opt6 from VP1__Norovirus__BAS30065
augaaaauggcaucaaaugacgcuaacccaucagauggaucugcagcaaaccuuguucccgaaguuaauaacgaaguaauggccuuagaaccaguuguuggagcagcaaucgcagcaccaguugcuggacaacaaaauguaauagauccauggauaagaaacaacuuuguacaagcaccaggaggugaauucacuguuucaccaagaaaugcaccaggagaaauauuauggucugcuccacuuggcccagaucuaaauccauaucuaucccaucuagcaagaauguauaaugguuacgcaggaggauuugaaguacaaguaauauuagcaggaaacgcauuuaccgucgucaaaacaacacuaucagcgguaccaccaaauuuccccacagaaggacuaagcccaucucaaguaacaauguucccacauauaauaguagauguacgccaacuagaaccaguuuuaauuccauuaccugauguacgaaacaauuucuaccauuauaaccaauccaaugauucaacaaucaaacuaauagcaaugcuauauacaccacuuagagcuaacaaugcuggagaagauguauuuaccgucagcuguagaguucucacaagaccuucaccagacuuugauuucauauuuuuaguaccaccaacuguagaaucacgaacaaaaccauucacuguacccauacuaacagucgaagaaaugacuaacucuagauucccaauaccacuugaaaaauuauucacagguccaucuucagcauucguaguucaaccacaaaacggcaggugcacaacagauggaguauuauuaggaacaacccaauuaaguccugucaauauaugcacauuuagaggagacguaacacauauagcaggcucuagaaacuacacaaugaaccucgcaagcuuaaauuggaacaauuacgauccaacagaagaaauaccagcaccacucgguacaccugauuucguagguaaaauucaagguguauuaacacaaaccacaaaaggagacggaucaacaagaggacacaaagcaaccguauauacugguucagcaccauucacaccaaaauuaggaucaguacaauucucaacagauacagaaaaugauuuugaaacacaccaaaauacaaaauuuacacccguaggaguaauacaagaugguggaacuacacacagaaacgaaccccaacaauggguacuuccuucuuacuccggccgaaacguaccaaacguacaucuagcaccugccguagcaccaacauucccaggugaacaacuacuauucuucagaucuacaaugccaggauguucaggauauccuaauauggaccuugauugcuuacuaccucaagaauggguacaacauuuuuaucaagaggcagcuccugcucaaucugacguagcacuucucagauucgucaauccagauacagguaggguacuauucgaauguaaauuacacaagagcggauauguaacuguagcacacacuggucaacaugacuuagucaucccaccuaacggauauuuuagauuugauucaugggucaaccaauuuuacacuuuagcaccaaugggaaacggaacuggaagaagacgcgcccuuuaa

SEQ ID NO: 32112 - RNA, 1623 nt, Artificial Sequence
  derived and/or modified sequence opt6 from VP1__Norovirus__BAS30068
augaaaauggccuccaacgaugcaacagcuucagauggaucagccgccaaccuaguacccgaaguuaacaaugaaguuauggccuuagaaccaguugucggagcagcaaucgcugcaccaguagccggacaacaaaauguaauagaucccuggauuagaaacaacuucguacaagcuccaggaggagaauuuacaguaucaccaagaaacgcucccggcgaaaucuuauggagugcaccacuaggaccagaucuaaauccauaucuaucacauuuggcaagaauguauaauggauacgcaggagguuucgaaguucaaguaauauuagcaggaaaugccuuuacagcaggaaaaauaauuuucgcagcaguuccaccaaacuuuccaauagaaggccuauccccaucacaaguaaccauguucccccacauuaucguugacguaagacaacuagaacccguacuaauaccccuaccagacguacgaaauaauuucuaucauuauaaucaaucaaaugacucuaccauuaaacuuauagcaauguuauauacaccauuaagagcaaacaacgcaggagaagauguauuuacaguuucauguagaguccuaacacgccccucaccagacuuugauuuuauauuccuaguacccccuacuguagaaucacgaacaaaaccauucacuguccccauauuaacaguggaagaaaugacaaacucacgcuuuccaauucccuuagaaaaacuauucaccggcccaucaucugcauucguuguacaaccacaaaauggcagauguacaacugacggaguguuacuaggaacaacacaacuauccccaguuaauauauguacauuucgaggugaugucacacauauagcaggaucacguaauuauacaaugaacuuagcaucauuaaacuggaauaauuaugauccaaccgaagaaauaccagcaccacuaggaacuccagauuuuguaggaaaaauacaaggaguacuaacacaaaccacuaaaggagauggauccacgcgaggccacaaagccacaguauacacaggauccgcaccuuuuaccccaaaacuaggaucaguacaauucucaacagauacugaaaacgauuucgaaacccaccaaaacacaaaauuuacaccaguuggaguaauacaagauggaggaacuacacacagaaaugagccacaacaauggguacuaccaucauauucagguagaaauguaccaaauguacacuuagcaccagcaguagcacccacauuuccaggggaacaacuauuauuuuuccgauccacaaugccaggcuguucagguuauccaaauauggacuuagacugccuauuaccacaagaauggguucaacauuucuaccaagaagcagcacccgcucaauccgacguagcacuucuaagauuuguuaauccagauacagguagaguccuauuugaauguaaacuucacaaaucaggauauguaaccguagcucacacaggacaacacgauuuaguuauaccuccaaaugguuauuuucgcuuugacucauggguaaaucaauuuuauacacuagcaccaaugggaaauggcacugguagaagaagagcacuauaa

SEQ ID NO: 32113 - RNA, 1623 nt, Artificial Sequence
  derived and/or modified sequence opt6 from VP1__Norovirus__BAS30071
augaaaauggcaucaaacgaugcaaauccaucagauggaucagcagcaaaucuaguacccgaaguaaacaacgaaguaauggcauuagaacccguaguaggagcagcaauagcagcuccaguagcaggacaacaaaauguaauugacccauggauaagaaacaacuuuguacaagcucccggcggcgaauuuacaguuagccccagaaaugcaccaggagaaauauuauggucagcaccuuuagguccagauuuaaacccauacuuaucacauuuagcacgaauguauaacggauacgcaggagguuucgaaguccaaguaauauuagcuggaaaugccuuuacugcaggaaaaaucauuuucgcagcaguucccccuaauuuccccauugaaggacuuucuccaucucaaguaacaauguucccacauauaauaguagacguacgacaacuagaaccagucuuaaucccauuaccagacguuagaaauaauuucuaucauuauaaccaaucaaaugauucaaccauuaaacuaauagcuaugcuauacacucccuuaagagccaacaacgcaggagaagaugucuuuacaguuucauguagaguacugacucguccuucuccagacuucgauuucauauuccucguaccaccaacaguagaaucuagaacaaaaccauuuacaguaccaauauuaacagucgaagaaaugaccaacuccagauucccuauaccauuagaaaaacuauuuacaggaccaucauccgccuuuguuguacaaccacaaaauggacgcugcaccacagaugguguauuacuaggaacaacacaauuauccccaguuaacauauguacauuuagaggugacguaacacauauagcaggauccagaaacuacaccaugaauuuagcgucacucaacuggaauaauuacgaccccacggaagaaauaccagcaccacuaggaacaccagacuuuguaggaaaaauccaaggaguacuaacacaaacaaccaaaggcgaugguucaacaagaggacacaaagcaacuguauauacaggaucagcaccauuuacuccaaaacucggauccguucaauucucaacugauacagaaaacgauuuugaaacacaucaaaauacuaaauuuacaccaguaggaguuauacaagacggaggaaccacacauagaaaugaaccccaacaauggguuuuaccaucauauucuggcagaaauguaccaaacguccauuuagcaccagcuguugcaccaacuuucccaggagaacaauuauuauucuuuagaucaacuaugccaggauguucaggauaucccaauauggauuuagauugccuucuaccacaagaauggguucaacauuucuaccaagaagcagcaccagcucaaagcgacguagcacuacuacgcuucguaaacccugacacuggaagaguuuuauuugaauguaaauuacacaaaagcggauaugucacaguagcacauacaggccaacacgauuuaguuauaccuccaaauggauauuuucgauucgacuccuggguaaaucaauuuuacacacuagcaccaaugggaaauggaacaggaagaagaagagcacuauaa

SEQ ID NO: 32114 - RNA, 1623 nt, Artificial Sequence
  derived and/or modified sequence opt6 from VP1__Norovirus__BAS30074
augaaaauggcuucaaaugacgcaaauccuucagauggaucagcagcuaaucuuguaccagaaguaaacaacgaaguaauggcacuagaaccaguaguaggugcagcaauugccgcaccaguagccggacagcaaaaugucauagauccauggauaagaaauaacuuuguccaagccccuggaggagaauuuacugucaguccuagaaaugcaccaggagaaauauuauggucagcaccucuagguccagaucuaaauccauauuuaucacacuuagcacgaauguacaauggauaugcuggaggcuuugaaguacaagucauacuagcuggaaaugcauuuacagccggaaaaauaauauucgcugcaguuccaccuaauuuuccaauagaaggccuaucaccaucccaaguuacuauguucccucauauaauaguagauguccgccaauuagaaccaguauuaaucccgcuaccagauguacgaaacaauuucuaucacuacaaccaaucaaaugacucaacaauaaaacucauagcaauguuauacacuccauuaagagccaauaaugcuggagaagauguauuuacaguaagcugccgcguauuaacaagaccaucaccagauuuugauuuuauauuuuuaguaccuccaacaguagaaucuagaacaaaaccauucaccgucccaauuuuaaccguagaagaaaugacaaauucuagauuuccaauuccauuagaaaaacuauucacaggaccuucaucagcauuuguuguucaaccucaaaauggaagaugcaccacagacggaguauuacuaggaaccacucaacuuuccccaguaaauauaugcacauuucgaggagauguaacacacauagcaggaucacguaauuauacuaugaaucuagcaucccuaaacuggaauaauuacgacccaacugaagaaauaccagccccuuuaggaacaccagacuuuguuggaaaaauacaaggaguacuaacacaaacuaccaaaggagacggaucuacaagaggacacaaagcaacuguuuauacugguuccgcuccauuuaccccaaaauuaggcucaguacaauucucaacagauaccgaaaacgacuuugaaacccaucaaaacacaaaauuuacaccuguugguguaauacaagacggcggaacaacacacagaaaugaaccacaacaauggguacucccauccuauucuggaagaaauguucccaauguacacuuagcaccagcaguagcaccaacauuuccaggcgaacaauuacuuuuuuuuagaucaacaaugcccggaugcucagguuauccaaacauggaucuugacugucuauuaccacaagaauggguacaacauuuuuaucaagaagcagcaccagcgcaauccgacgucgcacuacuuagguucguuaacccagauacaggaagaguuuuauuugaaugcaaacuacauaaaucaggauacgucacuguagcacacacaggacaacacgauuuaguaauaccaccuaacgguuauuucagauucgauuccugggucaaccaauuuuacacacuagcacccaugggaaacggaaccggaaggagaagagcauuauaa

SEQ ID NO: 32115 - RNA, 1623 nt, Artificial Sequence
  derived and/or modified sequence opt6 from VP1__Norovirus__BAS30077
augaaaauggcaagcaaugaugcaaacccaucagaugguucagcagcaaaccucgucccagaaguaaauaaugaaguaauggcacuagaaccagucguaggugccgccaucgcugcaccaguugccggacaacaaaacgucauagacccuuggaucagaaacaacuucguacaagcaccaggaggagaauuuacuguaucuccaagaaaugcaccuggcgaaauauuauggucugcaccucuaggaccagacuuaaauccauaucuuucacaccuagcccgaauguauaauggcuacgcaggaggauucgaaguccaaguaauccuagcugguaaugcuuucaccgcugguaaaauaauauucgcagcaguaccaccaaacuuuccaacagaaggacucucaccaucucaaguaacaauguuuccacacauaauaguagauguaagacaacucgaaccugucuuaauuccauuaccagacgucagaaauaauuucuaucauuauaaucaaaguaaugacucaacuauaaaacuuauagcaaugcuuuacaccccauuaagagcaaauaaugcaggugaagauguauuuacaguaagcugcagaguauuaacaagaccaucaccagacuuugacuuuauauuucuaguaccaccaacaguagaaucaagaacaaaaccauuuacaguaccaauauuaacaguagaagaaaugacaaacucaagauuuccaauaccuuuagaaaaacuauuuacaggcccaucauccgcauucguaguacaaccacaaaauggacgauguacuacagauggaguauuacuaggaacaacgcaauuaucaccuguaaacauauguacuuuucgaggagauguaacacauauugcaggaucacacaauuacaccaugaaucuagcaucauuaaacuggaacaacuaugacccaacagaagaaauaccagcaccccuaggcacaccugacuuugucggaaaaauccaaggaguauuaacacaaacuacaaaaggagacggaucuacacgaggucacaaagcaacaguauauacagguuccgcucccuuuacuccaaaacuaggcucuguacaauuuucaacagauacagaaaacgacuuugaaacacaucaaaauacgaaauucacaccuguuggcguaauucaagacggaggcacugcccacagaaacgaaccacaacaauggguccuaccuaguuauucuggaagaaacguccaaaauguucauuuagcuccugcuguagcaccuacauuuccaggagaacaacucuuauucuuuagaucaacaaugccaggauguuccggcuacccuaauauggacuuagauugcuuacuaccacaagaauggguucaacacuucuaucaagaagcagccccagcacaaucugacgucgcacuuuuacgauuugucaauccagacacagguagaguacuauucgaaugcaaauuacauaaaucugguuauguaacuguagcucacacuggacaacaugaccuaguuaucccaccaaauggauauuuuagauuugacaguuggguuaaucaauuuuacacacuagcaccaaugggcaauggaacuggcagaagacgggcauuauaa

SEQ ID NO: 32116 - RNA, 1623 nt, Artificial Sequence
  derived and/or modified sequence opt6 from VP1__Norovirus__BAS30080
augaaaauggccagcaaugaugcaaacccaucagacggaucugcagcaaauuuaguuccagaaguaaacaaugaaguaauggcauuagaaccuguagucggcgcagcaaucgccgcaccaguagcaggacaacaaaacguaauagacccauggauacgaaauaacuucguacaagcaccaggcggagaauucacaguaucacccagaaaugcuccaggugaaauacuauggucagccccacuaggaccugaccuaaauccauacuuaucacauuuagcaaggauguauaacggauacgcaggcgguuucgaaguacaaguaauacuagcuggaaacgccuucacagccggacaaauaauauucgcagcaguaccaccgaacuuuccuaccgaaggacuaucaccaagucaaguaacuauguucccacauauaauaguugauguaagacaacucgaaccaguacuaauaccauuaccagacguaagaaauaauuucuaccacuacaaccaauccaaugacucaacaauaaaacuuaucgcaauguuauacacaccucuacgugccaauaaugcuggugaagauguauuuacaguaucauguagaguauuaacacgacccucccccgauuucgauuuuaucuuuuuaguaccaccuaccguagaaucacgaacaaaaccauucacaguuccaauauuaacaguagaagaaaugaccaacucaagauuuccaaucccccuagaaaaacuauuuacaggacccucaucagcauucgucguacaaccccaaaacggacguugcacaaccgacggcguauuauuaggaacaacacaauuaucaccuguuaauauaugcacauuucgaggugacguaacacauauagcagguucuagaaacuauacaaugaaucuagcaucauuaaacuggaacaauuaugauccaacagaagaaauaccagcaccacuagguacaccagauuuuguaggaaaaauacaaggaguacuaacacaaacaacaaaaggugacgguucaacaagaggucacaaagcaacaguauauacaggauccgccccauucaccccuaaacuaggaucaguacaauucaguacagauacagaaaaugauuucgaaacucaccaaaacacaaaauucacaccaguagguguaauacaagacggaggaaccacacauagaaaugaaccacaacaauggguauuaccauccuacagcggaagaaacguaccuaauguacaucuagccccagcaguggccccaacauuuccuggugaacaacuacuauucuuuagaucaacaaugcccggauguucuggauauccaaauauggaucuagauugccuucuaccucaagaauggguacaacacuuuuaucaagaagcagccccugcccagucagaugucgcguuauuacguuucguaaacccugauacaggacgaguacuuuuugaaugcaaacuacacaaaucaggauauguaacaguagcacauacaggacagcacgauuuaguaauaccaccaaauggauacuucagauuugauuccuggguaaaucaauuuuacaccuuagcaccaaugggaaauggaacaggcagaaggagagcauuauaa

SEQ ID NO: 32117 - RNA, 1623 nt, Artificial Sequence
  derived and/or modified sequence opt6 from VP1__Norovirus__BAS30083
augaaaauggcuagcaaugacgcaaauccaucagauggauccgcagcaaaucuaguaccagaaguuaacaaugaaguaauggcauuagaaccaguagucggcgcagcaauagcagcaccugucgcaggacaacaaaacguaauagacccauggauaagaaauaacuuuguucaggccccagguggagaauuuacaguaucaccuagaaacgcacccggcgaaauauuauggucagcgccuuuaggacccgaccuaaauccuuauuuaucccacuuagcaagaauguauaacgguuaugccggaggauuugaaguacaaguuauacuagcaggcaaugcuuucacagcaggaaaaaucauauucgcagcaguaccaccaaacuuuccaacugaaggcuuaucaccaucccaagugacaauguuuccacacauaauaguagacguaagacaacuagaaccaguauuaauuccccuucccgacgucagaaauaauuucuaucauuauaaccaaucaaaugacucaacaauaaaacuuauagcuaugcuauacacaccacuaagagcuaacaaugcuggagaagaugucuuuacuguaucuuguagaguucuaacaagaccauccccagauuucgacuuuauauuucuaguaccaccuacaguagaaucaagaaccaaaccauucaccgucccaaucuuaacaguagaagaaaugacaaauucccgcuuuccaauaccacuagaaaaauuauuuacaggaccaucaucagcauuuguaguccaaccccaaaacggcagaugcacaacugacgguguacuucucgguacaacucaacuuucuccuguaaauauauguacauuuagaggagauguaacacauauagcaggauccagaaauuacacaaugaaccucgcaagcuuaaauuggaacaauuaugacccaacagaagaaauaccugcaccauuaggaacuccagauuucguugguaaaauacaaggcguauuaacccaaacaacaaaaggagacgguagcacaagaggacacaaagcaacagucuauacaggcagcgcaccuuuuaccccaaaacuagguucaguucaauucucaacagacacagaaaacgacuuugaaacacaucaaaauacaaaauucacacccguaggaguaauacaagacggcgguacuacucacagaaaugaaccucaacaauggguacucccuagcuacucaggaagaaauguaccaaacguacacuuagcuccagcaguugcaccuacauuuccuggugaacaauuauuauucuuccgcucaacaaugcccgguugcucaggauaccccaauauggauuuagauugccuauuaccacaagaauggguacaacacuucuaucaagaagcagcuccagcacagucagacguagcauuacuaagauucguaaaucccgauacaggacguguacuuuucgaaugcaaauuacacaaaucaggauauguaacaguugcacauacaggacaacaugauuuaguaauaccaccaaacggauacuuccgcuuugauucauggguaaaccaauuuuacacacuagcuccaaugggaaauggaacaggacgacgaagagcauuauaa

SEQ ID NO: 32118 - RNA, 1623 nt, Artificial Sequence
  derived and/or modified sequence opt6 from VP1__Norovirus__BAS30086
augaaaauggcauccaaugaugcaaacccauccgauggaucagccgccaaccuaguaccagaaguuaauaacgaagucauggcacucgaaccaguuguuggagcagcaauagcagcccccguagcaggucaacaaaauguaauugacccuuggauaagaaauaauuuuguacaagcaccaggaggagaauucacaguuucaccaagaaacgcuccaggagaaauacuauggucugcaccucuaggcccagaucuaaacccuuaccucucucacuuagcaagaauguacaauggauacgccggcgguuucgaaguacaaguaauacucgcagguaaugcauuuacugcaggaaaaauaauauucgcagcaguaccacccaacuucccaacagaaggucucucaccuucacaaguaacuauguuuccucacauaauuguugacguaagacaauuagaaccaguucuaauaccccuacccgauguaagaaauaauuucuaucacuauaaccaaucaaaugacuccaccauuaaauuaauagcaaugcucuauacaccacuccgugcaaauaaugcaggagaagauguauuuacaguaucaugccgcguauuaacucgaccaucaccagauuuugauuuuauauuccuaguaccaccaacaguagaaucaagaacaaaacccuuuacuguaccugucuuaacgguagaagaaaugacaaauucuagauucccaauaccacuagagaaacuauuuacagguccaucaucugcauuuguuguacaaccacaaaacggaagauguaccacagaugguguacuuuuagguaccacacaacuaucaccgguaaauauaugcacauucagaggugauguuacucauaucgcaaauucacacaacuauacaaugaaccuagccucauuaaacuggaauaacuacgacccaacagaagaaauuccagcaccacuaggaaccccugauuuuguugguaaaauacaaggaguacuaacacaaacaaccaaaggagacggauccaccagaggacauaaagcaaccguauauacaggcuccgcaccauuuacgccuaaauuaggaucaguacaauuuucaacagacacagaaaacgauuucgaaacacaucaaaacacaaaauucacaccagucgguguaauacaagacggaggaacuacccauagaaaugaaccucaacaauggguucuuccuuccuauucaggacguaauguacaaaauguacacuuagcaccagccguugcaccaacuuuucccggcgaacaauuacuuuucuuuagaucuacaaugccaggaugcucuggauauccaaauauggaucuagauugucuauuaccacaagaauggguucaacauuucuaucaggaagcagccccagcacaaucagacguagccuuacuacguuuuguaaacccagacacaggaagaguauuauucgaauguaaacuacacaaaucagguuauguuacaguagcacacacaggacaacacgaucuagucauaccaccaaauggauauuuccgcuucgacucauggguaaaccaauucuacacacuagccccuaugggaaauggaacuggaagaagacgagcauuauaa

SEQ ID NO: 32119 - RNA, 1623 nt, Artificial Sequence
  derived and/or modified sequence opt6 from VP1__Norovirus__BAS30089
augaaaauggcuucaaaugaugcaaacccaucagacggcuccgcagccaauuuaguaccagaaguaaacaaugaaguaauggcucuugaaccuguagucggagcagcaaucgcugcaccaguagcaggacaacaaaauguaauagacccauggauaagaaacaacuucguccaagccccaggcggagaauuuacaguaucuccaagaaaugcaccaggagaaauacucuggucagccccucuaggcccugacuuaaauccauaccuaucacacuuagcuagaauguauaacggauacgcaggaggcuuugaaguucaaguaauacuagcaggaaacgcauuuacugcgggaaaaauaaucuucgcagcuguaccaccaaacuuuccaacagaaggacuuucacccucacaaguaacaauguuuccucacauuauuguagauguacgacaauuagagcccguccuaauuccacuaccagacguacgcaacaacuucuaucacuacaaccaaucaaacgacucaacuauaaaacuuauagcaaugcuauauacaccauuacgagcaaauaaugcuggagaugacguauuuaccguaucaugccgcguucuaacaagaccaucccccgauuucgauuuuauauuucuaguaccuccuaccguagaaucaagaacaaaaccauucacaguaccaauacuaaccguugaagaaaugacaaauucuagauuuccaauuccauuagaaaaacuauucacaggaccaucaucugcauucguaguacaaccacaaaacgguagauguacaacagaugguguauuacuaggaacaacacaacuaucacccguuucaaucugcacauucagaggagauguaacacacauagcaggaucaagagauuacacgaugaaccuagcaagucuaaacuggaacaauuaugacccaacagaagaaauuccagcucccuuaggaacaccagauuuuguaggaaaaauacaaggcguauuaacacaaacaacaaaaggagacggaucuacacguggccacaaagccacuguauauacuggcucugcuccuuucacaccaaaacuugguucaguacaauucucgacagacacagaaaaugauuuugaaacacaccaaaauacaaaauuuacacccguaggcguaauucaagauggaaguacagcccauagaaaugaaccucaacaauggguauuaccgucuuacagcggcagaaauguucaaaacguacacuuagcaccugccguagcuccaaccuucccaggagaacaacuauuauuuuuuagaucaacaaugccuggaugcucaggauacccaaauauggauuuagauugucuauuaccccaagaauggguacaacauuuuuaccaggaagcagcuccagcucaaucugacguugcacuacuaagauuuguaaacccagacaccggaagaguccuauuugaauguaaauuacacaaaucuggauauguaacaguagcacacaccggccaacaugaucugguuauuccaccaaacggauauuucagguucgauucauggguuaaucaauuuuauacucuagcacccauggguaacggcacaggaagacgacgagcacuauaa

SEQ ID NO: 32120 - RNA, 1623 nt, Artificial Sequence
  derived and/or modified sequence opt6 from VP1__Norovirus__BAS30092
augaaaauggcuucaaaugacgcuaacccaucagauggaucagcagccaacuuagucccagaagucaacaaugaaguaauggccuuagaaccuguuguuggagcagcaauagcggcuccaguugccggacaacagaacguaauagacccauggauacgcaauaacuuuguacaagcaccugguggcgaauuuacagucucaccaagaaaugcucccggcgaaauauuauggucugccccucuagguccagacuuaaauccuuaccuuucucacuuagccagaauguacaacggauaugcaggaggauucgaaguacaaguaauucuagcaggaaaugcauuuacagcaggaaaaaucauuuucgccgcaguaccaccuaauuuuccaauagaaggcuuaucgccaucccaaguaaccauguucccacacauaauaguagacguaagacaacuagaaccaguucuaauuccauuaccugauguaagaaauaauuucuaucauuauaaucaaucaaaugauucaacaauaaaacuuauagccauguuauacacaccauuacgagccaacaacgcaggagaagacguauucacaguuucaugucgcguuuuaaccagaccaucaccagauuuugacuucauauuuuuagucccaccuaccguagaaucuagaacaaaacccuuuaccguaccaauauuaacaguagaagaaaugaccaacucaagauucccaauuccauuagaaaaacuauucacuggacccaguagcgccuuuguaguucaaccccaaaacggcagaugcacaaccgauggaguccuacucggaacaacacaauuaucccccguaaauaucugcacuuuucgcggcgacguuacucauauagcuuccagucgaaauuacacuaugaaucucgcaucauuaaacuggaauaauuaugauccaacagaagaaauacccgcaccuuuaggaacaccugacuuuguaggaaaaauucaaggaguuuuaacacaaaccacaaaaggagacggauccacuagaggucacaaagccacaguauauacaggcucagcacccuucacaccaaaacuaggaucuguacaauuuucuacagacacagaaaacgauuucgaaacucaccaaaacacuaaauucacaccaguaggaguaauccaagauggaggaacgacacaucgaaaugaaccucaacaauggguauuaccaucuuauuccggaagaaacgucccaaacguacacuuagccccagcaguagccccaacauucccaggagaacaacuauuauucuuuagaucuacaaugcccggcugcuccggauauccaaauauggaucuugacugucuauuaccucaagaauggguacaacauuuuuaucaagaagccgcucccgcucaaucagacguugcacuauuaagauucguaaacccagauacuggacgaguccuuuucgaaugcaaacuacacaaaucaggauacguaacaguagcucauacaggacaacacgaucucguaaucccucccaacggauauuucagauucgacaguuggguaaaucaauuuuauacacuagcaccaaugggaaauggaacuggaagacgcagagcucucuaa

SEQ ID NO: 32121 - RNA, 1623 nt, Artificial Sequence
  derived and/or modified sequence opt6 from VP1__Norovirus__BAS30095
augaaaauggcaucaaacgaugcuaacccauuugaugguucagccgcuaaccuuguuccagaaguaaacaaugaaguaauggcacuugaaccaguaguaggugcagcaauugcagcaccaguagcuggccaacaaaauguaaucgacccuuggauaagaaacaauuuuguacaagcaccagguggugaauuuacaguaucacccagaaaugcaccuggugaaauacuauggucagcaccauuaggaccugaucuaaauccauaucuaagccauuuagccagaauguauaacggcuaugcaggagguuucgaaguacaaguaauauuagcuggaaaugccuuuacagcaggaaaaauaaucuuugcagcaguaccaccaaauuuuccagccgaagguuuaucaccaucacaaguaacaauguucccacacauaauuguagauguacgacaauuagaaccuguacucaucccauuaccagauguacguaacaauuucuaccauuauaaccaauccaaugauuccacaauaaaacucauugcaaugcuauauacacccuuaagagcaaacaaugcaggagaagauguauuuaccguuucaugccgaguauuaacucgaccuucaccagauuuugacuucaucuuuuuaguaccaccaacaguagaaucaagaacuaagccauuuacaguuccaauucuaacaguugaagaaaugacaaacucaagauuuccaaucccacuagaaaaacuauuuacagguccauccagcgcauuuguuguacaaccacaaaacggaagaugcacuacagacggaguauuacucggaacaacacaacuaucacccgucaauauauguacauuuagaggugacguaacucauauagcaggaucuagaaacuacacaaugaauuuagcuucccucaauuggaacaauuacgauccaacagaagaaauaccagcuccauuaggaacacccgauuuugucggaaaaauacaaggagucuuaacacaaacaaccaaaggagacggauccaccagaggacauaaagcaacaguauauacuggaagcgcuccauuuacccccaaacuaggauccguacaauuuucaacagacacagaaaaugacuucgaaacacaucaaaacaccaaauuuacaccaguaggaguaauccaagauggaggaaccacacacagaaacgaaccccaacaauggguacucccaucauauucaggaagaaauguuccaaacguacauuuagccccugcagucgcuccuacuuuccccggagaacaacuucuauucuuuagaagcaccaugccaggaugcucagguuauccaaacauggaccuagauugcuuacuaccacaagaauggguucaacacuuuuaucaagaagcugcaccagcacaauccgauguugcauuacuaagauucguaaacccagauacuggaagaguacuauuugaauguaaguuacauaaaaguggauacgucacgguagcucacacaggccaacacgauuuaguaauacccccaaauggauacuuucgauucgauucuuggguaaaucaauuuuacacucuagcaccaaugggaaacggaacuggaagaagaagagcauuauaa

SEQ ID NO: 32122 - RNA, 1623 nt, Artificial Sequence
  derived and/or modified sequence opt6 from VP1__Norovirus__BAS30098
augaaaauggcauccaaugacgccaacccuucagauggaucugccgcaaaucuaguaccagaagucaauaaugaaguaauggcauuagaacccguuguuggagcagcaaucgcagccccagucgccggucaacaaaauguaauagacccauggauaagaaauaauuuuguacaagcaccuggaggagaauuuaccgucucuccuagaaaugcuccaggagaaauccucugguccgcaccauuaggaccagaucuaaacccauaccuaucucaucuagccagaauguauaacgguuacgcagguggcuuugaaguccaagucauacuagcaggaaaugcauuuacagcaggcaaaaucauuuuugcagcuguacccccaaacuucccaacagaaggucuaucaccaucacaaguaacaauguucccacacauaauaguugacgucagacaacuagaaccaguacuaauaccacuaccagauguaagaaacaacuucuaucauuauaaccaaucuaaugacucaacuauuaaauuaauagcaauguuauacacuccuuuaagagcaaacaaugcaggagaagauguauucaccguaucaugccgaguacuaacaagaccaucaccugauuuugacuuuauauuucuagucccacccacagucgaaucuagaacaaaaccauuuacaguaccaauauuaaccguagaagaaaugacaaauucucgauuucccauaccacuagaaaaacuuuuuacaggaccaucaucagcauuuaucguacaaccacaaaacggcagauguacaacagacggaguauuacuagguacaacacaacuaucaccgguaaacaucuguacuuuuagaggugauguaacacauauagcaggaaguagaaauuacacaaugaauuuagcaucacuaaacuggaacaauuacgacccaaccgaagaaauaccagcaccccuuggaacaccagacuuuguaggaaaaauacaaggcguacuuacacaaacaaccaaaggagacggauccacucgaggccauaaagccaccguauauacaggcucagcaccauuuacuccaaaacuaggaucaguccaauucaguaccgauacagaaaaugauuucgaaacacaccaaaauacaaaauucacaccuguaggagucauacaagauggaggaacaacccacagaaaugaaccacaacaaugggucuuaccauccuauucuggacgcaacguaccuaacguacacuuagcaccagcaguagcaccaacauuucccggagaacaauuacuauucuuucgcucaacaaugccaggauguucaggcuauccaaacauggaucuagauugucuucuaccucaagaauggguucaacauuucuaucaagaagcagcaccagcucaaucugacguagcacuuuuaagauuuguuaauccagacacaggacgaguauuauuugaauguaaacuacauaagagcggcuacguaacaguagcacacaccggacaacaugacuuaguaaucccacccaaugguuauuuuagauuugacucuuggguuaaccaauuuuauacauuagccccaaugggaaauggaacaggaagaagacgagcacuguga

SEQ ID NO: 32123 - RNA, 1623 nt, Artificial Sequence
  derived and/or modified sequence opt6 from VP1__Norovirus__BAS30101
augaaaauggcaucaaaugacgcaaacccaucugacggauccgcagcaaacuuaguaccagaaguuaauaacgaaguuauggcauuagaacccguaguaggugcugcaauagcagcaccaguagcaggucaacaaaauguaauagacccauggauaagaaacaacuuuguucaggcaccaggaggagaauuuacaguauccccaagaaaugcuccaggagaaaucuuauggucagcuccacuagguccugaccuaaauccauaucuaucgcaucuagcaagaauguauaaugguuacgccggaggauuugaaguacaaguaauacuagcaggcaaugcuuucacagcaggcaaaauaauauuugccgccguaccccccaacuuuccaacagaaggacuaucccccucucaagucaccauguuuccccacauaauuguagacguucgacaacuagaacccguauuaauaccauuacccgauguaagaaauaacuuuuaccacuacaaucaaucaaaugauagcacuauuaaauuaauagcaauguuauacacuccauuaagagcuaacaaugcaggagaagacguauuuacaguaaguuguagaguauuaacaagaccuucaccagacuuugauuucauauuuuuaguaccaccaacaguggaaucacgaacaaaaccauuuacaguaccuauccuaacuguagaagaaaugacaaacucaagauuuccaaucccacuagaaaaauuauuuacaggaccaucuucugcauuuguaguacaaccacaaaauggcagaugcacaaccgacgguguauuauuagguacaacucaacuaucaccaguaaacaucugcaccuuuagaggagacguaacccacauagcaggaucacgaaacuauacaaugaaucuagcauccuuaaauuggaacaauuacgaccccacagaagaaauaccugcaccucuaggaacaccagacuuuguagguaaaauucaaggagucuuaacccagacaacuaaaggugacggaucaacaagaggacacaaagccaccguauauacagguuccgcaccauucacacccaaauuaggcucaguacaauucucuacagauacugaaaacgacuuugaaacacaucaaaauacaaaauucacacccguuggaguaauacaagacggaucgaccgcacaccguaaugaaccacaacaauggguacucccaucauauucuggacgaaacguccaaaauguacacuuagcaccagcaguugcucccacuuuuccaggugaacaacuauuauucuucagaucuacaaugcccgguuguucaggauauccaaauauggauuuagauugucuacuaccacaagaauggguucaacacuucuaucaagaagcagcuccagcacaaagugacguugcacuauuaagauuuguaaauccugacacaggccgaguacuauucgaauguaaauuacauaaaucaggauauguaaccguugcacauacaggucaacacgaccuaguaauccccccaaacggauacuucagguucgacucauggguaaaucaauuuuauacccuagcaccaaugggcaauggaacaggcagaagaagagcuuuauaa

SEQ ID NO: 32124 - RNA, 1623 nt, Artificial Sequence
  derived and/or modified sequence opt6 from VP1__Norovirus__BAS30104
augaaaauggcuucuaacgaugcaaacccaucagauggaucagcagccaacuuagucccugaaguaaacaacgaaguaauggcauuagaaccuguaguaggagcagcaauugccgcuccagucgcaggacaacaaaauguaauagacccauggauaagaaauaacuuuguccaagcuccaggaggagaauuuacaguaucaccaagaaaugccccaggagaaauacuauggucagcaccacuaggucccgaucuaaaucccuaucucucucaccuagcaagaauguacaacgguuacgcaggaggauucgaaguucaaguaauacuagcuggcaacgcuuuuacagcaggaaaaauaauauucgccgcagucccuccaaacuuuccaaccgaaggucuauccccaagucaaguaacaauguuuccucacauaauaguagauguacgacaauuagaaccaguacuuauaccacuuccagacgucagaaacaauuuuuaucauuauaaccaaucaaaugauucuacuauaaaacuaaucgcaauguuauacaccccccuaagagcaaauaacgcaggagaagacguauuuacaguaaguuguagaguuuuaacaagaccauccccugauuucgacuuuauauucuuaguaccaccaacuguagaaagcagaacaaaaccauucacagucccaaucuuaacaguagaagaaaugacaaauucaagauucccaauaccauuagaaaaacucuucacaggaccaucuucugcauuugucguacaaccacaaaacggaagaugcacaacagacgguguccuauuaggaacaacacaacuaaguccaguuaauauauguacauuccgaggugacgucacacacauagcagguucacgagauuauacaaugaauuuagcuucuuuaaauuggaacaauuacgacccaacagaagaaauuccagccccauuaggaacaccagauuuugugggaaaaauacaaggaguuuuaacacaaacuacaaaaggugacggaucaacuagaggacacaaagcaaccguuuacacagguucagcaccauucacaccuaaauuagguuccguacaauuuucaacagacacagaaaaugauuuugaaacacaccaaaacgcuaaauuuacucccguaggaguaauucaagacggaucaacaacccaucgaaaugaaccacaacaauggguacuucccucuuauucuggaagaaauguaccaaacguacauuuagcgccugcaguugcuccuacauuucccggagaacaauuauuauuuuuccguucaacaaugccaggaugcucaggcuaucccaauauggaccucgauugccuauuaccacaagaauggguacaacacuuuuaucaagaagccgcaccagcacaaucagacgucgcacuauuaagauuugugaauccagacacagguagaguauuauucgaauguaaacuacauaaaucaggauauguuacaguagcacacacaggccaacacgaccuaguaauaccaccuaacggcuauuuuagauuugacucuuggguaaaccaauuuuauacuuuagcaccaaugggaaacggaacaggaagacgaagagcacuauaa

SEQ ID NO: 32125 - RNA, 1623 nt, Artificial Sequence
  derived and/or modified sequence opt6 from VP1__Norovirus__BAS30107
augaaaauggcaucaaaugacgcaaauccaagcgauggcucaacagcaaaccuuguaccagaagucaacaaugaaguaauggcacuagaaccaguaguaggugcagcaaucgcagcaccuguugcuggacaacaaaauguaauagauccauggauaagaaacaauuucguucaagcuccaggcggagaauucacaguaucuccacgaaacgcaccaggugaaauacuauggucugcaccauuaggaccugacuuaaauccauauuuaucacaucuagcacgaauguauaacgguuacgcagguggauuugaaguacaagucauauuagccggcaacgccuuuacagcaggaaaaauaaucuucgcugcaguaccaccaaauuuucccacugaaggucuaaguccaucccaaguuaccauguucccacacauaauaguugacguacgacaacuagaaccaguuuuaauaccauuaccagauguuagaaauaauuuuuaucacuauaaucaauccaaugauucaacaauaaagcucauagcaaugcuuuacacaccacuaagagcaaauaaugcaggagaagaugucuuuacagucucuugccguguauuaacuagaccaucuccagauuuugacuuuaucuuuuuaguaccuccaacaguagaaucccguacuaaaccauucacaguaccaauacucacaguagaagaaaugacaaauagucgcuuuccaauaccacucgaaaaacucuuuacaggcccguccucagcuuuuguaguacaaccccaaaaugguagauguacaacugacggcguauuacuagguacaacacaauuaucaccaguaaacauauguacauuuagaggugacguaacucacauugcaggaucacauaacuacacuaugaaucuagcaucccuaaauuggaauaauuaugauccuacagaagaaauaccugcaccccuagguacaccagauuucguaggcaagauacaagguguauuaacacaaacaaccaaaggcgacggaucaacaagaggacauaaagccacaguauauacaggaagugcgccauuuaccccaaaauuaggaucuguacaauuuucuacagauacagaaaaugauuuugaaacacaucaaaauacaaaauucacccccguaggcguaauacaagauggaggcacaacacauagaaaugaaccacaacaauggguacuaccauccuauucaggaagaaauguccaaaauguucauuuagcacccgcaguagcuccaacauuucccggagaacaauuacuuuucuuucguaguaccaugcccggaugcucuggauaucccaauauggauuuagauugccuucuuccacaagaauggguacaacacuuuuaccaagaagcagcacccgcacaaagcgauguagcauuauuacgauucguaaacccagauacaggacgaguauuauuugaaugcaaauuacauaaaagugguuauguaacaguagcacauacaggacaacaugauuuaguaaucccuccaaauggauauuuuagauuugauucauggguaaaucaauuuuacacauuagccccaaugggaaacggcacaggcaggagacgugcauuauaa

SEQ ID NO: 32126 - RNA, 1623 nt, Artificial Sequence
  derived and/or modified sequence opt6 from VP1__Norovirus__BAS30110
augaaaauggcuuccaaugaugcaaacccauccgauggaucagcagcaaauuuaguaccugaaguaaauaaugaaguaauggcauuagaaccuguuguaggugcagcuauagccgcaccaguagcaggacaacaaaacguaauagaccccuggauaagaaacaacuucguacaagcaccaggaggagaauucacaguaucuccacgaaaugcaccaggagaaauacuauggucagcacccuuaggaccagaucuaaauccauaucuaucccauuuagcaagaauguacaacgguuacgcagguggauuugaaguccaaguaauacuagcuggcaaugccuucacagcaggcaaaauaauauuugcugcaguaccaccaaacuuuccaauagaaggauuaucccccucacaaguuacaauguuuccacauauuauagucgacguaagacaacucgaaccaguacuaauuccauuaccagauguccgaaauaauuucuaucauuauaaccaaucaaaugauucaaccauaaaauuaauagcaauguuauacacaccacuaagagcuaacaacgcaggagaagauguauucacaguuucauguagaguauuaaccagaccaucaccagacuuugacuuuauuuuuuuaguaccaccaacaguagaaagcagaacaaaaccauuuacuguuccaauauuaaccguagaagaaaugacaaacucacguuuucccaucccauuagaaaaacuuuuuacagguccaucaucugcuuuugucguacaaccacaaaaugguagauguacaaccgauggaguucuuuuaggcaccacacaacuauccccaguaaauauaugcacauucagaggagacguuacacauauagccggaucaagaaacuauacaaugaaucuagcaucacucaacuggaacaacuacgacccaacugaagaaauacccgcuccauuaggaacaccagauuuuguaggaaaaauacaaggaguauuaacucaaacaacaaaaggagacgguucaacaaggggacacaaagcaacaguuuacacaggaucagcaccauuuacaccaaaauuaggcucuguacaauucaguacagauaccgaaaacgauuucgaaacacaucaaaauacaaaauuuacgccaguaggaguaauacaagacgguggaacaacacauaggaaugaaccucaacaauggguauuaccuuccuauucaggucgaaauguaccaaacguacacuuagcaccagcaguugccccuacauuuccaggagaacaauuauuauucuucagaucaacaaugccaggauguucaggauauccaaauauggaucuagacugucuccucccacaagaauggguacaacauuucuaccaagaagccgcuccugcacaauccgacguagcuuuacuaagauucguuaauccugauacaggaagaguauuauucgaauguaaacuucauaaaucuggauacguaacuguugcucacacaggacaacaugauuuaguaauaccaccaaauggauauuucagauucgauucaugggucaaucaauuuuauacacuugcucccaugggaaaugguacaggaagaagacgcgcucuauaa

SEQ ID NO: 32127 - RNA, 1623 nt, Artificial Sequence
  derived and/or modified sequence opt6 from VP1__Norovirus__BAS30113
augaaaauggcaucaaaugacgcaaauccuucagacggauccgccgccaacuuaguaccugagguaaauaaugaagucauggccuuagaacccguaguaggagcugccauagcagcuccuguugcaggucaacaaaauguaauagacccauggauaagaaauaauuucguccaagcccccggaggagaauuuacugucaguccaagaaaugcaccaggagaaaucuuauggucugcaccacuaggaccagauuuaaauccauauuuaucccauuuagcucgaauguauaaugguuacgccggagguuuugaaguacaaguuauauuagcaggcaaugcauuuacagcaggcaaaauaauauuugcagcaguucccccuaacuucccaacagaaggacuaucaccuucucagguaacaauguucccacauauaauagucgacguccgacaacuagaaccuguacuaaucccacuaccagacguuagaaacaauuucuaucauuauaaccaaucuaaugacucaacaauaaaauuaauagcaauguuauacacaccccuaagagcaaauaaugcuggagaagacguauuuacaguauccuguagaguccucacaagaccaucaccagacuuugacuuuauauuccuaguacccccaacaguagaaagcagaacaaaaccauucacaguaccuauacuaacaguagaagaaaugacaaauaguagauuuccaauaccacucgaaaaacuauuuacaggaccuucauccgcuuucguaguacaaccacaaaacgggagaugcacaacagauggaguauuauuagguacaacgcaacuuucuccaguaaauauaugcacauuccgaggugacguuacacauauagcuggcagccgaaacuacacaaugaauuuagcaucacuaaacuggaacaacuaugauccuacagaagaaauaccagcgccacuaggaacaccagacuucgucggaaaaauucaaggaguauuaacacaaacaacaaaaggagaugguucaacacgaggacacaaagcaacaguauauacaggaucugcaccauucacaccaaaacuagguucaguucaauucucaacagacacagaaaacgauuuugaaacacaucaaaauaccaaauucacaccaguaggaguaauacaagacggaggcacuacucauagaaaugaaccacaacaauggguauuaccgucuuauucagguagaaauguccccaacguacaccuagcacccgcaguagcaccuacauuuccaggagaacaacuacuguucuuuagaucaacaaugccuggauguucuggauacccaaauauggacuuagauugucuauuaccacaagaauggguacaacauuucuaccaagaagcugccccagcucaaucugacguugcuuuauuacgauucguaaauccugauacaggccguguacuguucgaauguaaauuacauaaauccgguuauguaacaguagcacauacaggccaacacgauuuaguaauaccacccaauggauacuuuagauucgacuccugggucaaucaauuuuacacacuagcaccaaugggcaacggaacaggaagaagacgugcacuauaa

SEQ ID NO: 32128 - RNA, 1623 nt, Artificial Sequence
  derived and/or modified sequence opt6 from VP1__Norovirus__BAS30116
augaaaauggcaagcaaugaugcaaacccaucagauggaucagccgcaaacuuaguaccagaaguaaauaacgaaguaauggcacuagaaccagucguaggagcagcaauagcagcaccagucgcuggacaacaaaaugucauugacccuuggauaagaaauaauuuuguccaagcuccaggaggagaauucacaguauccccaagaaacgcaccaggagaaauauuauggucagcaccauuaggaccagacuuaaacccauacuuaucacaucuagcacguauguacaacggauaugcagguggcuucgaaguacaagucauauuagcuggaaaugcuuucacugcaggaaaaauuauauucgcugcaguaccaccaaacuuuccaacagaaggauuaucuccuucacaaguaacaauguuuccccacauaauaguagauguuagacaacuagaaccuguacuaauaccuuuacccgaugucagaaauaauuucuaccacuacaaucaaucaaaugauucuacaauaaaacuaauagcuaugcuauacacuccccuaagagcaaacaacgcaggagaagacguauucacuguaucauguagagucuuaacaagaccaucaccagacuuugacuuuauauuuuuaguaccaccaacaguugaaucuagaaccaaaccauucacaguaccaauccucacagucgaagaaaugacgaacuccagauuuccaauuccacuugaaaaauuauucaccggcccuucuucugcuuucguaguccaaccccaaaacggacgaugcacaacagacgguguacuauuaggaaccacucaacuuaguccaguaaauauauguacauucagaggagacguaacacacauagccggaucacgagacuacacuaugaaccuagcaucauuaaauuggaacaauuacgauccuacugaggaaauaccagcaccacuaggaacaccagacuuuguaggaaaaauacaaggaaugcuaacacaaacaacaaaaggagacgguucaacacggggucacaaagcaacugucuacacaggaagcgcacccuuuacaccaaaauuaggaucuguaagauuuucaacagacacagaaaaugauuuugaaauacaccaaaauacuaaguucacacccguaggaguaauacaagacggaucuacaacacauagaaaugaaccacaacaauggguuuuaccaucuuacucuggaagagaugcccacaauguccauuuagcaccugccguagcacccacauucccuggcgaacaacuacuuuucuucagaaguacaaugccaggauguucaggauauccaaauauggaccuagauugcuuacucccccaagaauggguacaacauuucuaccaagaagcagccccagcacaaucugacguagcacuccuaagauucguaaacccagacacaggaagaguucuauucgagugcaaauuacauaaaucaggauauguaacagucgcacauacaggacaacaugaccuaguaauaccaccaaauggauauuuccgauuugauucauggguaaaucaauucuacacacucgcuccaaugggaaacggaacagguagacgaagagcuuuauaa

SEQ ID NO: 32129 - RNA, 1623 nt, Artificial Sequence
  derived and/or modified sequence opt6 from VP1__Norovirus__BAS30119
augaaaauggcaucaaacgaugccaacccaucagauggaucugcagcaaauuuaguaccugaaguaaacaaugaaguaauggcauuagaaccaguuguaggugccgcuaucgcagcaccuguagcaggacaacaaaauguaauagauccauggauacguaauaauuuuguucaagcaccaggcggagaauuuacaguaaguccaagaaaugcacccggagaaauauuaugguccgcucccuuaggcccugacuuaaauccauauuuaucacacuuagcaagaauguacaacggauacgccggagguuucgaaguacaaguaauacuagcaggaaacgcauuuacagccggaaaaauaauauucgcagccgucccaccaaacuuuccuauagaaggucuuucaccuucucaagucacaauguucccccacaucauaguagacguaagacaauuagaaccaguacuaauaccccuaccagauguccgaaauaauuucuaccacuauaaccaaucaaaugauaguacaauaaaauuaaucgcaaugcuauacacaccauuaagagcuaacaaugcuggagaagauguauuuaccguaucaugccguguucuaaccagacccaguccagacuucgacuuuauauuccuaguaccaccaacaguagaaucccgaacaaaacccuucacuguuccuauuuuaaccguagaagaaaugacaaacucaagauucccaauaccauuagaaaaacuuuuuacaggacccucaucagccuuuguaguacaaccccaaaacggacguugcaccacagauggaguccuacucggaacaacacaauuaucuccuguaaauauaugcacauucagaggagacguaacacauauagcaggaucaagaaacuacacaaugaauuuagcaucucuaaacuggaacaacuacgauccaacagaagaaaucccagccccacuaggaacacccgacuuugucggcaaaauacaaggcguauuaacucaaacaaccaaaggagacggaucaacuagaggccauaaagcaacuguauauacaggaagcgcacccuuuaccccuaagcuuggcucaguucaauucucuacagauacagaaaacgauuucgaaacacaccaaaacacaaaauuuacaccaguuggaguaauacaagauggaggaacaacucaucgaaacgaaccacaacaauggguucuaccaucauacucaggaagaaauguuccaaauguacauuuagcgccagcaguugcaccaacauucccaggugaacaauuacuauucuuucgaucaacaaugccuggcugcucaggauacccaaauauggaucuugauugucuacuaccacaagaauggguacaacacuuuuaccaagaagcagcaccagcacaaucagauguagcacuuuuaagauucguaaacccugauacaggcagaguucuauuugaauguaaacuucauaaaucaggauacguaacaguugcacacaccggacaacaugaucuaguaauaccacccaauggauacuuccgauucgacucauggguaaaucaauuuuacacucuagcaccaaugggcaauggaacaggaagaagaagagcacucuaa

SEQ ID NO: 32130 - RNA, 1623 nt, Artificial Sequence
  derived and/or modified sequence opt6 from VP1__Norovirus__BAS30125
augaaaauggcuucaaaugacgcaaauccaagugaugguucagcagcaaacuuaguaccugaaguuaacaacgaaguuauggcacuagaaccagucguaggagcagccaucgcagcuccuguugcaggacaacaaaaugucauagauccauggauacgaaauaacuuuguucaagcaccuggaggagaauuuacuguaucaccaagaaacgcaccaggagaaauacucuggucagcaccacuagguccagacuuaaaucccuaccuuucacaccucgcaaggauguacaauggauaugcaggcggauucgaaguacaaguuauauuagcagguaacgccuucacagcaggaaaaauaauauucgcagccguaccuccaaauuuuccaacugaaggauuaagcccaucacaaguuaccauguuuccacauauaauuguagauguuagacaauuagaaccaguccuaauacccuuaccagauguccgaaacaauuuuuaucauuacaaucaaucaaacgacucaacaaucaaacuaauagcaaugcuuuauacaccauuacgagcaaacaaugcaggugaagacguauuuacaguaucauguagaguccuaacucgcccauccccagauuucgacuuuauauuuuuaguccccccaacaguagaaucucgaacuaaaccauucacaguuccaauauuaaccguugaagaaaugacaaacuccagauucccaauaccacuagaaaaauuauuuacaggaccaucaagcgcuuuugucguacaaccacaaaauggacgcuguacaacugauggaguacuacuaggaacaacacaauuaucaccaguaaacauaugcaccuuucgaggagacguuacacauauagcaggaucaagagauuauacuaugaaucuagcaucacuaaauuggaacaauuaugacccaacagaagaaaucccagccccacuagguacaccagacuucguuggaaaaauccaaggaauguuaacacaaacaacaaaaggagauggaucaaccagaggucauaaagcaaccguuuauacaggcucugcaccauuuacaccaaaauuaggcucaguaagauuuucaacagauacagaaaacgacuucgaaauccaucaaaauacaaaauuuacaccagucggaguaauacaagaugguucaacuacccacagaaaugaaccucaacaauggguucucccaucauacuccggaagagaugcacauaacguccacuuagcaccagcaguagcaccuacauuuccuggugaacaauuauuauuuuuuagauccacaaugccaggaugcucaggauaccccaacauggaucuugauugccucuuaccacaagaauggguacaacauuuuuaucaagaagcggcaccugcacaaucagacguagcuuuacuccgauuuguaaacccugacaccggaagaguucuuuucgaaugcaaacuacacaaaucuggauacguaacagucgcacacacaggacaacacgaccuaguaauacccccaaauggauacuuuagauuugacuccuggguaaaccaauuuuacacacuagcaccuauggguaauggcacuggaagaagaagaguccuauaa

SEQ ID NO: 32131 - RNA, 1623 nt, Artificial Sequence
  derived and/or modified sequence opt6 from VP1__Norovirus__BAS30128
augaaaauggcaucaaacgacgcaaaucccucagauggauccgcagcaaauuuaguaccagaaguaaauaaugaaguaauggcccucgaaccaguaguaggagcagcaauugcugcaccaguagcaggccaacaaaacguuauagauccuuggauaagaaauaauuuuguacaagcucccggaggagaauuuacuguaucgccacgaaacgcaccaggagaaauacuuuggagugcaccacucggaccagacuuaaauccauauuuaucacacuuagcaagaauguacaauggcuaugcaggaggauuugaaguccaaguaauacuagcaggaaaugcuuuuacagcaggaaaaauaauauuugcagcaguacccccaaacuuuccuacagaaggucuauccccaucacaaguuacaauguucccacacauaauaguagacguaagacaacuagaaccaguucucauaccauuaccagauguaagaaacaauuuuuaucauuacaaccaaucaaacgacuccacaauuaaauuaaucgcaaugcucuacacaccauuaagagcaaacaacgccggagaagauguauucacaguaagcugcagagucuuaacucgaccaucacccgacuuugacuuuauauuccucguaccaccaacaguagaaucaagaacaaaaccauucacuguacccauacucacaguagaagaaaugacaaacucaagauuuccaauuccacuagaaaaauuauuuacuggacccucaucagccuucguaguacaaccacaaaauggucgauguaccacagacggcguccuacuaggaacaacacaauuaucaccaguaaacauauguacauuuagaggagacguaacacauauugcugguucaagaaauuauacaaugaaccuagcaucauuaaauuggaauaauuaugauccgacagaagaaaucccugcaccacuaggaacaccugacuucguaggaaaaauacaaggcguacucacacaaacaaccaaaggugacggaucaacuagaggacacaaagcaacagucuauacuggaucagcaccauuuacccccaaacucggaucaguacaauuuucuacagauacagaaaacgacuuugagacacaucaaaacacaaaauucaccccaguuggaguuauacaagacggagguacuacccaccgcaacgaaccccaacaauggguauuaccuaguuauucugguagaaauguuccuaauguacaucuugccccagcagucgccccaacuuuuccuggagaacaacuccuuuuuuucagaucuacaaugccaggaugcagcggauauccaaacauggauuuagacugccuacuaccucaagaauggguacaacacuucuaucaagaagccgcaccagcacaaucugauguugcccuacuacgcuucgucaacccagauaccggucgaguccuauucgaaugcaaauuacauaaaucugguuauguaacagucgcacauaccggacaacacgauuuaguuauaccacccaacggauacuuuagauucgacucauggguaaaucaauucuacacacuagcaccaaugggaaauggaacaggaagaagacgagcauuauga

SEQ ID NO: 32132 - RNA, 1623 nt, Artificial Sequence
  derived and/or modified sequence opt6 from VP1__Norovirus__BAS30134
augaaaauggcuaguaacgaugcuaauccaucagauggaucagcugcaaaucuaguaccagaaguuaauaaugaaguaauggcauuagaaccaguaguaggagcagcuauugcagcuccaguagcuggacaacaaaauguaauagacccauggauaagaaauaacuuuguccaagcaccuggaggugaauuuacaguuaguccacgcaaugcuccuggagaaauacuauggucagcaccacuaggacccgaucucaacccauacuugucccaucuugcaagaauguacaaugguuacgcuggagguuucgaaguucaaguaauauuagcagguaaugcauuuaccgcugguaaaauuauauucgcugccguaccaccaaauuucccaacagaaggcuuauccccaucacaagucacuauguuuccacauauaauaguagauguaagacaauuagaaccaguacuaaucccauuaccagacguaagaaauaacuucuaucacuauaaccaaagcaaugauuccaccauaaaacuaauugcaauguuauauaccccguuacgugcaaacaaugcuggagaagauguauuuacuguaucaugcagaguacuaacaagaccuuccccagacuuugauuuuaucuuuuuaguaccuccaacaguggaaucaagaacaaaaccauucacuguaccaauauuaacaguagaagaaaugacaaauuccagauuuccaauaccacuagaaaaacuuuucacaggacccucauccgcauuuguaguacaaccacaaaauggaagauguaccacagacggcgucuuacuuggcaccacccaauuaucaccagucaauauuugcacuuuuagaggagacguaacacauauagcuggaucucgaaacuacacaaugaauuuagcaucacuuaacuggaauaauuaugaucccacagaagaaauuccugcuccucuuggaacaccagauuuuguaggaaaaauacaaggcauguuaacccaaaccacaaagggagauggaucuacacguggacacaaagcuacuguauauacaggaucagcucccuuuacuccuaaacuaggauccguucaauuuucaacagauacagaaaacgacuuugaaacacaccaaaauacaaaauuuacaccaguugguguaauccaagacggaucaacaacacauagaaaugaaccucaacaauggguauuaccaucuuauucaggcagagauguaccaaacguccaccucgccccagcaguagcacccacuuucccuggagaacaacucuuauucuuucgaucaacaaugccagguuguucagguuauccaaauauggauuuagauugucuauuaccacaagaauggguucaacauuuuuaucaagaagcagcaccagcacaaucagaugucgcacuacuccgauuuguaaacccagacacagguagaguacuauuugaaugcaaauuacauaaaucaggauacguaacagucgcacauacaggacaacacgacuuaguaaucccaccaaacggcuauuuccgauuugacucuugggucaaccaauucuacacacuugcaccaaugggaaauggaaccggaagaagaagagcacucuaa

SEQ ID NO: 32133 - RNA, 1623 nt, Artificial Sequence
  derived and/or modified sequence opt6 from VP1__Norovirus__BAS30137
augaaaauggcaucaaaugacgcaaauccaucagauggaucugcugcaaaucuaguaccagaaguaaacaaugaaguaauggcacucgaaccaguaguuggagcagccaucgcagcaccaguagcaggacaacaaaauguaauagacccauggauuagaaacaacuucguucaggcacccggaggugaauuuacaguauccccuagaaacgcacccggugaaauauuauggagcgcaccucuuggaccggauuuaaaucccuauuuaucacauuuagcucgaauguauaacgguuacgcuggaggauuugaaguacaaguaauccuagcuggcaacgcuuuuacagccggaaaaauaauauuugcagcaguaccaccaaacuucccaacagaagguuuaucacccagucaaguaacaauguucccacauauaauaguagacgucaggcaacuagaaccaguacuaauaccauuacccgauguccgaaacaacuucuaucauuauaaucaaucaaaugacuccacuauaaaacucauagcaauguuauacacaccccuacgagcaaauaaugcaggagaagauguauuuacaguuucaugucgaguauuaacacgaccaucucccgauuuugacuuuauauuuuuaguuccaccuacaguagaaucuagaacuaaaccauuuacaguuccuauauuaaccguagaagaaaugacaaacucaagauuuccaauuccucuagaaaaauuauucacaggcccuucuuccgcauuuguaguacagccccaaaacggccgauguacaacugacggaguacuacuaggaaccacucaguuaucuccuguaaacauauguacauuucguggagacguaacacauaucgcaggcuccagaaacuacacuaugaauuuagcaucacuaaacuggaacaauuaugacccaacagaagaaaucccagccccauuagguacuccugacuucguagguaaaauacaaggcguacuaacacaaacuacaaaaggggaugguucaacaagaggacauaaagccacagucuauacaggaagcgcaccauucacaccaaaacucgggagcguacaauuuaguaccgauacagaaaacgauuucgaaacacaucaaaauacaaaauuuaccccaguuggaguaauacaagacggaggaacaacacaucgaaaugaaccacaacaauggguucuaccaagcuauucaggaagaaaugucccaaacguacauuuagcacccgcaguagcaccuacauuuccaggagaacaauuauuauucuuuagauccacaaugccuggcugcucaggauaucccaacauggauuuagauuguuuacuaccacaagaauggguacaacacuuuuaucaagaagcagcaccagcacaaucagauguagcauuacuaagguucguaaauccagauacaggccggguucuauucgaaugcaaacuacauaaaucagguuauguaacaguagcucauacaggacaacacgaccuagucaucccaccaaacggauauuuuagauuugacagcuggguaaaucaauuuuauacuuuagcaccaaugggaaauggaacaggccgaagaagagcacuuuaa

SEQ ID NO: 32134 - RNA, 1623 nt, Artificial Sequence
  derived and/or modified sequence opt6 from VP1__Norovirus__BAS30140
augaaaauggccucaaaugacgcuaacccaucagauggaucugcagccaauuuagucccugaaguaaauaaugaaguaauggccuuagaaccuguaguaggcgcugcaauagcagcacccguagcuggacaacaaaauguaauugaucccuggauacgaaacaauuuuguacaagcuccuggaggagaauuuacaguuagcccaagaaaugccccuggagaaauacuuuggucagcaccacuagguccagaucuaaauccuuaucuaucacaccuagcaagaauguauaauggauaugcuggaggauuugaaguccaaguuauauuagcuggaaacgcauucaccgcaggaaaaauaauauucgcugcaguacccccaaauuuuccaacagaaggauuaucaccaucccaagucaccauguuuccacauauaauaguagacguuagacaacuagaaccaguucuuauaccauuacccgacguaagaaauaacuuuuaccacuauaaccaauccaacgacucaacaauaaaacuuauugcaauguuauacacuccacuacgggcuaacaaugcaggagaggacguauuuacaguuuccuguagaguacucacuagaccauccccugauuucgacuuuauauuuuuaguuccuccaacaguagaaucuagaacuaaaccuuuuacuguaccuauacuaacaguagaagaaaugacaaauucucgauuucccauucccuuagaaaaauuauucacaggaccaucaucagcauucguaguacaaccacaaaacggaagauguacaacagacggaguucugcuuggaaccacacaacuaucaccugucaacauaugcacauucagaggugacguaacacauauagcaggaucaagaaacuacacaaugaauuuagcaucacuuaacuggaacaauuacgauccuacugaagaaauaccugcaccacuuggaaccccagacuuuguaggcaaaauacaaggaguuuuaacacaaaccacaaaaggcgacggcucaacaagaggucacaaagcaacaguauacacagguucagcaccauuuacuccuaaauuaggcucaguucaauucucuacagauacagaaaaugacuucgaaacacaucaaaauacaaaauucacaccaguaggaguaauccaggauggaggaacaacccauagaaaugaaccucaacaauggguauuaccuucauauuccggucguaacguaccuaauguccauuuagcacccgcaguagcaccaacauuuccaggagaacaacuauuauuuuucagaucaacaaugccaggaugcuccggcuaccccaauauggaucucgauuguuuacuaccucaagaauggguucaacauuuuuaucaagaagcagcaccagcccaaucagacguagcacuccuaagauucguaaauccagauacaggacgaguuuuauucgaauguaaauuacacaagucagguuacguaacaguagcacacacaggucaacaugaccuaguaauaccacccaauggauauuucagauucgauucuuggguaaaucaauuuuacacauuagcaccaaugggaaaugguacuggaagaagacgagcauuauaa

SEQ ID NO: 32135 - RNA, 1623 nt, Artificial Sequence
  derived and/or modified sequence opt6 from VP1__Norovirus__BAS30146
augaaaauggcuuccaacgaugcaaacccuucugauggcagugcagcuaaucuaguaccagaaguaaauaacgaaguaauggcacuagaacccguaguaggagcagccauagcugcacccguagcaggacaacaaaacguuauagaccccuggauaagaaauaacuuuguacaagcaccuggaggagaauucacaguuucaccacguaaugcuccaggagaaauauuauggagugcaccucucgguccagaccuuaauccauaucuaucacaucuagcaagaauguauaacggauaugcuggaggauucgaaguacaaguaauauuagcaggaaaugcauucacagcaggcaaaauaauauuugcagccguaccaccaaauuuuccaauugaaggacuaucaccgucacaaguaacuauguucccacauauuaucguugauguaagacaacucgaaccuguacuaauaccacuaccugauguccgaaacaauuucuaucauuauaaccaaucaaaugacucaacaauaaaacuaaucgcuaugcucuacaccccacuaagagcaaauaacgcaggugaagauguauuuacaguaucuuguagaguucuaacuagaccaucacccgauuuugacuucauauuucuaguacccccaaccguagaaucccgaaccaaaccauuuacaguaccaauuuugaccguugaagaaaugacaaacuccagauuuccaaucccacuugaaaaauuauucaccggaccuucgagcgcauuuguuguacaaccacaaaacggucgaugcaccacagauggaguacuuuuaggaacaacacaauuaucaccaguaaauauauguacauuccgaggagaugucacccacaucgcaggaucacacaacuacacaaugucuuuagcaucacuaaauuggaacaacuacgauccaacagaagaaauaccagcgccauuaggaacaccagacuuuguaggaaaaauacaaggagucuuaacucaaacaacuaaaggagacggaucaacaagaggacauaaagccacaguauauaccggaucagcuccauuuacaccaaaauuaggauccguacaauucucaacugacacagaaaaugauuuugaaacacaccaaaauacaaaauucaccccaguuggaguaauccaagauggaggaacaacacaucgaaaugaaccacaacaauggguauuaccauccuauucaggaagaaauguaccaaacguacauuuagcacccgcuguagcaccuacuuucccaggugaacaacuauuauucuuuagauccacaaugccaggauguucaggauauccaaacauggaucuagacugucuauuaccucaagaauggguucaacauuuuuaccaagaagccgcucccgcucaauccgauguugcacuauuacgauuuguaaaucccgacacuggaagaguucuauuugaaugcaaacuacacaaaucaggauacguaacuguagcucacacaggacaacacgaucucguuauuccaccaaauggcuauuuccgauucgauuccugggucaaucaauuuuacacucucgccccaaugggaaauggcacaggacgaagaagagcacuauaa

SEQ ID NO: 32136 - RNA, 1623 nt, Artificial Sequence
  derived and/or modified sequence opt6 from VP1__Norovirus__BAS30149
augaaaauggcuuccaaugacgcaaacccuucagauggcucagcagcaaacuuaguaccugaaguaaacaaugaaguaauggcacuagaaccaguaguuggugcagcaauagcagccccaguagcuggucaacaaaacguaauagacccauggauaagaaauaauuuuguccaagcaccuggaggagaauucacugucucuccaagaaaugccccuggugagauucuauggucagcuccauuaggacccgaccuaaaccccuaccuaucacacuuagcucguauguacaaugguuaugccggaggauuugaaguccaaguaauauuagcagguaaugcauucacagccgguaaaaucauauuugccgcaguaccaccaaauuuuccaacugaaggcuuaucaccaucacaaguaacaauguucccacauauuauaguagacguuagacaacucgaaccaguacuaauuccacuaccagacguacgaaacaauuucuaucacuacaaccaaucuaacgacuccaccauaaaacuaauagcaauguuauacacaccacuccgagcaaacaacgccggugaagauguauuuaccguuuccuguagaguacuaacaagaccaucaccagauuuugauuuuaucuuucuaguaccucccacaguagaaucccgaacaaaacccuucacuguaccaauacuaacaguugaagaaaugacuaacuccagauuuccaauaccuuuagaaaaauuauuuacuggacccucuucagcuuucguuguacaaccccaaaacggaagaugcacaaccgacggaguucuacucgguacaacucaauuaucaccaguaaauauauguacauuuagaggagauguaacacauauagcagguucacgaaauuacacuaugaaucuagcaucuuuaaacuggaacaacuacgaucccacagaagaaauaccggcaccuuuaggcacaccugacuuuguaggaaaaauacaaggagucuuaacacaaacaaccaaaggagacggaucaacaagaggucacaaagcaacaguauacacaggaucugccccauucacaccuaaacucggcucuguacaauucucaacagauacagaaaacgauuucgaaacacaucaaaacacaaaauucacaccagucggagucauacaagacgguucaacaacucaccgaaacgaaccucaacaaugggucuuaccaucauacucuggucguaauguaccaaauguacaccuagccccagcaguagcacccacauuuccaggugaacaacuauuauuuuuucgauccacaaugccagguugcuccggauauccaaauauggaucuagacugccuucuaccucaagaauggguacaacauuucuaucaagaagcagcacccgcacaaucagacguagccuuauuaagauucguaaacccugauacaggacgaguucuauucgaauguaaacuacauaaaucaggauauguaacaguagcgcauacuggacaacaugaucuaguaauuccuccaaacggauauuuccgauucgauucauggguaaaccaauucuauacuuuagcacccaugggaaauggaacaggaagaagaagagcacuauaa

SEQ ID NO: 32137 - RNA, 1623 nt, Artificial Sequence
  derived and/or modified sequence opt6 from VP1__Norovirus__BAS30152
augaaaauggcaucaaacgacgcaaacccaucagacgguucagcagcaaaccuaguacccgaaguaaauaaugaaguaauggcauuagaaccaguaguaggugcagcuauagccgcaccaguugcaggacaacaaaauguaauagauccuuggauacgaaauaacuuuguacaagcaccaggaggugaauucaccguaucaccuagaaaugcaccuggcgaaauacuauggucugcaccccuaggaccagauuuaaaccccuacuuaucacacuuagcacgaauguauaacggcuacgcaggaggauuugaaguacaaguaauucuagcaggaaaugccuucacagcuggcaaaauaauuuucgcagcaguuccaccaaacuucccaaccgaaggauuauccccaucacaagucacaauguuuccacacauaauaguugaugucagacaacuagaaccaguauuaauaccuuuaccagacguaagaaauaauuucuaucacuacaaucaaucuaaugauucuaccauaaaacuaaucgcaaugcuauauacuccauuacgagcaaauaaugccggugaagauguauucacaguaucauguagaguccuuacacgccccucaccagauuuugacuucauuuuucuaguuccaccaacaguugaaucacgaacaaaaccauucaccguuccaauacuaacaguagaagaaaugaccaacucucgauucccaauaccauuagagaaacuauuuacuggaccaucaucagccuuugucguacaaccacaaaauggaagaugcacaacugauggagucuuacuaggaacaacacaauuaaguccugucaauauaugcacauuuagaggugauguaacacauauagcaggaucuagaaacuauacuaugaauuuagcauccuugaacuggaacaauuacgaucccacagaagaaauuccagcuccauuaggaaccccagacuucguuggaaaaauacaaggaguacuaacacaaacaacaaaaggagacggcucaaccagaggacauaaagcaacaguauauacaggaucagcacccuucacaccaaaauuagguucaguucaauucucaacagacacagaaaaugacuucgaaacacaccaaaauacaaaauuuacaccuguaggaguaauacaagacggaggaacuacucaucgcaaugaaccucaacaaugggucuuaccauccuauucaggaagaaauguuccuaauguccaccuugcaccagccguugccccaacauuuccaggugaacaacuccuauucuucagaucaacgaugccagguugcucaggcuauccaaauauggaucuagauugccuauuaccacaagaauggguacagcauuucuaucaagaagcagcgccagcucaauccgacguagcauuacuaagauuuguaaauccagacacaggcagaguacuauucgaaugcaaauuacauaaauccggauauguuacaguagcacauacuggacaacaugauuuaguaauaccuccaaauggauacuucagauuugacucuuggguuaaucaauucuacacuuuagcaccuauggguaacggaacuggccgacgaagagcacuuuaa

SEQ ID NO: 32138 - RNA, 1623 nt, Artificial Sequence
  derived and/or modified sequence opt6 from VP1__Norovirus__BAS30155
augaaaauggcuuccaaugacgcaaauccuucagauggaucagcugcaaauuuaguaccugaaguaaacaacgaaguaauggcccuagaaccaguaguaggagcagcaauagcagcacccguagcaggucaacaaaacguaaucgaucccuggauacguaauaacuucguccaagcaccaggaggugaauuuacaguaucaccuagaaacgccccuggagaaauauuauggucagcaccucuaggaccagaucuaaacccauauuuaucucauuuagccagaauguauaacgguuacgcugguggauuugaaguacaaguuauauuagcaggaaaugcauuuacagcagguaaaauaauauuugcagcuguaccaccaaacuuuccaacagaaggauuaaguccaucucaaguaacaauguucccacacauaauuguagacguaagacaauuagaacccguacucaucccacuaccugauguaagaaauaauuucuaucauuacaaccaaucaaaugacucaacuauuaaacuaauagcuaugcuauacacaccauuacgagcaaauaaugcaggcgaagacgucuucacaguuucuuguagaguucuaacacgaccaucaccagacuuugauuuuauauuucuaguaccacccacaguagaaucuagaaccaaaccguucacaguaccuaucuuaacaguagaagaaaugacaaauucuagauuccccauaccuuuagaaaaauuauuuaccggcccaucaggagcuuucguuguacaaccacaaaacggaagaugcacaaccgauggaguauuacuugguacuacacaauuaucaccaguaaauauuugcacauuuaaaggagacguuacucacauugcuggaucaagaaauuacacaaugaaucuugcaucauuaaauuggaacaauuacgacccaacagaagaaauuccagcaccacuaggaaccccagacuucguagguaaaauacaagguguccuaacccaaacaacaaaaggagacggaucaacacgcggacacaaagcaacaguauauacuggaagcgcaccuuucacaccaaaauuaggaaguguucaauucagcaccgacacagaaaacgauuucgagacucaccaaaauacuaaauucacuccagucggagucauucaagauggaggaaccacucaucaaaaugaaccacaacaaugggugcuaccaucuuacucaggaagagacgucccaaauguucauuuagcuccagcaguagcuccuacuuuuccuggagaacaacuucuauucuuucgaucaacaaugccaggaugcucaggauaucccaauaugaaucuugacuguuuacuuccccaagaauggguacaacacuuuuaccaagaagcagcuccugcacaaucagacguugcauuacuaagauuuguuaauccagacacaggcagagucuuauuugaaugcaaauuacacaaaucaggcuauguaacaguagcacauacaggccaacaugauuuaguaauaccuccaaacggauauuuuagauucgauucauggguaaaucaauuuuauacauuagcuccuaugggaaaugguacaggaagaagaagagccuuauaa

SEQ ID NO: 32139 - RNA, 1623 nt, Artificial Sequence
  derived and/or modified sequence opt6 from VP1__Norovirus__BAS30158
augaaaauggccagcaaugaugcaaaucccucagacggaucugcagcuaacuuaguaccugagguaaacaaugaaguaauggcauuagaaccaguuguaggugccgcaauugcagcaccaguagcaggacaacagaauguaauagauccauggauaagaaauaauuucguacaagcacccggaggcgaauucacuguaucaccaagaaaugcaccuggcgaaauacucuggucugcaccuuuaggaccagacuuaaauccauaucuaucucacuuagcaagaauguauaacggauacgccggagguuucgaaguacaaguaauacucgccggaaaugcauuuacugcaggaaaaauaaucuucgcagcaguuccaccaaacuuuccuauugaaggacuaucaccaucacaaguaacaauguucccucauauuauaguagauguaagacaauuagaaccaguuuuaauaccacuaccagauguacgaaacaacuucuaucauuacaaucaauuaaacgacagcaccauaaaauuaauugccaugcucuacacuccacuucgagcuaacaaugccggugaagauguauuuacaguauccuguagagucuuaacuagaccuucacccgauuuugacuuuauauuucuaguaccaccaacagucgaaucuagaacuaaaccuuuuacaguuccaauauuaaccguugaagaaaugacaaauucaagauuuccaauuccauuagaaaaacucuuuacagguccaucuucagcauucgucguacaaccccaaaauggaagauguacaacugauggagucuuacuaggaaccacccaacuauccccuguuaacauauguacuuuuagaggugacguaacacauauugccggauccagaaacuacacaaugucucuagcaucacuuaacuggaacaauuacgauccaacugaagaaaucccugcaccuuuaggaacaccagacuuuguagguaaaauacaagguguauuaacucaaacaaccaaaggggacggaucaacacgaggccauaaagcaaccguauauacaggaucagcccccuuuacuccaaaacuaggaucaguacaauucagcaccgauaccgaaaaugauuucgaaacccaucaaaauaccaaauucacaccaguuggaguaauacaagacggaggaacaacacacagaaaugaaccacaacaauggguccuaccaucuuauucaggucguaauguaccaaacguacacuuagcacccgccguagcaccaaccuucccaggugaacaacuccucuucuuuagaucuacaaugccaggauguucaggauacccaaauauggauuuagauugcuuacuaccucaagaauggguccaacauuuuuaucaagaagcagcuccagcacaaucugacguagccuuauuaagauuuguuaauccagacacuggcagaguacuuuucgaaugcaaauuacacaaaucuggcuacguaacuguagcacacaccggccaacaugauuuaguaauaccuccaaauggauauuuucguuuugauaguuggguaaaucaauucuacacacuugcaccaaugggaaacggaacaggaagaagaagagcacuauaa

SEQ ID NO: 32140 - RNA, 1623 nt, Artificial Sequence
  derived and/or modified sequence opt6 from VP1__Norovirus__BAS30164
augaaaauggcaucaaaugacgcaaauccaucagacggaucagcugcaaaccuaguuccagaaguaaauaacgaaguaauggccuuagaacccguuguaggagccgcuauagcagcaccaguugcaggccaacaaaauguaauagacccauggauaagaaacaauuuuguacaagcaccaggaggcgaauuuacaguauccccaagaaaugcaccaggagaaauccuuuggucugccccacuaggacccgaucuaaauccauaucuaagccauuuagcuagaauguauaacggauacgcaggcggcuucgaaguccaaguaauacuugcaggaaaugcauuuaccgcaggaaaaauaauauucgcagcaguaccaccaaauuuuccaauugaaggauuaucaccuucacaaguuacuauguuuccacacauaaucgucgacguuagacaauuagaaccuguauuaauacccuuacccgauguacgaaacaauuucuaucacuacaaccaaucuaaugauucaacaauaaaauuaauagcuauguuauauacaccacuaagagcaaauaacgcaggagaagacguuuuuacaguuucuuguaggguacuuacccguccauccccagauuuugauuuuaucuuuuuaguaccaccuacaguagaaucaagaacuaaaccauuuacagucccaauauuaacagucgaagaaaugacaaauucuagauuuccaauaccauuagaaaaacuauucacaggaccaaguucagcuuucguaguacaaccacaaaacggaagauguacuacagauggcguacuuuuaggaacaacacaacuaucaccagucaauauaugcacauuuagaggagaugucacacauauugcaggaagucgaaauuauacuaugucucuggcaucacuaaacuggaacaacuacgacccaacagaagaaauaccugcaccacuuggaacaccagacuuugucggaaaaauacaaggcguacuaacccaaacaaccaaaggagacggaucuaccagaggacauaaagcaaccguuuauacuggaucagcacccuuuacaccaaaguuaggaucgguacaauucuccaccgauacagaaaacgauuuugaaacacaucaaaauacaaaauuuacccccgucggcguaauacaagauggaggaacaacucaucgaaacgaaccacaacaauggguuuuaccaucuuauucuggucgaaauguaccuaacguccaccuagcaccagccguagccccuacauucccaggagaacaacuacucuuuuuccgaucaaccaugccaggaugcucaggauauccaaacauggauuuagauuguuuauuaccgcaagaauggguacaacauuuuuaucaagaagcagcuccagcacaaucagacguugcauuauuaagauucguaaacccugauacaggacgcguacuguuugaauguaaacuccacaaaucugguuacgucacaguugcucauacaggucaacaugaucuaguaaucccccccaauggauauuuccgcuuugacuccuggguaaaucaauuuuacaccuuagcuccaaugggaaauggcacuggucgaagacgagcauuauaa

SEQ ID NO: 32141 - RNA, 1623 nt, Artificial Sequence
  derived and/or modified sequence opt6 from VP1__Norovirus__BAS30167
augaaaauggcaucaaaugacgcaaauccauccgacggcucugcagcaaaccuaguaccagaaguuaauaaugaaguaauggcacucgaacccguaguaggagcagccauagcagccccaguugcuggacaacaaaacguaauugauccauggauccgaaauaauuucguacaagcaccaggcggcgaauuuacaguuuccccaagaaaugcaccuggagaaauacuauggucugccccacuaggaccagacuuaaacccauaucuaucacaccuagcacgaauguacaacggauacgcuggcggauuugaaguucaaguaauacuagcaggaaacgccuuuacagcagguaaaauaauauuugcagcaguaccuccaaacuucccaacagaaggauuaucaccaucacaaguaacaauguuuccucauauaaucguagacguucgucaacuagaaccaguacuaauaccucuacccgauguaagaaacaauuucuaucacuauaaucaaucuaaugauucuacaauaaaacucauagcuaugcuauacacaccacuaagagcaaauaaugcaggugaagaugucuuuacaguuucuugccgaguacuaaccagaccuucaccagacuuugauuuuauauucuuaguuccaccaacuguagaaucaagaaccaaaccauucacaguaccaauacuuacaguggaagaaaugaccaauucuagauucccaauaccucuagaaaaacuuuuuacuggaccuucaucagcuuuuguuguacaaccacaaaaugguagauguaccaccgacggaguacuacucggaacaacacaauuaucuccaguaaauauauguacauuuagaggugacguaacccacauagccggaucuaggaacuacacaaugaaucuagcaucacuaaacuggaauaauuacgauccaacagaagaaauccccgcaccccucggaacaccagacuuuguaggaaaaauacaaggaguacuaacucaaacaacaaaaggcgauggaucaacucguggacauaaagcaacaguuuauacaggaucagcuccuuucacaccaaaacuaggcucaguccaauucucaacagauacagaaaacgacuucgaaacucaucaaaacacaaaguucacuccaguaggaguuauccaggauggaucaacaacucauagaaaugaaccacaacaauggguucuaccaucauacuccgguagaaauguaccaaauguacacuuagcaccugcaguagcuccuacauuuccuggugaacaacuauuauuuuuuagaucaaccaugcccggaugcucaggauauccuaauauggaucuugauuguuuauuaccacaagaauggguacaacauuuuuaccaagaagcagcacccgcacaaucugauguagcacuacuacgauuuguaaacccugacacuggcagagucuuauuugaauguaaacuacauaaaagcggauacgucacagucgcacacacuggacaacacgaucuaguuauaccuccuaauggauauuucagauucgauagcuggguaaaucaauucuacacuuuagcaccaaugggcaauggaacuggaagacgcagagcauuauaa

SEQ ID NO: 32142 - RNA, 1623 nt, Artificial Sequence
  derived and/or modified sequence opt6 from VP1__Norovirus__BAS30170
augaaaauggcuucaaaugacgcaaauccaucugauggaucagccgcaaacuuaguaccagaaguuaacaaugaaguuauggcauuagaacccguaguaggugcugcaauagcagcaccuguagcaggccaacaaaauguaauagauccauggauuagaaauaacuuuguacaagcuccagguggagaauuuacaguauccccacgaaaugcacccggagaaauauuauggucagccccacucggaccugaucuaaauccauacuuaucucaccuugcucgaauguacaaugguuacgcaggcggauucgaaguacaaguaauccuagcaggaaacgccuucacagcuggcaaaauaauauucgccgccguuccuccaaacuucccaacagaaggauuaucuccaucacaaguaacaauguucccucacauaauaguagacguacgacaacuagaaccaguucuaauaccauuaccggacguacgcaacaacuucuaccauuacaaucaaucaaacgacucaacaauaaaauuaauagcuauguuauacacaccauuaagagcaaacaaugcaggugaagauguauucacaguaagcuguagaguucuaaccagacccucaccagauuuugacuuuauauuucuaguuccaccaacaguagaaucaagaacaaaaccauucacaguaccaauacuuacaguagaagaaaugacuaauucaagauuuccaauuccauuagaaaaacuauuuacagguccuucuucggcauucguaguacaaccacaaaauggcagauguacaacugacgggguauuacuaggcacaacacaacuuucacccguaaauauaugcacauuuagaggagacgucacacauauagcuggaucucgaaauuauacuaugaauuuagccucacuaaacuggaauaauuacgacccaacagaagaaauaccugcuccccuaggcacaccugauuucgucggcaaaauacaaggaguacuaacacaaacaacuaaaggugacggaucaacacguggacacaaagcaacaguauacacagguucagcaccauucacuccaaaacuaggaaguguccaauuuucaacagauaccgaaaacgauuucgaaacacaccaaaacacaaaauucacuccagucggaguaauucaagacggaggaacuacccauagaaaugaaccucaacaauggguuuuacccuccuacucaggcagaaauguaccaaacguacaucuagccccagcaguagcuccaacauuuccaggugaacaauuacuuuuuuuuagaucaaccaugccaggauguucaggauauccaaauauggacuuagacugcuuauuaccacaagaauggguacaacauuucuaucaagaggcagcaccagcucagagcgauguagcgcuacuccgauucguaaauccagacacuggaagaguauuauucgaaugcaaacuacacaaaucuggauauguaacaguugcccauacaggccagcacgaucucguuauaccuccaaauggauauuuucgauuugauucauggguuaaucaauucuacacauuagcuccaaugggcaacggaacuggaaggcgcagagcccuuuaa

SEQ ID NO: 32143 - RNA, 1623 nt, Artificial Sequence
  derived and/or modified sequence opt6 from VP1__Norovirus__BAS30173
augaaaauggcuucaaaugacgccaacccuucugauggaucugcugcaaaccuaguacccgaaguaaauaaugaaguaauggcauuggaaccaguagucggagcagccauagccgcaccagucgcaggacaacaaaauguaauagauccuuggauacgaaauaacuucguacaagcaccugguggcgaauuuacaguaucuccaagaaacgcaccaggagaaauacuauggucagcaccccuaggaccagaucuuaauccauaucuaucucaccuugcacgaauguauaacggauacgcaggaggauuugaaguacaaguaauauuagcaggaaacgccuucacggcaggcaaaauaauuuucgcugcagucccaccaaauuuccccacagaaggacuuucaccaucccaagucacaauguuuccacacauaauaguagacguaagacaauuagaaccaguucuaauuccacuaccagaugugagaaauaauuucuaucacuacaaucaauccaaugacucaaccaucaaauuaaucgccauguuauacacaccauuacgagcuaacaaugcaggugaagaugucuuuaccguaucaugcagaguacuaacaagaccaucaccagacuuugacuuuauuuucuuaguaccaccuacagucgaaucccgaacaaaaccauucacaguacccauacuuaccguagaagaaaugacuaacucaagauuuccaauaccauuagaaaaacuauucacagguccaagcucagcuuucguuguccaaccacaaaacggacgauguacaaccgacggaguacuuuuaggaacaacacaacuaaguccaguaaauauaugcacauuucgaggagacguaacccauauagcaggaucaagaaauuacacaaugaauuuagcaucacuuaauuggaacaauuacgauccaacagaggaaauaccagcaccucuaggaacaccagacuuuguuggaaaaauucaaggaguauuaacccaaacaacaaaaggagacggauccacaagaggacacaaagccacaguauauacaggaucagcuccauucacaccaaaauuagguucuguacaauuuuccacagauacagaaaaugacuucgaaacacaucaaaacacaaaauuuacuccaguaggcguaauacaagaugguggcacuacucacagaaacgaaccacaacaauggguucucccaucauacucaggacguaaugucccaaauguccacuuagcaccagcagucgcaccaacauuuccaggugaacaacuauuauucuuucgaucaacaaugccaggaugcucaggcuauccaaacauggauuuagauugccuauuaccccaagaauggguacaacacuucuaucaagaagcagcaccagcacaauccgauguagcauuauuaagauucguuaauccagauacaggaagagucuuauucgaauguaaacuucacaaaucagguuauguaacaguagcccacacaggacaauaugaccuaguaauaccaccuaacgguuauuuucgauuugauucauggguaaaccaauuuuauacauuagcuccaaugggcaauggaacaggaagaaggcgagcauuauaa

SEQ ID NO: 32144 - RNA, 1623 nt, Artificial Sequence
  derived and/or modified sequence opt6 from VP1__Norovirus__BAS30176
augaaaauggcuucaaaugacgcaaauccuucagauggaucagcagccaacuuaguuccugaaguaaacaacgaaguaauggcuuuagaaccaguaguaggagccgcuauugcagcacccguagcaggacaacaaaauguaaucgaccccuggauacgcaauaauuuuguacaagcccccggaggagaauucacaguaucuccaagaaaugcaccaggagaaacauuauggagugcaccacuugguccagaucucaauccauaucuaagccaccuagcaagaauguacaauggguacgcugguggauucgaagugcaaguaauccuagcaggaaaugcauuuacagcagguaaaaucauauucgcagcagucccaccgaacuuccccacagaaggauuauccccuucccaagucacaauguuuccacacauaauaguagacgucagacaacuagaaccaguacuaauaccuuuaccagacguaagaaauaacuuuuaccauuauaaccaaucaaaugacucaaccauaaaauuaauagcuauguuauacacaccauuaagagcaaauaaugcaggagaagauguauuuacagucucuugucgagucuuaacaagaccuucaccagauuucgauuuuauauuucuaguuccacccacaguagaaaguagaacuaaacccuucacuguaccaaucuuaaccgucgaagaaaugaccaauucaagauuuccgauaccauuagaaaaauuauuuacaggaccuucaucagccuucguuguacaaccccaaaacggacgaugcaccacagacggaguauuacuuggaacuacacaauuaucuccuguaaauauauguacauuccgaggagacguuacccauauagcagguucuagaaauuacacaaugaauuuagcaucccuuaauuggaacaauuaugauccaacagaagaaaucccugcacccuuaggaacacccgacuucguaggaaaaauacaaggaauguuaacacaaacaacaaaaggcgauggauccacaagaggacacaaagcaacuguauauacaggaucagcaccauuuacaccaaaacuaggaucaguacaauucucaacagauaccgaaaacgacuucgaaacccaccaaaauacaaaauuuacacccguaggaguuauucaagauggaucuacaacccaccgaaacgaaccacaacaauggguacuaccauccuauucggguagaaauguaccuaacguacauuuagcaccugccguagccccaacauuuccuggagaacaauuacuauuuuuuagaucaacaaugccagguugcucaggauaucccaauauggacuuagauugucuacuaccccaagaauggguccaacacuuuuaccaagaagcagcccccgcacaaucugacguagcauuacuucguuuuguuaacccagauacaggaagaguacuauuugaauguaaacuccauaaaucaggauacguaacaguagcucacacaggacaacacgauuugguaauaccucccaacggauauuuucguuuugauucuuggguaaaucaauuuuauacacuagcgccaaugggaaacggaacuggaagaagaagagcccuguaa

SEQ ID NO: 32145 - RNA, 1623 nt, Artificial Sequence
  derived and/or modified sequence opt6 from VP1__Norovirus__BAS30179
augaaaauggcaucaaaugaugcaaacccuucagacggaucugcagcaaaccuaguaccugaaguaaauaacgaaguuauggcauuagaaccaguaguaggugcagcaauagcagcaccaguagcaggccaacaaaauguaauagacccauggaucagaaauaacuuuguacaagcaccuggaggugaauucacagucuccccuagaaaugcaccaggcgaaauacuauggucagcaccucuaggucccgauuuaaaucccuacuuaucacaccuagcaagaauguauaauggcuaugcuggaggauuugaaguucaagucauucuagcagguaaugcauucacagcuggcaaaauaauauucgcugcagucccaccaaacuuuccaaccgaaggccuaucaccaucacaaguaacaauguucccacacauaauaguagauguuagacaauuagaaccugucuuaauuccauuacccgauguacgcaauaacuucuaucauuauaaccaaucaaaugacaguacuauaaaacuaauagcaauguuauacaccccccuccgagcaaauaacgcaggagaagaugucuucacaguauccugucguguuuuaacacguccuucucccgacuuugacuuuauauuucuagucccaccaacagucgaaucucgaacuaaaccauucacaguaccuauacuaacaguagaagaaaugacaaauucaagauuuccaauaccacucgaaaaauuauuuacaggaccauccucagccuuuguuguucaaccacaaaacgguagaugcacaaccgacggauuacuacuaggcacaacacaauuaucacccgucaauauauguacuuuuagaggugacguaacacauaucgccggcucucgaaauuacacaaugaauuuagcuucacuaaacuggaacaauuacgauccaacugaagaaauaccugcaccccuaggaacccccgauuucguagguaaaauacaaggaaugcuaacacaaacaacaaaaggugacgguucaacacgagggcacaaagcaacaguauacaccggcuccgcacccuuuacuccuaaacuaggaucaguacaauucaguacagacacugaaaaugauuucgaaacucaucaaaauacaaaauucacaccagucggaguaauacaagauggaucuacaacacacagaaacgaaccacaacaauggguucuaccuucauacucaggacggaauguacccaacguacaccuugccccagcuguagcaccaacuuuuccaggugaacaacuccuauucuuucgaagcacaaugccaggauguucagguuaucccaacauggaucucgauugucuacuaccacaagaauggguucaacacuucuaccaagaagcugcaccagcucaauccgauguagcauuacuaagauuuguuaauccagacacaggaagaguauuauuugaaugcaaacuacauaaaucuggauauguaacaguugcacacacuggacaacacgaccuaguaauaccaccaaacggauauuuccguuucgauuccuggguaaaucaauucuacacauuagcuccaaugggcaauggaacaggaagaagaagagcauuauaa

SEQ ID NO: 32146 - RNA, 1623 nt, Artificial Sequence
  derived and/or modified sequence opt6 from VP1__Norovirus__BAS30182
augaaaauggcaucaucagaugcaaacccaucagacggcuccgcagccaacuuagucccagaaguaaacaacgagguaauggcuuuagaaccaguaguaggugccgcaauagcagccccaguagcaggccaacaaaacguaauagaucccuggauuagaaauaauuucguacaagcaccaggaggagaauuuacaguuucacccagaaacgcaccaggagaaauauuauggucagcuccucuaggaccagauuugaauccauaucuaucacaccuugcacguauguacaacggauaugcaggaggauuugaaguccaaguaauacuagcuggaaaugcauucacugccggcaaaaucauauucgcugcagucccuccaaauuucccuacugaaggccuaucaccaucacaagucacaauguuuccucauauaauaguagacgucagacaauuagaaccaguauuaauaccucuaccugauguacgaaacaauuucuaccauuauaaucaaucaaaugacucaacaauaaaauuaaucgccaugcucuauacaccacuaagagcaaacaaugcuggcgaagauguauuuacaguaucaugcagaguauuaacaagaccaucaccagacuucgauuucaucuuccuaguaccaccaacaguagaaucacgaacaaaaccauucacuguaccaaucuuaaccguagaagaaaugacaaauaguagauuuccaaucccccuagaaaaacuauuuacuggaccuucauccgcuuuuguaguccaaccacaaaauggcagauguaccacagauggcguucuuuuagguacaacacaacuaucacccguaaauaucuguaccuucagaggagacguaacacauauagcuggcucuagagauuacacaaugaaucuagcaucauuaaacuggaauaauuacgacccaacagaagaaauuccagcaccucuugguacuccagacuucguaggaaaaauacaagguaugcuaacacaaacaacuaaaggagacggaucaacccgaggacauaaagcaacaguuuacacaggaucagcuccauucacacccaaacuaggaucaguucaauuuucaacagacacagaaaacgacuucgaaacacaucaaaauacaaaauuuacacccgucggaguaauacaagauggcucaacuacacacagaaaugaaccacaacaauggguuuuaccuucauacucagguagaaauguaccaaacguacaccuagcucccgcaguagcacccacauuuccaggagaacaacuacuuuucuucagaucaacaaugccagguugcucaggauacccaaauauggaucuagacugcuuacuaccacaagaguggguacaacauuucuaucaagaagcagcuccagcacaaagcgauguugcacuuuuaagauuuguaaacccagacacaggacgcguuuuauucgaaugcaaauuacauaaaucuggauacguaacaguagcucauacaggacaacaugaucucgucauacccccaaaugguuacuucagauucgacucauggguaaaucaauuuuacacuuuagcuccuaugggcaacggaacagguagacgucgagcucuauaa

SEQ ID NO: 32147 - RNA, 1623 nt, Artificial Sequence
  derived and/or modified sequence opt6 from VP1__Norovirus__BAS30185
augaaaauggcaucauccgacgcaaacccuucagacgguuccgcagcaaaccuaguaccagaaguaaauaaugaaguuauggcauuagaaccaguaguaggugcugcaauagcagcucccguugcaggacaacagaauguuauagacccauggauacgcaauaauuuuguacaagcaccuggaggagaauuuacagucucaccaagaaaugcaccuggagaaauuuuauggucagcaccucuagguccugauuuaaauccauauuuaucacauuuagcucgaauguauaacggauacgcuggcggauuugaaguccaaguaauacuugcaggaaacgcauuuacagcaggaaaaauaauuuucgcagcaguacccccaaauuuuccaacugaaggccuaucuccuucccaaguuacgauguuuccacacauaauagucgauguaagacaauuagaaccaguucucauacccuuaccugauguucguaauaauuuuuaucauuacaaucaauccaacgauucuacaauuaaauuaauagcaauguuauacacuccauuacgugcaaacaaugcuggugaagacguuuuuacaguuuccugucgaguuuuaacaagaccaucuccugacuuugacuuuauauuucuaguaccaccuacaguugaaucaagaacaaaaccauuuacuguacccauacuaaccguagaagaaaugacaaacucaagauuuccaauaccacuagaaaaacuuuuuaccgguccaucauccgcuuucguaguccaaccacaaaaugguagauguacaacugaugguguauuacuuggcacuacccaacuaucaccagucaauaucugcacuuuuagaggagauguaacacauauagcaggcagccgcaacuauacaaugaaccuagcaucauuaaacuggaauaauuacgauccaacagaagaaauaccagcuccuuuagguacaccugacuuuguagguaaaauacaaggcauguuaacccaaacaacaaaaggcgacggaucuacaagaggacauaaagcaacuguauauacuggaucugccccauucacacccaaauuaggaucaguacaauuuucaacagauacagaaaaugauuuugaaacccaucaaaauacaaaauucacuccaguuggaguaauacaagauggaucaacaacacauagaaaugaaccucaacaauggguauuacccuccuacagcggaagaaacguaccaaauguacaucuagcucccgcaguagcaccaacauucccaggcgaacaauuacuauuuuuuagaucuacuaugccaggauguuccggcuacccaaauauggauuuagauugccuauuaccccaagaauggguccaacauuuuuaucaagaagcagcuccagcacaaucugauguugcacuucuacgcuuuguuaacccagacacgggucgaguauuauucgaauguaaauugcauaaaucaggauauguaacaguagcccacacaggacaacacgauuuaguaauacccccaaauggauauuuucgauuugacucaugggucaaucaauucuacacuuuagcaccaaugggaaauggaacaggacgaagacgugcacuauaa

SEQ ID NO: 32148 - RNA, 1623 nt, Artificial Sequence
  derived and/or modified sequence opt6 from VP1__Norovirus__BAS30188
augaaaauggcaucauccgacgcuaacccaucagauggaucagccgcaaaucuagucccugaaguaaauaacgaaguuauggcauuagaaccagucgucggagcugcuauagccgcacccguagcaggccaacaaaacguaauagaccccuggauuagaaauaauuucguacaagccccaggaggagaauucacaguuaguccccgcaacgcaccuggagaaauuuuaugguccgcaccauuaggaccagauuuaaaucccuaucuuucucacuuagcaagaauguauaauggauacgcuggaggcuucgaaguucaagucauacuagcugguaaugcauuuacagcaggaaaaauaauuuuugcagcaguaccaccuaacuuuccaacagaaggacuaucacccucacaaguuaccauguucccacacauaauaguugauguaagacaauuagaaccaguacucauaccauuacccgauguacgcaacaauuucuaucauuacaaucaaagcaaugauucaacuauaaagcuuauagcaauguuauauacuccauuaagagcaaauaaugcaggcgaagauguauuuacaguaaguugccgagucuuaacacgaccaucaccugauuuugauuuuauauucuuaguaccaccuaccguagaaucacgaacaaaaccauucacaguccccauacucaccguagaagaaaugacuaauagccgauuucccauaccccuagaaaaauuauuuaccggaccaucauccgcauuuguaguacaaccacaaaacggacgauguacaacugacggaguccuucucgguacaacacaacuaucaccaguaaauauauguacauuuagaggagacguaacacacauagcuggaucccguaacuacacaaugaauuuagcaucccuaaacuggaacaacuacgacccaacagaagaaauaccagcaccauuaggaaccccagauuuuguaggaaaaauacaagguauguuaacacaaacaacuaaaggugacggaucaacaagaggacacaaagcuacuguauacacagguuccgcaccauuuacacccaaauuaggauccguacaauuuucaacagacacagagaacgacuucgaaacacaucaaaauacaaaauuuacucccgucggaguaauacaugaugguucaacaacacauagaaaugaaccacaacaaugggucuuaccaucauauucaggccgaaauguaccaaacguucauuuagcuccagcaguagcaccuacauuuccaggcgaacaacuauuauucuuuagaucaacaaugccaggaugcucuggauacccaaacauggaccuagauugucucuuaccccaagaauggguucaacacuucuaucaagaagcagcaccagcucaaucagacguagcacuauuaagauuuguaaaucccgacacaggacguguacuauuugaauguaaacuacauaaaucaggauacguaacaguagcucauacaggccaacacgacuuaguaauaccaccuaauggauauuucagauucgauucaugggucaaucaauucuauacacuagcacccaugggaaauggaacuggacgaagaagagcauuauaa

SEQ ID NO: 32149 - RNA, 1623 nt, Artificial Sequence
  derived and/or modified sequence opt6 from VP1__Norovirus__BAS30191
augaaaauggcaagcaaugacgcuaacccaagugauggcucagcagcaaaucuuguccccgaaguuaacaaugaaguaauggcacucgaacccguuguuggagccgccaucgcagccccaguugccggacaacaaaauguaauugauccuuggauaagaaauaauuuuguacaagcuccuggcggagaauuuacaguauccccgagaaacgcaccaggagaaauauuauggucagcaccacuagguccugauuugaauccauaccuaucucaccuugcacgaauguauaacggauaugcaggagguuucgaaguacaaguaaucuuagccggaaaugcuuuuacugcagguaaaauaauuuucgcagcaguuccaccaaacuuuccaacagaaggacuaucaccaucacaagucaccauguucccucacauaauaguugauguaagacaauuagagccaguauuaauaccacuucccgacguaagaaacaacuuuuaucauuauaaccaauccaaugauucuacuauuaaacucauagcaauguuauauacaccauuaagagcaaacaaugcaggagaagauguauucacagucucaugcagaguacuaacaagaccaucaccagacuucgauuuuauuuuuuuaguaccaccuacaguagaaucuagaacaaaaccuuucacggucccaauacuaacaguagaagaaaugacaaauucuagauuccccauuccauuggaaaaauuauuuacaggcccaucaucagcuuuuguuguucaaccucaaaacggccgauguacaaccgacggcguauuacuaggaacaacucaauuaucaccagucaacauauguaccuuucgaggagacguuacucauaucgcaggaucaagaaauuauacaaugaacuuagcuucauuaaacuggaauaauuaugauccuacagaagaaauaccugcaccauuaggaaccccagauuuugucggaaaaauucaagguguauuaacacaaacaacaaaaggugacgguucuaccagaggacacaaagcaacugucuauacuggaucagcaccauuuacaccuaaacuaggaaguguacaauucgguacagauacagaaaaugauuucgaaacacaccaaaauacaaaauuuacaccaguaggagucauucaagacgguggcacaacacauagaaaugaaccacaacaauggguccuaccaucauacucaggaagaaaugucccaaacguucauuuagcaccagcaguagcaccaacauuuccaggagaacagcucuuauuuuuuagaucaaccaugcccggcuguucugguuacccaaacauggauuuagauugccuacuaccacaagaauggguccaacauuuuuaucaagaagcagcaccagcucaauccgacguagcacuacuaagauucguaaauccagacacuggaagaguacuuuuugaaugcaaauuacauaaaucaggauacgucacaguagcucacacaggacaacacgaccuaguaauaccacccaauggauauuucagauuugacucauggguaaaucaauuuuauacauuagcucccauggguaacggaacuggaagaagaagagcauuauaa

SEQ ID NO: 32150 - RNA, 1623 nt, Artificial Sequence
  derived and/or modified sequence opt6 from VP1__Norovirus__BAS30194
augaaaauggcuucaaacgaugcuaacccaagugauggaucagcagcaaacuuaguacccgaaguuaauaaugaaguaauggcacucgaaccaguugucggagccgccauagcagcuccaguagcaggacaacaaaauguaauagacccauggauaagaaauaacuucguacaagcaccuggaggagaauuuacaguaagcccacgaaaugcaccaggugaaauacuuuggucagcaccacuagguccagaucuaaaucccuaucuuucacacuuagcacgcauguacaacggcuacgcuggaggcuucgaaguccaaguaauauuagcaggcaaugcauucacagcagguaaaauaauauucgccgcaguuccucccaacuuuccaacugaaggacuaaguccuucucaagucacaauguucccacacauaaucguugauguuagacaacuagaaccaguacuaauuccauuacccgacguaagaaacaauuuuuaccauuauaaccaaaguaaugacucuacaauaaaacuuauagcuauguuguacacuccuuuacgagcaaauaaugcaggagaggauguauuuaccguuucauguagaguacuaaccagaccaucuccugacuuugauuuuauuuuucucguuccaccuaccguagaauccagaacaaaaccuuuuaccgucccaauauuaaccguagaagaaaugacaaacucaagauuuccaauuccacuugaaaaacuauuuaccggaccauccucagcauuuguaguucaaccacaaaacggaagauguaccacagacgguguauuacuaggcaccacacaauuaucuccaguaaauauuugcacauucagaggugauguuacacauauagcagguucuagaaacuacacaaugaauuuagcaucauuaaacuggaacaauuaugacccaacagaagaaaucccagcaccucuaggaacaccagauuuuguaggaaaaauacaagguguacucacacaaacaacaaaaggugacggaucgacuagaggccacaaagcaacagucuauacaggaucugcacccuucacaccuaaacuaggaucaguucaauucggaacugacacagaaaacgauuucgaaacacaccaaaauacaaaauuuacuccaguaggaguuauacaagacggagguacaacacaucgcaacgaaccacaacaaugggucuuaccauccuacucaggacgaaauguaccaaauguacaccuagcaccagcaguagcaccaacauucccaggagaacaauuauuauucuucagaucaacuaugccaggaugcucaggauauccaaauauggaucuagauuguuuacuaccucaagaauggguucaacauuucuaccaagaagccgcacccgcacaaucagauguagcauuauuaagauucguaaauccagacacaggaagaguacucuucgaaugcaaacuacauaaaaguggauaugucacagucgcacacacaggacaacaugauuuaguaauuccaccaaacggauacuuuagguuugauucauggguaaaccaauucuacacucuagcuccaaugggaaauggaacaggaagaagacgagcauuauaa

SEQ ID NO: 32151 - RNA, 1623 nt, Artificial Sequence
  derived and/or modified sequence opt6 from VP1__Norovirus__BAS30197
augaaaauggcaucaaaugacgcaaacccaucugaugguucagcugcaaacuuaguuccugaaguaaauaaugaaguaauggcacuagaaccaguaguaggagcugcaaucgcagcaccagucgcuggccaacaaaacguuauagauccauggauaagaaauaauuuuguacaagcaccaggaggugaauuuacaguaucacccagaaaugcaccaggcgaaauucuauggucagcaccauuaggaccagauuuaaaccccuacuuaucacaccuugcacgaauguacaacggauacgcaggaggauuugaaguacaaguuauacuagcagguaacgcauuuacagcuggaaaaauaauauuugcugcaguaccaccaaauuuuccaacagaaggauuaucaccaucucaagucacgauguucccacauauaauuguagacguucgacaacuagaaccaguucucauaccuuuaccagaugugcgcaacaauuuuuaccacuacaaccaaucaaacgacuccaccauaaaacuaauagcaauguuauacacaccucuacgggccaacaaugcaggugaggacguuuuuacaguaucaugcagaguacuaaccagaccaucaccugacuucgacuuuauauucuuaguaccaccaacaguugaaucaagaacaaaaccauuuacaguaccuaucuuaacaguagaagaaaugacuaacucaagauuuccaauuccccuagaaaaacucuuuacaggaccaucaucagcauuuguuguucaaccacaaaacggaagauguacuacagauggaguauuacuaggaaccacacaauuauccccaguaaauauauguacuuuucggggugacguuacacauauugcuggcucuagaaauuauacuaugaaccuagcaucauuaaauuggaacaauuaugaucccacggaagaaauuccagcaccacuagguacgccagacuuugugggaaaaauacaagguguucuuacacaaaccacaaaaggcgaugguucaacuagaggccauaaagcaacaguauacaccgguucugcacccuuuacaccaaaacuuggaucaguacaauucggaacagauacagaaaaugacuucgaaacacaccaaaauaccaaauuuacacccguuggaguaauacaagacggaggaacaacacauagaaaugaaccacaacaauggguacuaccaucauacucaggccgaaauguccccaauguccaucuagcaccagcaguagccccaacauuuccaggcgaacaacuauuauucuuuagaucuacaaugccaggaugcuccggauaucccaauauggaucucgauugcuuacuaccacaagaauggguacaacauuucuaucaagaagcagcaccagcccaaagugacguagcuuuauuacgauucguuaacccugacacagguagaguucuuuucgaaugcaaauuacauaaaucaggauauguuacaguagcacauacaggacaacacgaccucgucauaccaccaaauggauauuuuagauucgauagcuggguaaaccaauuuuauacacuagcaccaaugggaaacggaacaggaagacgacgugcacuauaa

SEQ ID NO: 32152 - RNA, 1623 nt, Artificial Sequence
  derived and/or modified sequence opt6 from VP1__Norovirus__BAS30200
augaagauggcaucuaacgacgcaaauccauccgauggaagugccgccaaccuuguuccagaaguaaauaacgaaguaauggcacuagaaccaguagucggagcugccaucgcagcacccguagcaggacaacaaaaugucauugacccauggauacgaaacaacuucguccaagcaccaggcggagaauuuacuguaagcccacguaaugcuccaggagaaauacuuuggucagcaccauuaggaccagaucuaaacccauaucuaucacaccuugcaagaauguauaauggcuacgcaggaggauuugaaguacaaguuauucucgcaggcaaugcauuuacugcuggcaaaauaauauucgcagcuguaccaccuaauuuucccacagaaggacuaucaccaucacaagucaccauguuuccucauauaauuguagauguaagacaauuagaaccuguauuaauucccuuaccagauguacgaaacaauuuuuaucauuauaaucaaucaaaugacucaacuauuaaacuaauugccauguuauauacaccucuacgugcaaacaaugcuggagaagauguauucacagucucauguagaguacuaacccgaccaucaccagacuucgauuucauauuucucguaccuccuaccguagaauccagaacaaaaccuuuuacaguaccaauauuaacaguagaagaaaugacaaacucacgauuuccaauacccuuagaaaaauuauucacaggcccaucaucagcuuuuguuguacaaccacaaaauggcagaugcacaacagacggaguacucuuaggaacuacacaacuuucacccguaaauauauguacauuucgaggcgaugucacacauauugcagguucaagaaacuacacaaugaauuuagcaucauuaaauuggaacaauuacgauccaacagaagaaauacccgcaccauuaggaacuccagacuuuguagguaaaauacaagguguauuaacacaaacaacaaaaggugacggaucaacucgaggacauaaagccacuguauauacugguucagccccauucacaccaaaacucggaucuguacaauucgguacagauaccgaaaaugauuucgaaacacaucaaaacacaaaauuuaccccuguuggagucauacaagacgguggaacuacacauagaaaugaaccccaacaauggguacuuccuucauacucuggaagaaauguaccaaacguacauuuagcaccagcagucgcaccaacauuuccuggugaacaacuauuauuuuuuagaucaacaaugccuggcuguagcggauacccaaauauggacuuagauuguuuauuaccacaagaauggguacaacauuucuaccaagaagcagcaccagcacaaucggacguugccuuauuacgauucguaaauccagauacaggaagaguacuauucgaaugcaaauuacauaaaucaggauauguaacugucgcacacacuggacaacacgaucuuguaauaccucccaauggauauuuuagauuugauucauggguaaaucaauuuuacacauuagcacccaugggaaauggaacagguagaagaagagcauuauaa

SEQ ID NO: 32153 - RNA, 1623 nt, Artificial Sequence
  derived and/or modified sequence opt6 from VP1__Norovirus__BAS30203
augaaaauggcuuccaaugacgcaaauccauccgauggcucugccgccaaccucguaccagaaguuaacaacgaaguuauggccuuagaaccaguaguaggugcagcaaucgccgcaccaguagcaggacaacaaaauguuauagauccauggauuagaaauaacuuuguacaagcuccaggaggcgaauuuacagucuccccaaggaaugcuccaggugaaauauuauggucagcaccacucggcccagaucuuaaccccuaucuaucacaccuagccagaauguauaacggauacgccggcggauucgaaguucaaguaauucuugcaggcaaugcauuuacugcaggaaaaauaauuuuugcugccguaccaccaaacuucccaacagaaggauuaucacccucccaagucacuauguuuccacauauaauaguugacguaagacaacuagaaccaguauuaauaccauuaccagauguuagaaacaacuucuaucauuauaaucaaagcaacgauucaaccauuaaauuaauagcaaugcuauauacaccauuaagagcaaacaaugcaggagaagauguauucacaguauccugucgaguacuaacaagacccucaccugacuuugacuuuauauuuuuaguuccaccaaccguagaaucacgaacaaaaccuuuuacagucccuauauuaacaguagaagaaaugacuaauucaagauuuccaauaccuuuagaaaaauuauuuaccggaccaucauccgcuuucguuguacaaccacaaaauggaagaugcacaaccgacgguguacuacuuggaacaacucaacuauccccagugaauauauguaccuuucgcggugauguaacccauauagcaggaucuagaaauuauaccaugaauuuagcaucuuuaaauuggaauaauuaugacccaacagaagaaauaccagcaccccuaggaaccccagacuuuguaggaaaaauccaaggaguacuaacacaaacaacaaaaggcgauggauccaccagaggacacaaagcaacugucuauacaggaucagcaccauuuacaccuaaguuaggcaguguacaauuuggaacagauacagaaaaugauuuugagacacaucaaaauacaaaauucacaccaguaggaguaauacaagauggaggaacaacacaucguaaugaaccccaacaauggguauuacccuccuauuccggccgaaacguaccaaacguacaccuugcuccagcaguagcaccuaccuuccccggagaacaacuauuauucuuuagaucaacuaugccaggauguucuggauaucccaauauggaucuagauugucuuuuaccucaagaauggguacaacauuucuaucaagaagcagcaccugcacaauccgacguugcacuauuaagauucguaaauccagacacaggucgcguauuauuugaauguaaacuacauaaaucaggauauguaacuguagcacacacaggacaacaugaucuaguaauaccuccaaauggauauuuucgauuugauucauggguaaaccaauuuuacacacuagcaccuaugggaaacggaacaggaagaagaagagcauuauaa

SEQ ID NO: 32154 - RNA, 1623 nt, Artificial Sequence
  derived and/or modified sequence opt6 from VP1__Norovirus__BAS30206
augaaaauggcuucaaacgacgcaaacccaucagacgguucagcagcaaaucuuguaccugaaguuaacaaugaaguuauggcucuagagccagucgucggagcagcaauagcagcaccaguagcaggucaacaaaauguaauagacccauggauucgcaacaacuucguacaagcuccaggaggcgaguuuacaguaucaccuagaaacgcaccgggagaaauauuauggagcgcaccauuaggaccagauuuaaacccauaucuuucacauuuagcacgaauguauaauggauaugccggagguuucgaaguacaaguuauacuagcaggaaaugcauuuacagcuggaaaaauaauauuugcagcaguaccaccuaauuuuccuacagaaggacuaucaccaucacaaguaacaauguucccacacauaauaguagacguucgacaacuagaaccaguuuuaauaccauuaccagauguaagaaacaauuuuuaucacuauaaccaaucaaacgacagcacaaucaaacuaauagcaaugcuauacaccccauuaagagcaaacaaugcaggcgaagauguauuuacagucuccugucgaguccucaccagaccauccccagauuuugacuucauauuucuuguaccaccaacaguugaaucuagaacaaaacccuucacaguaccaauacuaacaguugaagaaaugacuaacucacgauucccaauuccacuagaaaaauuauuuacagguccaucuagugcuuucguugugcaaccucaaaacggaagaugcacaacugacggaguacuauuaggaacgacacaauuauccccaguuaauauuugcacauuccgaggugauguaacacauauagcuggaaguagaaauuacacuaugaaucuagcuucacuaaauuggaacaacuacgauccaacagaagaaauaccugccccauuagguacaccagacuuuguuggcaagauacaaggaguacuuacacaaaccacuaaaggagauggcucuacuagaggacacaaagcaacaguauacaccgguucagccccauucacaccuaaacucggcucuguucaauuuggaacagauacugaaaaugacuuugaaacucaucaaaauacaaaauucacaccaguuggagucauacaagauggaggaacuacccauagaaaugaaccccaacaauggguacuacccucauacucaggaagaaauguaccaaauguucauuuagcacccgcaguagcaccaacuuuuccaggcgaacaacuauuauuuuuuaggaguacaaugccaggauguuccggauauccaaacauggaccuagauugcuuauuaccccaagaauggguucaacacuuuuaucaagaagcagcaccagcacaaucugauguagcacuacuaagauucgucaacccagacacaggcagaguauuauuugaaugcaaacuacacaaaucaggguauguaacaguagcucacacaggacaacacgaccucguaauuccuccaaauggauauuuuagauucgauucauggguaaaucaguucuacacauuagcacccaugggaaauggaacuggucgaagaagagcccuauaa

SEQ ID NO: 32155 - RNA, 1623 nt, Artificial Sequence
  derived and/or modified sequence opt6 from VP1__Norovirus__BAS30209
augaaaauggcaucuaaugacgcuaacccuucagacggaucugccgcaaauuuaguaccagaaguaaauaacgaaguuauggcauuagaaccaguggucggagcagcaaucgcagcacccgucgcaggacaacaaaacguuauugauccauggauuagaaauaacuuuguacaagccccagguggagaauuuacaguaucaccacgaaaugcaccaggagaaauauuaugguccgcaccuuuagguccagacuuaaacccuuaccuuucacauuuagcccgcauguacaaugguuacgcaggagguuucgaaguucaagucauauuagccggaaacgcauuuacagcaggaaaaauaauauucgcagcaguaccaccaaauuuuccaaccgaaggauuauccccaucacagguaacaauguuuccucauauaauaguagauguaagacaacuagaaccaguccuaauacccuuaccagacguacguaacaauuuuuaucacuauaaccaaagcaaugacagcacuauaaaacuuauagcuauguuauacacucccuuaagagcuaacaaugcaggagaagacguauucacaguaagcugccguguauuaacuagacccucaccagauuuugacuuuauuuuucuaguaccccccacuguagaaucacggacuaaaccuuucaccgucccaauuuuaacaguagaagaaaugacaaacucaagauuuccaauaccauuagaaaaacucuuuacaggcccaucaagugcauucguaguucaaccccaaaacggaagguguacaacugacggaguauuacuaggaacaacucaauuaagcccagucaauauaugcacuuucagaggagacguaacacauauagcaggaucaagaaacuauacaaugaauuuagcaucauuaaauuggaacaauuaugaucccacagaagaaguaccagcaccauuaggaaccccugauuuugucggcaaaauacaagguguauuaacucaaaccacuaaaggugacggaucuacaagaggacauaaagcaacaguauauaccggaucagcaccauucacaccaaaacucgguucuguccaauucucaaccgauaccgaaaacgauuucgaaacucaucaaaauacuaaauucacaccaguaggaguaauucaagauggaucaacaacacacagaaacgaaccacaacaguggguauuaccauccuauucaggaagagauguacccaauguucauuuagcaccagcaguagcuccaacauuuccaggagaacaacuacucuucuuuagaucaacaaugccagguuguuccggauauccaaacauggauuuagauuguuuauuaccacaagaauggguacaacauuuuuaccaagaagccgcgccagcacaaucagauguagccuugcuacgauucguaaacccagauacaggccguguauuauuugaaugcaaacuacauaaaucaggauauguaacaguagcucacacaggccaacacgaucuugucauacccccaaauggauauuuccgauucgauucuuggguaaaucaauuuuacacauuagccccuaugggaaauggaaccggccgaagaagagcauuauaa

SEQ ID NO: 32156 - RNA, 1623 nt, Artificial Sequence
  derived and/or modified sequence opt6 from VP1__Norovirus__BAS30212
augaaaauggcuucuaacgacgcuaacccauccgacggaagcgcagcgaacuuaguaccagaaguaaauaaugaagucauggcacuagaaccaguaguaggagcagcuauagcagccccagucgcaggacaacaaaacgucauagauccuuggauacgaaauaauuucguacaagcaccuggaggugaauuuacaguaucaccacguaaugccccaggagaaauacuauggucagcaccacuugguccagaucuaaacccauaucucucacaccuggccagaauguauaacggauacgcaggaggcuucgaaguacaaguaauacuagcugguaaugccuucacagcaggcaaaauaauauuugcagcaguuccacccaauuuuccaacagaaggauuaucaccaucccaaguaacaauguuuccacacauuauaguugacguaagacaauuagaaccaguacuaauaccacuccccgauguacguaacaauuuuuaccacuacaaucaauccaacgauucuacuauaaaauuaauagcuauguuauauacuccucuucgugcaaauaaugcuggggaagauguauucacaguaagcugcagagucuuaacaagaccaucacccgauuuugacuucauauuuuuaguaccaccaacuguagaaucuagaacaaaaccguucacuguaccaauacuaacaguagaagaaaugacaaauucacgauuuccaauaccuuuagaaaaauuauuuacaggaccaucaagcgcauuuguuguacaaccccaaaauggaagauguacaacagaugguguacuauuaggcacaacacaacuuucaccaguaaauauauguacauuuagaggagauguaacucacauugccggaucaagaaauuacaccaugaaccuagccucuuuaaacuggaacaacuaugauccuaccgaagaaauaccagcaccacuaggaacacccgauuuuguaggaaaaauacaaggaguacuaacccaaacuacuaaaggagauggcagcacuagaggccauaaagcaacaguuuauacagguucugcuccauucacaccaaaacuaggcucaguacaauuuucaacagauacagaaaacgacuucgaaacacaucaaaauacaaaauucacuccuguugguguuauacaagaugguggcacuacucaucguaacgaaccucaacaauggguacuaccaucuuauucaggcagagauguaccaaauguacaccuagcaccagcaguagcaccaaccuucccaggagaacaacuauuauucuuuagaucaacaaugccaggaugcucggguuauccaaauauggaccuagauuguuuauuaccacaagaauggguacaacacuuuuaucaagaagccgcucccgcucaaagugacguagcacuacuaagauuuguuaacccagacacaggccgaguacuauucgaaugcaaauuacauaaaucaggguauguaacaguagcacacacaggccaacacgaccuaguaaucccaccaaauggauauuuucgcuucgacucaugggucaaccaauuuuacacauuagccccuaugggaaauggaacagguagaagaagagccuuauaa

SEQ ID NO: 32157 - RNA, 1623 nt, Artificial Sequence
  derived and/or modified sequence opt6 from VP1__Norovirus__BAS30215
augaaaauggccucaaacgaugcaaaccccucagacgggucagcagcaaacuuaguaccagaagucaacaaugaagucauggcucuagagccuguaguaggcgcagcuauagcagcucccguagccggucaacaaaacguaauagacccauggauaagaaacaacuuuguacaagccccaggaggugaauuuacaguaucaccaagaaaugcuccaggagaaauacucuggucugcaccuuuaggaccugacuuaaacccauaucuaucgcaccuagcacguauguauaacggauacgcagguggcuuugaaguccaagucauauuagcuggaaaugccuuuacagccggaaaaauaauauucgcagcagucccaccaaacuuuccaacagaaggacuaucaccuagucaaguuacaauguuuccucacauaaucguagacguaagacaacuugaaccuguacuaauaccccuaccagacguaagaaacaacuuuuaccacuauaaccaaaguaacgauagcacaauaaaauuaaucgccaugcuauacacuccacucagagcaaacaaugcaggagaagaugucuucacaguaucuugcagagucuuaacaagaccaucaccugauuuugauuuuauauuucuaguaccaccuacaguagaaucacgaacaaaacccuuuacuguaccaauacuaacaguagaagaaaugacuaacucgagauuuccaauaccacuagaaaaauuauuuaccggaccaucaucagcauucguaguacaaccucagaauggccgauguacaacagacggaguacuauuaggaacaacucaauuaucaccaguuaauauuuguacuuuuagaggcgauguaacacauauagcaggauccagaaauuauacuaugaaucuagcaagcuuaaacuggaacaauuacgacccaacagaagaaaucccagccccucuaggaacuccagauuuuguaggaaaaauacaaggaauguuaacacaaacuacuaaaggagauggauccacacguggacauaaagcaacaguuuauacagggagugcacccuuuacacccaaauuaggaucaguacaauuuuccaccgacacagaaaacgacuucgaaacccaccaaaacacuaaauucacaccaguagguguaauacaagaugguuccacaacacaucgaaaugaaccacaacaauggguacuaccaucuuauucagggagaaacguaccaaauguacauuuagcgccagcuguagcaccgacauuuccaggagaacaacucuuauucuuuagaucaacaaugccaggaugcucuggauauccaaacauggaccuagacugccuacucccccaagaauggguacaacauuucuaucaagaagcagcacccgcacaaucagauguagcacuauuaagauuuguaaauccagauacaggaagaguauuauuugaaugcaagcuacauaaaagcggauaugucaccguagcucauacaggucaacacgaccuaguuauaccuccaaauggcuauuucagauuugauucauggguaaaucaauucuacacauuagcacccaugggaaauggcacaggaagacgacgugcauuauaa

SEQ ID NO: 32158 - RNA, 1623 nt, Artificial Sequence
  derived and/or modified sequence opt6 from VP1__Norovirus__BAS30218
augaaaauggcauccaaugaugcuaacccaucagacggaucugcagcaaaccuaguacccgaaguuaacaaugaaguuauggcgcuugaaccaguaguuggugcagcaaucgcagcaccaguagcuggucaacaaaaugucauagacccauggauuagaaauaacuuuguucaagcaccaggaggugaauuuacaguauccccucgcaaugcaccuggagaaauacucuggucagcuccacuaggaccagaucuuaaucccuaccuaucucaccucgccagaauguacaauggauacgcaggagguuuugaaguacaaguaauacuugcaggaaaugccuuuacagcaggaaaaauaauauuugccgcaguucccccaaacuucccaacagaaggauuaucuccuucacaagucacaauguucccacacauaauuguagacguaagacaacuugaaccaguauuaauacccuuaccagauguaagaaacaauuucuaccacuacaaucaaucuaaugacuccacaauuaaauuaauagcaaugcuauacacaccacuccgugcaaauaaugccggagaagacguauucacugucucuuguagaguacuaacacgaccuucaccagacuucgacuuuaucuuuuuaguaccaccaacaguugaaucaagaacuaaaccauucacuguaccaauucuaacaguagaagaaaugacaaauucacgauucccuauaccacuagaaaaacuauuuacaggcccaucaucagcuuucguaguccaaccacaaaacggaagauguacaacugacgguguacuuuuaggaacaacacaauuauccccaguaaacauauguaccuuucgaggugacguaacucauauagcaggcaguagaaauuauacaaugaaucuagcuucccuaaauuggaacaauuaugaccccaccgaagaaaucccagcaccacuaggcacaccagauuuugucggcaaaauacaaggaauguuaacccaaacaacaaaaggugacggcucaacccguggucacaaagcuacagucuauacuggaucagcacccuucacacccaaacuagguucaguucaauucucuacagauacagaaaaugauuuugaaacucaucaaaacacaaaauucacuccuguaggcguuauacaagaugguagcacaacacauagaaacgaaccacaacaauggguacuaccaucauauucaggaagaaacguucccaauguacaccuagcaccagccgucgcaccaaccuuuccaggugaacaacucuuauucuucagaucgacaaugcccggcuguucaggauacccaaauauggaucuagauuguuuacuaccacaagaauggguacaacauuuuuaucaagaagcagcccccgcacaaucagacguagcauuacuaagauuuguaaacccagauacuggaagaguacuauucgaauguaaacuacacaaaucaggauauguaacagucgcacauaccggccaacacgaucuaguaauuccuccaaauggauacuuuagauuugacucauggguaaaccaauucuacacacuagcaccaaugggcaauggaacuggacgacgacgagcucuauaa

SEQ ID NO: 32159 - RNA, 1623 nt, Artificial Sequence
  derived and/or modified sequence opt6 from VP1__Norovirus__BAS30221
augaaaauggccaguucugacgcaaacccuucagauggaucugcagcuaaccuuguacccgaaguaaacaaugaaguuauggcacuggaaccaguaguuggcgcagcaauugcagcaccaguugcuggucaacaaaaugucauugauccuuggauaagaaauaacuuuguacaagcaccaggaggagaauucacuguaucaccacgaaaugcaccuggagaaauauuaugguccgcaccacuaggaccagaucuaaauccuuaccuaucacaccuugcacgaauguauaacgguuacgccgguggcuuugaaguacaagucauauuagcaggaaaugccuuuacagcaggaaaaauaauauucgcagcaguuccaccaaauuucccaaccgaaggauuaucaccaucacaaguaacuauguucccucacauaauaguagacgucagacaacuagaaccaguucuaauaccauuaccagauguacgaaauaauuucuaucauuacaaucaaucaaacgauucgacaauuaaacucauagccauguuauauacuccacuacgagcuaacaaugcaggugaagauguauuuacaguauccugcagaguccucacuagaccaucaccugacuuugacuuuaucuuucuaguaccaccaacaguagaaucucgcacuaaaccauucacaguaccaauacucaccguagaagaaaugacaaauucacgauuucccauuccacuugaaaaacuauuuaccgguccuucaucagcuuucguuguacaaccacaaaacggaagauguacaacugacggaguauuacuuggaacaacccaacuuagcccaguaaacauaugcacauucagaggagaugucacacacauagcaggaucuagaaauuacacaaugaaucuagcuucacuaaacuggaacaauuacgauccaacagaagaaauaccagcuccauuaggaacaccugacuucguagguaaaguacaaggcguauuaacacaaacaacaaaaggagaugguucaacaagaggacauaaagcaacaguuuacacaggaucagcaccguuuacaccaaaacuaggcucaguacaauucucaacagauacagaaaacgauuuugaaacccaucaaaauacuaaauucacacccguaggcguaauccaagaugguuccacaacacaccgaaacgaaccucaacaauggguucuaccauccuauucaggcagaaacguaccaaauguacacuuagcaccagcuguagcaccaacauucccaggagaacaacuauuauucuuuagaucuacuaugccaggcugcagcggauauccaaauauggaccuagacugcuuauuaccacaagaauggguacaacauuucuaucaagaagccgcaccagcacaauccgacguugcuuuauuacgauuuguuaaucccgauacuggaagaguauuauucgaaugcaaauuacacaaaucaggauauguaacaguagcacacacaggacaacacgauuuaguuaucccacccaacggauauuuucgauucgauuccuggguaaaucaauucuacacacuagcaccuaugggaaacggcacugguagaaggagagcacuauaa

SEQ ID NO: 32160 - RNA, 1623 nt, Artificial Sequence
  derived and/or modified sequence opt6 from VP1__Norovirus__BAS30224
augaaaauggccucaaaugaugccaacccaucagacggauccgcugcaaaccuaguacccgaaguaaacaaugaaguaauggcacuagaaccuguaguaggagcagccaucgccgcaccuguagcaggacaacaaaauguaauagacccuuggauuagaaauaauuucguacaagcacccggcggugaauuuacaguaucaccacgaaaugcaccaggagaaaucuuauggucagcaccucuugguccagauuuaaauccauaccuaucacacuuagcccgcauguauaacggauacgcaggaggauucgaaguacaaguaauacucgccgguaaugcauucacagccggaaaaauuauuuucgcagcuguaccaccuaacuuuccaacugaaggacucuccccaucacaaguaaccauguucccacacauaaucguagacguaagacaacuagaaccuguccuuauaccauuaccagauguaagaaauaauuuuuaucauuauaaucaaagcaaugauucaacuaucaaauuaauagcaaugcuauacaccccucuaagagcuaauaaugccggagaagauguuuuuacaguaucaugccguguacuaacaagaccaucacccgacuuugacuuuauauuucuaguaccaccaacuguagaauccagaacaaaaccauucacaguucccguauuaacaguagaagaaaugacaaauucucgauucccaauaccacuagaaaaacuauuuacaggucccucaucagccuucguuguacaaccgcaaaacggaagauguacaaccgauggaguuuuacucggcacaacacaauuaucaccaguaaacaucuguacauuuagaggugauguaacccacauagcuggaaguagaaauuacacaaugaaucucgcuucuuuaaauuggaauaauuaugauccaacagaagaaauaccagcaccacucggaaccccagauuucguaggaaaaauucaaggaauguuaacacaaacuacuaaaggagacggaucaacucgcggccauaaagcaacuguauauacaggcucagcuccauucacacccaaauuaggaucuguucaauucucuaccgauacagaaaacgacuuugaaacacaucaaaauacuaaauucacaccaguaggaguaauacaagauggcucaaccacucacagaaacgagccacaacaauggguacuacccucauacaguggacgaaauguuccuaauguacauuuagcaccagcaguagcaccaacauuuccuggagaacaauuacuauucuucagauccacaaugccagguuguuccgguuauccaaacauggauuuagauugccuacuaccacaagaauggguucaacauuucuaucaagaagcagcuccagcucaaucagacgucgcauuauuaagauucguaaacccagauacaggaagaguacuauucgaaugcaaauuacacaaaagugguuacgucacaguagcacauaccggacaacaugaucuaguuauaccaccaaauggcuacuuccgauuugacucaugggucaaucaauuuuacacauuagcuccuaugggcaauggaacaggacgaagacgagcucuauaa

SEQ ID NO: 32161 - RNA, 1623 nt, Artificial Sequence
  derived and/or modified sequence opt6 from VP1__Norovirus__BAS30227
augaaaauggcaucaucagacgcaaauccaucagauggaucagcagccaauuuaguuccagaagucaauaacgaaguaauggcauuagaaccaguuguaggugcagcaauagcagcaccaguagcaggacaacaaaaugucauagauccauggauuagaaauaacuuuguacaagcaccaggcggugaauucacaguaucaccaagaaacgcacccggagaaauacuuuggucagcaccacuaggcccagaucuaaacccauaccuaucucaucuugcucgaauguauaauggauaugcaggaggauuugaaguacaaguaauauuagcaggaaaugcauucacagcuggaaaaauaaucuuugcagcagucccuccaaauuucccaacagaaggauuaucaccaucacaaguaacuauguuuccccacauuauaguagacguuagacagcuagaaccaguuuuaauaccacuuccugacguccgcaacaacuuuuaccacuacaaucaaucuaaugacaguacuauaaaauuaauagccaugcuauacacaccucuacgugcaaacaaugcuggugaagauguuuuuacaguaucaugcagaguuuuaacccgaccuuccccugauuuugauuucauauuucuaguuccaccuaccguagaaucaagagcuaaacccuucacaguaccaauacuuacagucgaagaaaugacuaauucucgauuuccuauuccacuugaaaaauuauuuacaggucccucaucagcauuuguaguacaaccccaaaaugguagaugcaccacagacggaguacuacuaggaacuacccaacuaucaccuguaaauaucuguacauuuagaggcgauguuacucauauagcagguucuagaaacuacaccaugaauuuagcaucaccaaacuggaacaauuaugauccaacagaagaaauaccagcaccauuagguaccccugauuucguugguaaaauacaaggaauguuaacacaaacuaccaaaggugacggaucaacaagaggacauaaagcaacaguuuacacaggaucagcuccuuuuacaccaaaauuaggauccguacaauucucaacagacacagaaaacgauuuugaaacucaucaaaacacaaaauuuacaccaguuggaguaauucaagacggaucaacuacacauagaaaugagccucaacaauggguacuaccuucuuacagcggacgcaauguaccuaauguacauuuagccccagcaguugcaccuaccuuucccggcgaacaacuacuuuuuuucagaaguacaaugccaggaugcucaggauaucccaacauggaucuagacugccuuuugccccaagaauggguucaacauuucuaucaagaagcagcuccagcacaaucagacguugcucuacuaagauuugucaauccagauacuggacguguauuauuugaauguaaacuacauaaaucaggauacguaacagucgcacauacuggacaacaugaccuuguaauuccuccuaauggauauuuccgauucgauucauggguaaaucaauucuacacauuagcacccaugggcaauggaacaggaagaagaagagcccuuuaa

SEQ ID NO: 32162 - RNA, 1623 nt, Artificial Sequence
  derived and/or modified sequence opt6 from VP1__Norovirus__BAS30230
augaaaauggcaaguaacgaugcaaauccauccgauggaucagccgcuaaccuaguacccgaaguuaacaaugaagucauggcuuuagaaccgguaguaggagcagcaauagcagcaccagucgcaggccaacaaaauguaauagacccuuggauuagaaauaacuucguacaagcuccaggcggagaauuuacaguaucaccaagaaaugcucccggugaaauccucuggucugcaccucuaggaccagauuuaaacccuuacuuaucacauuuagcacgaauguauaacucuuacgcuggaggauucgaagugcaagucauacuagccggaaaugcauuuacagcuggaaaaauaauauuugcagcaguaccaccuaacuuuccaacagaaggccucucaccuucccaaguuacaauguuuccccacaucauaguagacgucagacaacuagaaccagucuuaauuccacuaccagauguaagaaacaacuucuaucacuauaaccaauccaacgauucaacaauuaaacuaaucgcaaugcuauauacaccacuccgugcaaacaaugccggugaagacguauuuacaguuuccuguagaguacuaacaagaccuucacccgacuuugacuucauauuucuaguaccaccuacuguagaaucaaggacaaaaccauuuacaguacccauuuuaacuguugaagaaaugacaaauuccagauucccaauuccauuagaaaaacuauuuacaggaccaagcuccgcauucguaguacaaccacaaaauggaagauguacgacagacggaguauuacuuggaacuacgcaauuaucaccaguaaauauaugcacauucagaggugacguuacccacauagcaucaucaagaaacuacacaaugaaucuagcuucauuaaauuggaauaacuacgauccaacagaagaaauccccgccccuuuaggaacaccagacuuuguaggaaaaauacaaggaaugcuaacacaaacaacuaaaggagauggaucuacaagaggucauaaagcaacagucuacacaggaagugcaccauuuacuccaaaauuagguagcguacaauucucaacagauacagaaaacgacuuugaaacucaucaaaacacaaaauucacaccaguaggaguaauacaagacgguucaacaacacauagaaaugaaccucaacaaugggucuuacccucauauucagguagaaacgucccuaauguccauuuagccccugccguagcaccagcauucccaggagaacaacucuuauuuuuucgaucaaccaugccaggcuguucaggauauccaaauauggaucuagacugccuucuaccccaagaauggguacaacauuucuaucaagaagcagccccagcucaaucagacguagcacuuuuaagauuuguuaauccagacacaggaagaguacuuuucgaauguaaacuacauaaaucaggauacguaacaguugcacauacuggacaacacgaucuaguuauaccaccaaacggauacuucagauucgauucauggguaaaucaauuuuauacuuuagccccgauggguaauggaaccggacguagacgugcauuguaa

SEQ ID NO: 32163 - RNA, 1623 nt, Artificial Sequence
  derived and/or modified sequence opt6 from VP1__Norovirus__BAS30233
augaaaauggccuccaaugacgcaaacccaucugauggaucggcugcaaauuuaguaccagaaguaaacaaugaaguaauggcccuagaaccagucguuggcgcagcaauagcagcaccaguagcaggacaacaaaauguaaucgacccauggauuagaaauaacuuuguacaagcaccuggcggugaauuuacaguaucaccucgcaacgcaccaggugaaauacucuggucugcaccauuaggaccugacuuaaauccuuaccuaucacaccuagcaagaauguauaacggauacgcaggaggauucgaaguucaaguaauauuagcuggaaaugcauucacugcaggaaaaauuauauuugccgccguaccaccaaacuuuccaacagaagggcuaucuccaucucaaguaacaauguucccacacauaauuguagauguaagacaauuagaaccaguacucauaccacuuccagaugucagaaacaacuucuaccauuacaaccaaucaaacgacaguaccauaaaacuuaucgcaauguuauacacaccacuacgcgcuaauaaugccggagaagauguauuuacaguaucaugcagaguacuaacaagaccuucaccagacuucgacuucauauuucuagucccuccaaccguagaaucaagaacuaaaccauucacuguaccaauauuaacaguagaagaaaugaccaauucaagauuuccaauuccacuagaaaaauuauuuacuggaccaucuuccgcuuucguuguacaaccccaaaacggucguuguacaaccgacggaguacuccucgguacaacccaacuaucuccaguuaauauauguacuuuccgcggagauguuacgcauauagcuggaucaagaaauuacacaaugaauuuagcauccuuaaauuggaauaauuacgaucccacagaagaaauaccagcuccucuaggaacaccagacuuuguaggaaaaauccaaggagucuuaacccaaacaacuaaaggagacggaucaacaagaggucacaaagcaaccguauacaccggaucugccccauuuacaccaaaauuaggauccguacaauuuuccacagauacagaaaacgauuucgaaacacaucaaaacacgaaauucacuccaguuggcguaauacaagauggcggaaccacacaccgaaacgaaccacaacaauggguauuaccuucauacucaggacgaaacguacccaauguucaccuagcaccugcaguagcgccaacauuuccaggcgaacaacuucuauucuucagaucaacaaugccaggauguucuggauaccccaacauggaucuugauugcuuauuaccacaagaauggguacaacauuucuaucaagaagcagcacccgcacaaucagauguugcauuacuaagauucgucaacccagacacaggaagaguuuuauuugaauguaaacuacauaaaucaggauacguaacaguagcucacacuggacaacacgauuuagucauaccaccaaauggauauuuuagauucgauucauggguuaaucaauuuuauacacuagcucccaugggaaaugguacaggccgaagacgugcucucuaa

SEQ ID NO: 32164 - RNA, 1623 nt, Artificial Sequence
  derived and/or modified sequence opt6 from VP1__Norovirus__BAS30236
augaaaauggcaucaaaugaugcuaaucccagugacggcagcgcagcaaaucuaguaccagaaguaaauaaugaaguaauggcauuagaaccuguaguaggagcagcuauagcugcaccaguagcaggacaacaaaauguaaucgacccauggauaagaaauaacuuuguacaagcuccaggaggugaauucacaguaucacccagaaacgcaccaggagaaauuuuaugguccgccccauuagguccagaccuaaauccauaccuuucacaucuugcaagaauguacaacggcuacgcaggaggauucgaaguacaaguaauacuagccggaaacgcauuuacagcaggaaaaaucauuuuugcagcaguuccaccaaacuuucccacagaaggacuuucaccaucacaaguaaccauguucccccacauaauuguugacguuagacaacuagaaccaguacuaauacccuuaccggauguacgaaacaauuucuaucauuauaaccaaucaaacgacuccacuauaaaacuaauagccaugcucuauacaccauuacgcgcuaauaaugcaggcgaagauguauuuacagucucauguagaguacuaacaagacccaguccugacuuugauuuuauauuucucguaccuccaacagucgaaucaaggacaaaacccuuuacaguuccuauacuaacuguugaggaaaugacaaacucaagauuuccaauaccacucgaaaaacuauuuacaggaccuaguucagcauucguaguacaaccacaaaauggaagauguacaacugacggaguccuacuaggaacaacucaacuaagucccguaaauauaugcacauucagaggagacguaacacauauagcaggcucacgaaauuauaccaugaaucuugcaucauuaaauuggaacaauuacgauccaaccgaagaaaucccugcaccucuuggaaccccggauuucguuggcaaaauacaagguaugcucacgcaaacaacaaaaggugacgggucaacaagaggccacaaagcaaccguauauacaggaucagcaccauuuacuccuaaacuaggaagcguacaauuuucuacagacacagaaaacgauuucgaaacucaccaaaauacaaaauucacaccaguaggaguaauacaagauggcucaacaacacauagaaaugaaccacaacaauggguauuaccaucauacucaggaagaaacguaccaaauguacaucuagcccccgcaguagcaccuaccuuuccaggugaacaacuacuuuucuuucggucaaccaugccagguuguucaggauacccaaauauggaucuugauugcuuacucccccaagaauggguccaacacuucuaucaagaagcagcaccagcucaauccgacguugcauuauuaagauucguaaacccagauacuggaagagugcuuuuugaauguaaauuacauaaaucaggauaugucaccguagcacauacaggccaacacgaucuaguaauaccucccaauggcuacuucagauuugacucaugggugaaucaauucuauacacuagcaccaauggguaacgguacagguagaagacgugcauuauaa

SEQ ID NO: 32165 - RNA, 1623 nt, Artificial Sequence
  derived and/or modified sequence opt6 from VP1__Norovirus__BAS30239
augaaaauggcaucuaacgacgcaaauccaucagauggaucagcagcuaauuuaguaccagaagucaauaaugaaguaauggcacucgaaccaguaguaggagcagcuauagcagcaccagucgcaggacaacaaaacguaauagacccauggauaagaaauaauuuuguacaagcuccagguggagaauuuacaguuuccccaagaaaugcacccggagaaauucucuggucugcaccgcuugguccagauuuaaauccauaucuaucacaucuugcaagaauguauaauggauacgccggagguuucgaaguccaaguaauacuagcaggaaaugcauuuacggccggaaaaaucauuuucgcagcaguuccaccaaauuuuccaaccgaaggacucucaccaucccaaguuacaauguucccacacauaauaguagacguaagacaauuagaacccguauuaauaccuuuaccagauguaagaaauaauuucuaucacuauaaucaaucgaacgacucaacuauuaaacuaauagcaaugcuauacacaccauuaagagcaaacaaugccggagaagacgucuuuacaguaucauguagaguauuaacaagaccuucaccagacuuugauuuuaucuuuuuaguaccaccaacaguagaauccagaacaaaaccauuuacagucccuauauuaacaguugaagaaaugaccaauucacgauuuccaauaccauuagaaaaacuuuucaccgggccaucaagcgcauucguaguccaaccacaaaacggacgaugcacaacagacgguguauuauuaggaacaacccaauuaucuccaguaaauauauguacuuuccggggagacguuacacacauagccggaucccgcaacuacacuaugaauuuagcaucacuaaauuggaacaauuacgauccuacagaagaaauacccgcaccacuuggaacaccagauuuuguaggaaaaauacaaggaaugcuaacucaaacaacaaaaggcgacggcucuacacgcggucacaaagcaaccguauauacaggaucugcaccauuuacuccaaaauuaggaucaguacaauuuucaacagauacagaaaacgauuuugaaacacaucaaaauacaaaauucaccccagucggcguaauacaagauggaucaacaacacaucgcaaugaaccccaacaauggguacuuccaucauauucaggucgaaacguaccuaacguacauuuagcaccagcugucgcaccaaccuuuccaggagaacaauuauuauuuuuuagaucaaccaugcccggcugcucuggauauccaaauauggaucucgauugcuuauuaccacaagaauggguacaacauuuuuaucaagaagcagcaccagcacaauccgacguagcauuacuacgauucguaaauccagauacaggaagaguauuauuugaauguaaauuacauaaaucaggauauguaaccguagcacauacaggccaacacgaucuaguaauuccuccaaacggauacuuccgauuugauucuuggguaaaucaauuuuauacucuagcaccaaugggaaauggaacaggacgaagaagagcauuauaa

SEQ ID NO: 32166 - RNA, 1623 nt, Artificial Sequence
  derived and/or modified sequence opt6 from VP1__Norovirus__BAS30242
augaaaauggcaucaaaugaugcuaacccaucugacggauccgcagcaaaucuagucccagaaguuaauaaugaaguaauggcacuagaaccuguaguaggagcagcaauagcagccccaguagcaggacaacaaaacguaauagauccuuggauaagaaauaauuuuguucaagcaccaggaggagaauuuacaguaagucccagaaaugcuccaggagaaauauuauggucugcuccucuaggaccugaucucaauccuuauuuaucacauuuagcaagaauguacaauggauacgcaggaggauucgaaguucaaguaauucuagcaggaaacgcauuuacagcaggaaaaauaauauucgcagccguucccccaaacuuccccacugaaggucuaucccccucacaaguuacaauguucccacacauaauagucgacguuagacaauuagaaccaguauuaauaccacuucccgaugucagaaacaauuucuaucacuauaaccaaucuaaugacucaacaauuaaauuaaucgcaaugcucuacacaccucuaagagcaaauaaugcuggugaagauguauuuaccgucucaugccgcguacuaacaagaccuagcccagauuucgacuucauauuucuaguuccaccaacaguagaaucuagaacaaaaccauucaccguaccuauauuaacuguagaagaaaugaccaauucaagauuucccauacccuuagaaaaacuauuuacaggaccaucuucagcauucguaguacaaccccaaaauggaagauguacaacugaugguguuuuacuaggaacaacucaacuaucacccgucaacauaugcacuuuucgcggagacguuacacauaucgcaggaucuagaaauuauacuaugaauuuagcuucacuaaacuggaauaauuaugacccaacagaagaaguaccagcacccuuagguacaccagauuuugucgguaaaauucaaggaguccuaacacaaacaacaaaaggagacggcuccacacgaggucacaaagcaacaguauauacagguucagcaccauucaccccaaaacuaggaucaguccaauucucuacagacacagaaaacgauuucgaaacacaccaaaauacuaaauuuacaccaguaggaguaauacaagacggaggcacaacacauagaaaugaaccccaacaauggguauuaccauccuauucuggaagagauguaccaaacguacaccuagcaccggcuguagccccaacauuuccaggagaacaauuacuauuuuuuagaucaaccaugccuggauguucaggcuauccaaauauggaccuggacugcuuacuuccucaagaauggguucaacacuucuaccaagaagccgcacccgcacaaucagacguagcauuacuacgauucguuaauccagacacaggaagaguacuauucgaaugcaaauuacauaaaucaggauacguaacaguagcccauacaggucaacacgaucuaguuauaccaccaaauggcuacuuucguuuugacucauggguaaaucaauuuuacacauuagccccaaugggcaauggaacaggaagaagaagagcauuauaa

SEQ ID NO: 32167 - RNA, 1620 nt, Artificial Sequence
  derived and/or modified sequence opt6 from VP1__Norovirus__BAS30245
augaaaauggccucaaacgaugcaaaucccucagauggaucugcagcaaacuuaguaccagaaguaaauaaugaaguuauggcacuagaacccguuguaggagcagcaaucgccgcacccguagcaggacaacaaaacguaauagauccauggauaagaaauaacuucguacaagcuccaggcggagaauuuacaguaaguccccgaaacgcaccaggagaaauacucuggucugcaccacuaggaccugaccuaaauccauauuuaucacauuuagcuagaauguauaacggcuacgcaggaggauuugaaguacaagucauacuagccgguaaugccuucacugcagguaaaauaaucuucgcagcaauaccaccaaauuuuccuacagaaggacuaucaccuucacaaguaacuauguuuccucauaucguagucgacguaagacaacuagaaccagucuuaauaccauuaccagacguacguaauaacuuuuaccauuauaaucaaaccaaagaaucaacgauaaaacucgucgcaaugcuauauacacccuuacgagccaauaaugcaggagaugacguauuuacaguaucaugcagaguauuaacaagaccauccccagauuucgacuucaucuuucucguaccaccaucaguagaauccagaacaaaaccauuuaccgucccgauacuaacaguagaagaaaugacaaacucuagauuuccaaucccauuagaaagacuauuuacaggaccauccucagccuucguaguucaaccacaaaauggcagaugcacuacagacggaguauuacuaggaacaacacaacuaucaccagucaacauauguaccuucagaggagauguaacucgaguuuccacuacacauguauaugaaaugaacuuagccucacaaaauuggaauaauuacgaccccaccgaagaaguaccagcuccucuuggaacaccagacuucguuggaaaaauccaaggaguauuaacacaaaccacucgcacugacgguucaacaagagcccauaaagcaacaguaucuacaggugcggcagacuucacuccaaaacuaggaagcauaagauuugaaacaacaacuaaccgagaucuagaaacacaucaaaacacaaaauuuacacccguuggaguuauacaagauggcgacaaccaucaaaaugaaccacaacaauggagacuaccaggauacgcuggacgagaugcucauaauguucacuuagccccagcaguagcaccaacauuucccggagaacaacuauuauucuucagaucaacuaugccaggaugcaguggcuacccaaacaugaacuuagauugccuccuuccacaagaauggguucaacauuuuuaccaagaagcagcaccagcucaaucagacguugcuuuauuaagauucguaaacccagauaccggacgaguacuauucgaauguaaauuacacaaaucuggauacuuaacagucgcacacacaggaccauacgaccuaguaauuccaccaaaugguuauuucagauuugauucauggguaaaucaauuuuauacccuagcuccaaugggaaauggcacaggucgaagaagagcauuauaa

SEQ ID NO: 32168 - RNA, 1623 nt, Artificial Sequence
  derived and/or modified sequence opt6 from VP1__Norovirus__BAS30248
augaaaauggcauccucagacgcuaauccuucagauggaucaacagcaaaccucguaccagaaguuaacaacgaaguaauggcuuuagaaccaguagucggagcagcaauagcagcaccaguagcaggacaacaaaauguaauagauccauggauacgaaacaauuuuguacaagcacccgguggagaauuuaccguaucaccaagaaaugcaccuggugaaauauuauggagcgcaccccuaggcccagacuuaaaccccuaucucagccaccuagcucgaauguauaacgguuacgcuggaggauuugaaguacaagucauuuuagcuggaaaugcauuuacagcaggaaaaauaauauuugcagccguucccccaaauuuuccuacagaagguuuaucuccuucacaaguaacaauguuuccacauauaaucguagacguuagacaacuggaaccaguauuaauaccccuuccagauguacguaacaacuuuuaucauuauaaccaaaguaaugacccuacuauaaaacuuauagccaugcuuuacacaccacuucgagcaaacaaugcaggagaugacguauuuacaguuuccuguagagucuuaacaagaccaucucccgacuuugauuuuauauuucuuguaccaccuacaguagaaucuagaacuaaacccuuuuccguuccaauacuaacaguagaagaaaugacaaacucuagauuuccaauaccucuugaaaaauuauuuaccggaccauccagugcauuuguuguacaaccccaaaauggaagaugcacaacugacgggguauuacuagguacaacccaacuaucaccuguuaauauauguacuuuuagaggagaugucacacacauaacaggcucuagaaauuauacaaugaaucucgcaacacaaaauuggaacucauacgacccaacagaagaaauuccagcaccacuaggaacaccagacuucgucggaaaaauacaaggaguauuaacacaaaccacaagagcagacggauccaccagaggucauaaagcaauaguauauacaggaucagcagacuuugcaccaaaauuaggaagaguccaauuugcaaccgauacagauaaugauuuuggagcaaaccaaaauacaaaauuuacaccaguagguguuauacaagauggcgacacagcccauagaaaugaaccacaacaauggguuuuaccuuccuauucaggaagaaacagccauaacguacaucuagccccagcaguugcuccaacauucccaggcgaacaacuucuauucuuuagaucaacaaugccaggaugcucuggauauccaaauauggaucuagauugcuuauuaccccaagaauggguacaauauuuuuaucaagaagcugcacccgcacaaucagauguagcacuacuccgauucguaaacccagauacaggacgcguacuguuugaaugcaaauuacauaaauccggauauguuacaguagcacauacaggacaacaugaucuaguaauuccaccuaacggauauuucagauucgauuccuggguaaaucaauucuacacucuugcaccaaugggaaauggaacaggcagacgacgagcauuauaa

SEQ ID NO: 32169 - RNA, 1623 nt, Artificial Sequence
  derived and/or modified sequence opt6 from VP1__Norovirus__BAS30251
augaaaauggcaucaucagaugcaaacccaucagauggauccacagcaaaucuuguacccgaaguaaacaaugaaguaauggcauuagaaccaguuguaggagcugcuauagcugcaccaguagcaggacaacaaaauguaauagacccauggauaagaaauaauuucguacaggcuccuggaggugaauuuacaguaucacccagaaaugcaccaggagaaauacuuuggucagccccccuaggaccagacuuaaauccauaccuuucacaccucgccagaauguauaacggauaugcugguggauuugagguacaagucauacuagcuggcaacgccuuuacagcaggaaaaauaauauucgcugccgucccaccaaacuuuccaacugaaggauuaucaccaucacaaguaaccauguucccacauauaauaguugacgucagacaacuagaaccagucuuaauaccacuaccagauguccguaauaacuucuaccauuauaaccaaucuaaugacccaaccauaaaacuuauagcaaugcucuacaccccucuaagagcaaacaaugcaggugaugaugucuuuacaguuuccugcagaguacuaacaagaccaaguccagacuuugauuuuauauuucuaguaccaccaaccguagaaucuagaacuaaaccauucuccguaccaauccuaaccguagaagaaaugacuaacuccagauuccccauaccacuugaaaaacuauuuaccggacccucaucagcauuuguaguacaaccucaaaacggacgaugcacuacagauggaguacuauuaggcacaacacaauuaucuccaguuaacauaugcacauucagaggagacguaacccauauaacaggaucacgaaauuacacaaugaauuuagcaacacaaaauuggaauucauacgauccaacagaagaaaucccagcaccuuuaggaacaccagacuuugucggaaaaauacaaggaguauuaacacaaacaacacgagcagacggaucaacaagaggacauaaagcaaccgucuauacuggcuccgcagauuuugccccaaaauuaggccguguccaauuugcuaccgauaccgauaacgauuucgacgcaaaccaaaacaccaaauucacaccaguuggaguuauacaagauggagacacagcccaucguaacgaaccacaacaauggguacuaccuucauauucaggaagaaauucccauaauguacauuuagccccagcaguagcuccaacauuuccuggugaacaacuacuauuuuucagaucaacaaugccuggaugcuccggcuaccccaauauggaucuagauugucuacuaccucaagaauggguacaauauuuuuaccaagaagcagcuccagcacaaucagauguagcauuauuaagauucguaaauccagacacuggaagaguacucuuugaaugcaaacuucauaaaucaggcuacguaacagucgcucauacaggccaacacgaccuaguaauaccaccaaacggauauuuuagauucgauucuuggguuaaucaauuuuacacucuugcccccaugggaaauggaaccggaagaagaagagcacuauaa

SEQ ID NO: 32170 - RNA, 1626 nt, Artificial Sequence
  derived and/or modified sequence opt6 from VP1__Norovirus__BAS30254
augaaaauggcaucuucagacgcaaacccaagcgacggauccacagcaaacuuaguaccagaaguaaauaaugaaguaauggcacuugaaccaguaguaggagccgcaauagcagcacccgucgccggacaacaaaauguaauagacccauggauaagaaacaauuuuguccaagcuccaggaggagaguucacaguaucaccaagaaacgcaccaggcgaaauacuauggucugccccuuuaggaccagauuuaaauccuuaccuaucacauuuagcuagaauguacaauggcuaugccggaggauuugaaguacaaguaauauuagcaggaaacgcauucacagcaggaaaaauaauauucgcagcggucccuccaaauuucccuacagaaggacucucaccaucacaaguaacaauguuuccacacaucauaguagauguaagacaacuagaaccaguacuuauuccguuaccagauguaagaaacaacuucuaucacuacaaucaaucuaacgauccaacaaucaaacuuauagccauguuauacacaccucucagagcaaauaaugcaggagaugacguauucacaguaucaugcagaguacuaacaaggccaucaccagauuucgacuuuauauuccuaguuccaccuacuguagaaucucgcacaaaaccauuuucaguaccuguacuaaccguugaagaaaugacaaauucaaaaguaucacccauuccauuaaaaaaacuauucacuggaccaucaucagcuuucguaguacaaccucaaaacgguagauguacaaccgacggcguacuacugggcacaacucaacuuucaccuguaaauauauguacauuccguggcgauguuacacacauuccaggaucucgaaacuacacaaugaauuuagcaucccaaaacuggaacucauacgauccaacagaagaaauaccagcaccuuuagguacccccgacuuuguaggaaaaauucaagguguacuaacucaaacaacaagaacaaauggauccacccgagggcacaaagccacaguauauacaggaucagcagacuuuuccccuaaguuaggaagaguacaauucgcaacagacacagacaacgacuucgaaacaaaucaaaauacuaaauuuacaccuguagguguaauacaagauggaucaacaacaccuagaaaugaaccacaacaauggguucuaccaucauauuccggacgcaacauacauaacguucacuuagcaccagcaguagccccuaccuuucccggagaacaauuacuauucuuccgaucaacuaugccaggauguucaggauaucccaauauggaucuagacuguuuacuaccacaagaauggguacaauauuucuaccaagaagcagcaccagcacaaucagacguugcacuucucagauucguaaauccagacacagguagaguacuauuugaaugcaaacuacacaaaucaggauauguaacaguagcucacacaggacaacaugacuuaguaauuccuccaaauggauacuuccgauucgauucauggguaaaucaauucuacacucuagcaccuaugggaaacggaacaggacgaagaagagcccuauaa

SEQ ID NO: 32171 - RNA, 1623 nt, Artificial Sequence
  derived and/or modified sequence opt6 from VP1__Norovirus__BAS30257
augaaaauggcaucauccgacgcaaacccaucagauggaucuaccgcaaacuuaguaccagaaguaaauaaugaaguaauggcacuagaaccaguaguaggcgcugcaaucgcagccccagucgcaggacaacaaaacguuauagacccauggauaagaaacaauuuuguacaagccccaggaggugaauuuaccguaucaccucgcaacgcaccaggugaaauacuauggagcgcaccucuaggacccgacuuaaacccauaucuaucacaucuagcacgcauguauaauggauacgcaggaggauucgaaguccaaguaauauuagcaggcaaugcauucacugcuggaaaaauuauauuugcagcaguaccuccaaacuucccaacagaaggauuaucaccgucacaaguaacaauguucccacauaucauaguagacguaagacaacuagaaccuguccucauaccauuaccagauguaagaaauaauuuuuaucacuauaaucaaucuaaugauucuaccaucaaauuaaucgcaauguuauauacacccuuaagagcaaacaacgcuggagaugacguauuuacuguaucaugucgaguauuaacacggccaaguccagacuuugacuuuauauuccuaguaccaccaacaguagaaucucgaacaaaaccauucucaguaccaguauuaacaguagaagaaaugacaaacucaagauuuccuauaccucuagaaaaacuauuuacaggacccucaucugcauucguaguacaaccacaaaacgggcgauguacuacagauggaguauuauuaggaacaacacaauuaagcccaguaaacauuuguacuuuucgaggagauguaacccacaucucaggcucaagaaacuauaccaugaauuuagccucccaaaacuggaauaguuaugauccuacagaagaaaucccagcaccacuagguacucccgacuuugucggaaaaauacaagguguacuaacacaaacaacacgaaccaauggaucaacaagaggacacaaagcaacaguauauacugguucagcugacuucucuccaaaauuaggcagaguacaauuugcaacagacaccgacaaugacuucgaaacaaaccaaaauacaaaauuuacaccagucggcgucauucaagacggaucuaccacaccacgcaacgaaccacaacaauggguacuacccuccuacagcgguagaaauauccacaacguucauuuagccccagccguagcaccaacauuuccaggagaacaauuacuuuucuucagaucaacaaugccagguugcucaggauauccaaauauggaucuagauugccuauuaccacaagaauggguucaauacuucuaccaagaagcagcacccgcacaaucagauguagcauuacuaagauucguaaauccagauacuggaagaguacuuuucgaauguaaacuccacaaaucaggauauguaacaguagcacacacaggacaacaugaccuaguaauaccuccaaauggauauuucagauuugacucuuggguaaaucaauucuacacauuagccccuaugggcaacggaacaggaagacguagagcucuauag

SEQ ID NO: 32172 - RNA, 1623 nt, Artificial Sequence
  derived and/or modified sequence opt6 from VP1__Norovirus__BAS30260
augaaaauggcaucaucagacgcaaauccaucagauggaucaacagcuaacuuaguaccagaaguaaacaaugaaguuauggcacuagaacccguaguaggcgccgcaauagcagcaccagucgcaggucaacaaaauguuauagacccauggauucgcaacaauuucguacaagcaccaggaggagaauuuacuguaucaccacguaaugcaccaggagagaucuuauggucugcaccauuaggaccagauuuaaauccauauuuaucacaccuagcaagaauguauaaugguuacgcaggcggauucgaaguucaaguuaucuuagcuggaaaugcauucacagcaggcaaaauuauauucgccgcuguaccaccaaauuuuccuacagaaggacuaucaccaagucaaguaacaauguuuccucauauaauaguagacguacgacaacuagaacccguacucauaccacuacccgauguccgaaacaauuucuaucauuauaaucaaucaaaugauccaacaauuaaauuaauagcaauguuauauaccccuuuaagagccaauaaugcaggagaugacguauucacaguaucuugcagaguauuaacaagaccuucaccagauuucgauuuuauauuucucguaccaccaacaguugaauccagaacaaaacccuucucaguaccagucuuaacagucgaagaaaugacaaacucaagauucccaaucccauuagaaaaauuauuuacaggccccucuagugcauuuguuguacaaccacaaaacgguagaugcacaacugacggagucuuacucggaacaacucaacuaucccccguaaauaucugcacauucagaggcgauguaacacacauaccaggauccagaaauuauacaaugaaucuagcuucacaaaauuggaauucauaugauccaacagaagaaauuccagcaccauuaggaacaccagauuucgucggaaaaauucaaggaguacuaacacaaacuacucgcacaaacgguaguacuagaggacacaaagcaacaguuuauacagguuccgcagacuucaguccuaaauuaggacguguccaauuugcaacagauacagauaacgauuuugaaacaaaccaaaauacaaaauucaccccaguaggaguaauacaagacggaaguacaacuccaagaaacgaaccccaacaauggguacuaccaucuuauuccggacgaaauauacacaacguacaccuagcaccagcaguugcaccaacauuuccaggugaacaacuauuauucuuuagauccaccaugccaggaugcucagguuaccccaacauggaucucgacugccuacuuccucaagaauggguacaauacuucuaccaagaagcugcaccagcacaauccgacguagcuuuacugagauucguaaauccugauacaggaagaguauuauuugaauguaaacuacauaaaucaggcuauguuacaguagcacacacuggacaacaugaucugguaauaccaccaaauggauauuucagauucgacucauggguaaaucaauucuauacucuagccccaaugggaaauggaacagguagacgaagagcauuauaa

SEQ ID NO: 32173 - RNA, 1623 nt, Artificial Sequence
  derived and/or modified sequence opt6 from VP1__Norovirus__BAS30263
augaaaauggcaucuucugaugcaaacccaagcgacggaucaacagcaaacuuaguuccagaaguaaauaaugaaguaauggcacuagaaccaguaguaggugcagcuauagcagcaccuguagcaggacaacaaaauguaauagauccauggaucagaaauaauuucguacaagcaccuggaggagaauuuacaguaucuccacgaaacgcuccaggagaaauacuauggagugcuccacuaggaccagaucugaacccauaccuuagucauuuagcacgaauguauaacggauacgcaggcggauuugaaguucaaguaauacuagcaggaaacgcauuuacggccggcaaaauuauauuugcagccguacccccaaacuuuccuaccgaaggacuaucaccuucacaaguaacuauguucccacacauaauuguagacguuagacaacuagaaccaguacuuauaccacuuccagauguacguaauaacuucuaucacuacaaccaaucaaaugauuccacaauuaaauuaauagcuauguuauacacaccauuacgugccaauaaugcaggagacgauguauuuaccguuucuugucgaguacuaacuagaccaucaccugacuuugauuuuauauucuuaguaccaccaacaguagaaucagaaaccaaaccuuuuuuuuuucccguacuaaccguugaagaaaugacaaauucacguuuuccaauaccauuagaaaaacucuuuacugguccaucauccgcauucguaguucaaccacaaaauggacgauguacuacagacggaguacuucuugguaccacacaauuaaguccaguaaauauuuguacauuuagaggagacguaacacacauaccagguuccagaaauuauacuaugaacuuggcaucccaaaauuggaacucauacgauccuaccgaagaaauaccugcaccccuaggaacaccagauuuuguagguaaaauucaaggaguauuaacucaaacuacaagaacaaacggcucaacacgcggacacaaagcuaccguuuauacaggauccgcagacuucucaccuaaacuagguaggguacaauuugcaacagauaccgauaacgauuucgaaacaaaccaaaauacaaaauucacaccaguaggcguaauccaagacggaagcacaacaccuagaaaugaaccacaacaauggguacucccaucuuauucaggaagaaauauucacaauguacaucuugcaccugcaguagcaccaacuuucccaggagaacaauuacuauuuuuuagaucaacaaugcccggaugcucaggauacccaaauauggaccucgacugucuucuuccacaagaauggguacaauacuuuuaccaagaagcagcaccugcacaaucagacguagcacuauuaagauucguaaacccagauacaggaagaguacuuuucgaaugcaaacuccauaaaucaggauauguuacugucgcucacacgggucaacacgaccuuguuaucccaccuaacggcuauuucagauuugacucauggguuaaucaauuuuacacauuagcaccaaugggaaauggcacuggacgaagaagagcacuauaa

SEQ ID NO: 32174 - RNA, 1623 nt, Artificial Sequence
  derived and/or modified sequence opt6 from VP1__Norovirus__BAS30266
augaaaauggcuagcucagacgcaaaucccucagauggcucuacagcaaaccuaguaccagaaguuaacaacgaaguuauggcacuagaaccaguaguaggagccgcaauagcagcaccaguagcaggccaacaaaacgucauagacccuuggauaagaaauaacuucguacaagccccuggcggagaauuuacaguaucuccucgaaaugcacccggcgaaauauuauggucagccccacuaggaccagacuuaaauccauaucucucacauuuagcacgaauguauaaugguuaugcuggcggauucgaaguacaagucauacuagcaggaaaugcauucaccgcaggcaaaauaauauuugcagcaguuccaccaaacuuccccacagaaggacuaagccccucucagguaacaauguucccacauauaauaguagacguaagacaauuagaaccuguauuaauuccccuuccagauguaagaaauaacuucuaucauuacaaucaaucaaaugauucaacuauaaaacuaauagcuaugcuauauacaccacuaagagcuaacaacgcuggagacgauguauucacaguaucaugccgaguacuaacaagaccaucaccagauuucgacuuuauauuucuagucccaccaacaguugaaucaagaacaaaacccuuuucaguaccaguucucacaguugaagaaaugacaaacucaagauuuccaauaccauuagaaaaauuauuuacagguccaucaucagcauucguaguacaaccacaaaacggaagaugcacaacagacggagucuuacuagguacuacacaauuauccccaguuaacauauguacauuucgcggugauguaacacacaucucaggaucaagaaacuauacaaugaaccuagcaucccaaaauuggaauucuuacgauccaaccgaagaaauaccagcaccacuuggaacaccagacuuuguaggaaaaauacaaggaguacucacacaaacaacacgaacgaauggcuccacaagaggccauaaagcaacaguauacacugguagcgcagacuuuucaccaaaauuaggaagaguacaauucgcaacagacacagacaacgacuucgaaaccaaucaaaauaccaaauucacuccaguuggagucauacaggaugguucaacaacgccuagaaaugaaccacaacaauggguccucccaucauauucugguagaaacauccauaacguucauuuagcccccgcagucgcaccuacauucccuggugagcaauuauuauuuuuuagaucaacaaugccaggauguucaggauauccaaauauggaucuagauugcuuacuaccucaagaauggguacaauauuucuaucaagaagcugcuccagcacaauccgacguagcauuacucagauucgucaacccagauacuggaagaguacuauucgaaugcaaauuacauaaaucuggcuauguaacagucgcacauacaggccaacacgaucuaguuauuccaccaaauggauacuuucgauuugauucaugggucaaccaauuuuacacacuagcaccuaugggaaauggaacaggaagaagacgagcauuauaa

SEQ ID NO: 32175 - RNA, 1623 nt, Artificial Sequence
  derived and/or modified sequence opt6 from VP1__Norovirus__BAS30269
augaaaauggcaucaucagaugcaaacccuucagauggaucaaccgcuaaccuuguaccagaaguaaauaaugaaguaauggcacuagaaccuguaguaggagcagcaauagcagcaccaguagcaggucaacaaaacguuauagauccauggauaagaaauaacuuuguacaagcaccuggaggagaauuuacaguaucaccacgaaaugcaccaggugaaauauuauggucugcaccuuuaggacccgaucuaaauccauaccuaucccauuuagcacgaauguacaacggauaugcagguggauucgaaguacaaguaauacuagcuggcaacgcuuuuacagcaggaaaaauaauauucgcagcuguaccacccaauuucccaacagaaggacuaucaccuucacaaguaacaauguucccacacauaauuguagacguacgacaauuagaaccaguacucauaccauuaccugacguuagaaauaauuucuaccacuauaaccaaucaaacgacaguacaauaaaauuaauagccauguuauauacacccuuaagagcaaacaaugcaggagaugacguauuuacagucucuugucguguucuaacaagaccaaguccugacuuugacuuuauauuuuuaguccccccuacaguugaaucucgaacuaaaccauuuucaguaccuguuuuaacuguagaagaaaugaccaauucacguuuuccaauaccauuagaaaaauuauuuacaggaccaucuuccgccuucguaguacaaccucaaaacgguagaugcacaacugacggaguacuacuugguacaacacaauuauccccaguaaauauauguacauuuagaggagauguaacccacauaucaggcucaagaaauuacacaaugaaucuagcaucacagaacuggaacucuuaugauccaacagaagagauaccagcuccacuagguacaccugacuuuguuggaaaaauacaaggaguauuaacacaaacuacuagaacaaacggaaguacaagaggccacaaagcaaccgucuauaccgguucagcagacuucucuccaaaacucggccgaguacaauuugcaacagacacagauaaugauuucgaaacuaaucaaaacacuaaauuuacuccaguaggaguuauacaagauggcucaaccaccccaagaaacgaaccacaacaauggguacuaccauccuacaguggccgcaauauccacaacguacauuuagccccugcaguagcuccuacauuuccaggagaacaacuacucuucuuuagaucaacaaugccaggauguuccggcuauccaaauauggaccucgauugccuacuaccacaagaauggguacaauauuucuaccaagaagcagcaccagcacaaucagauguugcacuacuuagauuuguuaacccagacaccggaagaguacuauucgaaugcaaacuccacaaaucaggauacguaacaguagcacacacaggccaacacgaucuaguaauaccuccuaaugguuacuuccgauuugauucuuggguaaaccaauuuuauacacuagccccuaugggcaacggaacaggaagaagaagagcauuauaa

SEQ ID NO: 32176 - RNA, 1623 nt, Artificial Sequence
  derived and/or modified sequence opt6 from VP1__Norovirus__BAS30272
augaaaauggcaagcucagaugcuaacccaucagaugguucaacagcuaaucuaguaccagaaguaaauaacgaaguaauggcacuagaaccaguaguaggcgcggcaauagcagcaccuguagcaggccaacaaaacgucauugauccauggauuagaaacaacuucguccaagcacccggaggagaauucacaguuucuccacgcaacgcaccaggagaaauucuauggucagcaccacuaggaccagaccucaauccauaucuaagccaucuagcacgaauguauaauggauaugcaggaggauucgaaguacaaguaauacuagcagguaacgccuuuacagcagguaaaauaauuuucgcagcugucccaccaaacuuuccaacagaaggauuaucaccaucacaagucaccauguuuccacacauaauaguagauguaagacaacuagaaccaguacuaaucccacuacccgauguuagaaauaacuuuuaccacuauaaccaaucuaacgacucaacaauuaaauuaauagcaauguuauacaccccauuacgcgcaaauaaugccggagacgacguauuuacaguaucaugcagaguauuaacuagaccaucaccagauuucgacuuuauuuucuuaguuccuccaaccguagaaaguagaacaaaaccauuuucaguucccgucuuaacuguugaagaaaugacaaacucaagauuccccauaccucuagaaaaauuauucacaggaccaucaucagcauuuguaguacaaccacaaaauggaagauguacaaccgacggaguacuacuaggaacaacucaauuaucaccagucaauaucuguaccuucagaggugacguuacacauauaaguggaucaagaaauuauaccaugaacuuagcaucccaaaacuggaacucauaugauccuacugaagaaaucccagcaccucuaggaacaccagauuuugucggaaaaauccaaggaguccucacccaaacaaccagaacuaacggaucuacaagaggacacaaagcuacaguauacacaggcuccgcagacuucagcccaaaauuaggaagaguucaauucgccacagauacagauaaugacuucgaaacuaaccaaaauacaaaauuuacaccagucggcgucauacaagacggaucaacaacaccaagaaaugaaccacaacaaugggucuuaccaucuuauucuggaagaaacauucacaauguacaccuagcaccagcaguagcaccuacauuuccaggagaacaguuacuauucuucagaucaaccaugccuggauguucuggauauccaaauauggaccuagauuguuuacuaccacaagaauggguacaauauuucuaucaagaagccgccccagcacaaagugauguagccuuauuaagauuuguaaaccccgacacuggaagaguauuauucgaauguaaauuacacaaaucuggauauguaacaguagcacauacaggccaacacgauuuaguaauaccacccaacgguuauuucagguuugauuccuggguaaaucaauuuuacacacuugcaccuauggguaauggaacaggaagacguagagcuuuauaa

SEQ ID NO: 32177 - RNA, 1623 nt, Artificial Sequence
  derived and/or modified sequence opt6 from VP1__Norovirus__BAS30275
augaaaauggcaucuaaugacgccaauccuucagauggcucaacagcaaaccuaguaccugaaguuaauaacgaaguaauggcauuagaaccaguuguaggagccgcaaucgcagcaccugucgcaggccaacaaaaugucaucgauccuuggauacgaaacaacuuuguacaagccccaggaggcgaauuuaccguaucaccucgaaaugcacccggagaaauauuauggucagcaccacuagguccagaucucaacccauauuuauucccucuagcaagaaaaguaaaaggauaugcuggcggcuuugaaguacaaguaauauuagcaggaaaagcauuuccagcaggaaaaauaauuuucgcagcaucucccccuaauuuuccaacagaaggacuaucuccaucucaaguaacaauguucccucauaucauaguugacguacgacaauuagaaccaguccuaaucccauuacccgauguacgaaauaacuucuaucauuauaaucagucaaaugacucaacuauaaaacuaauagcaaugcuauauacaccacuuagagcaaauaaugcuggugaagauguauuuacaguaucauguaggguccuaacuagaccaucaccagacuuugacuuuauauuuuuaguaccaccaacaguagaaucacgaacuaaaccuuuuucaguaccuauuuuaacaguugaagaaaugaccaacucucgcuuuccaauucccuuagaaaaacucuuuacaggcccauccuccacuuucguaguacaaccacaaaauggcagaugcacaacagacggaguacucuuagguaccacacaauuauccccuguuaauauauguacuuuuagaggugacguaacacauaucgcuggaucaagaaauuacacaaugaauuuagcuucucaaaacuggaacucauacgacccuacugaagaaauuccagcaccucuagguacaccagauuuuguaggcaaaauucaaggaguacuuacucaaacaacacgacgagacgguuccacaagaggccacaaagcuaccguauacacagguucugcagacuucuccccaaaauuagguagaguacaauucgcuacagacacagacaacgauuuugauacccaccaaaauacaaaauucacacccguuggaguaauucaagacggaggcacagcacauagaaacgaaccacaacaauggguccuuccauccuacuccggcagaaauacucauaacguacaccuagcaccugccgucgccccaacauuuccuggagaacaacuacucuucuuccguucaacuaugcccggaugcucaggauacccaaauauggaucuagauugccuuuuaccacaagaauggguacaauauuuuuaucaagaagcagcucccgcacaaucagauguagcacuccucagauuuguaaacccagacacaggaagaguacuauucgaaugcaaauuacauaaaaguggauauguaacaguagcucacacaggccaacacgaccuaguaauaccaccaaauggcuacuucagauucgacucauggguaaaccaauuuuacacauuagcaccaaugggaaauggcacaggacgacgaagagcauuauga

SEQ ID NO: 32178 - RNA, 1623 nt, Artificial Sequence
  derived and/or modified sequence opt6 from VP1__Norovirus__BAS30278
augaaaauggccuccuccgacgcaaauccaagugauggcucuacagcaaaucuaguaccugaagugaauaaugaaguaauggcccuagaaccaguaguaggcgcagcaauagcugcaccaguagcaggacaacaaaaugucaucgacccauggauaagaaacaacuuuguccaagcaccaggaggagaauucacaguaucaccuagaaaugcaccaggagaaauacuauggucagcaccacuagguccagauuuaaauccauaucuaucacaccucgcaagaauguauaacggauacgccggcgguuucgaaguacaaguaauauuagccggaaacgcauuuacugccggaaaaauuauauuugcagcaguaccaccuaacuuuccaaccgaaggacuaucaccaucacaaguaaccauguucccucauauuauaguagacguucgacaacuagaacccguacuaauuccuuuacccgauguccgaaacaauuuuuaucacuauaaucaaaguaacgacucaaccaucaaacucauugcaaugcucuauacuccacuacgcgcaaacaaugcaggagaugacguauuuacagucucaugucgaguucuaacacgaccaagcccagacuuugacuucauauucuuaguaccuccaacaguagaaucaagaacaaaaccauucaguguucccguacugacaguagaagaaaugacaaauucacgauuuccaaucccccuagaaaaauuauucacuggcccuucaucagcauuuguuguacaaccacaaaauggaagaugcacaacagacggcguccuauuagguacuacacaacucucuccuguaaauauaugcaccuuuagaggagacguuacacauaucucuggauccagaaauuauacaaugaaccucgcuucacaaaacuggaauucauaugaucccacagaagaaauaccagccccuuuaggaacaccugacuucguaggaaaaauucaaggcguacuaacacaaaccacacgaacuaauggaucaacaagaggacauaaagcaacagucuauacaggaucagcagacuuuucaccaaaacuaggaagaguacaauucgcuacagauacagauaacgauuucgaaacuaaucaaaacacaaaauuuacaccuguuggcguaauacaagauggauccacaacaccuagaaaugaaccucaacaauggguauuaccuucuuauucaggaagaaauauacauaacguacaccuagcaccugcagucgcaccaacauucccaggcgaacaauuacuuuuuuuuagaucuacaaugccaggaugcucaggcuacccaaauauggaccuagauuguuuacuaccacaagaauggguucaauacuucuaucaagaagcagcaccugcccaaucagacgucgcacuacuaagauucguuaaucccgacacuggacgaguacuauucgaauguaaacuccacaaaucaggauauguaacuguagcacauacuggccaacaugauuuagucauaccaccaaauggauauuuuagauuugauucaugggucaaucaauucuauacuuuagcaccaaugggaaauggaaccggaagaagaagagcacuauaa

SEQ ID NO: 32179 - RNA, 1623 nt, Artificial Sequence
  derived and/or modified sequence opt6 from VP1__Norovirus__BAS30284
augaaaauggccuccucagaugcaaacccaucagauggaucaacagcaaauuuaguaccagaaguaaacaacgaaguuauggcucuagaaccaguaguuggagcugccauagcagcuccaguagcuggacaacaaaauguaauagacccauggauaagaaauaacuucguacaagcaccaggaggagaauucaccguaucaccaagaaaugcuccuggagaaauauuauggucagccccccuaggccccgaucuaaauccauaccuaucccacuuagcaagaauguacaacggauacgcuggcggauuugaaguucaaguaauauuagcaggaaaugcauuuacugcaggcaaaaucauauuugcagcaguacccccaaauuuuccuacugaaggacuaucuccaucucaaguaaccauguucccacacauaauaguagauguaagacaauuagaaccaguacuuauuccuuuaccagauguacgaaauaauuucuaucauuacaaucaauccaaugacccuacaauaaaacuaauagcaauguuauauacaccacuacgagcaaauaacgcuggagaugacguuuuuaccguuucaugucguguacuaacccguccaucaccagacuuugauuucaucuuuuuagucccaccaacaguagaaucaaggacaaaaccuuucucuguaccaguucuaaccgucgaagaaaugacaaauuccagauuuccaauaccccuugaaaaauuauuuacugguccaucuucagcuuuuguaguucaaccacaaaacggacgcuguacaacagauggaguacuuuuaggaaccacacaauuaagcccaguaaauauauguacauuuagaggagaugucacacacauaucaggaucccgcaauuacacaaugaauuuagccucacaaaacuggaauucauacgacccaacagaagaaauuccggccccacuaggaacuccagauuuuguugguaaaauacaaggaguucucacacaaacaacaagaacaaacggaucaacuagaggacauaaagccacuguuuauacuggaucugccgacuuuucacccaaauuagguagaguccaauuugcuacagacacugauaacgauuucgaaacaaaucaaaauacaaaauuuacaccagucggaguuauacaagaugguucuacuacaccaagaaaugaaccacaacaauggguacuaccauccuauucuggacguaacauacauaauguacaccuagccccugcuguagcccccaccuuuccaggagaacaacuacuauuuuucagaucaaccaugccugguugcucuggcuacccuaauauggacuuagauugccuucuaccacaagaauggguccaauacuucuaucaagaagcugcaccggcccaaucugaugucgcacucuuaagauucguuaaucccgauacagguagaguacuuuuugaaugcaaacuucauaaauccggauauguaacuguagcacacacaggucaacaugaucuagucauuccgccaaacggauacuuuagauuugauucauggguuaaucaauuuuacacacuagccccaaugggaaacgguaccggacgaagaagagcauuauaa

SEQ ID NO: 32180 - RNA, 1623 nt, Artificial Sequence
  derived and/or modified sequence opt6 from VP1__Norovirus__BAS30287
augaaaauggcuucaucagaugccaaucccucugauggcuccacagcaaacuuaguuccagaaguuaauaaugaaguaauggcacuagaaccaguaguuggcgcagcgauagcagcuccagucgcaggacaacaaaauguuauugacccauggauaagaaauaauuuuguacaagcuccaggaggagaauuuacaguaucuccaagaaaugccccaggagaaaucuuauggucugcuccacucggaccagaccuuaauccuuaucuaucucacuuagcacgaauguauaacggauacgcaggaggauuugaaguacaaguaauacuagcaggaaaugcauuuacugcaggcaaaauuauuuuugccgccguaccacccaauuuuccaaccgaaggccuaucaccaucacaaguaacaauguuuccucacauuauaguagacguaagacaauuagaaccaguucucauacccuuaccagaugucagaaacaauuucuaccacuauaaucaaucaaacgaccccacaauaaaauuaauugcuauguuauacacaccauuaagagcaaacaacgcaggagacgaugucuuuacaguaucuugucgcguauuaacaagaccuucaccagacuuugacuuuauuuuuuuaguaccaccaacuguugaaucaagaacaaaaccauucuccguaccaguacuuacuguagaagaaaugacaaauucacgauucccaauaccacuagaaaaacuauuuacagggcccucaucagcauucguuguucagccacaaaacggaagaugcaccacagauggagucuuacuaggaacuacacaacuaucccccguaaacauaugcaccuuuagaggagauguaacacauaucccuggaucaagaaauuacacaaugaaucucgcaucacaaaacuggaacucuuacgauccaacagaagaaauaccugcaccauuaggaacgccagacuuuguugguaaaauacaaggagucuuaacacaaacaaccagaacaaacggaucaacuagaggacacaaagccacuguauauacaggauccgcagacuuuucaccuaaacuaggccguguucaauucgcuaccgacacagacaaugauuucgaaacaaaccaaaauacuaaauuuacaccaguuggaguaauccaagaugguucaaccacaccuagaaacgaaccacaacaaugggucuuaccaucauauucaggaagaaauauucauaacguucauuuagcaccagcaguagccccaaccuuucccggagaacaacuacuuuucuuucgcagcacuaugccaggaugcucuggcuauccuaauauggaccuagacugucuacuaccacaagaauggguccaauauuuuuaucaagaagcugcaccagcccaaagugacguugcauuacuaagauuuguaaacccagauacaggaagaguccuuuucgaauguaaacuacacaaaucaggauacguuacuguagcacauacuggacaacaugauuuaguaaucccaccaaaugguuauuucagauuugacaguuggauuaaucaauuuuauacccuagcaccaaugggcaauggaacaggaagaagaagggcauuauaa

SEQ ID NO: 32181 - RNA, 1623 nt, Artificial Sequence
  derived and/or modified sequence opt6 from VP1__Norovirus__BAS30290
augaaaauggcuucuucagaugcuaauccauccgacggaucaacagcuaacuuaguaccggagguaaacaaugaagucauggcacuagaaccagucguaggagcagccauugcugccccaguagcaggccaacaaaauguuaucgauccuuggauaagaaauaacuuuguucaagcaccagguggagaauuuacaguuuccccaagaaaugcacccggcgaaauauuauggucagcuccccuaggaccagacuuaaacccauacuuaagucaccuugcccgaauguauaaugguuacgcuggcggauuugaaguacaagucauuuuagcaggaaacgcauuuacugcaggaaaaauaauuuucgcugcaguaccaccaaauuucccaacagaaggauuaucaccaucacaaguaacuauguucccucauaucaucguugacguaagacaauuagaacccguauuaauaccacuaccagauguacgcaauaacuuuuaucacuauaaccaaucgaacgacucaaccauaaaauuaauagccaugcuauacacaccguuaagagcuaacaacgcaggagaugaugucuucacgguaucauguagaguauuaacaagaccaucaccugacuuugacuuuauauuucuaguaccaccaacuguagaaucaagaaccaaaccauuuaguguaccuguccuuaccgucgaagaaaugacuaacagcagauuuccaauaccacuagagaaauuauucacuggacccagcucagccuucguaguccaaccacaaaacggaagauguacaacugacggaguauuacuagguacaacucaauuaucaccaguaaacauauguacauuuagaggugacguaacucauauauccggaucccgaaauuacaccaugaauuuagcaucccaaaauuggaauucauacgaucccacagaagaaauaccagccccauuaggaaccccagauuucguagguaaaauucaaggaguccuaacacaaacaacaagaacaaauggcucaacaagaggacauaaagcaacaguauauacaggcuccgcagacuucucucccaaacuuggcagaguucaauucgcuacugauacagauaaugauuuugaaacaaaccaaaacacaaaauucacaccuguaggaguaauacaagauggaagcacuacuccccgaaaugaaccacaacaauggguucuaccuucauauucagguagaucaauacacaacguucaucucgccccagcagucgcaccaacauuuccgggagaacaauuacuauuuuuuagaucaacaaugccaggauguucaggcuauccaaauauggaucuugauugccuauuaccacaagaauggguccaauacuuuuaucaagaagcagcacccgcacaaucagauguagcucuauuaagauucguaaacccagacacaggaagaguuuuauuugaaugcaaacuacauaaauccggauacguaacuguagcucacacaggucaacacgaucuaguaaucccacccaauggauauuuucgcuuugacucuuggguaaaucaauucuacacacuagcaccaaugggaaauggcacaggaagacgcagagcguuauaa

SEQ ID NO: 32182 - RNA, 1623 nt, Artificial Sequence
  derived and/or modified sequence opt6 from VP1__Norovirus__BAS30293
augaaaauggcaucuucugacgcaaauccuagugacggaucaacugcuaaccuuguaccugaaguuaauaaugaagucauggcccuagaaccaguaguuggagcugcuauagcagcaccuguagcuggacaacaaaacguaauagacccauggauaagaaacaacuuuguacaagcuccaggaggagaauuuacaguuucgccccgaaaugcaccaggagaaauccuaugguccgcaccauugggaccagacuuaaaucccuaccuaucccaucucgcucgaauguacaacggauaugcaggcggauucgaaguucaaguaauauuagcaggaaaugcguuuacagcaggaaaaaucauauuugcagcagucccaccaaauuuuccuacagaaggacuaagcccaucucaaguaacaauguucccacacaucauaguagauguacgacaauuagaaccagucuuaauaccacuaccagauguuagaaacaauuuuuaccauuauaaccaaucuaaugacccuacaauuaaacuaauugcaaugcuuuauacaccucuaagggcaaauaaugcaggagacgauguauuuacuguaucaugcagaguauuaacaagaccaucaccagauuuugauuucaucuuuuuaguaccuccuacuguagaaagccguacuaaaccuuuuucaguacccauuuuaaccgucgaagaaaugacaaacucccgauuuccuauaccauuagaaaaacuauuuacagguccauccucaacauuugucguucaaccucaaaacggaagaugcacaacagauggaguauuauuaggaaccacucaauuauccccaguuaauauauguacauucagaggagaugucacacauauagcagguucaagaaauuacacuaugaauuuagcuucacaaaauuggaacucuuacgauccaacugaagaaauaccagcuccguuaggaacaccugacuucguaggcaaaauacaaggaguucuuacucaaacuacccgaacagacggaucaacaagaggccacaaagccacaguauauacaggcucagcagacuuuuccccaaaacuugguagaguucaauucgcuaccgacacagauaaugacuuugaugcaaaucaaaauacaaaauuuacuccaguaggaguaauacaagacggaggaacugcucaucgaaaugaaccucaacaauggguauuaccaaguuauucaggacgaaauacacacaacguacaccuagccccagcaguagcaccaacuuuucccggagagcaauuacuuuucuuccgauccacaaugccaggaugcucaggauauccaaauauggaucuagauugcuuacuaccucaagaauggguacaauauuucuaucaagaagcagcaccagcacaauccgauguagccuuacuaagauucguuaauccagauacaggaagaguccuauucgaaugcaaacuacacaaaucuggauacgcuacaguugcacacacuggacaacacgauuuaguaauaccaccaaauggauacuucagauucgacucauggguaaaccaauuuuacacacuugcaccaaugggaaaugguacaggaagaagacgcgcauuauaa

SEQ ID NO: 32183 - RNA, 1623 nt, Artificial Sequence
  derived and/or modified sequence opt6 from VP1__Norovirus__BAS30296
augaaaauggcaucaaaucauguaaacccaucagauggaucuacagcaaacuuaguacccgaagucaauaaugaagucauggcacuagaaccaguuguaggugcagcaauagcagcaccugucgccggacaacaaaauguaauagauccauggauacgaaacaauuucguacaagcaccaggcggagaauuuacaguaucuccaagaaaugcaccaggagaaauauuauggucagccccacuaggacccgaccucaauccauaccucucacacuuagcucgaauguauaacggauaugcaggaggauuugaaguacaagucauauuagcaggaaaugcuuuuacagcaggaaaaauaaucuuugcagcaguuccuccuaacuuccccacugaaggauuaucaccuucacaaguaaccauguucccacacauaauaguagauguacgacaacuagaaccaguauuaauuccacuuccagacguaagaaacaacuucuaucacuauaaucaaaguaaugauccaacaaucaaauuaauagcaaugcuauacaccccccuaagagcaaacaacgcaggagacgauguuuuuacaguuucaugucgcguccucacacgaccaucaccagacuuugacuucauauuccuuguccccccaacuguagaaucaagaacaaaaccauucucaguaccaguacuuacuguagaagaaaugacaaacucaagauuuccaaucccuuuagaaaaauuauuuacaggaccaucaucagcauuuguaguacaaccacaaaacggucgcuguacuacagacggaguauuauugggcacuacucaacuuuccccuguaaacauaugcaccuuuagaggagacguaacacauauuccaggaucuagaaauuacacuaugaaucuagcaucacaaaacuggaacucauacgaucccacagaagaaauuccugcaccauuaggaacaccugacuucguaggaaaaauacaaggcguuuuaacccaaacaacuagaacaaauggcucuacaagaggucacaaagcaacagucuauacaggaucagcugacuucucuccaaaauuaggaagaguacaauuugcaacagauaccgauaacgauuuugaaacaaaucaaaacacaaaauucacaccaguaggcguuauacaagacggaucaacuacaccacgaaacgaaccccaacaauggguucuaccuaguuauucaggucgaaauauacacaacguccacuuagcaccagccguagcaccaacauuuccuggagaacaauuacuauucuucagaucaauaaugcccgguugcuccggauaucccaauauggaucucgauugccuacuaccacaagaauggguucaauacuuuuaucaagaagcagcucccgcacaaucagaugucgcauuauuaagauucguaaaucccgacaccggccguguacuauuugaaugcaaauuacacaaaucaggauauguaaccguagcccacacgggacaacacgauuuaguaauaccucccaacggauacuucagauucgauucauggguaaaucaauucuauacuuuagcaccuaugggaaauggaacaggucgccgacgagcacucuaa

SEQ ID NO: 32184 - RNA, 1623 nt, Artificial Sequence
  derived and/or modified sequence opt6 from VP1__Norovirus__BAS30299
augaaaauggccucauccgaugcuaacccaucagacggaucaacagcuaaucuuguaccagaaguaaauaaugaaguaauggcauuagaaccaguaguaggugcagcaauagcugccccaguugcuggccaacaaaacguaauagacccauggauacgcaauaacuuuguacaagcccccggaggagaauucacuguaucuccacgaaacgcaccaggcgaaauacuaugguccgcaccacuaggaccagaccuaaaccccuaucuaucacacuuagcuagaauguauaauggcuacgcaggaggauucgaaguccaagucaucuuagcuggaaacgcauuuacugcugguaaaauaguauucgcagcaguacccccaaacuuucccacagaaggucucucuccaucacaaguaaccauguucccucacauaaucguagacguaagacaacuagaacccguacuaauaccacuuccagacguaagaaacaauuucuaucacuacaaccaauccaaugacccaacaauuaaacuaauagcaauguuauacacaccacuuagagcuaacaaugcaggagaugacguauuuacuguaagcugucgugucuuaacccgaccauccccagauuuugauuucaucuuucuaguaccaccaacuguugaaucaagaacuaaaccauucucaguaccuauacuaaccguagaagaaaugacaaauucccgauuuccaauaccacuugaaaaacuuuuuacaggaccaucaucugcauucguaguacaaccacaaaauggaagauguacaacugaugguguauuacuaggaacuacacaacuaucaccuguaaauauaugcacauuuagaggagaugucacacacaucgcaggaucacacaauuacacaaugaauuuagccucacaaaacuggaacuccuacgauccaacagaagaaauaccagcaccacucggaacaccagacuuuguaggcaaaauacaaggaguacuaacucaaacaacacgcacagauggaucaacaagaggacauaaagcaacaguauacacuggauccgcagaauuuucaccaaaacuaggccgaguacaauuugcgacugauaccaauaacgauuuugacgcaaaucaaaauacaaaauucacaccaguaggaguaauacaagauggaggaacaacucauagaaacgaaccacagcaauggguccuaccuucauacucaggaagaaauacacauaacguacaccuggcucccgcaguagcaccaacauuuccaggugaacaauuauuauucuuccgaucuacaaugcccggaugcucagguuacccaaauauggaucuugauugcuuacuaccacaagaauggguucaauauuuuuaccaagaagccgccccagcucaaucagacgucgcacuauuaagauucguuaacccagacacaggacgaguacuauucgaaugcaaauuacauaaaucaggcuauguuacugucgcacacacaggccaacacgauuuaguaauuccaccaaacggcuauuuucgauuugauucauggguuaaucaauucuauaccuuagcacccaugggaaaugguacaggccgaagacgcgcauuauag

SEQ ID NO: 32185 - RNA, 1623 nt, Artificial Sequence
  derived and/or modified sequence opt6 from VP1__Norovirus__BAS30302
augaaaauggcaucaucugacgccaacccauucgacgguucaacagcaaacuuaguaccagaaguaaacaaugagguaauggcacuagaacccguaguaggagcagcaauugcagcaccaguagcaggacaacaaaacgucauagacccauggauacgaaauaacuuuguucaagcaccuggaggagaauuuacuguguccccacgaaaugccccaggagaaauauuauggucagccccacuaggacccgaucuuaaucccuaucucucacacuuaucaagaauguacaacgguuacgcuggaggauucgaaguccaaguaauacuagccggaaacgcauuuacugcaggcaaaauaauuuucgcagcaguaccaccaaacuuuccaacugaaggcuuaucaccaucacaaguuacaauguucccacauauaauaguagacguaagacaauuagaaccaguauuaauaccucuucccgauguaagaaacaauuucuaccauuacaaccaaucaaaugauccuacaauuaaauuaauagcaauguuauauacaccccucagagcuaauaaugcaggagaugaugucuucacuguauccugccgaguuuuaacuagacccucaccagacuuugacuuuauuuuccuuguaccaccaacaguagaaucccgaacuaaaccuuuuucaguacccguacuuacaguagaagaaaugacaaacucaagauuuccaauuccauuagaaaaacuauuuacaggaccaucaucagcauucguuguccaaccucaaaauggaagauguacuacagacgguguauuauuagguacuacacaauuaagcccaguuaauaucugcaccuuuagaggagacguaacacauauuccuggaaguagaaauuauacaaugaacuuagcaucacaaaacuggaauucuuaugacccaaccgaagaaauaccagcaccacuagguacaccagacuucgucggaaaaauacaaggaguauuaacacaaacaacgagaacaaauggaucaacaagaggccauaaagcaacuguauauaccggaucagcagacuucucaccaaaacuaggaagaguacaauuugcuaccgacacagauaacgacuucgaaaccaaucaaaauacaaaauucacaccaguugguguaauucaagacggaucuacaacaccacguaaugaaccacaacaauggguacuaccaucauauucaggacgaaacauacauaauguucacuuagccccagcaguagccccaacauuuccuggagaacaacuauuauucuucagauccaccaugccaggaugcaguggauauccaaauauggaccuagacugucuacuaccacaagaauggguacaauacuucuaucaagaagcagcacccgcacaaucggauguugcauuacuacgcuucguaaaccccgacacaggcagaguacuauuugaauguaaauuacauaaaucaggcuauguuaccguagcacacacaggacaacaugaucucguaauaccacccaacggcuauuuuagauuugauuccuggguaaaucaauuuuauacuuuagccccaaugggaaauggaacaggacgccgaagagcauuauaa

SEQ ID NO: 32186 - RNA, 1623 nt, Artificial Sequence
  derived and/or modified sequence opt6 from VP1__Norovirus__BAS30305
augaaaauggcaagcucagaugcaaacccuuccgacgguucaacagccaaccuuguuccagaaguuaacaaugaaguaauggcccuagaaccuguagucggagcagccaucgcugcaccaguagcaggacaacaaaauguaauagacccauggaucagaaacaacuuuguccaagcaccaggaggggaauuuacaguaucaccaagaaaugcaccaggagaaauacuauggucaggcacacuaggaccagacuuaaauccauauuuaucacacuuagcccgaauguacaauggcuacgcaggaggcuuugaaguacaaguaauauuagcaggaaaugcauuuacagcagguaaaauaauuuucgcagcuguaccuccaaauuuuccaacugaaggacuuucaccaucacaaguaacgauguucccacacauaauaguugacguaagacaauuagaacccguauuaauaccccuacccgauguaagaaacaacuucuaucacuauaaucaaagcaaugacccaaccauaaaacuaauagcuaugcuauacacaccuuuaagagccaauaaugcaggugacgauguauuuacaguuuccuguagaguucucacaagaccaucaccugacuuugacuuuaucuuucuaguaccaccaacaguugaaucacgcacaaaaccauuuucaguaccaguacuaacaguagaagaaaugacaaacucuagauuucccauaccauuagaaaaauuauucacgggucccucuucagcuuucguaguacaaccccaaaacggaagaugcacaacugacggcguacuuuuagguacaacccaauuaucacccguaaauauaugcacauucagaggagauguaacacauauacccggaucacgcaauuacacaaugaauuuagcaucucaaaauuggaacucauacgacccaacugaagaaauaccagcaccauuaggaacaccagacuucguaggaaaaauacaaggaguacuaacucaaacaacaagaacaaacggaucaacgagaggacacaaagcaacuguauacacaggcucagcagauuuuucaccaaaauuaggaagaguacaauucgcaacugauaccgauaaugauuucgaaacaaaccaaaauacaaaauucacuccaguugguguaauacaagaugguagcacaacacccagaaaugaaccacaacaauggguacuaccaucauauucaggucgaaauauacacaacguccauuuagcaccagcaguagcaccgacauucccaggagaacaacuauuauucuucagaucuacaaugccagguuguuccggauacccaaauauggaucucgacugcuuauuaccccaagaauggguucaauauuuuuaucaagaagcagcuccagcacaaucagacguagcauuacuaagauucguaaacccugacacuggcagaguacuauucgaauguaaacuacacaaaucaggauauguaacgguagcacacacaggacagcacgaucuaguaaucccgccaaauggauauuucagguucgauagcuggguuaaucaauucuauacacucgcuccaaugggaaacggaacaggaagaagaagagcacucuaa

SEQ ID NO: 32187 - RNA, 1626 nt, Artificial Sequence
  derived and/or modified sequence opt6 from VP1__Norovirus__BAS30308
augaaaauggcaucaaacgauguuaacccuuccgacggaaguacagcaaaucuagucccugaaguuaacaacgaaguaauggcacuagaaccaguaguaggagcagcuaucgccgcaccaguagcaggacaacaaaacguuaucgauccuuggauuaggaauaauuucguacaagcaccugguggagaauuuaccguuucacccagaaaugcaccaggagaaauacuauggucugcgccacuagguccugacuuaaaccccuaucucagucaucucgcacgcauguacaauggauacgcuggaggcuuugaaguacaaguaauacuagcaggaaaugcauuuacagcaguagucagaauaauauuuucagcaguaccaccaaacuuuccuacagaaggccuuucaccaucacaaguaacaauguucccucacauaauaguagauguaagacaacucgaaccaguauuaauaccauuaccugacguacgaaacaauuucuaucacuauaaccaaucaaacgacucaacaauaaaacuaauagcaaugcuauacacuccacuaagagcaaauaaugcaggugacgauguauucacaguaucaugcagaguacuaacucgaccaagcccagacuuugacuuuauauuucuuguaccaccuacgguagaaucaagaacaaaaccauuuucagucccaguacuuacaguagaagaaaugacaaauucacgauuuccaauaccuuuagaaaaauuauuuaccggaccaucuucagcauuugucguucaaccccaaaacggacgauguacaacagacggaguccuacuagggacaacacaacuaucaccgguaaacauuugcaccuucagaggugacguaacacacauaucagguucccgaaacuacacuaugaauuuagcuucacaaaacuggaacuccuacgacccaacagaagaaauaccagcaccauuaggaaccccagauuuuguaggaaaaauacaagguguauuaacacagacaacacgaacaaauggcucaacaagaggacacaaagccacaguauauaccggauccgcagauuucucaccaaaauuaggcagaguacaauucgcaaccgacacugauaacgacuuugaaacaaaucaaaacaccaaauuuacaccaguaggcguaauccaagauggauccacuacaccaagaaaugaaccacaacaauggguacuuccaucuuacagcggacgaaauauacauaauguacauuuagcaccagccguagcaccaacauuuccaggagaacaacuacuauuuuuuagaaguacaaugccaggaugcucaggauauccaaauauggaccuagauugucuacuuccacaagaauggguacaauacuucuaucaagaagcugcaccugcacaaucagacguagcauuacuuagauucguaaauccagauacuggaagaguacuuuuugaauguaaacuucauaaaucaggcuauguaacaguagcccauacaggacaacacgaccucgucauaccaccuaacggauauuuuagauucgauucauggguaaaccaauuuuacacacuagccccaaugggaaauggaacaggaagaaggcgagcauuauaa

SEQ ID NO: 32188 - RNA, 1623 nt, Artificial Sequence
  derived and/or modified sequence opt6 from VP1__Norovirus__BAS30311
augaaaauggcaucaucugaugcuaaucccucagauggaucaacggcuaaucuaguacccgaaguaaauaaugaaguaauggcauuagagccuguaguaggugcagcaauagcagcaccaguagcuggacaacaaaauguaauagaccccuggauaagaaauaauuuuguacaagcaccaggaggugaauucacaguaucaccaagaaacgcaccaggagaaauacucuggucagcaccucuaggcccagaucuuaauccauaccuaucacauuuagcaagaauguauaacgguuaugccggaggauucgaaguacaaguaauauuagcaggaaacgcauuuacugccggaaaaauaauauuugcugcgguuccaccaaauuucccaacagaaggauuaucacccucccaaguaacaauguuuccccacauaauaguagacguaagacaacucgaaccugugcuaauuccucuacccgauguacgaaacaacuucuaucacuauaaccaaucaaaugacucaacaauaaaacuuauagcaaugcuuuacacaccauuaagagccaacaaugcaggagaugauguuuuuacaguuuccugucgaguacuaacaagaccuucaccagacuucgauuuuauauuucuuguaccaccaacagucgaaucacguacaaaacccuucuccguuccaguacuuacaguggaagaaaugacuaauuccagauucccaauaccacuagaaaaacuauucaccggaccaucaucugcauuugucguacaaccacaaaauggaagauguacaacagacggaguauuacuaggaacaacccaacuuucaccaguuaacauauguacauucagaggagauguaacgcauauaccaggaucaagaaauuauacaaugaauuuagcaagucaaaacuggaauaguuaugauccaaccgaagaaauaccagcaccauuaggaacaccugauuucguugguaaaauacaaggcguacuaacacaaacaacuagaacaaaugguucaaccagaggccauaaagcaacaguauacacuggaucagcugauuuuucaccaaaacuaggacgaguacaauuugcuaccgauacggauaacgauuucgaaacaaaucaaaauacaaaauuuacuccaguaggagucauucaagacggcucuaccaccccuaggaaugaaccacaacaauggguacuuccauccuauucuggucgcaacauacauaacguacauuuagccccugcaguagcuccaaccuuuccuggagaacaacuacuauuuuucagaucaacaaugcccggaugcucagguuauccaaauauggauuuagacugccuacuuccucaagaauggguacaauauuuuuaucaagaagcagccccagcacaaucagacgucgcccuacuucgauuuguaaacccugacacuggaagaguacuauucgaaugcaaauuacauaaaucagguuacguaacagucgcccacacaggccaacacgaccuaguuauaccaccuaaugguuauuuuagauucgauucauggguaaaucaauuuuacacccucgcaccaaugggaaauggaacuggaagaagaagggcauuauaa

SEQ ID NO: 32189 - RNA, 1623 nt, Artificial Sequence
  derived and/or modified sequence opt6 from VP1__Norovirus__BAS30314
augaaaauggcaucauccgacgccaauccaucagaugguucuaccgcaaaccuaguuccagaaguaaacaacgaaguuauggcacuagaacccgucguaggagcugcuaucgcagcaccagucgcaggccaacaaaacguaauagauccauggauacgaaauaauuuuguacaagcuccaggaggagaauuuaccguuucccccagaaaugcaccaggagaaauacuauggucugcaccauuaggucccgaccuaaauccauaccuuucacacuuagcccguauguauaacggauacgcaggagguuuugaaguucaaguaauauuagccggaaacgcauuuacugcaggaaaaauaauauucgcagcaguaccaccuaauuuucccacagaaggacuaucaccuucucaagucacaauguuuccucacauaauaguugacguuagacaauuagaaccaguauuaauccccuuaccagacguaagaaacaauuuuuaccacuauaaucaaagcaaugacccuacaauaaaacuaauagcaauguuguacacuccacuaagagcuaacaaugcaggagacgacguauuuacaguauccugucgaguucuaacaagaccuuccccagauuuugacuucauuuuuuuaguaccuccaacagucgaaucuagaacaaaaccauuuucaguaccaguucuaacaguagaagaaaugacaaacucaagauucccaauaccacucgaaaaauuauuuacaggaccauccucagcauuugucguacaaccacaaaacgguagauguacaacagacggaguauuacuagguacaacacaauuaucaccaguaaauaucuguaccuuccgcggagacguuacacauauaccaggaucaagaaauuacacaaugaaccuagcuucacaaaacuggaauucauaugacccaacagaagaaauaccagcaccccuaggaacuccugauuuugucgguaaaauacaaggaguauuaacacaaacaacacgcacaaacggaucgacuagaggacacaaagcaacagucuauacaggaucagcagacuuuucuccaaaauuaggcagaguucaauuugcuaccgacaccgauaacgacuucgaaaauaaucaaaauacaaaauucacaccugucgguguaauacaagacggaucuacuacaccaagaaaugaaccacaacaauggguacucccuucauauucaggaagaaauauacauaacguccacuuagcaccagccguagcaccaaccuuccccggcgaacaacuauuauucuucagauccacaaugccaggaugcucagguuauccaaacauggaucuagauugccuuuuaccccaagaauggguucaauauuucuaccaagaagcagcacccgcucaaucagacguugcacuacucagauucguuaauccagacacaggaagaguacuauuugaaugcaaacuucacaaaucaggauacguaacaguagcacacaccggacaacaugaucuagucauaccaccaaacggauauuucagauuugauuccuggguaaaucaauuuuacacauuagcaccaaugggcaacggaacuggacgacgaagagcauuauaa

SEQ ID NO: 32190 - RNA, 1623 nt, Artificial Sequence
  derived and/or modified sequence opt6 from VP1__Norovirus__BAS30317
augaaaauggcaucaucagacgcaaaucccucagauggauccacagccaaucucguaccagaaguaaacaaugagguaauggcacuagaaccaguuguaggagcagcaauugcagccccaguagcaggacaacaaaauguuauugacccauggauaagaaauaauuucguucaagcaccaggaggagaauuuaccguaagcccaagaaaugcaccaggugaaauucuguggucagccccauuaggcccagaucuaaauccauauuuaucccaucuagccagaauguauaauggauacgcuggcggauucgaaguccaagucauacuagccggaaaugcuuucacagcaggaaaaauaauuuucgcagcaguuccaccuaauuucccaacagaaggauuaucaccuucacaagucacaauguuuccacauauuaucguagauguaagacaacuugaaccuguacucauaccauuaccagauguacgaaacaauuuuuaucauuauaaucaaucaaaugauccaacaauaaaacuuaucgcaauguuauauacaccacuacgagccaacaaugcaggugaugacguauuuacagucucaugccgcguacuaacaagacccucaccagacuucgacuuuauuuuucuaguuccacccacaguagaaaguagaaccaaaccuuucucaguaccaauacuaacaguugaagaaaugacaaauucaagauuuccaauuccccuagaaaaacuauuuacaggacccucaagcaccuucguaguacaaccacaaaauggacgauguaccacagauggaguccuauuagguacaacacaauuauccccaguuaauauauguacauuuagaggugacguaacacauauagcaggaucacgcaacuacaccaugaauuuagcuucacaaaacuggaauagcuaugauccaaccgaagaaaucccagcaccauuaggcacacccgacuuuguaggaaaaauacaaggaguucuaacacaaacaacuagaacagacggaucaacacgaggucauaaagccacaguauauacaggaucugcagacuuuuccccuaaacuuggaagaguacaauucgcaacagauacagacaacgauuucgacgcuaaucaaaauacaaaauucacuccaguaggaguuauacaagaugguggaacagcucaccgaaacgaaccacaacaauggguacucccaucuuauuccggacguaauacacauaauguccacuuagcaccagcaguugcaccuacuuuccccggcgaacaacuauuauucuuucgaucuacaaugccuggaugcucaggauauccaaacauggaccuagauuguuuacuuccacaagaauggguacaauauuucuaucaagaagcagcaccagcacaauccgacgucgcauuauuacguuuuguaaauccagacacaggucguguuuuauuugaauguaaauuacauaaaaguggcuauguaacaguagcucacacaggacagcacgaucuuguuauaccaccaaauggauauuuucguuucgacucauggguuaaccaauuuuacacauuagcaccaaugggcaacggaacaggaagacgaagagcacuauaa

SEQ ID NO: 32191 - RNA, 1623 nt, Artificial Sequence
  derived and/or modified sequence opt6 from VP1__Norovirus__BAS30320
augaagauggcaucauccgaugcaaauccaucugacggcucuaccgcaaaccuugucccagaaguaaauaaugaagucauggccuuagaaccaguuguaggugcagcaauagccgcuccaguagcaggucaacaaaauguuauugauccauggauaagaaacaacuuuguacaagcaccagguggugaauuuacaguaucaccuagaaaugcaccaggagaaauacuauggucugcuccuuuaggucccgauuuaaacccuuaccuaucucauuuagcaagaauguauaauggcuacgcaggcggcuucgaaguacaaguaauacuagccgguaaugcauuuacagcaggaaaaauaauauucgcugcaguaccaccaaacuuuccaacagaaggccuaucacccucccaaguaaccauguuuccacauauaauaguugacguuagacaacuagaaccaguauuaauaccccuacccgacguaagaaacaauuucuaucauuauaaccaaucaaaugacccaaccauaaaauuaaucgcaauguuguacacaccccuaagagccaauaaugcuggagacgauguauuuacaguaucaugcagaguucuaacaagaccaucacccgauuuugacuucaucuuccuaguuccaccuacaguagaaagcagaacaaaaccauuuucuguaccaauacuaaccguagaagaaaugacaaauucuagauuuccaauacccuuagaaaaauuauucacuggcccaucaaguacauucguuguacaaccacaaaacggaagauguacaacagacggcguacuacuaggaacaacacaacucucaccuguaaacauuuguacauuuagaggagauguaacacauauagcgggaucaagaaauuacaccaugaauuuagcaucacaaaacuggaacucauacgauccuacagaagaaauacccgcaccauuaggaacaccugacuuuguaggaaaaauacaagguguauuaacacaaacuacgagaacagacgguucaacuagaggucauaaagccacuguauauacagguucugcugacuuuucaccaaaacucggaagaguccaauucgcaacagauacagauaaugauuucgaugccaaucaaaacacuaaauucacuccuguaggcgucauacaagaugguggcacagcucacagaaaugaaccucaacaauggguccucccaucauauucagguagaaacacacauaacguucaccuugcccccgcuguagcuccuacauuuccaggagaacaacucuuauucuuuagaucuacaaugcccggaugcucuggauacccuaauauggaucuagauugccuacuaccucaagaauggguacaauacuuuuaccaagaagcagcaccagcacaaucagacguugcauuacuuagauucguaaauccagacacaggaaggguccuauuugaauguaaacuacauaaaucaggauacgucacaguagcacacacaggucaacaugaucucguuauaccaccaaauggauacuuucgauuugauucaugggucaaucaauuuuauacacuagcaccaaugggaaacggaacuggacgacgacgagcacuauaa

SEQ ID NO: 32192 - RNA, 1623 nt, Artificial Sequence
  derived and/or modified sequence opt6 from VP1__Norovirus__BAS30323
augaaaauggcuucaucagacgccaauccaagcgauggaagcacugcaaaucucguaccugaaguuaauaacgaaguaauggcucuagaaccaguaguaggagcagcaaucgcugcaccaguagcaggacaacaaaauguaauagauccuuggauaagaaauaacuucguacaagcaccaggaggagaauuuaccguaucaccucgaaaugccccaggugaaauuuuaugguccgcaccccuaggaccagaucuaaacccuuaucuaucacacuuagcaagaauguauaacggcuacgcaggaggauucgaaguacaaguaauuuuagccggcaaugcauuuacagccggaaaaauuauauuugccgcagucccaccaaacuuuccaaccgaaggacucucaccaucucaaguaacaauguuuccucacauaaucguagacguacgccaacuagaaccuguauuaauaccauuaccagauguaagaaauaacuuuuaccacuauaaccaaucaaaugauccuaccauuaaauuaaucgcaauguuauacaccccacuaagagcaaauaaugcaggagaugauguauucacaguuucaugucgaguucuaaccagacccucaccagauuuugacuucauauuucuaguaccaccaacaguagaauccagaacaaaaccauucucaguaccaguacuaacaguagaagaaaugacuaauucacgauuuccaauaccccuagaaaaauuauucacagguccaucaucagcuuucguuguccaaccacaaaacggacgauguacaacugaugguguacuauuaggaacaacucaacuuucuccagucaauauauguacauuucgaggagauguaacacacaucucuggaucacgaaauuauacuaugaaccucgcaucccaaaauuggaacagcuaugauccaacagaagaaaucccagccccuuuaggaacaccugacuucguuggcaaaauacaaggcguauuaacccaaacaacaagaacuaauggcuccacaagaggacacaaagcuacaguauacacaggaucugcugacuuuucaccuaaacuuggacgaguccaauucgcuacagauacagauaaugauuuugaaacaaaucaaaauacaaaauucacaccaguaggaguaauacaagacggaggaaccacuccuagaaacgaaccucaacaaugggucuuaccaucuuauuccggucggaauauacauaauguacaccuugcaccugcugucgcaccuaccuuuccuggagaacaauuacuauuuuuucgaucaacaaugcccggaugcuccggauaucccaauauggauuuagauuguuuauuaccccaagaauggguacaauacuuuuaccaagaagcagcacccgcucaaucugauguagcacucuuacgauucguaaauccugauaccggaagaguauuauucgaaugcaaacuacauaaaagcgguuauguaaccguugcucacacuggacaacacgaucuuguaauuccaccaaacggauauuuucgauuugauucauggguaaaucaauuuuauacauuagcuccaaugggaaaugguaccggaagaagacgugcauuauaa

SEQ ID NO: 32193 - RNA, 1623 nt, Artificial Sequence
  derived and/or modified sequence opt6 from VP1__Norovirus__BAS30326
augaaaauggccaguucagacgcuaauccaagcgacggaucaaccgcuaaccuugucccagaaguaaacaaugaaguaauggcacuggaaccaguaguuggagccgcaauagcagcacccguagcuggacaacaaaauguaauagauccuuggauacgaaauaacuucguacaggcaccaggaggagaauuuacaguaagucccagaaaugcacccggcgaaauacucuggucagccccauuaggaccagaucucaauccauaucuaucacacuuagcaagaauguauaacggauaugccggaggauucgaaguacaagucauacuagccgguaacgcauuuacagcuggaaaaauaaucuucucugcaguaccaccaaauuuuccaacagaaggauuaucuccaagucaaguaaccauguucccacacauaauaguagacguaagacaauuagaaccuguccuaauaccauuaccagauguacgaaauaauuucuaucacuauaaccaaucaaaugaccccacaauaaaacuuauagccauguuauacacaccauuacgcgcaaacaacgcaggagaugauguauuuacaguauccugcagaguucuaacacgaccuucaccagauuuugauuuuauauuuuuaguuccaccaaccguagaaucaagaacaaaaccauucagcguaccaauauuaacaguagaagaaaugacaaauucccguuuucccauaccauuagaaaaacuauuuacaggucccucuucaacauucguaguacaaccacaaaacggacgaugcaccacagaugguguauuauuaggcacaacacaacuaucacccguaaauauaugcacuuuucgaggagacguaacacacauaacagguucucauaauuacacaaugaaccuagcaucccaaaacuggaacucauacgauccaacagaagaaauaccagcaccuuuagguacaccugauuucguaggaaaaauacaaggcguccuaacucaaacaacaagaacugacggaucaacaagaggacacaaagcaaccguuuauacaggaucagcagaauuuuccccuaaacuaggaagaguacaauucgcaaccgauacaaacaacgauuuugaugccaaucaaaauacaaaauuuaccccagucggugucauacaagauggaggaacaacacaccgcaacgaaccacaacaauggguacuacccagcuauucuggaagaaacacacauaauguucaucuagcaccagcaguagcaccaacauuuccaggcgaacaauuacuauuuuuuagaucaaccaugccuggcugcucaggauacccaaauauggaccuagauugcuuauuaccacaagaauggguucaacauuucuaccaagaagcagcaccagcucaaucagacguagcucuuuuaagauuuguaaacccagacacaggaagaguauuauucgaaugcaaacuacauaaaucaggcuauguaacuguagcucauaccggacaacaugauuuaguuaucccaccuaauggauauuuuagauuugauucaugggucaaucaauucuauaccuuagcaccuaugggaaauggaaccggcagaagaagagcucucuaa

SEQ ID NO: 32194 - RNA, 1623 nt, Artificial Sequence
  derived and/or modified sequence opt6 from VP1__Norovirus__BAS30329
augaaaauggcaaguucagaugcuaacccauccgauggcuccacagcaaacuuaguaccugaaguaaacaaugaaguaauggcacuagaaccaguagucggagccgcaauagcagcaccaguagcuggacaacaaaacguaauagacccauggauaagaaauaauuucguacaagccccaggaggagaauucacuguuucuccaagaaaugcaccaggagaaauauuauggucagcaccauuaggaccugaucuaaauccauaucuuucccaccuugcacguauguauaauggauacgcuggaggauucgaaguacaagucauauuagcaggaaacgcauuuacugcaggaaaaaucauauuugcugcaguaccaccaaacuuuccaacugaaggguuaucaccaucacaaguaaccauguuuccacacauuaucguagacguuagacaacuagaaccaguauuaauuccacucccugauguacgaaacaacuuuuaucacuauaaccaaucaaaugacucaacaauaaaauuaauagccauguuauacacaccuuuaagagcaaauaacgcuggugacgaugucuuuacaguaucauguagaguacugacaagaccaucuccagauuuugacuucauauuuuuaguaccaccaacaguagaaucaagaacuaaaccauuuucaguaccaguuuuaacaguagaagaaaugaccaauucacgauuuccaauaccucuagaaaaacuauucacagguccaucuagugcauucguaguacagccacaaaacggcagauguacaacugacggaguauuauuaggaacuacacaauuaucaccaguuaauauauguacuuucagaggagauguaacacauauaucaggcucgagaaauuacacaaugaaucuugcaucacaaaacuggaauucuuacgauccaacagaagaaauacccgcuccacuaggaacaccagacuuuguaggaaaaauacaagguguauuaacacaaacaacaagaacaaauggaucaacuagaggacacaaagcaacaguauauacaggaucagcagacuuuucacccaaauuagguagaguacaauuugcaaccgauaccgauaacgacuucgaaacaaaccaaaacaccaaauucacuccaguuggaguaauacaagacggaaguaccacaccacgaaaugaaccucaacaauggguccuaccauccuacucagguagaaauauacauaauguacauuuggccccagcagucgcaccaacauuuccaggagaacaacuauuauuuuuccgaucaacuaugccaggauguucaggauauccuaacauggaucucgauugcuuacucccacaagaauggguucaauacuuuuaccaagaagccgcaccagcacaaucagacgucgcacuauugagauucgucaauccagauacaggacgaguauuauucgaaugcaaacuacacaaaucuggauauguaacgguagcacauaccggacagcacgauuuaguaauuccaccuaaugguuacuuccgauucgauucuuggguaaaucaauuuuacacucuagcaccaauggguaauggaaccggcagaagacgugcccuauaa

SEQ ID NO: 32195 - RNA, 1623 nt, Artificial Sequence
  derived and/or modified sequence opt6 from VP1__Norovirus__BAS30332
augaaaauggcuucaucugacgcaaaucccucagaugguucaacagccaacuuaguaccagaagucaacaacgaaguaauggcccuagaaccuguuguaggugccgccauagcagcaccaguagcaggacagcaaaaugucauagacccauggauaagaaauaacuuuguacaagcaccaggaggagaauucacagucucaccaagaaacgcaccaggagaaauacuauggucagcaccuuuaggaccagaucuaaauccauaucuaucacauuuagcuagaauguauaacggauaugccggaggauuugaaguacaaguaauacucgcaggaaaugccuucacagcagguaaaauaauuuucagugccguacccccuaacuucccaacugaaggucugucaccuucacaaguuaccauguuuccacacaucauaguugacgucagacaauuagaaccaguccuaauaccauuacccgauguaagaaacaauuucuaucacuauaaccaaucaaaugacccuacaauuaaacuaauagcaauguuauacacaccuuuacgcgcaaauaaugcaggagacgauguuuuuacaguaucauguagagucuuaacucgaccaucaccagauuucgacuucaucuuuuuaguuccaccaacaguagaaucaagaacuaaaccauuuagcgucccuauacuaaccguagaagaaaugacuaacucaagauuucccacaccacuagaaaaacuauuuacagguccaucuuccacauuuguaguacaaccacaaaacggaagauguacuaccgauggaguucuacucgguaccacucaacuuucacccgucaacauauguacauuuagaggagauguaacacacauaacaggaucacauaauuacacaaugaauuuagcaucccaaaauuggaauucauacgacccaacagaagaaaucccugcaccauuaggaacaccagacuuuguaggaaaaauacaagguguuuuaacacaaacaacgagaacugacggaucgaccagaggacacaaagcaacuguauauacagguucagcugaauuuaguccaaaauuagguagaguacaaguagcaacagauacaaauaaugacuuugaugcuaaucaaaauacaaaauucacaccaguuggaguaauacaagauggaggaaccacucauagaaaugaaccccaacaauggguacuaccaucauauucuggaagaaaugcccacaacguacaccuagcuccagcuguagcuccaacauucccaggagaacaauuacuauuuuucagaucuacaaugccggguuguucuggauacccuaacauggauuuagauugccuuuuaccacaagaauggguucaacauuuuuaucaagaagcagcuccagcacagagcgacguagcauuauuacgauucguaaacccagauacaggaaggguauuauucgaaugcaaauuacauaaaucaggauacguaacuguagcacacacaggacaacacgaucuaguaauacccccaaacgguuacuuccgauucgacucauggguaaaccaauucuacacucuagcaccaaugggaaacggcacaggacgaagaagagcacuuuaa

SEQ ID NO: 32196 - RNA, 1623 nt, Artificial Sequence
  derived and/or modified sequence opt6 from VP1__Norovirus__BAS30335
augaaaauggcuuccucugacgcuaaucccucagauggauccacagccaaccucguaccagaaguaaacaaugaaguaauggcacuugaaccaguaguuggugcagcaauagccgcaccagucgcaggacaacaaaacguaauagaccccuggauucgaaauaacuuuguacaagcaccuggaggagaauuuacaguaucacccagaaacgcaccaggugaaauauuaugguccgcaccacuaggaccagaucuaaacccauauuuaucacaucuugcaagaauguauaacggcuacgcuggaggauuugaaguacaaguaauauuagcuggaaaugcuuuuacagccgggaaaaucauauucgcagcaguaccgcccaacuuuccuacagaagguuuaagcccaucacaaguuacaauguuuccccauauaauaguagauguuagacaauuagaaccaguacuaauaccauuaccagauguucgcaacaacuucuaccacuauaaccaaucaaaugacccuacaauaaaacuaauagcaauguuauauacaccacucagagccaacaaugcaggugaugauguauucacagucucauguaggguacuaacaagaccauccccagauuuugacuuuauauuccucguuccaccuacagucgaaucaagaacaaaaccauuuucuguaccaauacuaacaguagaagaaaugacuaacucaagguuuccaaucccuuuagaaaaacuauuuacaggaccaucaucagcauucguuguacaaccacaaaacgguagauguacaacagacggaguacuuuuaggaacaacacaacuaagccccguaaauaucugcaccuuuagaggagacguaacccauauagcuggaucacauaauuauacaaugaauuuagccucacaaaacuggaacucauacgaucccacagaagaaauaccagcaccauuagguacacccgacuuuguuggaaaaauacaaggcguauuaacccaaacaacaagaacagaugguucaacacgaggacacaaagcaacaguuuauacuggaucagcagaauuuucaccuaaacuaggaagaguucaauuugcuacagauacaaauaacgacuucgacgcaaaucaaaauacaaaauuuacuccaguugggguuauacaagauggaggaacaacacauagaaaugaaccucaacaauggguacuaccaucauacuccgguagaaauacacauaauguacauuuagcacccgccguugcucccacauucccaggugaacaauuacuuuucuuucgaucuacaaugccagguugcuccggauauccaaacauggaucuagauugcuuacuuccacaagaauggguccaauauuuuuaucaagaagcagcuccagcacaaucagacguagccuuacucagauucgucaaucccgacacaggaagaguuuuauuugaauguaaacuacauaaaaguggauauguaacaguagcccacacaggacaacacgaucuaguaauacccccaaauggauacuucagauucgauuccuggguaaaucaauuuuacacuuuagcaccaaugggaaauggcacaggaagaagaagagcacuuuaa

SEQ ID NO: 32197 - RNA, 1623 nt, Artificial Sequence
  derived and/or modified sequence opt6 from VP1__Norovirus__BAS30338
augaaaauggcauccuccgaugcaaaucccucugaugguucaacugcaaacuuaguaccagaagucaauaaugaaguaauggcauuagaacccguuguaggcgcagcaauagcagcaccagucgcaggacaacaaaauguaauugauccauggauacgaaauaacuucguacaagcaccagguggagaauuuacagucuccccccgaaaugcaccaggugaaauacucuggucagccccucuaggucccgaucuaaacccauauuuaucacauuuagcaagaauguauaauggauacgcuggagguuuugaaguacaaguaauauuagcagggaacgcuuuuaccgcaggaaaaauaauauucgcagcaguuccaccaaacuuuccuaccgaaggacuaucacccucucaaguaacaauguucccacauauaauagucgacguuagacaauuagaaccaguucuuauaccauuaccagauguccgaaauaacuucuaucauuacaaucaaaguaaugacccaacaauuaaauuaauagcaaugcuauacacaccacuaagagcaaacaaugcaggagacgauguauuuacaguaucauguagagucuuaacuagaccaucaccagacuuugacuuuauauuucuuguaccuccuacaguagaaaguagaacaaaaccuuucucuguaccaauacuaacaguagaagaaaugacgaacucaagauuuccaauaccauuagaaaaacuauuuacaggaccauccuccgcauucguaguccaaccacaaaacggacgauguacaacugauggaguacucuuagguaccacucaauuaucucccgucaauauauguacauuuagaggagauguaacacacauaacaggcaguagaaacuacacuaugaacuuagcuacccaaaacuggaauucuuacgaucccacagaagaaauacccgcccccuuaggaacaccagauuuuguagguaaaauacaaggaguacuuacacaaacuacaagagcagauggaucuacaagaggacauaaagcaacagucuauacaggaucagcagacuuugcuccaaaauuaggccguguacaauuugcaacagauacagauaacgauuuugaugcaaaccagaauaccaaauucacaccaguaggaguaauacaagacggagauaccgcacaucgaaacgaaccacaacaaugggucuuaccaucuuauucaggacgaaauucucauaauguacaccuagcaccagcaguugcaccaacauuucccggagaacaacuacuauucuuucgaucuacuaugcccggauguucaggauauccaaauauggaccuagauugccuauuaccucaagaauggguacaauauuucuaccaagaagcagcaccagcacaaucagauguugcccuacuccguuucguaaauccugacacaggaagaguacuauucgaauguaaauuacauaaaucuggauacguaacuguugcccauacaggacaacacgaucuuguaauuccuccaaacgguuacuuucgauucgauucauggguaaaccaauuuuacacacucgcaccuaugggaaacggaacaggaagacgaagagccuuauaa

SEQ ID NO: 32198 - RNA, 1623 nt, Artificial Sequence
  derived and/or modified sequence opt6 from VP1__Norovirus__BAS30341
augaaaauggcuuccucagaugcaaacccauccgauggaucuacagcuaaccuagucccagaaguaaauaaugaaguaauggcucuagaacccguaguaggagcagcaauagcugcaccaguagcaggacaacaaaauguaauugauccauggauuagaaauaauuuuguacaagcaccaggaggagaauuuacaguuucaccacgaaacgcaccuggagaaauauuauggagcgcaccauuagguccagaccuaaaucccuaucucucccauuuagcaagaauguauaacggauaugcagguggauucgaaguacaaguaauacuagcuggaaaugcauucacagcagguaaaauaaucuuugccgcaguuccaccaaacuuucccacagaaggccuaucuccaucccaaguaacuauguucccucacauuauaguugauguaagacaauuagaaccaguauuaauacccuuaccugauguaagaaauaacuuuuaccauuauaaccaaucaaaugacccaacaauaaaacuaauagcaaugcuauacacaccacucagagcaaacaaugccggagacgacguauuuacaguaucaugcagaguacuaacaagaccuucaccugacuuugacuuuauauuucuagucccaccgacaguagaaucaagaacaaaaccauuuucuguaccaguacuaacaguagaagaaaugacuaacucaagauuuccaauaccgcuagaaaaauuauuuacagguccaaguucagcauucguuguacaaccacaaaacggacgauguacaacagaugguguauuacuaggcacaacacaauuaucaccuguaaauauauguaccuuucguggagaugucacucauauaccaggaaguagaaacuacacaaugaaccuagcuucccaaaacuggaauucauaugauccaacugaagaaauuccugcaccucuaggaacaccagacuuuguuggaaaaauccaaggaguacuaacacaaacuacaagaaccaauggaucaacaagaggucauaaagcaaccguauauacagguucugcagauuuuucaccaaaauuaggacgaguucaauucgcgacagacacagauaaugauuuugaaacuaaucaaaacacaaaauuuacaccaguaggaguaauucaagacggaucuacaacaccucguaaugaaccucaacaauggguacuacccucauauucuggcagaaauauucauaacguacaucucgccccagcaguagcaccaacauuuccaggagaacaacuauuauuuuuucgaucuacaaugccaggauguucuggauauccaaacauggauuuagacugcuuacuuccacaagaauggguacaauauuucuaucaagaagcagcacccgcacaaucagauguugcauuauuacgauucguaaauccagacacuggaagaguauuauucgaauguaaauuacauaaaucaggauauguuaccguugcacauacuggucaacaugauuuagucauaccacccaauggcuacuuuagauucgacagcugggucaaucaauuuuacacauuagcaccaaugggaaacggaacaggucggagacgagcacuauaa

SEQ ID NO: 32199 - RNA, 1623 nt, Artificial Sequence
  derived and/or modified sequence opt6 from VP1__Norovirus__BAS30344
augaaaauggcaucuucagaugcaaauccuucugacggaucaacagcaaacuuaguaccagaaguuaauaacgaaguuauggcacuugaaccaguaguaggagccgcuauagcagcuccagucgcaggccaacaaaauguaauagauccauggauacgaauaaacuucguacaagcaccaggaggagaauuuacaguuucaccuagaaaugcuccaggagaaauauuauggucagcaccauuaggaccugauuuaaauccauaucuuucacaccuagccagaauguauaacggauacgcuggugguuuugaaguacaaguaauacuagcaggaaacgcauucacugcuggaaaaauaauuuucgcagcaguaccccccaacuuuccaaccgaaggacuaucacccucccaaguaacaauguucccacauauaaucguagacguaagacaacuagaaccaguacuaaucccucuaccagauguacgcaacaauuucuaccacuauaaucaaaguaaugauccaacaauaaaacuuauagcaauguuauacacaccauuacgugcaaacaacgcuggagaugacguauuuacaguaucaugucgaguauuaacucgaccauccccagauuucgauuucauauuuuuaguuccaccaacaguugaauccagaacaaaaccauuuucuguacccguauuaacaguugaagaaaugacuaacucuagauuuccaauaccacuagaaaaauuauuuaccggcccaucaucagcauucguuguccaaccacaaaauggcagauguacaacagacgguguacuacuaggcacaacucaacuaucaccugucaacauaugcacauuuagaggcgauguaacacauauaccuggaucacgcaauuacacaaugaaucuagcaucacaaaacuggaauuccuacgaucccacugaagaaauaccagcuccauuaggaacaccugacuuugucggaaaaauacaaggagucuuaacacagaccacacguaccaacggaucaacucgcggacauaaagcaacuguauacacaggaucagcugacuuuucaccaaaauuagggcgaguacaauuugcaacugauacugauaaugacuuugaaacuaaucaaaauacaaaauuuacaccagucggcguaauacaagauggaagcacuacaccucgcaaugaaccacaacaauggguccuacccucauauucuggacgcaauauacauaacguucacuuagcaccugcaguagcacccacauucccaggagaacaauuacuuuucuucagaaguacaaugccaggauguuccggauacccaaacauggaucuagacugcuuacuaccccaagaauggguucaauauuucuaucaagaagcagcuccagcccaaucagacguagcauuauuacguuucguuaaccccgacacaggaagaguacuauucgaaugcaaguuacauaaaucagguuaugucacaguagcacauacaggccaacacgaccuaguaauaccaccaaauggauauuuucguuucgacuccuggguaaaucaauuuuacacucuagcaccaaugggaaauggaacaggucgccgaagagcacuuuaa

SEQ ID NO: 32200 - RNA, 1623 nt, Artificial Sequence
  derived and/or modified sequence opt6 from VP1__Norovirus__BAS30347
augaaaauggcauccucagacgcuaacccauccgauggaucaacagccaaccuugucccagaaguaaacaaugaaguaauggcccuagaaccaguaguaggagcagccauagcagcuccugucgcaggacaacaaaauguaauagacccauggauaagaaauaacuucguacaagcaccagguggagaauuuacaguaucaccaagaaaugccccuggcgaaauauuauggucagcaccacuaggaccagaucuaaauccauaccuaucacauuuagcacgaauguauaaugguuacgcaggaggauucgaaguacaaguaauacuagccggaaaugcauucacugcaggaaaaaucauauucgcugcaguuccaccaaauuuuccaacugaaggauuaucaccaucacaagucaccauguucccucauauaauaguagacguaagacaacuugaaccaguuuuaauucccuuaccagauguaagaaacaacuucuaucacuauaaucaaucgaaugauccaacaauuaaacuaauagcaauguuauauacuccauuaagagcaaacaaugcaggugacgauguauucacagugucuuguagaguauuaacuagaccauccccugacuuugacuuuauauucuuaguuccaccuacaguagaaucuagaacuaaaccauucucaguacccguauuaacugucgaagaaaugaccaacucaagauucccaauaccauuagaaaaacuauucacagguccaucuucagcuuucgucguacaaccacaaaacgguagaugcacaacagacggagucuuacuagguacaacucaacuauccccuguaaauauauguacauuuagaggugacgucacacacauacccggaucaagaaauuauaccaugaaucuagcaucacaaaauuggaauagcuacgauccaacagaagaaauaccagcaccacuuggaacaccagacuuuguaggcaaaauacaaggaguccuaacacaaacaacaagaacaaacggcucaacacgaggacauaaagcuacagucuauaccggcagugcagacuucucacccaaauuaggacgaguacaauucgccacagauacagacaaugauuucgaaacaaaucaaaauacaaaauuuacuccaguaggaguuauccaagauggaucaacaacaccaagaaacgaaccacaacaauggguacucccaucauauucaggaagaaauauacauaacguccaucuagcccccgcaguugcaccuacuuuuccaggugaacaacuucuauucuuucgaucaacaaugcccggauguagcggauaccccaauauggaccuagacugucuucucccucaagaauggguacaauauuuuuaucaagaagcggcaccagcacaaucugaugucgcacuuuuaagauuuguaaauccagacacaggaagaguuuuauuugaaugcaaacuucauaaaucuggauaugucacaguagcacauacaggacaacacgacuuaguuauaccaccaaacggauacuuucgauucgacucauggguaaaucaauuuuacacauuagcuccgaugggaaauggaacagguagaagaagagcauuauaa

SEQ ID NO: 32201 - RNA, 1623 nt, Artificial Sequence
  derived and/or modified sequence opt6 from VP1__Norovirus__BAS30350
augaaaauggcaucuuccgaugcaaacccaucagauggauccacagcaaauuuaguacccgaaguuaauaacgaaguaauggcuuuagaaccaguuguaggugccgcaauugcagcaccaguagcaggacaacaaaauguuauagauccauggaucagaaauaacuucguacaagccccaggaggugaauuuacaguauccccaagaaaugccccgggagaaauacuauggucugcaccuuuaggaccagacuuaaacccauaucuaucucaucuagcccgaauguauaacggauacgcaggaggauuugaaguacaaguaauauuagcaggaaacgcuuuuacagccgguaaaaucauuuucgccgcuguaccaccuaacuuuccaacagaaggacuuagcccaucacaaguaacaauguucccacacauaauaguagauguaagacaacuagaaccaguacuaauuccauuaccagauguucguaacaauuucuaucacuauaaccaaagcaaugacccaacuauaaaauuaauagcaauguuauacacaccacuaagagcuaacaaugcuggugacgaugucuucacaguaucauguagaguccucacucgccccuccccugacuuugauuuuauauuuuuaguaccaccuacaguagaaagucgcacaaaacccuuuucaguaccuguacuaacagucgaagaaaugacaaacuccagauucccaauaccucuagaaaaauuauucacugguccaucaucagcauucguaguacaaccacaaaacggacgauguacaacagacggaguauuauuaggaacaacccaauuaaguccuguaaauauaugcacauucagaggcgacguaacccauauucccggaucaagaaauuauacaaugaaucuagcaucacaaaacuggaauucuuaugaucccacugaagaaauaccagccccacuagguacaccugacuuuguaggaaaaauacaaggagucuuaacccaaacaacaagaacuaacggaagcacaagaggacauaaagccacuguauauacaggcucugcagacuuuucuccuaaauuagguagaguccaauuugcaacugauacagacaacgauuucgaaacaaaucaaaacacaaaauuuacacccguaggugucauacaagacggaucaacaacaccaagaaaugaaccacaacaauggguauuaccuuccuauuccggaagaaauauccacaauguacaucuagcaccagcuguagcgccaacuuucccaggagaacaacuacucuucuuuagaucaacaaugccaggauguucaggauauccaaacauggaucucgacuguuuacuaccucaagaauggguacaauacuuuuaucaagaagcagcaccagcacaaagugauguagcucuauuaagguucguaaaccccgauacaggucgaguauuauucgaauguaaauuacacaaaucuggauacguaaccguagcacauacaggacaacaugaucuuguaauaccaccaaauggauauuuuagauuugauucaugggucaaucaauuuuacacuuuagcuccaauggguaacggcacuggcagacgaagggcauuauaa

SEQ ID NO: 32202 - RNA, 1623 nt, Artificial Sequence
  derived and/or modified sequence opt6 from VP1__Norovirus__BAS30353
augaaaauggcaagcuccgacgccaauccaagcgaugguucuacagcaaaucuuguuccagaaguaaacaaugaaguaauggcauuagaacccguaguaggagccgcaauagcagccccaguagcaggccaacaaaacguaauugauccauggauaagaaauaacuuuguucaagcaccuggaggagaauucacuguuaguccaagaaacgcacccggcgaaauauuauggucagcaccacuagguccagaccuaaaccccuauuuaagucaccuugcaaggauguauaaugguuaugcaggcgguuucgaaguacaaguaauacuagcagguaaugccuuuacagcuggaaaaauaaucuucgccgcaguaccucccaacuuuccaacagaaggucuaucacccucacaaguaacaauguucccacacauaauaguagauguuagacaauuagaaccaguuuuaaucccacuaccagacguuagaaacaauuucuaucacuauaaccaacuaaaugacccaacaauaaaauuaauagcaaugcuuuauacaccacuacgagcaaauaaugcuggagacgauguauuuacaguaucuuguagaguauuaacuagaccaucuccagacuucgauuuuauauuucuaguuccaccaacagucgaaucacguacaaaaccuuucucagucccaguauuaacaguagaagaaaugacuaauucccgauucccaauuccacuugagaaacuauuuacaggaccaucaucagcauucguuguacaaccucaaaauggcagauguacaacugacgguguacuacuagguacaacucaauuaucaccuguaaauauauguaccuuccgaggagauguaacucauauaccaggaucccguaauuacacaaugaaucuagcaucacaaaacuggaauucauaugauccaacugaagaaauuccagcaccauuaggaacaccugauuucguaggaaaaauacaagguguucuaacacaaacaacuagaacuaacggaucaacacgaggucauaaagcuacaguauauacaggaucagcagacuuuucuccaaaacuaggaagaguccaauucgcaacagacacagauaacgauuucgaaacaaaucaaaauaccaaauuuacaccaguuggaguaauacaagaugguucaacaacuccaagaaaugaaccacaacaauggguauuaccaucauauucaggaagaaauauacauaauguccaccuagcacccgcagucgcaccuaccuucccaggagaacaacuauuauuuuuuagaucuacaaugcccggaugcucaggcuauccaaauauggacuuagacugccucuuaccacaagaauggguacaauauuucuaucaagaagccgcaccagcacaaucagacguagcauuauuacguuucguuaacccugacacaggaagaguacucuucgaaugcaaacuccauaaaucaggauauguaacuguagcacauaccggacaacaugaccuuguaauaccaccaaauggauacuuuagauucgauuccuggguaaaccaauuuuauacauuggcaccaaugggaaacggaacaggaagacgaagagcauuauaa

SEQ ID NO: 32203 - RNA, 1623 nt, Artificial Sequence
  derived and/or modified sequence opt6 from VP1__Norovirus__BAS30356
augaaaauggccucuuccgaugcuaacccuagugacggaucaacagcaaacuuagucccagaaguaaauaaugaaguaauggcacuagaaccaguagucggugcagcuauagccgcaccaguugcaggacaacaaaauguaauagauccauggauucgaaauaacuuuguacaagccccagguggagaauuuacuguaucuccuagaaacgcaccaggagaaauuuuauggucugaaccacuaggacccgaccuaaauccuuaccuaucucaccuagcaagaauguauaacggcuaugcuggaggcuuugaaguacaaguaauauuagcugguaaugcuuuuacagcaggaaaaaucauauucgcagcaguccccccaaacuuuccaaccgaaggauuaucuccaucucaaguaacaauguucccucacauaauaguagacguaagacaacuagaaccaguauuaauuccacuuccagaugucagaaacaauuucuaucacuauaaccaaucaaacgauucaacaauaaaacuuaucgcaaugcuauauacucccuuaagagccaacaaugccggagacgauguauuuacagucucaugucgaguccucacaagaccuucaccagacuuugacuuuauauuucuuguaccuccaaccguagaaucaagaaccaaaccuuucucgguacccguacuaacaguagaagaaaugacaaacucaagauuuccaauaccucuagaaaaacuauucacuggaccaucaucugcauucguaguccaaccccaaaauggucgcuguacaacagacggaguccuucuaggaacaacucaauuaucuccaguaaacauauguacauucagaggagauguuacucauauaccuggcucacgaaauuacacaaugaaccuugcaucucaaaauuggaacucuuacgaucccacagaagaaauaccagcacccuuaggcacuccagauuuugucggaaaaauacaaggaguauuaacacaaaccacacgaacaaacggauccacaagaggccauaaagcaaccguauacacagguucagcggauuucaguccaaaacuagggcguguccaauuugcaacugacaccgauaacgauuuugaaacaaaucaaaauacaaaauuuacaccaguaggaguaauacaagacgguggaacaacccauagaaaugaaccccaacaauggguacuccccucauauucaggaagaaauauacauaacguucaccucgcaccagcagucgcaccuacauuuccaggagaacaacuccuauuuuucagaucaacuaugcccggaugcucagguuacccuaauauggaccucgacuguuuacuaccacaagaauggguacaauauuuuuaucaagaagcagcaccagcacaauccgacguagccuuauuaagauucguaaacccagauacaggaagaguccuuuucgaauguaaauuacauaaaucuggauauguaacgguagcucauacaggucaacaugauuuaguaauaccaccuaauggcuauuucagauucgacucuuggguaaaucaauucuacacauuagcucccaugggaaauggaaccggcagaagaagagcacuauaa

SEQ ID NO: 32204 - RNA, 1623 nt, Artificial Sequence
  derived and/or modified sequence opt6 from VP1__Norovirus__BAS30359
augaaaauggcuucauccgacgcaaauccaucagaugguucaacagccaaucuuguaccagagguaaacaaugaaguuauggcuuuagaacccguuguaggagcagcaauagcugcuccaguagccggacaacaaaacguaauagacccauggauaagaaauaauuuuguacaagcaccaggaggugaauuuacaguaucaccaagaaaugccccaggcgaaauauuaugguccgccccacuuggaccagauuuaaauccuuauuuaucacacuuagcccgaauguacaacggauacgccgguggauucgaaguccaaguuauacucgcaggaaaugcuuuuacagcaggaaaaauaauauucgcagcuguuccaccaaacuuuccaacagaaggacuaucaccaucucaaguuacaauguuuccacauauaauaguagauguaagacaauuagaacccguucuaauaccauuaccagauguaagaaauaauuuuuaccacuauaaccaaucuaaugacucaacuauuaaacuaauagcaaugcuauauacuccucuuagagcaaacaaugcaggugacgacguauuuacaguaucaugcagaguccuaacacgaccaucuccagauuuugacuucauauuucuaguaccaccaacagucgaaucaagaacuaaaccauuuucaguuccagucuuaacaguagaagaaaugacaaauucacguuuccccauaccucuagaaaaauuauuuacagguccuucaucagcauucguaguccaaccccaaaacggacgauguacaacagacggaguauuacuuggaacaacacaauuaucaccaguaaauaucuguacauuuagaggcgaugucacacauauaucagguucucgaaacuauacuaugaaucuagcuucacaaaauuggaauucauacgauccuaccgaagaaauaccugccccauuaggcaccccagacuuuguaggaaagauacaaggaguacuaacacaaacuaccagaacaaacggaucaaccagaggccacaaagcaacaguuuauacagguucagcagacuuuuccccaaaauuaggcagaguacaauucgccacugauaccgauaaugacuucgaaaccaaccaaaauacaaaauuuacacccguagguguaauacaagacggaucaacaacuccuagaaaugaaccacaacaauggguacuaccaucauacucaggaagaaacauacauaauguacacuuagcuccugcagucgccccaacuuucccaggagaacaacucuuauucuuuagaucuaccaugccagguuguucaggcuauccaaacauggaucuagauuguuuguuaccacaagaauggguucaauauuuuuaucaagaagcagcaccugcacaaucugauguugcccuauuaagauucguuaacccggacacaggcagaguacuuuuugaaugcaaacuacauaaaucaggauaugucacaguugcacacacaggucaacaugauuuaguaauaccaccaaacggauacuuucguuuugacucauggguaaaucaauuuuacaccuuagcuccaaugggaaauggaacaggacgccgacgcgcacucuaa

SEQ ID NO: 32205 - RNA, 1623 nt, Artificial Sequence
  derived and/or modified sequence opt6 from VP1__Norovirus__BAS30362
augaaaauggcuucaucugacgcaaacccauccgauggaucuacagcaaaccuaguacccgaaguaaacaaugaaguuauggcacuugaaccaguaguaggugcagcaauagcagcaccaguagcaggacaacaaaacguuauagacccauggauucgcaauaauuuuguccaagcaccuggaggugaauucacagucucaccaagaaacgcaccaggagaaaucuuauggucagcaccacuaggaccagaucuaaacccauaccuuucacaccuggccagaauguacaaugguuaugcaggaggcuuugaaguacaaguaauauuagcuggcaacgccuuuacagccggaaaaauuaucuucgcagcaguaccaccuaacuuucccacagaaggauuguccccaucacaaguaacaauguuuccacacauaauaguagacguuagacaacuagaaccaguauuaauuccucuacccgaugucagaaauaauuuuuaucacuauaaccaaucaaacgacccuacaauaaaauuaauagcaauguuauauacaccacuuagagcaaacaacgcuggagacgacguauucacaguaucaugucguguucuaacuagaccauccccagauuuugacuucauauuuuuaguaccacccacuguugaaaguagaacaaaaccuuucucaguaccaguauuaacagucgaagaaaugacuaauucaagauuucccauaccacuagaaaaacuauuuacaggaccaucuucugcauucguaguacaaccucaaaacggaagauguacaacagacgguguacuacuaggaacaacacaacuaucaccaguaaauauauguaccuuuagaggagacguaacacauauacccgguucaagaaacuacacaaugaaccucgcaucacaaaacuggaauucuuacgauccuaccgaagaaauccccgcuccacuaggcacaccagacuucguaggaaaaauacaaggcguauuaacacagacuacaagaacaaacggaucuacaagaggacacaaagcaacuguauauaccggaucagcagauuuuuccccaaaauuaggaagaguacaauucgcaacugauacagacaacgacuuugaaacuaaucaaaacacaaaauuuacacccguagguguuauacaagacgguucaacaacuccuagaaacgaaccucaacaaugggucuuaccuuccuacucuggccguaacauacauaauguucaccuagccccugcaguagcaccaacauuuccuggugaacagcuacuuuuuuucagauccacaaugccaggcugcuccggcuaucccaauauggauuuagacugcuuacucccccaagaauggguacaauacuuuuaucaagaagcugcaccugcacaaucagacguagcccuauuaagauuuguuaacccugacacaggacgaguauuauucgaaugcaaacuccacaaaaguggcuacgucacaguagcccauacaggacaacaugaucucguaauaccaccaaauggauacuuuagauucgacuccuggguaaaucaauuuuacacauuagcacccaugggaaacggaacagguagaagaagagcauuauaa

SEQ ID NO: 32206 - RNA, 1623 nt, Artificial Sequence
  derived and/or modified sequence opt6 from VP1__Norovirus__BAS30365
augaaaauggccucuucagacgcaaauccaucagauggcucaacagcaaauuuagucccagaaguaaacaaugaaguaauggcacuagaaccaguaguaggugcagcaaucgcagcaccuguagcaggccaacaaaacguaauagaccccuggauacgaaacaacuuuguacaagcaccuggcggagaauuuacaguaucaccucgaaacgcaccaggagaaaucuuaugguccgcaccucucggaccagaucuaaacccuuacuuaucacaucuugccagaauguauaacgguuacgcaggagguuuugaaguccaagucauauuagcaggaaacgcuuuuaccgcaggaaaaaucauuuuugcagcaguacccccaaauuuccccacagagggauuaucacccucacaaguaacaauguucccacauauaauaguagauguaagacaacucgaaccaguacuaauaccauuaccagauguacguaacaauuuuuaucauuacaaccaaaguaacgaccccacaaucaaauuaauagcaaugcuauacacuccauuacgcgcaaauaacgcaggcgaugaugucuuuacaguuucaugucgaguacuaacaagaccuucaccagacuuugacuuuauauucuuaguaccaccaacaguugaaucaagaacaaaaccauucucaguaccaguauuaacaguagaagaaaugaccaacucaagauuucccauaccccuagaaaaauuauuuacaggaccuuccucagcauucguuguacaaccucaaaauggaagauguacaacugacggaguauuauuaggaacuacucaacuaucaccagucaauauuuguacauuccguggagauguaacacacauaucaggaucucgaaauuacacaaugaauuuagcuucucaaaauuggaauucauaugauccaacagaagaaaucccagcuccauuagguacaccagauuucguaggaaaaauucaaggugucuuaacccaaacuacucgcacaaacggaucaacccgaggucacaaagccacuguauacacaggauccgccgauuucucaccaaaacuuggaagaguacaauuugcuaccgacacagauaacgauuucgaaaccaaucaaaauacaaaauucacacccguaggcguaauucaagauggaucuacaacaccacgaaaugaaccacaacaauggguauuaccaucauauuccgggcgaaacauccauaacguacauuuagcaccagcaguagcuccaacauuuccaggagaacaauuauuauuuuuucgaucaacaaugccaggauguucuggauaccccaauauggacuuagauugcuuauuaccccaagaauggguacaauauuuuuaccaagaagcugccccagcacaaucugauguagcucugcuuagauuuguaaacccagauacagguagagucuuauuugaaugcaaauuacacaaauccgguuauguaacaguagcucauacaggacaacacgacuuagucauaccaccaaacggcuauuuucgauuugacucauggguuaaucaauucuacacacucgcuccaaugggcaauggaacaggacguagaagggcauuauga

SEQ ID NO: 32207 - RNA, 1623 nt, Artificial Sequence
  derived and/or modified sequence opt6 from VP1__Norovirus__BAS30368
augaaaauggccucuagcgaugccaaccccagcgaugguucuacagcgaaccuuguaccagaaguaaacaacgaaguuauggcucuagaaccuguagucggagcagcuaucgcagcaccuguagcaggucaacaaaaugucauagaccccuggauaagaaauaacuuuguacaagcaccaggcggcgaauuuacaguaucacccagaaacgcaccaggagaaauacuauggucugcaccccuaggaccagauuuaaauccauaucuaucacaucuugcacguauguauaaugguuacgcaggaggcuucgaaguucaaguaauacuagcuggaaaugccuuuaccgcagguaaaaucauuuucgcagcaguaccaccaaauuuuccaacugaaggacuaucccccucucaagucacaauguuuccccauaucauaguugauguacgucaacuagaaccuguacuaauuccacuuccagauguacgaaacaacuuuuaucacuauaaucagucaaacgacccaaccauaaaauuaaucgcaauguuauacacaccuuuaagagcaaauaacgcuggagaugauguuuucacaguaagcuguagagucuuaacaagaccaucaccagacuucgauuuuauauuucucguaccuccaacaguugaaucacgaacuaaaccuuucucagucccaguauuaaccgucgaagaaaugacuaacucaagauuuccuauaccacuugaaaaacuauucacaggcccaucauccgccuucgucguccaaccacaaaacggcagauguacaacugauggagucuuauuaggaacaacacaacuaucaccaguaaauauauguacauuuagaggugauguuacccauauaccuggcucuagaaacuauacaaugaauuuagcuucucaaaacuggaacucauaugaucccacagaagaaauuccugcuccacuaggcacaccagacuuuguuggaaaaauucaaggaguacuaacccaaacaacaagaacaaacgguucaacacgaggccauaaagcaacaguauacacaggauccgcagacuuuucaccaaaauugggaagaguacaauucgcaacagacacagauaacgauuucgaaacaaaucaaaauacaaaauuuaccccaguaggaguaauacaagaugguuccacuacuccacgaaacgaaccccaacaauggguccucccauccuacucaggcagaaacauucauaauguucacuuagcccccgcaguagccccaacauuuccaggagaacaacuacuauuuuuuagaaguacaaugccaggauguucaggauauccaaacauggacuuagauugccuauuaccacaagaauggguucaauauuucuaccaagaagcagcaccagcucaaucagacgucgcauuacuacgauucguaaacccagacacagguagaguacuauuugaaugcaaauuacauaaaucaggauauguuacuguagcacauacgggacaacacgauuuaguaauaccacccaacggauauuuuagauucgauucauggguaaaucaauuuuauacacuagcaccaaugggcaauggaacaggaagaagacgugcacucuaa

SEQ ID NO: 32208 - RNA, 1623 nt, Artificial Sequence
  derived and/or modified sequence opt6 from VP1__Norovirus__BAS30371
augaaaauggccucaucagaugcaaauccuucugauggcucaacugcaaaccuuguaccagaaguaaacaaugaaguuauggcauuagaacccgucgucggagccgcaaucgcugccccaguagcaggucaacaaaaugucauagauccauggauaagaaauaauuuuguacaagcaccaggaggagaauuuacaguauccccacgaaaugcaccaggagaaauacuauggucagcuccuuuagguccagauuuaaaucccuaccuaucccaccucgcaagaauguauaauggauacgcuggcggauuugaaguccaaguaauacuagcaggaaaugcauucacugcuggcaaaauaauauucgcugcuguacccccuaauuuuccaacagaaggacuaucacccucacaaguuacaauguucccccauaucaucguagacguaagacaacuugaaccuguauuaauuccauuaccagacguacgaaacaacuuuuaccauuauaaccaaucaaaugacccuacuauuaaacuaauagcuauguuauacaccccauuacgagcuaacaaugcuggagacgauguuuuuaccgucucauguagaguauuaacacgaccaucaccagauuuugauuuuauauuccucgucccaccaacaguagaaucaagaacaaaaccauuuuccgucccaguacuaaccguagaagaaaugacuaacucaagauuuccaauaccacuugaaaaacuauucacaggaccaucaucagcauucguaguacaaccacaaaacggccgauguacaacagacggcguccuacucggaacaacacaacuuucuccugucaacauaugcacauucagaggagauguuacacauauaccuggaucucgaaauuauacaaugaaucuugccucacaaaacuggaauucuuacgauccaacagaagaaaucccagcaccccuagguacaccagacuuuguaggaaaaauacaagguguacuuacacaaacuaccagaacaaauggcucuacccgaggacacaaagcaacuguuuauacuggaucugcagauuuuucaccaaaauuaggaagaguacaauucgcuacugauacagacaacgauuucgaaacaaaucaaaauacuaaauuuacaccaguuggaguaauacaagacgguucuacuaccccaagaaaugaaccacaacaauggguacuuccuucuuacaguggcagaaacauacauaacguacacuuagcaccugcaguagcaccuaccuuuccaggggaacaacuuuuauuuuuucgaucuacaaugccaggauguucagguuacccaaacauggaucucgauugucuuuuaccacaagaauggguacaauacuucuaucaagaagcagcaccagcacaaucugacguugcauuacuccguuuuguaaacccagacacuggucgaguacuauucgaaugcaaacuacauaaaucaggauauguaacuguagcacauacaggccaacacgaccucguuaucccaccaaauggauacuucagauuugauaguugggucaaccaauuuuacacauuagcuccaaugggcaacggaacuggcagaagacgagcucuuuaa

SEQ ID NO: 32209 - RNA, 1623 nt, Artificial Sequence
  derived and/or modified sequence opt6 from VP1__Norovirus__BAS30374
augaaaauggcaucaucugacgcaaaucccucagacggaucaacugcuaauuuaguaccagaaguaaacaacgaaguuauggcacuugaaccaguaguaggagcagcaauagcagcaccaguagcaggacaacaaaacguaauagauccuuggauaagaaauaauuuuguacaagccccaggaggugaauuuacaguaucaccacgaaaugcaccuggggaaauacucugguccgcaccacuaggaccagaucuaaauccauaccuaucacauuuagcacguauguauaacggauacgcaggagguuucgaaguccaaguaaucuuagcuggcaaugcuuuuacagccggaaaaauaauauucgcagcaguuccaccaaacuuccccacagaaggacuaucaccaucacaagucacuauguucccacacaucauaguagacguaagacaacuagaaccaguacuuauaccacuacccgacgucagaaauaacuucuaccacuauaaccaaucaaaugauccaacuauaaaacuaauagcaauguuauacacaccacuaagagcaaacaaugcuggugacgacguauucaccguaucaugccgaguauuaacaagaccaucaccagauuucgacuuuauuuucuuaguaccacccacaguagaaucacgcacaaaaccauucucuguuccaguacuaaccguagaagaaaugaccaauaguagauuuccuauaccacuagaaaaauuauucacaggacccucaucagcauucguaguacaaccacaaaacggucgauguacaacagacggaguuuuauuaggaacaacccaauuaucaccaguaaauauauguacauuuagaggagacguaacacacauaacaggcucucgaaauuacacuaugaauuuagcaucacaaaauuggaacagcuaugacccaacagaagaaauuccagcaccauuaggaaccccagacuuugugggaaaaauacaaggcguccuaacacaaacaacaagaacuaacgguucaacaagaggacacaaagccacaguauauaccggauccgcugauuuuucaccaaaauuaggaagaguacaauucgcaaccgauacagauaaugauuucgaagcaaaucaaaacacaaaauucacaccaguuggaguaauacaagacggaucaaccacaccaagaaaugaaccucaacaauggguccuccccucuuauagcggacgaaauauacauaacguacaucuagcccccgcaguagcgcccaccuuuccaggugaacaauuacuauucuucagaagcacaaugccaggaugcucuggauacccaaacauggaucuagauugcuuauuaccacaagaauggguacaauauuuuuaucaagaagccgcaccagcacaaucugauguugcauuacuaagauuuguaaaccccgauaccggcagaguacuuuucgaaugcaaauuacauaaaucaggauauguaacuguagcacauacaggacaacaugaucuaguuauuccacccaacgguuauuuccgauuugacucauggguaaaccaauuuuauaccuuagcaccuauggguaauggaacaggucguagacgagcacucuaa

SEQ ID NO: 32210 - RNA, 1623 nt, Artificial Sequence
  derived and/or modified sequence opt6 from VP1__Norovirus__BAU16297
augaaaauggcuucaaacgacgauaauccuagugauggauccgcagcaaaucuaguaccggaaguuaacaaugaaguuauggcguuagaaccaguaguaggagcugcaauagcagcaccaguagcuggucaacaaaacguaauagauccauggauaagaaauaauuucguacaagcaccaggaggagaauuuacuguaucaccacgaaaugcacccggugagauauuauggucagcaccauuaggacccgaccuaaauccuuauuuaucacaucuagcaagaauguauaacggauacgcaggcggauuugaaguacaaguaauauuagccggcaaugcauuuacagcaggaaaaguaauauuugcagccguaccaccaaacuuccccacagaaggccuaucaccaucucaaguuacaauguucccacacauaguaguugacguaagacaauuagaacccguucuaauaccccuacccgaugucagaaauaacuucuaccauuauaaccaaucuaaugacccuacaauaaaauuaaucgcuauguuauauaccccacuaagagcaaacaacgcaggugacgauguauuuacuguauccuguaggguauuaacccguccaucaccagauuuugacuuuauauuccuaguuccaccaacuguugaaucuagaacaaaaccauucucaguaccuguauuaacaguagaggaaaugacaaauucaagauucccaaucccauuagaaaaacuauuuacaggacccucaucagcuuucguuguccaaccccaaaauggaagaugcacaacagacggaguacuuuuaggaacuacucaauuaucaccaguaaauauauguacauuuagaggagacguaacacauauaaccggaucaagaaacuacacuaugaacuuagcuucacaaaacuggaacaauuaugauccaacagaagaaauaccagcacccuuaggaacccccgacuuuguaggaaaaauucaaggcguauuaacgcaaacaacacgaacagauggaaguacaagaggacauaaagcaaccgucuauacagguuccgcagauuucgcacccaaauuaggaagaguacaauucgagacagacacagaucacgauuucgaagcaaaucaaaauacuaaauucacucccguagguguuauacaagauggaggaacaacacacagaaacgaaccucaacaaugggucuuaccaucuuauucaggaagagauacacacaacguacacuuagcaccagcaguagcuccaacauucccgggagaacaacuccucuuuuucagaucaacaaugccaggaugcucagguuauccuaauauggacuuagacugcuuauuaccucaagaauggguacaauauuucuaccaagaagccgcaccugcacaaucagacguagcuuuacuaagauucguaaacccagacacaggacgaguacucuucgagugcaaacuacacaagagcggcuacguuacagucgcacauacuggacaacacgaucuaguaaucccaccaaacggcuauuuccgauucgacucauggguaaauaaauuuuacacauuagcaccuaugggaaauggaacaggcagaagaagagcaguguaa

SEQ ID NO: 32211 - RNA, 1623 nt, Artificial Sequence
  derived and/or modified sequence opt6 from VP1__Norovirus__BAU16299
augaaaauggcauccaaugacgcugcaccaucaaaugacggagcugcaggacuaguaccugaaggcaacaacgaaacacuaccacuagaacccgucgccggagcugcaaucgcagcaccuguaacaggacaaaacaauaucauagauccauggauaagaauaaacuuuguucaagcaccaaacggugaauuuacaguuucacccagaaacucaccuggcgaaauacuccuaaaccuagaacuaggaccagacuuaaaucccuaucuagcucauuuaucaagaguauacaauggauaugcaggaggagucgaaguacaaguauugcuagcuggaaaugcuuuuacugcaggaaaaauuuuauuugcagcuguacccccaaacuuuccaguagaauucuuaucaccagcccaaauaaccauguuaccacauuuaauaguagacguccgaacacuagaaccaauaaugauuccucuacccgauguucgaaauacauuuuuccacuauucaaaccaacccaacucucgaaugagauuaguagcuauguuauauacaccacuuagaucaaaugguucuggagaugaugucuuuacuguaucauguagaguacuuacaagaccuacaccagauuuugaauuuacauaucuaguaccaccaucaguagaaucaaaaacaaaacccuuuucauuaccaauacuaacuuuauccgaacuaacuaacucucguuuuccaguaccaauugauucacuuuuuacugcacaugauaacguuuggcaaguacaaugccaaaauggaagauguacccuagauggagaacuacaaggaaccacacaacuucucccaacaggaaucugcgcauuuagaggcagaguuacagcacaaaucaaucagagagacagauggcacaugcaauuacagaauuuaaacggaacaacauacgacccuacagaugacguacccgcacccuuagguacuccugauuucaaaggcguuguauucgguaugguaucacaaagaaacguaggaaaugacgcaccagguaguacaagagcccaacaagcauggguaucaaccuauagcccacaauuuguacccaaauuaggaucaguaaaucuaagaauaucagacaaugacgauuuccaguuucaaccaacaaaauucacaccaguuggaguaaaugaugaugacgauggacauccauuuagacaaugggaauuaccaaacuacuccggcgaacuaacacuuaauaugaauuuagccccccccguagcaccaaauuucccaggagaacaacuucuauucuucagaucuuuuguaccuuguagcggaggcuacaaucaaggcauaauugauugucuaauaccacaagaauggauacaacacuuuuaucaagaaucugcccccucccaaucagauguagcccuaauaagauacguaaacccagacacaggcagaacacucuuugaagcaaaauuacaucgaucaggcuacauaacaguagcucacucaggugauuacccacuuguagucccagcaaauggccacuuuagauuugauuccuggguaaaucaauuuuacuccuuagcuccaauggaaaccgguaauggaagaagacgugcacaauaa

SEQ ID NO: 32212 - RNA, 1635 nt, Artificial Sequence
  derived and/or modified sequence opt6 from VP1__Norovirus__BAU16301
augaugauggcauccaaagacgcagcaccuucagcagauggagcgacaggugcaggacaauuaguaccugaagucaauacugcugauccaaucccuauugauccaguugcaggaucaucuacagcauuagcaacagcuggucaaguaaaucuaauagauccauggauaaucaacaacuucguacaagcuccacaaggugaauuuacuauaucuccuaauaacacuccaggcgacguuuuauuugauuuacaacuaggaccacaucuaaauccuuucuuaucacauuuaucccaaauguacaaugguuggguagggaauaugcguguaagagucguacuagcaggcaacgcauucacugcagguaaaguaaucauaugcugcguaccaccuggauuucaaucaagaacccuuucuauugcucaagcaacauuauucccacauguaauagcagauguccgaacacuagauccaguugaaguuccacucgaagacguacguaauguauuauaucacaauaacgacacacaacccacuaugagacuguuauguauguuauauacaccauuaagaacaggaggagcauccggugguacagacucauuuguaguugcuggcagaguccuaaccuguccaggaccagacuuuaauuuuuuauuuuuaguaccacccacuguagaacaaaaaacaagaccauucaccguaccaaauauaccacucaaauaucuuucaaacucacgaauaccaaacccaaucgaaggaaugagccuaucaccagaccaaacacaaaauguacaauuucaaaacgguagaugcacuauagauggacaaccacuagguacaaccccaguuucagucucgcaacuauguaaguuuagagguagaauuacaucaggccaaaaaguauuaaaccuaacagaacuagacggaucuccauucauggcauuugcagcaccagcaccuguuggcuuuccagaccuagguucaugugacuggcacauagaaaugucaaaaauuccaaacucaucaacacaauccaacccuauagucguaaacuccgucaaaccaaauucucaacaauuuguaccucaccuaucaucaauaacacuggaugacaauguaucaaguggcggcgacuauauaggaacaauccaauggacaucaccucccucaggaucagguggagcaaauaccaacuuuuggaaaauaccugauuacggaaguucacucgcugaagcaucacaauuagccccagccguauauccaccaggauuuaaugaaguaauaguuuauuuuauggcaucuauacccgguccuaaucaaucaggaucuccaaauuuaguuccuugccuacuaccacaagaauauauaacucauuuuauaagcgaacaagcaccaauacaaggugaagcagcauuauuacacuacguagacccagacaccaauagaaacuuaggagaauuuaaauuauauccaggaggauaucuuacaugcguuccaaauucauccucaaccggaccucaacaacuuccauuagacggcguuuucguuuuugcuucuuggguaucaagauucuaccaacuaaaaccuguuggaacagcaggcccugcaagagguagacucggagucagaagauaa

SEQ ID NO: 32213 - RNA, 1623 nt, Artificial Sequence
  derived and/or modified sequence opt6 from VP1__Norovirus__BAU16303
augaugauggcaagcaaagauguaccuacaucaccagauggugcuucaggagcuggacaauuaguaccagaaguaaauacagcugaucaaauaucaauggauccagucgcuggagcgucuacugcaguugcaacagcaggacaaguaaauaugauugacccuuggauuuuuaauaauuuuguacaagcaccccaaggagaauuuacaauaucaccgaacaauacaccaggagauauucuauuugauuuacaauuaggaccacaucuuaacccauuccuugcacauuuaucacaaauguacaauggguggguugguaauaugcguguaagaauuuuauuagcuggaaaugcuuuuacagcagguaaaauaauaauauguugugugccuccaggauuugaugcaaggauauuaaccauagcucaagcaacauuauucccacaccuaauagcugacguacguaccuuagaaccaguugaacuaccuuuagaagacguaagaaauguacuuuaucauaauucuucacaaccucaaccuacaaugagauuaguagcaauguuauauacuccuuuaagaacagguggggguaguggaggaacagacgcauucguuguagcaggaagaguacuuacaugcccagcuccagauuucucauuccuuuuucucguaccuccaucaguugaacaaaaaacgagaguuuuuagcguaccaaacauuccucucaaagauuuaucuaacucaagaguaccaacacuaauacaagguauguuuguuucaccagacgucaaucaaucaguacaauuucaaaauggaagaugccaaauagauggucaacugcaaggaacaacuccuguaucauuaagucaacuuuguaaaauaagaggaaaaacuucaucaaauacacgaguacuaaauuuaucagaaguagacggaacaccuuucgucccauuagaaucuccugccccuguaggauuccccgauaucggaggaugcgacuggcauguaggauuuacuuuugaagcaagggaccaaggaccuucacaaaauguuacauucgccacaaaugauucaucuuuuguaccuuaucuugguucuauaucuccacacaauggugauggcuuccauuccggugauauaauaggaucacuagacuggauuucagcaccaucagauggaucagcauuagauguauggucaauaccuaaauauggaucuucauuaccagacguaacucauuuagcaccagccguauuucccccaggauucggugaaguaauucucuauuuccauucuaaauuuccaggcaguggacccacggauaaacuaagaguaccuuguuuaaugccucaagaauuuauaacacacuuuugugaugaacaagcaccuauagcaggagaagccgcacuucuucauuauguagauccagacgcagguagaaauuuaggugaauuuaaauuauauccagauggauuuaugacuuguguaccaaacucaauaucuagcggaccacaaacucuuccaauaaaugguguauuugucuuuguaucauggguaucacgauuuuaucaacuaaaaccagucggaacggcuucuauggcgagaagauuaggucuaagaagaauauaa

SEQ ID NO: 32214 - RNA, 1647 nt, Artificial Sequence
  derived and/or modified sequence opt6 from VP1__Norovirus__BAU16305
augaaaauggcuucaaaugacgcuacaccuucaaacgacggagccgcaggacuaguucccgaaauaaauaaugaagcaauggcacucgacccaguagcaggagcagccauagccgcaccacuaacaggacaacaaaauauaauugauccauggauaaugaauaauuuuguacaagcuccuggaggcgaauucacaguaucaccacgaaauucaccaggugaagucuuacuaaaccuagaauuaggaccagaaauaaauccauaucuagcacaccuagcaagaauguacaacgguuaugcaggaggauucgaaguacaaguaguauuagccggaaaugcauuuacagcaggcaaaauaauuuuugcugcaauuccacccaacuucucaacagauaauuuaucugcagcacaaauaacaauguguccccauguuauaguagacguuagacaauuagaaccaguaaaucuaccgaugccagauguaagaaacaauuucuuccacuauaaucagggcucugacucaagauuaagauuaauagcaaugcuauauacaccacuucgagcaaauaauucuggagaugaugucuuuacuguaucaugccgaguauuaacacgaccaucaccagauuuuucuuuuaauuuuuuagucccaccaacaguagaaucaaaaacaaaaccauuuacacuaccaauacuuacaauuucugaaaugucaaauucucgauuuccaguaccaauagauucauuacauacuaguccaaccgaaaauguagucguacaaugccaaaacggacgaguuacacucgauggagaauuaaugggcacaacacaacuacuaccaucccaaauaugugccuuuagagguguauuaacaagauccacaucaagagcaucagaccaagcggauacagcagcaccaagacuuuucaacuacuauuggcacauccaauuagauaauuuaaacggaacaccauaugaccccgcugaagacauaccaggaccauuagguacaccagauuucagaggcaaaguauucggcguagcaagccagagaaauccagauucaacaacacgugcacaugaagcaaaaguugacacuacagccggaagauucacaccaaaacucggaucccuugaaauaucaacagaaucagaugacuuugaccaaaaucaaccuacaagauuuacaccaguugguauugguguagaccaugaagccgauuuucaacaauggucucuuccagacuauucuggacaauuuacacacaacaugaacuuagccccagcaguagcaccgaacuucccaggagaacaauuacuguucuuuagaucacaauuaccaucaucaggugguagaucaaauggaauacuugauugcuuaguaccacaagaauggguacaacacuucuaccaagaaagcgcaccugcucaaacacaaguagcauuaguaagauacguaaacccagacacaggacgaguacucuuugaagcaaaacuacacaaauuaggcuuuaugaccauagcaaaaaacggagauucaccaauaauaguaccaccagacggcuauuuuagauucgaaucuugggucaauccuuuuuauacacuugcaccaaugggaauaggaaauggaagaagacgaauacaauaa

SEQ ID NO: 32215 - RNA, 1671 nt, Artificial Sequence
  derived and/or modified sequence opt6 from VP1__Norovirus__BAU16306
augaaaauggccaguucagaugcugcacccucagcugauggagcaggaaauuuaguaccagaaucccaacaagaaguccuaccacuagcuccuguagcaggugcagcacuugcagcaccaguaguaggucaaacaaauauaauagauccauggauuaaagaaaauuuuguucaagcuccacaaggagaauuuacuguuagccccaaaaauucaccaggugaaauauuaguaaaucuugaacuaggaccaaaacuaaauccauaucuugaucaucucucacgaauguauaacucuuaugcaggaggcauugacguaaugguaguuuuagccggcaaugcuuucacagcagguaaaguauuaauagccgcuauucccccaaauuuccccguagaaggaguaagugcaagucaagcaacacaauucccacauguuauaauagauguacgaacacuugauccaguaagacuuccauuaccagauguaagaucaaccuucuuucacuacaccaacgauacugaacccaaaaugcgucuuguaauaugguuauauacaccacuaagaacaaacgguaguggagacgauucauuuacaguaucagguagaauauuaacacguccaucacaagauuuugaauuugcauucuuaauaccaccaaccguagaaacuaaaacaacaccauuuagcguacccggauuuucaguacaagaaaugaguaauucaagauggccagcugcuauaucagcaaugguaguuagagguaaugaaccacaaguuguacaauuucaaaacggaagagcccacuuggauggaaugcuucuugggacaacuccagucucucccaauuacauagcaucauauagaggaaucucaacagguaauucaagaagugcuaguccugaagcagaugaaagagcaguaggaucauucgacguauggauaagacuacaagaaccagacggacagcccuacgauauauuuggaaaacaaccagcaccaauaggaacacccgauuucaaagcaguuaucguaggcuuugcugcacgacccuuaacaucaggaaguuaugcaaaugaagccuauguaaacacuacagcaagcgauuaugcgcccgcaacugguaacaugagauuuacaguuagaaacggaggaagcggucauauaucagcaaacaaauauugggaauuuaaaagcuuuggaguagaaggagaaagacauacagauauucaauaucaagaauacgaauuaccagauuacucaggacaaguugcaagcaaucauaaucuagcuccuccaguugccccuagaaugcccggcgaaucacucuuauuauuucaaucuaauaugccuguaugggaugacggacauggagaaucaacaccaaaaaaaauacauugcuuauuaccacaagaauuuauaggccacuucuucgauaaacaagcaccaaguuuaggagacgcugccuuacuacgcuauguaaaucaagaaacaaacagaguauuauuugaauguaaauuauaccgcgacggauauaucacaguugcagcaaguucuggucuauuagacuuuccacuagauggauucuuuagauuugacagcuggguauccagcuuuuacauucuaucuccaguaggaucaggacaagguagacguggaagaguuagauuucaauaa

SEQ ID NO: 32216 - RNA, 1626 nt, Artificial Sequence
  derived and/or modified sequence opt6 from VP1__Norovirus__BAU16307
augaugauggccuccaaagaugcaacacccuccgcagauggagcuaauggagcuggacaauuaguaccagaaguaaauaaugcagaaccacuaccacucgacccagucgcaggagcaucaaccgcccuugcaacagcaggacagguuaauaugauugacccauggauuuucaauaauuucguacaagcaccucaaggcgaauuuacaauuucuccaaacaacacuccaggugauauccuuuuugaccugcaauuaggaccacaucuuaaccccuucuuagcucauuuaucccaaauguauaacggauggguaggcaacaugcgaguaagagucauauuagcuggaaacgcauucacagcugguaaaguuaucauauguuguguaccaccuggauuucaaagccgaacauuaucaauagcucaagcaacauuauuuccacauguaauagcugauguuagaacauuagaaccacuugaaauuccauuagaagacguaagaaauacacuuuaccauaauaaugauucacaaccaacaaugagacuacucuguaugcuauauacacccuuacgcacaggaggaggaucuggaggaacugacgcuuucguuguagcaggaagaguacuaacaugcccaucaccagacuucaacuuuuuauuucuaguaccaccaaccguagaacaaaaaacucgcccauuuucaguaccaaauauaccacuacaaaaccuaucaaauuccagaguaccaucucuuauacaaucuaugguuuuaucauccgaucacgcacaaacuguacaauuucaaaauggaagaugcacaacagacgggcacuuacuaggaacaacuccaguaucuucuggacaauuaaugaaauuuagaggaaaaguuacuccaggcucuaaaguauuaaauuuaaccgaacuagacgguaguccauucuuagcauuugaaccaccugcccccgcaggauuuccagaccuaggcaaaugugacuggcauaucgaaaugucacuauaucaaguaaauaaucaagauaacccaauaguauuaagagcuauagaaccaaauuccaguuccuuuguaccacauuuaggaucaguaucauuuaaccaaaaugucgacgcagcaggagauuacgucugcaccauucaauacacaaguccacccucuaacucacacgacgcagauguagauuuuuggucuauaccagacuaugguucaaacuuagcugaagcaucucaauuagcacccguaguauacccaccuggauuuggugaagcaauuguuuauuuuaugucaagaguaccuggauggaauagaacaaacagacuaaauuuaguaccauguuuacuaccacaagaauuuauaggucauuucguaucagaacaagcaccugcaauaggagaagcagccuuacuucauuaugucgacccagauacuaacagaaauuuaggugaauuuaaacuuuauccagaagguuucauuacuugcguaccaaauggaacuggaccacaacaacuaccauuaaauggaguauucguauucucuucauggguaucuagauucuaucaacuaaaaccaguaggaaccgccucuagcgcacgaggaagauuaggaauccgaagauaa

SEQ ID NO: 32217 - RNA, 1623 nt, Artificial Sequence
  derived and/or modified sequence opt6 from VP1__Norovirus__BAU24831
augaaaauggcuucaucugaugcaaacccaucagaugguucugcagcaaauuuaguaccagaaguaaauaaugaaguaauggcauuagaaccaguaguaggagcagcaauagcagcgccaguagcuggacagcaaaauguaauagacccauggauacguaauaacuucguacaagcaccaggaggagaauucacaguaucuccucgaaacgcaccaggcgaaauacuuuggagugcaccacuaggaccagauuuaaauccuuauuuaucacaucuagcacgaauguauaacggauacgcagguggauucgaaguacaagucauacuagccgguaacgcauuuacagccgguaaaguaauauuugcagcagucccaccaaauuuucccacagaaggacuaucacccagucaaguaacaauguucccacacauuguaguugacguaagacaauuagaaccuguucuaauuccauuaccugauguaagaaacaauuuuuaccacuauaaucaaagcaacgauccaacaauuaaacuuauagcuaugcuauauacuccacuacgagcaaacaaugccggugaugauguauucacaguaucaugcagaguauuaacacgaccaucucccgauuuugacuucauauucuuaguaccacccacaguagaaucacgaacuaaaccuuucucuguaccaguacuuacaguugaagaaaugacaaauucaagauuuccaauuccauuagaaaaacuauucacaggaccaucuuccgcauucguaguacaaccucaaaauggaagaugcaccacagauggaguccuacuaggcacaacacaauuaucaccaguaaacauuugcaccuuuagaggugacguaacccacauaacaggcucaagaaauuacacuaugaaucuugcaagucaaaacugguccaauuaugacccaacagaagaaauuccagcaccacucgguacuccugacuucguuggcaaaauacaaggaguauuaacacaaacaacaagaaccgacggaucaacaagaggacacaaagccaccguauauaccggauccgcagauuuugcccccaaacuaggcagaguacaauuugaaacugauacagaucaugauuuugaagcaaaucaaaacacaaaauucacaccaguaggcguaauccaagauggguccacaacacaucgcaacgaaccccaacaauggguacuaccaucauauucaggcagaaauacaccaaauguacaccuagcaccagcaguagcuccaacauucccaggagaacaauuauuauuuuucagaaguacaaugcccgguuguucuggauacccaaauauggaucuugacuguuuacuaccucaagaauggguucaauauuuuuaccaagaagccgcaccugcucaaucagacguugcauuacuaagauucguaaauccugauacaggaagagucuuauuugaaugcaaauuacauaaaucuggauauguaacagucgcucauacuggacaacaugaucucguuauacccccaaaugguuauuucagauucgauucaugggucaaccaauuuuauacacuagcuccaaugggaaauggaacaggaagaagaagagcacuuuaa

SEQ ID NO: 32218 - RNA, 1623 nt, Artificial Sequence
  derived and/or modified sequence opt6 from VP1__Norovirus__BAU24834
augaaaauggcaucaucagacgcaaauccauccgauggcuccgcagcaaacuuagucccugaaguaaacaaugaaguaauggcacuagaaccagucguaggagcagcaauagcagcaccuguggcaggccaacaaaacguaauagauccauggauaagaaauaacuuuguccaagcacccggaggagaauuuaccguaucaccaagaaaugcacccggcgaaauauuauggucugcaccauuaggaccagacuuaaauccauaucuaucacauuuagcaagaauguauaacggauaugcaggaggauuugaaguacaaguaauacucgccggaaaugcauucaccgcaggaaaaguaauauucgcagcaguucccccuaacuucccaacagaagguuuaucaccaucucaaguaacaauguucccacacauagucguagacguaagacaauuagaaccaguauuaauaccauuaccugauguacguaacaauuuuuaucauuacaaucaaucaaacgauccaacaauaaaacuaauagcaaugcuuuacacaccacuuagagcaaauaacgcaggagacgacguauuuacaguaucaugcagaguauuaacaagacccagccccgauuuugacuuuauauuccuaguuccaccuacaguugaaucaagaacaaaaccauuuucaguaccagucuuaacuguagaagaaaugacuaauucacgauuuccaauacccuuagaaaaauuauuuaccggaccauccucagcauuuguuguacaaccccaaaacggucguugcacaacagacggaguacuucuaggaacaacacaauuaucaccuguaaauauuuguacauuuagaggagacguuacacacauaacaggaucaagaaauuacacaaugaaucuagcuucucaaaauuggagcaauuacgauccaacugaagaaauacccgcaccauuaggaacaccagacuuuguaggaaaaauucaaggaguucucacacaaacaacaagaacugauggaucaacaagaggacacaaggcaacugucuauacaggaucagcugauuuugcacccaaauuaggaagaguacaauucgaaacagauacagauagagauuucgaagcaaaucaaaacacaaaguucacaccaguuggcguaauccaagacggaucaacaacacaucgaaaugaaccucaacaauggguacucccaucauauucaggaagaaauacuccaaauguucacuuagcuccagcaguugcaccaacguuccccggagaacaauuauuauucuuuagaucaacaaugccagguuguucuggauacccaaauauggaucuagacugcuuacucccacaagaauggguccaauauuucuaucaagaagcagcuccagcucaaucagaugucgcccuucuuagauuuguuaacccagacacaggacgugucuuauuugaaugcaaauuacauaagucaggauacguuacaguagcacacacaggacaacaugaccucguaauaccaccaaauggcuacuuccgauucgauucauggguuaaccaauuuuacacucucgccccaaugggaaacggaaccggucgacguagagcauuauaa

SEQ ID NO: 32219 - RNA, 1623 nt, Artificial Sequence
  derived and/or modified sequence opt6 from VP1__Norovirus__BAU24837
augaaaauggcuucaucagaugccaacccauccgauggcucagcugcaaaucucguaccagaaguaaauaacgaaguuauggcacuagaaccaguuguaggagcagcuauagccgcaccaguagcaggacaacaaaacgucauagauccuuggauuagaaacaauuuuguccaagcaccaggaggugaauucacuguuucaccuagaaacgccccaggagaaauucucugguccgccccuuuaggaccugaccuuaauccauauuuaucccauuuagcucgaauguauaacggauaugcugggggcuuugaaguucaaguaauacucgcaggaaaugccuuuacugcagguaaaguuauauucgcagcaguaccaccaaauuuccccacagaaggucuaucaccaucucaaguaacaauguucccacauauaguaguagauguaagacaacuagaaccaguucuuauuccauuaccagauguacguaauaauuucuaucauuauaaccaaucaaaugacucaaccauaaaacuaauagcaauguuguauacuccacuucgagcaaauaaugcaggagacgauguauuuaccguuucaugucgagucuuaacucgcccaucuccugauuuugauuucauauucuuaguaccucccaccguagaaucucgcacaaaaccauucucuguaccaguucuaacaguagaagaaaugacaaauucaagauuccccauaccauuagaaaaauuauuuaccgguccuucaagugccuuuguaguucaaccacaaaacggaagauguacuacagauggaguccuacuaggaaccacacaguuaaguccagucaauauaugcacauucagaggugauguaacacacauuacuggcucacgaaauuauaccaugaacuuagcuucucaaaacuggucaaauuacgaccccacagaagaaauaccugcuccucuaggaacuccugacuuuguagguaaaauacaaggaguacuaacacaaacaaccagaacagauggaucuacacgaggucauaaagcaacaguauacacaggaucagcagacuuuguuccaaaacuaggucgaguacaguuugaaaccgauacagauagagacuucgaagccaaucaaaauacaaaauuuacaccaguaggaguaauacaagauggaucuacaacacacagaaaugaaccacaacaauggguacuaccaucauacucaggaagaaacacaccaaacguucaucuagcaccugcaguagcuccuacuuuuccaggcgaacaacuacuauuuuuucgaucaacaaugccaggauguucaggauacccaaauauggaucuagacuguuuacuaccucaagaauggguucaauacuucuaucaagaagcagcaccugcacagucagacguugcauuacuuagauucguaaauccugauacaggaagaguucuauuugaauguaaacuucauaaaucaggauauguaacaguagcacacacaggucagcaugacuuagucauaccaccuaacggcuauuuuagauuugauucuuggguaaaucaauuuuauacauuagccccuaugggaaacggaaccggaagaaggagagcuuuauaa

SEQ ID NO: 32220 - RNA, 1623 nt, Artificial Sequence
  derived and/or modified sequence opt6 from VP1__Norovirus__BAU24840
augaaaauggcuuccucugaugccaauccaucugauggaucagcagcaaacuuaguaccagaaguuaacaacgaaguaauggcauuagaaccaguaguuggagcugcuauugcagcuccaguagcaggacaacaaaauguaauagauccauggauacguaauaacuucguacaagcaccuggaggagaauuuaccguaucuccaagaaacgcaccaggagaaauauuauggucagcuccacuaggaccagaucucaaucccuaccuaucacacuuagccagaauguacaacggcuaugcaggcggauuugaaguacaaguaauauuagcuggaaacgcauuuaccgcaggaaaaguaauauucgcugcaguaccacccaauuucccaacagaaggauuaucaccuucccaaguaacaauguucccacauauaguaguagauguaagacaacuugaaccaguacuaauucccuuaccagauguacgaaauaacuucuaccauuauaaccaaucaaacgacccaacaauaaaauuaauagccaugcuauacacaccacuaagagccaauaaugcaggugaugauguauuuacaguaucuuguagaguauuaacucgaccaucacccgauuuugauuucauauuccuuguacccccuacaguagaaucacgcacaaaaccauuuagcguacccguauuaacaguagaagaaaugacgaacucaagauucccaauaccacuagaaaaacuauuuacaggaccauccucagcauucguaguacaaccacaaaauggacguuguaccacagacggaguauuacuaggcacaacacaacuaucuccagucaacaucuguacucuuagaggagacguaacacauaucacagguucgagaaauuauacaaugaacuuagcaagucaaaauuggucuaauuaugauccaacagaagaaaucccagcacccuuaggaacaccugacuuuguaggaaaaauccaaggaguuuuaacucagacaacccgaacagacggaucaacuagaggucauaaagcaacaguauauacaggaucagcagacuuugcaccaaaauuaggccguguacaauucgaaacagacacugauagagauuucgaagcaaaucaaaauaccaaauucacaccaguaggaguaauacaagacggcucaaccacacacagaaaugaaccacaacaauggguacuacccagcuauagcgguagaaauacaccaaauguacauuuagcaccagcaguugcgccaacuuuuccaggcgaacaauuacuauuuuuucgcucuacgaugcccggauguucuggauauccaaacauggaccuagacuguuuauuaccucaagaauggguacaauauuucuaucaagaagcagccccugcacagucugacguagcucucuuaagauucguaaauccagauaccggccgugucuuauucgaaugcaaacuacauaaaaguggauacguaacuguagcacauacaggacaacaugaucuuguaauaccaccaaacggauauuuucgauucgacagcugggucaaucaauuuuauacuuuggcucccaugggaaauggcacaggaagaagaagagcauuauaa

SEQ ID NO: 32221 - RNA, 1623 nt, Artificial Sequence
  derived and/or modified sequence opt6 from VP1__Norovirus__BAU24843
augaaaauggccucaucagacgcaaacccaucagauggauccgcagcuaauuuaguaccagaagucaacaacgaaguaauggcuuuagaaccaguaguaggagcagcaauagccgccccaguagcaggccaacaaaauguaauagauccauggauaagaaacaauuucguacaagccccaggaggagaauuuaccguauccccacgaaaugcaccaggagaaauauuauggucagcaccacuagguccagaccuaaauccauacuuaucccauuuagcacguauguauaacggauaugcaggaggauucgaaguucaaguaauucuugcaggaaaugcauucaccgcaggaaaagucauauuugccgcaguuccaccaaacuucccaacagaaggacuaucuccaucacaagucacaauguuuccacauaucguaguagacguacgacaauuagaaccaguacuuauaccccuaccagacgucagaaacaacuucuaucacuacaaucaaucaaaugacccaacuauuaaacuaaucgcuauguuauacacccccuuaagagcaaauaaugcaggagaugauguauuuacuguaucaugcagaguuuuaacacgacccucaccugacuuugacuucauauuucuaguuccuccaacaguagaaucaagaacaaaacccuucucugucccaguuuuaacagucgaagaaaugaccaacucaagauuuccuauaccuuuagaaaaacuuuuuacaggaccuucaucagccuucgucguucaaccacaaaacggucgauguacaacagacggaguacuccuaggcaccacucaacuaucacccguuaauauauguacauuuagaggugacguaacacauaucaccgguucaagaaauuauacaaugaaucuugccucccaaaauuggucaaauuaugauccaacagaagaaaucccagcuccauuaggaacaccagauuuuguagggaaaauacaaggaguuuuaacccaaacaaccagaacugacggaucaacacgaggacauaaagcaacaguauacacaggaucagccgauuucgcuccuaaauuagguagagugcaauucgaaacagauacagauagagauuucgaagccaaucagaauacaaaauuuacacccguaggaguaauacaagaugguucaacuacacauagaaaugaaccucaacaauggguacuucccucauacucuggacgaaacacaccaaauguacaccucgcaccggcuguagcaccaacauuuccuggagaacaacuuuuauuuuuucgaucaacaaugccagguugcuccggauauccaaauauggacuuggauuguuuauuaccacaagaauggguccaauauuuuuaucaagaagcagcaccagcacaaucagacguagcauuauuaagauucguaaacccagacacaggaagaguacuauucgaaugcaaauuacacaaaucaggauauguaacaguugcucacaccggccaacaugacuugguuauaccaccaaauggcuauuuuagauucgauuccugggucaaucaauucuacacauuagcacccaugggaaauggaacaggcagaagaagagcauuauaa

SEQ ID NO: 32222 - RNA, 1623 nt, Artificial Sequence
  derived and/or modified sequence opt6 from VP1__Norovirus__BAU24846
augaaaauggcaucuaaugaugccaauccuuccgacggaucagcagcuaaccugguuccagaaguaaauaacgaaguaauggcacuagaaccaguuguaggagccgcaauagcugcaccaguagcaggacaacaaaaugucauagacccauggauaagaaacaacuuuguucaagcaccuggaggagaauuuacaguuucuccaagaaaugccccuggcgaaauauuauggucugcacccuuaggccccgaucuuaacccuuaucucucacauuuagcaagaauguacaauggauaugcaggaggauucgaaguacaagucauuuuagccggcaacgcauucacagcaggaaaaauaauauucgcagccguccccccaaacuuccccacugaagguuuaucaccaucucaaguaaccauguuuccacacaucauaguugacguacgccaacuagaaccaguuuuaauaccauuaccugauguacgaaacaacuucuaucauuauaaccaaucuaaugacucaacaauaaaacuuauagccaugcuauacacuccacuacgagcaaauaacgcuggagaagauguauuuaccguauccuguagaguauuaacacguccauccccugauuucgacuuuauauuucuaguaccaccaacuguggaaucacgaacaaaaccauucacaguaccaauauuaacaguagaagaaaugacuaacucuagauuuccaaucccacuugaaaaauuauucacaggaccaucaucagcauuuguuguacaaccccaaaacggaagaugcacgacagauggcguauuauuaggcacaacucaauuauccccaguuaauauauguaccuuccgcggugacguaacacacauagcgggaagcagaaauuauacaaugaauuuagcaucucucaauuggaacaauuaugauccaacagaagaaauaccugcaccucuagguacaccagauuucguuggaaaaauacaaggaaugcuaacucaaacaacaaaaggcgacggauccacaagaggacacaaagccacaguauauacaggaucagcaccauuuacaccuaaacuuggaucaguacaauucgaaacugauacagaaaacgauuucgaaacccaucaaaacacaaaauucacaccaguuggcguaauacaagaugguggaacgacccauagaaacgaaccucaacaauggguccuaccauccuauuccggaagaaauguaccaaauguacaccuagcaccagcaguagcaccaacauuuccaggagaacaauuauuauucuuuagaucaauaaugcccggaugcagugguuauccaaauauggaccuugauugcuuacuaccucaagaauggguacaacauuucuaucaagaagcagcaccagcacaaucugauguagcccuauuaagauucguuaauccugauacuggaagaguacuauucgaauguaaauuacauaaaucagguuauguuacagucgcacauacuggacaacacgaccuagucauaccccccaauggauauuuuagauucgauucauggguaaaccaauucuauacacuagcaccaauggguaacgguacaggacgaagacgagcucuuuaa

SEQ ID NO: 32223 - RNA, 1623 nt, Artificial Sequence
  derived and/or modified sequence opt6 from VP1__Norovirus__BAU24849
augaaaauggcaucaucugaugcaaauccaucagacggaucagcagcuaaucucguaccagaaguaaauaaugaaguaauggcacuagaaccagucguuggugcagcuauagcagcaccaguggcuggacaacaaaauguaauagacccauggauacgcaacaacuuuguucaagcaccaggaggagaauucacagucucaccacgaaaugcucccggagaaauauuauggucagcgccauuaggacccgaccucaauccauaccuaagucacuuagcuagaauguauaaugguuaugcagguggauucgaaguacaagucauccuagcagguaaugcauucaccgcaggcaaaguuauauucgccgcaguaccccccaauuucccaacugaaggacuaucuccaucucaaguaacaauguuuccucauauaguagucgacguaagacaacuagagccaguauuaauuccacuaccagacguacguaauaauuuuuaucauuauaaccaaucaaaugacccuacaauaaaacuaaucgcaauguuauacaccccauuaagagcaaacaaugccggagaugaugucuuuacaguaucuuguagaguauuaacacgcccuucaccagacuucgauuuuauauucuuagucccaccaacaguagaaucuagaacaaagccauuuuccguaccuguuuuaaccguagaagaaaugacaaacucacgcuucccuauaccuuuagaaaaauuauuuacaggaccaucauccgcuuucguuguccaaccccaaaacggacgaugcacuacagacggaguauuauuaggaacaacacaauuaucaccaguaaauauauguaccuucagaggcgauguuacucacauaacaggaucaagaaacuacacaaugaauuuagccucacaaaacuggagcaacuaugauccaaccgaagaaauaccagcaccacuuggcacaccagacuuuguaggaaaaauccaaggaguacuaacacaaacaacaagaacagacgguucuacacgaggucauaaagcaacagucuauacaggaagcgcagacuuugcaccuaaacuuggucgaguacaauuugaaacagacacagauagagacuuugaagcaaaucaaaauacuaaauuuacaccagucgguguuauacaagacggcucuacuacacauagaaacgaaccccaacaauggguauuaccauccuauucuggaagaaauacaccaaauguucaccuugcaccagcaguagcaccaacauucccaggagaacaacuacucuuuuuuagaucaacaaugccgggaugcucaggauauccaaauauggauuuagauugucuauuaccacaagaauggguacaauacuuuuaccaagaagcagccccagcucaaucagacguagcacuacuucguuuuguaaacccagauacaggacgaguauuauucgaaugcaaauuacauaaauccggauacgucaccguagcucacacaggacaacaugaccucguaauaccaccaaauggauauuuuagauucgauucauggguaaaccaauuuuacacacuugcaccaaugggaaaugguaccggacgucgacgagcauuauaa

SEQ ID NO: 32224 - RNA, 1623 nt, Artificial Sequence
  derived and/or modified sequence opt6 from VP1__Norovirus__BAU24852
augaaaauggccaguuccgaugcaaauccaucagacggaucagcagcaaacuuaguaccagaaguaaauaaugaagucauggcauuagaaccaguagucggagccgcuauagcagcaccaguagcugggcaacaaaauguaauagaucccuggauaagaaauaacuuuguucaagccccaggcggagaauuuaccgucucaccuagaaaugcaccuggagaaauauuauggucagccccgcuaggaccagaccuaaacccauaccuaucacaucuugcacguauguauaacggauaugcuggaggauuugaaguacaaguaauacuugcaggcaaugcauuuacagcaggaaaaguuauauuugcagcaguacccccaaauuuuccaacagaaggacuuucaccaucacaaguuacaauguuuccucauauagucguagacguacgacaacuagaaccuguucuuauuccuuugcccgauguuagaaacaauuucuaucacuacaaccaaucaaacgauccaacaauaaaacuaauagcaaugcucuauacaccccuaagagccaauaacgcaggagaugauguuuuuacaguauccuguagaguucuuacaagaccuucaccagauuuugacuucauauuuuugguaccuccaacuguagaaucaagaacaaaaccuuuuucuguaccaguacuuacaguagaagagaugacaaacucacgcuuuccaauaccguuagaaaaacuuuucacagguccuucuagcgccuucgucguacaaccacaaaacggaagauguacaacagacgguguauuauuaggcaccacacaauuaucaccuguaaacauaugcacauucagaggagacguaacacauauaacaggaucaagaaacuacacuaugaauuuagcaucacaaaauuggaacaacuaugauccaaccgaagaaauaccagccccauuaggaacaccagauuuugucggcaaaauacaaggaguccuaacacaaaccacaagaacagauggaaguacgagaggacacaaagcaacuguuuacacaggaagcgcagacuuugcuccaaaacuaggcagaguacaauucgaaaccgauacugacagagacuucgaagcuaaucaaaauacuaaauucacaccaguaggaguaauacaagacggaucaacaacacauagaaaugaaccacaacaauggguacuaccaaguuauucaggacgaaacacgcacaacguccaccucgcaccugcaguagcuccaacauuuccaggcgaacaauuacuauuuuuuagaucuaccaugccagguuguucagguuauccaaacauggauuuagacugccuauuaccccaagaaugggugcaauauuucuaucaagaagcugcaccagcucaaucugacguagcauuacuaagauuuguaaauccagacacuggaagaguucuuuuugaauguaaacuacacaaaucaggauaugucacaguugcucauacuggccaacacgaucuaguaauaccacccaacggcuauuuccgcuucgauucuuggguaaaucaguucuacacucuagcuccaaugggaaauggcaccggacgaagaagagccguauaa

SEQ ID NO: 32225 - RNA, 1623 nt, Artificial Sequence
  derived and/or modified sequence opt6 from VP1__Norovirus__BAU24855
augaaaauggcaucuaaugaugcaaauccuucagaugguucugcagccaaucucgucccagaaguaaacaacgaagucauggcacuagaaccaguaguuggagcagccaucgcagcaccagucgcaggacaacaaaauguaauagacccuuggauuagaaauaacuucguacaagcaccaggaggagaauucacaguaucaccaagaaaugcaccuggagaaauauuauggucagcaccacuaggaccagaccuaaacccauacuuaucccaucuugcacguauguauaacggcuacgcuggcggauuugaaguucaaguuauucuagcaggcaacgcauuuacagcuggaaaaauaaucuuugcagccguuccaccuaacuucccuacagaaggucucucaccaucucaaguaaccauguucccacauaucaucguagacguaagacaacuagaacccguacuaauaccucucccagauguucgaaauaauuucuaucauuacaaccaauccaacgacucaacaauaaaacuaauagcuaugcuauauacgccauuaagagcaaauaacgcaggagaagacguauucacagucucaugcagaguauuaacacgacccucacccgacuucgacuucaucuuccuaguaccaccuacuguugaaucucguacaaaaccauucacaguaccaauauuaacagucgaagaaaugacaaacaguagauuuccaauaccacucgaaaaauuauuuacagguccaucaucagcauucguaguacaaccacaaaauggacgaugcacaacagacggaguacuacuaggaacaacucaauuaucuccugucaacauauguaccuuuagaggagauguaacacacauagccggaucaagaaauuauacuaugaauuuagcaucccuaaacuggaauaacuacgauccaacugaagaaaucccagcaccucuuggaacaccagacuucguaggaaaaauacaaggcauguuaacacaaacaacaaagggagacggaucaacaagaggacauaaagcuacagucuauacagguucagcaccauuuacaccuaaauuaggaucuguccaauuugaaacagacaccgaaaacgauuuugaaacacaccaaaauacaaaauucacaccaguaggaguuauacaagauggaggaacaacacaucgaaaugaaccacaacaauggguucuaccaucuuacagcggucguaacguaccaaauguacaucuugccccagccguugcacccacauuuccaggagaacaacuauuauucuuuagaucaaucaugccagguugcuccggauaccccaauauggauuuagauuguuuacuaccucaagaauggguacaacauuucuaucaagaagcagcacccgcucaaucugauguagcauuauuaagauucgucaacccagacacaggaagaguccuauuugaauguaaacugcauaaaucaggauacguaacuguugcccauacaggacaacacgacuuaguaauacccccaaauggcuauuucagauucgauaguuggguuaaucaauuuuauacccuagcuccaaugggcaauggaacuggaagaagaagagcauuauaa

SEQ ID NO: 32226 - RNA, 1623 nt, Artificial Sequence
  derived and/or modified sequence opt6 from VP1__Norovirus__BAU24858
augaaaauggcaaguucagacgccaacccuucagauggaucugcagcaaaucuagucccagaaguaaauaaugaaguuauggcacuagaaccuguaguaggcgcugcaauugcagcucccguagccggacaacaaaaugucauagacccuuggauuagaaacaauuuuguacaagcuccaggcggugaauuuacuguuuccccacgaaaugccccaggagaaauauuauggucagcaccucucggaccagauuuaaauccauauuuaucacauuuagcacgaauguauaacggauaugcaggaggauuugaaguucaaguuauauuagcaggaaaugcuuucacugcuggaaaaguuauauuugcagcaguuccaccaaacuuuccuacugaaggacuuucaccaucacaaguaacaauguuuccacacauaguaguagauguaagacaacuagaaccaguauuaauuccacuaccagacgucagaaauaacuucuaccacuauaaucaaaguaaugauccuacaauaaaacuaauagcaauguuauauacuccacucagagcaaauaaugcaggugacgauguauucacaguuucauguagaguacuaacaagaccuucuccggacuuugacuuuauuuuucucguucccccaaccguugaaucacgaacuaaaccauucucuguaccuguauuaacaguagaagaaaugacaaacucuagauucccaauaccauuagaaaaacuauucacaggaccauccagugccuucguuguacaaccacaaaauggaagauguaccacugacggaguacuacuaggaacaacacaauuaucacccguaaauauuugcacuuuucgaggagacguaacccauauaacagguucucgcaacuacacaaugaaucuagcaucucaaaauuggucaaacuacgauccaacagaagaaauaccagcuccacuaggaacccccgauuucgucggaaaaauucaaggaguauuaacacaaaccacccgaacagauggaucuacaagaggacacaaagcaacuguauauacagguucagccgacuucgcacccaagcuaggacgcguccaauuugaaacagacacagaucacgauuuugaagcuaaucaaaauacaaaauucacaccuguuggaguuauccaagauggaucaacaacucacagaaacgaaccacaacaauggguauuaccaucauauucaggaagaaacaccccaaauguacaccuagcacccgcuguugcaccaacauuucccggagaacaacuauuauuuuuccgaucaacaaugcccggauguucuggauaucccaacauggauuuagauugucuauuaccacaagaauggguacaauacuucuaucaagaagcagcuccugcccaaucagauguugcuuuauuacgauuuguaaaucccgauacaggaagaguauuauuugaaugcaaauuacauaaaucuggcuacguaacaguugcucauacaggacaacaugauuuaguaauuccaccuaacggcuauuuccgauucgauuccugggucaaccaauuuuacacacuggcaccuaugggaaauggaaccggacgaagacgagcauuauaa

SEQ ID NO: 32227 - RNA, 1623 nt, Artificial Sequence
  derived and/or modified sequence opt6 from VP1__Norovirus__BAU24861
augaaaauggcaucuaaugaugcuaauccaucagacggaucagcugcaaaccuaguaccugaaguaaauaaugaaguuauggcccuagaaccuguagucggagcagcaauagcagccccaguagcaggucaacaaaacgucauagaccccuggauuagaaacaacuuuguacaagcacccggaggagaauuuacaguaagcccuagaaacgcaccaggugaaaucuuguggucagccccucuaggaccagaucuaaauccauaucuaucccauuuagcccgaauguacaacgguuacgcaggaggauucgaaguacagguaauauuagccggaaaugcauuuacagccggaaaaauaauauucgcugcuguaccuccuaauuuuccaacagaaggauuaucuccaucacaaguuaccauguuuccccauauaauaguagacguacgacaauuagaacccguacuuauaccacucccagaugucagaaauaauuuuuaucacuauaaucaaucaaaugacucuacaauaaaauuaauugcaaugcuauacacaccauuaagagcaaacaaugcaggagaagauguauucacuguaucauguagagucuuaacgagaccuucaccugacuucgauuuuauauuuuuaguaccuccuacaguagaaagcagaacaaaaccuuucacaguuccaauacuaacaguagaagaaaugacaaauucucguuuuccaauucccuuagaaaaacuauucacaggucccucaucagcuuucguaguacaaccacaaaauggccguuguaccacugauggaguccuucuaggaacuacucaacuaucaccaguuaacauauguaccuuucgaggagauguaacacauauagcgggaucucgaaauuacacgaugaaucuagcaucauuaaauuggaauaauuacgaucccaccgaagaaauaccagcuccuuuaggaacacccgauuuuguaggaaaaauacaaggaauguuaacccaaacaacaaaaggagacggaucuacaagaggacacaaagccacagucuacacaggaucagcaccuuucaccccaaagcucggauccguacaauucgaaacagacacagaaaacgauuucgaaacucaucaaaacacaaaauucaccccagucggaguaauacaggacgguggaacaacacaccgaaaugaaccucaacaauggguauuaccuucuuauucaggaagaaacgucccuaauguucaccuagcaccugcaguagccccaaccuucccaggagaacaacuacuauucuuuagaucaacaaugcccggauguucaggauauccaaauauggaucuagauugccuacuaccucaagaauggguacaacacuuuuaccaagaagccgcuccagcacaauccgacguagcacuucuuagguuuguaaauccagacaccggaagagucuuauuugaaugcaaacuacauaaaucaggauauguaacaguugcucacacuggacaacacgaucuaguuauaccuccuaauggauauuuccgauuugacuccugggucaaucaauuuuauacccuagcaccaaugggaaacggaacaggaagaagaagagcccucuaa

SEQ ID NO: 32228 - RNA, 1623 nt, Artificial Sequence
  derived and/or modified sequence opt6 from VP1__Norovirus__BAU24864
augaaaauggcauccuccgaugccaaccccucagauggauccgccgccaaccuaguaccagaagucaauaaugaaguaauggcacuagaaccaguaguaggcgcagcaauugcagcaccaguugcuggacaacagaauguaauugacccauggauacgaaacaauuuuguacaagccccaggaggagaauucaccguauccccacgaaaugcaccaggugaaauccuauggucagcaccuuuagggccagauuuaaaucccuaccuuagccaccuugcacguauguauaauggauacgcaggcggauuugaaguacaaguaauacuagcaggcaaugccuuuacagcuggcaaaguaaucuuugcugcaguaccacccaacuuuccaacugaaggacuuucacccucccaagucacaauguuuccacacauaguaguagacguaagacaauuagaaccaguuuuaaucccacuaccagauguccguaacaacuucuaucacuacaaucaaucaaaugacccuacaauaaaacucauugcaaugcuauacacaccuuuaagagcaaacaaugcaggagaugauguuuuuacagucucauguagaguuuuaacacguccaucaccugauuuugauuuuauauuucuaguaccaccaacagucgaaucucgaacaaaaccauucucaguuccuguacuuacaguagaagaaaugacuaacucaagauuuccaauaccacuugaaaaauuauuuacuggaccaucaucagccuuugucguacaaccacaaaacggaagauguacuacagacggaguccuuuuagguacaacccaauuaucacccguaaauaucuguacauuuagaggagaugucacacacauaacaggaucacgaaacuacacaaugaacuuagcaucacaaaauugguccaauuacgauccaacagaagaaauaccugcaccuuuaggaacaccagauuuuguaggaaaaauacaaggaguucuaacacaaacaacaagaacagacggauccacaagaggucauaaagcuaccgucuacacaggaucagcugauuucgcaccuaaauuaggaagaguacaauucgaaacagauacagaucgcgauuucgaagcaaaccaaaauaccaaauuuacuccaguaggaguuauccaagacggaucaacaacacauagaaacgaaccucaacaauggguacuaccuucuuacucaggacgaaacacuccaaauguacacuuagcaccagcaguugcaccaacauuuccaggagaacaauuauuauucuuuagaucaacuaugcccggauguagcggauauccaaauauggaucuugauugcuuacuaccacaagaauggguacaauauuuuuaccaagaagcagccccagcacaaucugaugucgcacuucuaagauucguaaaucccgauacuggaagaguucuauucgaaugcaaacuacauaaaucuggauacguaacagucgcccacacaggacaacacgaccuaguaaucccaccaaaugguuauuuuagauucgacuccugggucaaucaauuuuacacuuuagcaccaaugggaaauggcacuggccgacgaagagcacucuaa

SEQ ID NO: 32229 - RNA, 1623 nt, Artificial Sequence
  derived and/or modified sequence opt6 from VP1__Norovirus__BAU24867
augaaaauggcaucuucagaugcaaacccaacagauggaucagcugcuaaccuuguacccgaaguaaauaacgaaguaauggcauuagaacccguaguaggagcagcaaucgccgcaccaguagcaggacaacaaaacgucauagacccauggauuagaaauaauuuuguacaagcaccaggaggcgaauucaccguaucaccgcgaaaugcccccggagaaauacuauggucugccccacuaggaccagaucucaauccuuaucuaagucacuuagcaagaauguauaacgguuaugcaggcggauucgaaguacaaguaauacuagcuggaaaugcauuuacagcaggaaaaguaauauuugcagcugucccaccuaauuucccaacagaagguuuaucaccaucacaaguaacaauguucccucauauugucguagacgucagacaacuagaaccaguauuaauaccacucccugauguaagaaauaauuuuuaucauuacaaucaauccaaugacccaaccauaaaauuaauagcaaugcucuauaccccauuacgagcuaacaaugcaggagaugauguuuuuacaguaaguugcagaguacuaacaagaccuucgccagauuucgacuuuaucuuccuaguuccaccaacaguugaauccagaacaaaaccauuuucaguuccaguacuaacaguagaggaaaugacuaauaguagguuuccaauaccauuagaaaaauuauucacaggaccaucaucagcauuuguaguccaaccacaaaacggaagauguacaacagacggaguauuacugggaacaacacaacuaucaccagucaauaucuguaccuuucgaggugauguaacacauauuacaggaucuagaaauuauacaaugaaccuagcaucacaaaacuggaguaauuaugauccaacagaagaaauucccgccccacuaggaacaccugauuucguaggaaaaauucaagguguacucacacaaacaacacgaacugacggaucaacuagaggacacaaagcaacaguauacacaggaagugcugacuuugcaccuaaacuaggacgaguacaauuugaaacagauacugaucacgauuuugaagcaaaucaaaauaccaaauucacuccagucggaguuauccaagacgguaguacaacacauagaaaugaaccacaacaauggguucuaccaucauauucaggcagaaauacaccaaacguacaucuagccccagcaguagcaccaacauuuccaggugaacaauuacuauuuuuuagauccacuaugcccggcugcuccggauauccaaauauggacuuagauuguuuauuaccacaagaauggguacaguacuucuaucaagaagcagcuccagcacaaucagauguagcacuuuugcgcuucguaaacccagacacaggaagaguacuuuuugaauguaaacuucauaaaucuggauauguuacaguagcacacacaggacaacaugaucuaguaauaccacccaacggauauuucagauuugauucuuggguuaaucaauuuuacacacuagccccaaugggaaauggaaccggucgaagaagagcccuauaa

SEQ ID NO: 32230 - RNA, 1623 nt, Artificial Sequence
  derived and/or modified sequence opt6 from VP1__Norovirus__BAU24870
augaaaauggcuaguucugaugcaaacccaucagaugguucagcagcuaaccuaguaccagaaguaaacaaugaaguaauggcucuagaaccagucgucggugcagcuauugccgccccuguugcaggucaacaaaacguaaucgacccauggauaagaaauaauuuuguacaagcaccuggaggugaauuuaccguaucaccacgaaaugcaccaggagaaauccuguggucagcaccacuaggucccgauuuaaaccccuaucuaucucaccuugcaagaauguacaauggauacgcuggaggauuugaaguacaaguaauuuuggcuggaaaugccuuuaccgcuggaaaagucauauucgcagccguaccaccuaacuuuccaacagaaggauuaucacccucucaagucacaauguucccacauauaguaguggacguuagacaacuugaacccguauuaauaccauuaccagauguacgaaacaauuuuuaccacuauaaucaaucaaaugauccaacaaucaaauuaaucgcuauguuauauacuccauuaagagcaaauaaugcaggcgaugauguauuuaccguuagcugcagaguacuaacaagaccaucaccugacuuugauuuuauauuucuaguuccaccaacaguagaaucaagaacaaaaccauuuucaguaccaguauuaaccguugaagaaaugacaaacuccagauuuccaauuccucuugaaaaauuauucacuggaccaucauccgcauucgugguacaaccacaaaacgguagauguaccacugauggaguauuauuaggaacuacacaacuaucacccguaaauauauguacauuucgaggagacguaacucacauaacaggaucacgaaauuacaccaugaauuuagcuucccaaaauugguccaacuacgauccaacugaagaaauaccagcaccuuuaggcacaccagauuucguaggaaaaauucaaggcguacuaacacaaacaaccagaacagacggcucaacaagaggacacaaagcaacaguauauacaggaucagcagacuuugcaccaaaauuaggcagaguucaauucgaaaccgacaccgaucacgacuucgaagcuaaccaaaauaccaaauuuacaccaguaggaguaauacaagauggcuccacaacccacagaaaugaaccacaacaauggguacuaccaucauacucuggaagaaauacaccaaacguacaucuagcaccugccguagcaccuacuuuuccaggcgaacaauuacuauucuuuagaagcaccaugccaggcugcucaggauaucccaauauggaucuagauuguuuacuaccacaagaauggguucaauauuucuaucaagaagcagcacccgcucaaagugacguagcacuuuuacgauuuguuaacccugauacagguagaguauuauuugaaugcaaacuacacaaaucaggauacguaacaguagcucacacaggucaacacgaccuaguaauaccacccaaugguuauuuccgauucgauucauggguaaaucaauuuuacacauuagcuccgaugggaaacgguacaggaagaagaagagcauuauaa

SEQ ID NO: 32231 - RNA, 1623 nt, Artificial Sequence
  derived and/or modified sequence opt6 from VP1__Norovirus__BAU24873
augaaaauggccucaagcgaugcuaacccuucagauggaucugcagccaaccuuguaccugaaguaaacaacgaaguaauggcacucgaaccaguaguaggugcagcuauagcagcaccaguagcaggacaacaaaauguaaucgauccauggauuagaaauaacuucguacaagccccaggaggagaauuuacuguauccccacgaaaugcaccaggagaaauacuauggucugcacccuuaggaccagaccuaaaccccuaccuaucacaucuagcaaggauguacaauggauacgccgguggauuugaaguacaaguaauuuuagccggaaacgcauuuacugcagguaaaguaauauucgcagcaguaccaccuaacuucccaacagaaggauuaucacccucacaaguuacaauguucccacauauaguaguagacguucgacaacucgaacccguacuaauaccacuaccugacguccgcaacaauuuuuaccacuauaaccaaaguaaugauccuacuauaaaacucauagcaauguuauauacacccuuaagagcuaauaaugcgggagacgauguuuuuacaguaucaugccguguacuaacacgcccaucuccagacuucgacuuuauauuuuuaguuccaccuacugucgaaucaagaacuaaaccauucucaguaccaguguuaacaguagaagaaaugaccaauucaagauuuccaauaccauuagaaaaauuauuuacaggaccaucaucagcuuuuguuguacaaccacaaaauggaagaugcacuacagauggugucuuauuaggaacuacacaauuaucucccgucaauauauguacauuucgaggagauguaacacacauaacaggaucaagaaauuauacaaugaauuuagcaucccaaaauuggucuaacuaugauccaaccgaagaaauaccagcuccucucggcacaccagacuuuguuggaaaaauucaagguguucuuacccaaacaacacguacugacggaucaacaagaggacauaaagcuacaguauacacuggaagugcagacuuugcucccaaacuaggacgaguacaauuugaaacagacacagaccgagauuuugaagcaaaucaaaauacaaaguucacaccaguuggcgucauacaagacgguucaaccacacauagaaacgaaccccaacaauggguauuaccaucuuauucuggucgaaauacaccaaacguacaccuagcaccagcaguugccccuacauuuccuggagaacaguuacuuuucuucagaucaacuaugccuggauguucuggcuauccaaauauggauuuagacugcuuauuaccccaagaauggguacaauauuuuuaucaagaagcagcuccugcacaauccgauguagcacuacuaagauuuguuaaccccgacacaggucguguauuauucgaaugcaaauuacauaaaucaggauauguaacaguagcacacacaggacaacaugaucuuguuauaccaccaaauggauauuuuagauuugauucaugggucaaucaauuuuauacacuagcaccaaugggaaauggaacaggucgaagaagagcauuauaa

SEQ ID NO: 32232 - RNA, 1623 nt, Artificial Sequence
  derived and/or modified sequence opt6 from VP1__Norovirus__BAU24876
augaaaauggcaucaagugacgcaaauccaagugacggaucagcugcaaacuuaguuccugaaguaaacaaugaaguaauggcuuuagaaccaguaguaggagcagcuauagcagcaccaguagcuggucaacaaaacgucauagacccauggauuagaaauaauuuuguacaagcucccggaggagaauuuaccgucucaccacgaaaugcuccaggcgaaauacuuuggucagcaccuuuaggaccagaucuaaaucccuaucuaucucauuuggcaagaauguacaacgguuacgccggaggauucgaaguccaaguuauuuuagcuggaaacgcauucacagcaggaaaaguaaucuuugcagcuguuccacccaacuuucccacagaaggauuaucaccaucacaaguuacaauguucccacauauaguuguagacguaagacaauuagaaccuguccuaauucccuuaccagacguaagaaauaauuuuuaucacuacaaccaaucaaacgauccaaccauuaaauuaauugcuaugcuauauaccccacucagagccaacaacgcaggugaugauguauuuacaguaucaugucgaguauuaacuagaccaucaccagacuuugauuucauauuucuuguaccuccaacaguugaaagccgaacaaaaccauuuucaguaccaguacuaacaguugaagaaaugacaaacucucgauuuccaauaccauuagaaaaauuauuuacaggaccaucaagugcauuuguaguacagccccaaaacggaagauguacaaccgauggaguauuauuagguacaacucaauuaagcccagucaauauauguaccuuucgaggagacguaacucauauaacaggauccagaaauuacacaaugaaucuagcaucccaaaauuggaguaacuacgauccaacagaagaaauaccagcaccacuaggcacuccagacuuuguaggaaaaauucaaggaguauuaacacaaacaaccagaacagacggauccacuagaggucacaaagccacaguauauacugguucagcugauuucgcaccaaaacuuggccgugugcaauucgaaaccgacacagaucgcgauuuugaagcaaaucaaaauacaaaauucacucccguagguguaauacaagacggcaguacuacacacagaaaugaaccacaacaauggguacuaccaucauauucuggaagaaauaccccaaauguucaucuugcaccugcaguagcaccuaccuuucccggugaacaauuauuauuuuuuagaucaacaaugccaggaugcucagguuaucccaauauggaucuagacugcuuauuaccacaagaauggguccaauauuuuuaucaagaagcagcaccugcacaaucagacguugcauuacucagauucguaaacccagacaccggacgaguuuuauucgaauguaaacuccauaaaucaggauauguuacuguagcacacaccggacaacaugacuuaguuauaccuccaaauggauauuuccgauucgauaguuggguuaaccaauuuuacacacuagcaccaaugggaaaugguacaggucguagacgcgcauuauaa

SEQ ID NO: 32233 - RNA, 1623 nt, Artificial Sequence
  derived and/or modified sequence opt6 from VP1__Norovirus__BAU24879
augaaaauggcaucaucagaugcaaauccaucagauggaagugcagcaaauuuaguaccagaagucaauaacgaaguaauggcucuagaaccaguaguaggugcugcaauagcagcaccaguagcuggccaacaaaauguaauagacccauggauaagaaauaacuuuguacaagcaccaggaggugaauuuacaguaucaccaagaaacgcuccaggagaaauauuauggucagcaccuuuaggaccagauuuaaauccauaccuaucucaccuagcccguauguauaauggcuacgcagguggguucgaaguccaaguaauacuagccggcaaugcauuuacagcaggaaaagucauauuugcugcaguaccuccaaacuuucccaccgaaggccucucaccaucacaaguaacaauguucccacacauaguaguugacguuagacaauuagaaccaguacuaaucccacuacccgauguaagaaauaauuucuaccauuauaaucaaucaaaugauccuacaauaaaauuaauagcaaugcuuuacacuccucuaagagcaaacaacgccggugaugauguuuucaccguaucauguagaguucuuacacgaccaaguccugauuuugacuuuauauuuuuaguaccaccaacaguugaauccagaacaaaaccuuucuccguaccuguccuaacugucgaagaaaugacuaauucacgauuucccauaccguuagaaaaacuauucacaggaccaucuucagcauuuguaguucaaccacaaaauggaagauguacaacagacggaguccuacuagguacaacacaacuaucuccuguaaacauauguacauuuagaggagacgucacacauauaacaggaucaaggaauuacacaaugaaccuagcaucacaaaacugguccaauuacgauccaaccgaagagauaccugcaccacuaggaacaccagacuuuguagguaaaauucaaggaguccucacucaaacaacaagaacugauggcucaacaagaggccacaaagccacuguauauacaggauccgcagacuuugccccaaaauuaggacgcguacaauucgaaacagauacugauagagacuucgaagcaaaucaaaacacaaaauuuacaccaguaggcguuauacaagacggcucaaccacacaccgaaaugaaccacaacaauggguuuuaccuucuuacuccggaagaaacacaccaaauguucaccuagcuccugcuguugcaccaacauuucccggugaacaauuauuauucuuccgaucaacaaugccaggaugcucugguuauccaaauauggaucuagauugccuauuaccucaagaauggguacaauauuuuuaucaagaagcagcucccgcucaauccgauguugcuuuauuacguuuuguuaacccugacaccggaaggguuuuauuugaaugcaaauuacauaaaucaggauacguaacaguagcacacacaggacaacacgauuuagucauaccucccaauggauauuuucgauucgauucauggguuaaccaauucuacacuuuagcacccaugggaaaugguaccggcagaagacgcgcucuuuaa

SEQ ID NO: 32234 - RNA, 1623 nt, Artificial Sequence
  derived and/or modified sequence opt6 from VP1__Norovirus__BAU24882
augaaaauggcaagcucugaugccaacccuucagauggauccgcugcuaauuuaguuccagaaguaaauaacgaaguaauggcucuagaaccuguuguaggugccgcaauugcagcaccaguagccggacaacaaaauguaauagauccauggauaagaaauaauuuuguccaagcuccugguggugaauucaccguauccccacgaaacgcacccggugaaauauuauggucagcaccauuaggaccugaccuaaauccauaucucagccauuuagcaagaauguauaauggcuaugcugguggcuucgaaguacaaguaauauuagcaggaaaugcuuuuacagcaggaaaaguaaucuucgccgcaguacccccaaacuuuccaacagaaggauuauccccuucacaaguaacaauguuuccacacauaguaguagacguaagacaauuagaaccaguauuaauaccuuuaccagauguacguaacaauuuuuaucacuauaaucaauccaacgauccaacaauaaaauuaauagcaauguuauacacaccacuaagagcaaacaaugcaggcgacgacguuuuuacaguaagcugucgaguacuaacucgaccaucaccagauuuugacuuuauuuuucuaguaccaccuacaguugaaucaagaacaaaaccauuuucaguacccguacuaacuguugaagaaaugacaaacucacgcuuuccaauaccucuagaaaaacuauuuacggguccaucuucagcauucguaguacaaccacaaaacggaagauguacaacagaugguguauuauuaggaacaacacaauuaucaccaguuaauauauguacuuuuagaggugacguaacacauauuacaggauccagaaauuacacaaugaaucuagcaucacaaaauuggaauaacuacgauccgacagaagaaauaccagcuccauuagguaccccugacuucgucggaaaaauucaaggaguacucacacaaacaacaagaacagacggcucaacaagaggacacaaagcaacaguuuauacagguucagcagacuuugcaccaaaacuaggucgaguccaauuugaaacagauaccgaucacgauuucgaaacaaaccaaaauacuaaauucacuccuguaggagucauucaagacggaggaacaacacauagaaaugaaccucaacaauggguacuacccucuuacagcggacgaaauacaccuaacguccacuuagcacccgccgucgcuccuaccuucccaggagaacaauuauuauucuuucgaaguacaaugccuggauguucaggcuaccccaauauggaccuagauuguuuguuaccacaagaauggguacaauacuuuuaucaagaagcagcacccgcccaaucugacguagcauuauuacgauuuguaaaccccgacacaggaagagucuuauuugaauguaaacuacauaaaucuggauacguaaccguagcucauacaggacaacacgacuuagucauaccacccaacggauacuuccgauuugauuccuggguaaaccaauuuuacacacuagcuccaaugggaaauggaaccggucgcagacgagcauuauaa

SEQ ID NO: 32235 - RNA, 1623 nt, Artificial Sequence
  derived and/or modified sequence opt6 from VP1__Norovirus__BAU24885
augaaaauggcaucuucugacgcgaauccauccgauggauccgcagcuaaccucguacccgaaguaaauaaugaaguaauggcuuuagaaccaguaguuggcgccgcaauagcugcuccugucgcuggacaacaaaauguaaucgauccauggauaagaaauaauuucguccaagcacccggcggagaauuuacuguuucacccagaaacgcucccggagaaauacuauggagugcuccacuagguccagacuuaaauccauauuuaucucaucuugcaagaauguacaauggauaugcagguggcuuugaaguacaaguuauacuagccgguaacgccuucacagcaggaaaaguaauauuugcugcaguaccuccaaauuuuccaacugaaggucuaucuccaucucaaguaacaauguucccacacaucguaguagauguaagacaauuagaaccaguuuuaauaccauuacccgauguacguaauaauuucuaccacuauaaucaaucaaaugacccuacaauaaaauuaauugcaaugcuauacacaccuuuaagagcaaauaaugcaggagacgauguauuuacugucucaugccgaguacuaacuagaccuucaccugauuuugauuucauauuccuaguacccccaacaguagaaucaagaacaaaaccuuuuaguguuccaguacuaacaguagaagaaaugacaaauucacgcuuuccaaucccuuuagaaaaauuauucacaggaccuucaagcgcauuuguaguacaaccucaaaacggacgauguacaacagacgguguauuacuuggaacuacacaauuauccccaguaaauauaugcacauuuagaggagauguaacacauauaacuggaucuagaaauuacacaaugaaucuagcaucccaaaauuggaauaacuacgacccaacugaagaaaucccagcaccauuaggaaccccagacuucguaggaaaaauucaaggaguauuaacacaaacaacaagaacagacggaucuacuagaggacauaaagccacaguauauacagguuccgcagacuuugcacccaaauuaggccgaguacaauuugaaacagauacagaccacgauuucgaagcaaaccaaaauacaaaauuuacaccaguuggaguaauacaagacgguggcacuacacacagaaacgaaccacaacaauggguacuaccaucauacucaggaagagacacacauaacguucaccuagccccagcaguagcuccuaccuuuccaggagaacagcuacuuuucuuuagaucaacuaugccaggaugcucaggauauccuaacauggaucucgacugccuacuaccacaagaauggguucaauauuucuaccaggaagcagcaccugcucaaucagacgucgcacuauuaagauuuguuaauccagauaccggacgaguauuauuugaauguaaauuacauaaaucaggauauguaacaguagcacauacaggacaacaugaucuaguuauaccuccaaaugguuauuucagauuugauucauggguaaaucaauuuuacacauuagcaccuaugggaaacgguacaggaagaagaagagccgucuaa

SEQ ID NO: 32236 - RNA, 1623 nt, Artificial Sequence
  derived and/or modified sequence opt6 from VP1__Norovirus__BAU24888
augaaaauggcaucaucagacgcuaauccaucugauggaucugccgcuaaccuaguacccgaaguaaauaacgaaguuauggcuuuagaaccaguugucggcgcugcaauugcagcacccguagcaggccagcaaaacguaauagaccccuggauacguaacaauuucguucaagcaccugguggugaauuuacagucuccccacgaaacgcucccggagaaauacuauggucagcaccucuuggaccugaucuuaauccauaucuuucccaucuagccagaauguauaauggauaugcuggcgguuuugaaguucaaguaauacuagcaggaaaugcauucacugcaggcaaaguaauuuuugcagcuguaccacccaauuucccaacugaagguuuaucaccaucacaaguuacuauguuuccacauauaguagucgacguaagacaauuagaaccaguacuaauaccacuuccagacguaagaaacaauuuuuaccacuacaaucaaucaaaugacccaaccaucaaacuaauagcuaugcuuuacacaccauuaagagcaaauaaugcaggagaugauguauucacaguauccuguagaguacuuacacgaccaucaccagauuuugacuucaucuuuuuaguuccaccaacaguugaaucacgaaccaaaccauucucaguaccaguccuaacaguagaagaaaugacuaauucaagguucccaaucccauuagaaaaauuauuuacaggaccaaguucagccuuuguaguacaaccacaaaacggacgcuguacuacagauggaguacuccuaggaacaacccaguuaucuccaguaaauauauguacauuuagaggagauguuacacauauaacaggaucaagaaauuacacaaugaacuuagccucccaaaauuggucaaacuaugauccuacugaagaaauacccgcaccauuaggaacuccagacuuuguagguaaaauccaagguguuuuaacccaaacaaccagaaccgauggaucuacuagaggacauaaagcuacaguauauacaggaagugcagacuuugcgccaaaauuaggacgaguccaauuugaaacagauacagaucgugacuucgaagcaaaucaaaacacaaaauuuacacccguuggaguuauacaagauggauccaccacucauagaaaugaaccacaacaauggguauuaccauccuacucaggcagaaauacaccaaacguacaucuugcaccagcaguugcaccaacauuuccaggagaacaauuacuauuuuuccgaucaacaaugcccggcuguuccggcuaucccaauauggacuuggauugcuuauuaccacaagaauggguucaguacuucuaccaagaagcagcuccagcacaaagcgacguagcucuacuacgauuuguaaauccagauacuggccgaguacuauucgaguguaaauuacacaaaagcggauauguaacuguagcacacacuggacaacaugacuuaguuauaccaccaaauggcuauuucagauucgauuccuggguuaaucaauuuuacacauuagccccuaugggaaauggaacaggaagaagaagagcacuauaa

SEQ ID NO: 32237 - RNA, 1623 nt, Artificial Sequence
  derived and/or modified sequence opt6 from VP1__Norovirus__BAU24891
augaaaauggcauccaaugaugcuaacccaucagauggauccgcagcaaaucuaguaccugaaguuaacaaugaaguuauggcacuagaacccguaguuggagcagcaaucgcugcacccguugcuggccaacaaaauguaauugauccauggauacgaaauaacuucguacaagcaccagguggagaauucacaguuucaccuagaaaugcaccaggagaaauuuuauggucagcaccacuagguccagauuuaaacccuuauuuaucccauuuagcuagaauguauaacggcuaugcaggaggauuugaaguucaagucauucuagcaggaaacgcauuuacugcaggaaaaauaauauuugcagcaguuccuccaaacuucccaacagaaggacuaucacccucacaaguaacuauguucccucauauaaucguugacguaagacaauuagaaccaguacuaauaccacuaccagacguaagaaacaauuucuaucacuacaaucaaucaaaugacucaacuauaaaauuaauagccauguuauauacuccgcuaagagcuaacaaugcaggugaagauguauuuacuguuuccuguagaguauuaacaagaccaucuccagauuuugauuuuaucuuucuaguaccaccuaccguagaaucaagaacaaaacccuuuacuguuccuauauuaacaguagaagaaaugacaaacucaagauucccaauuccacucgaaaaacuuuuuacaggaccaucuucagcuuucguuguacaaccacaaaauggaagauguacaacugauggaguccuuuuaggaacaacucaauuaucaccaguaaauauauguacauuuagaggagacguaacccauauagccggaucacguaauuacacaaugaaccucgcaagcuuaaauuggaacaacuacgauccuacugaagaaaucccagcaccucucggaacaccugacuuuguaggaaaaauacaagguauguuaacacaaacaacaaagggcgaugguucaacaagaggacacaaagccacuguauacacaggcucugcaccauuuaccccaaaacuaggaucuguacaauucgcaaccgauacugaaaacgauuuugaaacucaucaaaacacaaaauucacuccaguuggcguuauacaagacggaggcacaacacauagaaacgaaccacaacaauggguauuaccaucauauucaggaagaaacguaccaaauguccacuuagccccagcaguugcaccaacauuucccggagaacaauuauuauucuuuagaucaacuaugcccgguugcucuggauaucccaacauggaucuagacugcuuacuuccucaagaauggguucaacauuuuuaucaagaagcugcacccgcacaaucagauguagccuuauuaagauucguaaauccagacacaggaagaguccucuuugaaugcaaauuacacaaaagugguuauguaacaguagcucauaccggacaacaugaucuuguaauaccaccaaacggcuauuuccgauucgacucauggguaaaucaauucuauacauuagcuccuaugggaaaugggacagguagaagacgagcauuauaa

SEQ ID NO: 32238 - RNA, 1623 nt, Artificial Sequence
  derived and/or modified sequence opt6 from VP1__Norovirus__BAU24894
augaaaauggccucaucugaugccaauccaagcgauggaucugccgcaaacuuagugccugaaguaaacaacgaaguaauggcacucgaacccgucguaggugccgcaauagcagcucccguagcaggccaacaaaauguaauagacccguggauaagaaauaauuuuguacaagcacccgguggcgaauucacaguaucacccagaaaugcuccuggagaaauacucuggucagcaccauuagguccugauuuaaauccauaccuaagucacuuagcccgaauguauaauggauacgcaggaggauucgaaguacaagucauucuagcaggaaaugccuuuacagcaggaaaaguaaucuuugcagcaguaccaccuaacuuuccaacagaaggacuaucaccaucacaaguaacaauguuuccacacauaguaguugacgucagacaauuagaaccaguauuaauuccacuacccgauguaagaaacaauuuuuaucauuauaaucaaucaaaugauccaacaauaaaauuaauagcaauguuauacacacccuuaagagccaauaacgccggagacgacguauuuacaguuucuugucggguacuaacaagaccaucaccagauuucgacuucauauuccuaguaccaccaaccguagaaucaagaacuaagccauuuucaguaccaguacuuacugucgaagaaaugaccaauucaagauucccaauuccacuugaaaaauuauuuacagguccauccucggcauucguaguacaaccacaaaacggacgauguacaacagacggaguacuacuagguacaacacaauuaucaccaguuaauauauguacauuuagaggagacguaacacacauuacugguuccagaaauuauacaaugaauuuagcaucacaaaauugguccaacuaugaucccacagaagaaauaccagcaccacuagguacaccagacuuuguaggaaaaauacaaggaguucuaacacaaacuacaagaacugacgguucuacacgcggucacaaagcaacaguauauacagguuccgcagacuuugcaccuaaauuaggaagaguucaauuugaaacagacacugaucacgauuucgaagcaaaucaaaauacaaaauucacaccaguaggaguaauccaagacggaaguacuacacaucgaaacgaaccucaacaauggguauuaccaagcuauucuggaagaaauacacccaauguacauuuagccccagcgguagcgccaacauuuccaggagaacaacuacuauuuuuucguucaacuaugccaggaugcucaggauacccaaauauggacuuagauugcuuacuaccacaagaauggguucaauauuuuuaccaagaagcagcaccagcucaaucagacguagcauuacuacgauuugucaauccagacacaggaagaguauuauucgaauguaaacuacauaaaagcggauauguaaccguagcacauacuggucaacacgaucuaguaauaccuccaaauggauauuuucgauucgacucauggguaaaucaauuuuacacucuagccccaaugggaaauggaacaggaaggcgaagagcacuauaa

SEQ ID NO: 32239 - RNA, 1623 nt, Artificial Sequence
  derived and/or modified sequence opt6 from VP1__Norovirus__BAU24897
augaaaauggccucuuccgaugcaaacccaucagauggaucagccgcaaacuuaguuccagaaguaaacaacgaagucauggcccuugaaccaguaguaggcgcugcuauagcagccccuguagcaggacaacaaaaugucauagaccccuggaucagaaauaauuuuguacaagcuccaggaggagaauucacaguuucuccaagaaaugcuccaggagaaauuuuaugguccgcccccuuagguccagauuuaaauccauaccuuucccacuuagcaagaauguauaauggauaugcuggaggauucgaaguacaaguaauacuagcagguaaugcauuuacugccggcaaaguaaucuuugccgcaguaccucccaacuuuccuacugagggauuaucaccaucacaagucacuauguuuccccacauagucguagacgugaggcaacuagaacccguacuaauaccacuaccagauguaagaaauaacuucuaucacuauaaccaaucaaaugacccaacuauuaaacuuauagcaaugcuauacacaccauuaagagcaaauaaugccggugacgauguauucacugucuccuguagaguacugacuagaccauccccagacuucgacuucauauuucucguaccgccuacaguagaaucaagaacuaaaccuuuuucuguaccaguacuaacagucgaagaaaugaccaacucaagauuuccuauaccacuggaaaaacuauucacaggaccaucaucagcauuuguaguacaaccacaaaacggaagauguacaacagacggaguauuacucgggacaacacaauuaucaccuguaaauaucugcacauucagaggagacguaacccacauaaccggaucucgaaauuauacuaugaaucuagcaucacaaaauuggucgaauuacgauccuacagaagaaauaccagcaccacuaggaacacccgacuuuguaggaaaaauucaaggaguuuuaacacaaaccaccagaaccgacggauccacucgaggacauaaagcaacuguuuauacuggaucagcagauuucguuccaaaacuaggacgaguacaauuugaaacagauacagaccacgauuuugaagcaaaucaaaauacaaaauuuaccccaguaggaguuauacaagacggcucaacaacacacagaaaugaaccacaacaauggguacuaccaucuuacucuggaagaaauacaccaaacguacaccucgcuccagccguagccccaacuuucccaggagaacaacuauuauuuuuuagaucuaccaugcccgguugcucuggauacccaaacauggauuuagacuguuuauuaccacaagaauggguucaauauuucuaucaagaagcagcaccagcucaaucagaugucgcauuauuacgauucguaaauccugauacaggaagaguauuauucgaaugcaaacuccacaaaucaggauaugucaccguagcacauacaggacaacaugauuuagucauaccaccaaauggcuauuucagauuugauucauggguaaaucaauucuacacacuagcuccuauggguaaugguaccggacgaagaagagcacuuuaa

SEQ ID NO: 32240 - RNA, 1623 nt, Artificial Sequence
  derived and/or modified sequence opt6 from VP1__Norovirus__BAU24900
augaaaauggccucuucagaugcaaacccaagcgaugggucugcagcaaaucuuguaccagaaguaaauaacgaaguaauggcauuagaaccaguaguaggcgcagcuauagcagcuccaguagcuggacaacaaaacguuauagacccauggauuagaaauaacuuuguacaagcaccuggaggugaauucacaguauccccaagaaacgcacccggagaaauauuauggucagcaccauuaggaccagauuuaaaucccuauuuaucccaccuagccaggauguacaacggcuacgcaggaggauuugaaguacaaguaauacuugcuggaaaugcauuuacagcaggaaaaguaauuuuugccgcuguaccccccaauuuucccacugaaggacuaucucccucucaaguaacaauguuuccacacauaguaguagauguaagacaauuagaaccaguacuuauaccauuaccagacguacgaaacaacuucuaucacuauaaucaaaguaaugacccaacuauaaaauuaauagcuaugcuuuauacuccauuaagagcaaauaacgcaggcgaugauguauucacaguaucauguagaguacuaacaagaccaagcccagauuuugacuucauauuucuuguaccaccaacaguugagucaagaacaaaaccauucuccguaccuguauuaacagucgaagaaaugacaaauucuagauuuccaaucccauuagaaaaauuauuuaccgguccaucaagugcauucguaguacaaccacaaaacggaagauguacaacagacggcguauuauuaggcacaacacaauuaucaccaguaaacaucuguacauuuagaggagaugucacacauauaacagguuccagaaauuauacaaugaaucuagcaucacaaaacugguccaauuacgauccaacugaagaaaucccagcaccucuaggaacaccagacuuugucggaaaaauacaaggcguuuuaacacaaacaacaagaacagacggaaguacucgaggacauaaagcaacaguauauaccggauccgcagauuuugcaccuaaacuaggaagaguacaauucgaaacagauacagaccgagauuuugaagccaaccaaaacaccaaauucacuccaguaggcguuauucaagacggauccacaacacaucgcaaugaaccacaacaauggguacuaccuucauacuccggccgcaauacaccaaauguacaccuagccccagcaguagcuccuaccuuuccaggugaacaacuacuauuuuuucgcucuaccaugccuggauguucaggauacccaaauauggacuuagauuguuuauuaccacaggaauggguacaauauuuuuaccaagaagcagcuccagcacaaucugauguagcauuacuaagauucguaaauccugauacaggacgcguuuuauucgaaugcaaauuacacaaaucaggauauguuaccguagcacauacaggccaacacgacuuaguuauaccaccaaauggauauuuuagauucgauucuuggguaaaucaauuuuauacucuagcaccaaugggaaauggaacuggccgcagacgcgcauuguaa

SEQ ID NO: 32241 - RNA, 1623 nt, Artificial Sequence
  derived and/or modified sequence opt6 from VP1__Norovirus__BAU24903
augaaaauggcuucaucagacgcaaauccaucagauggaucagcugcaaaccuuguaccagaaguuaacaacgaaguuauggccuuagaaccaguuguaggagcagcaauagcagccccaguagcaggacaacaaaauguaauugaucccuggauaagaaacaacuucguucaagcaccaggaggugaauucacagucucaccucgaaaugcuccuggagaaauacucuggucagcaccucuaggaccagaucuaaauccauaucuaucacacuuagcaagaauguauaacggauaugcaggagguuucgaaguacaaguaauacuagcaggaaaugcauuuaccgcaggaaaaguaauuuucgcugccguaccuccaaauuuuccaacugaaggucuuucaccaucacaaguaaccauguucccucacauuguaguagauguaagacaauuagaaccuguccucauaccauuaccagauguaagaaacaacuuuuaccacuauaaccaaucaaacgauccuacaauaaaauuaauagcaauguuauauacaccauuaagagcuaauaaugcaggagacgauguauuuacuguuucaugcagaguucuaacaagaccaucuccagacuucgauuucauauuccuaguuccaccaacagucgaaagcagaacaaaaccauucucagucccuguacuaacuguggaagaaaugacaaacagcagauucccaauaccacuugaaaaacuauuuacaggacccucaucagccuuugucguacaaccacaaaacggaagaugcacuaccgacggaguauuauuaggaacaacacaauuauccccaguaaauaucugcacuuucagaggagacguaacacauaucacuggauccagaaacuauacaaugaacuuagcaagucaaaacuggagcaauuacgauccaacagaagaaauaccagcaccucuagguaccccagauuucguaggaaaaauacaagguguacuaacucaaacuacaagaacagacggaucaacucgaggacacaaagcuacuguauacacaggaucagcagacuuugcuccuaaacuaggaagaguucaauucgaaacugacaccgaccgcgauuuugaagcaaaucaaaauaccaaauuuacaccaguaggaguaauacaagauggcucuacgacucauagaaaugaaccacaacaauggguucuaccuucauacucaggccgcaauacacccaauguacaucuagccccugcaguagcccccacauuuccaggagaacaacuuuuauucuucagaucuacaaugccagguugcucaggauacccaaauauggaccuagauugccuacuaccacaagaauggguccaauauuucuaucaagaagcagcaccagcacaaucagacguagcacuauuaagauucguuaaccccgacacaggaagaguacuauucgaauguaaauuacauaaauccggcuauguaacuguagcucacaccggccaacaugaccuaguaauaccucccaauggauacuucagauucgacucaugggucaaucaauuuuauacacucgcuccaaugggaaauggaacaggucgccgaagagcauuauaa

SEQ ID NO: 32242 - RNA, 1623 nt, Artificial Sequence
  derived and/or modified sequence opt6 from VP1__Norovirus__BAU24906
augaaaauggcuucauccgacgcaaacccaucagauggaucagcugcuaaccuaguaccagaaguaaauaacgaaguaauggcauuagaaccuguaguaggugcagcaauagcagcuccaguagcuggacaacaaaauguaauugaccccuggauaagaaauaacuuuguacaagcaccaggaggagaauuuacagugucacccagaaaugcaccuggugaaauacuauggucagcaccacuaggaccagaucuaaauccauacuuaucucaucuagcaagaauguacaacgguuacgcaggagguuuugaaguacaaguaauauuagcaggaaaugcauuuacagcaggaaaaguaauuuuugcagcaguaccaccuaauuuuccuacagaaggacuaucuccaucacaaguuaccauguuuccacauauaguaguagauguccgucaauuagaaccaguuuugaucccuuuaccagauguacgaaacaacuuuuaucauuauaaucaauccaacgacccuacaauuaaacuaauagcuauguuauauacacccuuacgagcuaacaaugcuggugaugacguauuuacuguaucaugcagaguauuaacuagaccaucaccagacuucgacuucauuuuuuuaguaccaccaacaguugaaucucguaccaaaccauuuucaguaccuguccucacaguagaagaaaugacuaauuccagauuuccaaucccccuagaaaaacuauucacaggaccaucaucugcuuucguuguucaaccacagaauggacgaugcaccacagauggaguauuauuagguacaacacaacuaucaccaguaaacauauguacauucagaggugacgucauacacauaaccggaucuagaaauuacacuaugaauuuagcuucacaaaauuggucaaauuaugaucccacagaagaaauaccagcaccacuugguacaccagauuuuguuggaaaaauacaagguguacuaacucaaaccaccaggacugacggaucuacuagaggucauaaagccacuguauauacaggauccgcagacuuugccccuaaauuaggaagaguacaauucgaaacagauacagaccacgauuuugaagcuaaucaaaauacaaaauucacuccaguuggaguaauacaagacggguccaccacucauagaaaugaaccacaacaauggguauuaccaaguuauucagguagaaauacaccaaacguucauuuagcaccagcaguagcaccaaccuuuccaggugaacaacuacuauuuuucagaucaacaaugccaggauguucuggauauccuaauauggauuuagauugcuuauuaccacaagaauggguccaauauuuuuaccaagaagccgcaccagcccaaagugacguagcauuauuaagauucguaaauccagauacaggacgaguacuauucgaauguaaauuacauaaauccggauaugucacaguugcacacacuggucaacaugaucuaguaauaccucccaauggauauuucagauucgauucauggguaaaucaauuuuacacuuuagcuccaaugggaaauggaacaggacguagaagagcauuauaa

SEQ ID NO: 32243 - RNA, 1623 nt, Artificial Sequence
  derived and/or modified sequence opt6 from VP1__Norovirus__BAU24909
augaaaauggccuccagugacgcuaauccaucagacggauccgcagcuaaccucguaccagaaguaaacaaugaagucauggcuuuagaaccaguaguaggagcagcaauagcugcaccaguagcuggacaacaaaacguaaucgacccauggauaagaaauaauuuuguccaagcacccgguggugaauuuacaguuucuccacgcaaugccccuggugaaauacuauggucagcuccucuaggaccugauuuaaacccauacuuaucccaucuagcacgaauguauaauggauacgccggaggauuugaaguacaaguaauauuagcaggaaacgccuuuacagcaggaaaaguaauauucgcugcagucccaccaaacuuuccaacugaaggacucagucccucacaaguaacaauguucccacauauaguaguugacguaagacaauuagagccaguucuaauaccccuacccgacguaagaaauaacuuuuaucacuauaaccaaucaaaugauccuacaauuaaacuaauagccauguuauauacucccuuacgagccaacaaugcaggagacgauguauuuacaguaucuuguagaguauuaacaagaccaucacccgacuuugauuuuauauuuuuaguaccaccaacaguugaaucccgaacaaaaccauuuucaguaccuguuuuaacaguagaagaaaugacuaauucaagauuuccaauacccuuagaaaaauuauuuaccggaccaucaucagcauuuguaguccaaccacaaaacggaagauguacaacagauggaguacuacuaggaacaacacaauuaagcccuguaaacauauguacuuuccgaggagauguaacacauauaacaggaucaaggaacuacacaaugaaccuagcuucacaaaacuggucaaacuaugauccaacagaagaaauaccugcaccgcuaggaacaccugacuucguaggaaaaauacaagguguacuaacacaaacaacuagaacagacggaucaaccagaggacacaaagcaacaguauacacaggaucagcugacuucgcacccaaacuuggacgcguccaauucgaaacugacaccgaccgggacuuugaagcuaaucaaaacaccaaauucacccccguaggcgucauacaagauggauccacuacacaucgcaacgaaccccaacaauggguauuaccaucauacucagguagaaauacuccuaacguacaccucgcaccagcaguagcaccaacauuuccuggagaacaacuucuauuuuucagaucaacaaugcccggcugcaguggcuauccaaacauggauuuagauuguuuauuaccacaagaauggguucaauauuucuaucaagaagcagcaccagcacaaucggacgucgcauuacuaagauucguuaauccagacacaggccgaguacucuuugaauguaaauuacauaaaucaggauauguaacaguagcacacaccggacaacacgaccucguaauacccccaaauggauacuucagauucgauucauggguaaaucaauuuuauacauuagcaccaaugggaaacggaacuggaagaagaagagccuuauaa

SEQ ID NO: 32244 - RNA, 1623 nt, Artificial Sequence
  derived and/or modified sequence opt6 from VP1__Norovirus__BAU24912
augaaaauggcaucaucagacgcaaaccccucagacggaucugcagcuaacuugguacccgaaguaaacaaugaaguaauggcacuugaaccaguuguaggagcugcaauagcagcaccaguugcaggacaacaaaacguaauugacccuuggauucgaaauaacuuuguacaagccccaggaggagaauucacuguaucaccaagaaacgcacccggcgaaauacuauggucagcaccacuaggcccagaccuaaaucccuaucuaucacaucuagcuagaauguauaaugguuacgcaggcggauuugaaguacaaguaauuuuagcaggaaacgcauucacagcagguaaaguaauauuugcagcaguuccaccaaacuuuccuaccgaaggacucucacccucucaaguaacaauguuuccucauauaguaguagacguacgacaacuagaaccaguauuaauaccacuaccagacguacgaaauaauuucuaucacuauaaucaauccaacgacccaacaaucaaacuaauagcuauguuauauacuccacuaagagcaaauaacgcaggagacgauguauuuacaguaucuugucgaguucuuacaagaccaucaccugacuucgacuucauuuuucuuguuccaccaacaguagaaucuagaacuaaaccauucuccguaccaguauuaacaguugaagaaaugacgaacucacgauuuccaauuccauuagaaaaauuauuuacagguccuagcagcgcauucguaguacaaccacaaaauggaagauguaccacagacggaguacuucuaggaacaacacaauuauccccuguaaauauaugcacauuuagaggugacguaacccauauaacuggcucaagaaauuacacuaugaauuuagcaagucaaaacuggucuaacuaugacccaacagaagaaauaccagcaccauuaggcacaccagauuuuguaggaaaaauucaaggaguuuuaacacaaacaacaagaacagacgguucaacaagaggacauaaagcaacaguauauaccgguucagcagacuuugcacccaaacuaggaagaguucaauuugaaacagauaccgaccacgauuucgaagccaaucaaaauacaaaauuuacuccaguagguguaauacaagacggaucaacaacacauaggaaugaaccacaacaauggguauuaccaucauacucaggaagaaauacaccaaacguccaucuagcacccgcaguugcaccuacuuuuccuggagaacaacucuuauuuuuuagaucuacuaugccagguugcuccggcuauccaaauauggaucuagacugucuacuaccacaagaauggguucaauauuuuuaucaagaagcugccccugcacaaucugauguagcacucuuacgauuuguaaauccugauacaggucgagucuuauuugaauguaaauuacauaaaucaggauauguaacuguagcucacacaggacaacacgaccuagucauaccacccaacggauauuuuagauucgauucauggguaaaucaauuuuauacuuuagcaccaaugggcaacggaacaggacgccguagagcacucuaa

SEQ ID NO: 32245 - RNA, 1623 nt, Artificial Sequence
  derived and/or modified sequence opt6 from VP1__Norovirus__BAU24915
augaaaauggcauccucugacgcuaacccauccgaugguucagcagcaaaccuuguaccugaagucaacaacgaaguaauggcauuagaaccaguaguaggagcugcaauagcagccccaguugcaggacaacaaaauguuauagaccccuggaucagaucuaauuuuguacaggcaccaggcggagaauuuacuguuucacccagaaaugcaccaggagaaauacuuuggucagcaccauuaggaccagaucuaaauccuuaccuaucacaccuagcacgaauguauaacggauacgcaggagguuuugaaguccaaguaauauuagccggcaaugcauuuacagcaggcaaaguaauauucgcugcaguaccaccaaacuucccaacagaaggccuuucaccaucucaaguaacaauguuuccccacauaguaguagauguacgacaauuagaaccaguucucauaccacuaccagacguaagaaacaauuucuaucacuauaaccaaaguaaugaucccacaaucaaauuaauagcaaugcuguauacgccacuaagagccaacaaugcaggagacgaugucuuuacaguauccugcagaguacuaacaagaccauccccagauuucgauuuuauauuucuaguaccaccaacaguugaaucaagaacaaaaccauuuucaguaccaguauuaacaguugaagaaaugaccaauucaagauuuccaauaccauuagaaaaauuauuuacaggacccucaucagcauuugucguacaaccucaaaacgguagauguacaacugacggaguauuacuaggaacaacacaauuaucuccaguaaauauauguacauuuagaggugacguaacccauaucaccggaucaagaaacuacacuaugaaccuagcaucacaaaacuggucaaauuaugauccuacugaagaaauacccgccccacuaggaacacccgacuucguagguaaaauacaaggaguuuuaacucaaacuacacguacagacgguucaacccgaggacauaaagcaacuguauacacugguagcgcaaacuuugcaccuaaacuaggucgcguacaauuugaaacagacacagaucacgacuucgaagcuaaccaaaauaccaaauuuacaccaguaggaguuauacaagauggcagcacaacacauagaaacgaaccacaacaauggguccuaccuucuuauaguggaagaaacacuccaaacguacaccuagcuccagcaguagcuccaacauucccaggagaacaacuauuauuuuucagaucaacaaugcccggaugcuccggauauccaaacauggaccuagauuguuuacuaccacaagaauggguacaauauuucuaucaagaagcagcacccgcacaaucagacgucgcacuacuacgauuuguaaauccagauaccggcagaguauuauuugaaugcaaacuucacaaaucaggcuaugucacaguagcucauacaggccaacaugaucucguaauaccaccaaaugguuauuuccgcuucgacucauggguaaaucaauuuuauacacuugcuccaaugggaaauggaacaggaagaaggagagcccuauaa

SEQ ID NO: 32246 - RNA, 1623 nt, Artificial Sequence
  derived and/or modified sequence opt6 from VP1__Norovirus__BAU24918
augaaaauggcuaguucugaugcaaaccccucagauggauccgcagcaaacuuaguaccugaaguuaacaaugaaguaauggcucuagaaccagucguaggugcagcaauugcagcaccuguugcaggacaacaaaauguaauagacccauggauaagaaacaacuuuguacaagcaccagguggagaauuuacagucucaccucgaaaugcaccaggcgaaauacucuggucagcaccacuuggacccgacuuaaauccauaucuaucccaucuugcacgaauguacaacggcuacgcaggagguuucgaaguccaaguaauucuagcuggcaacgcauucacagcuggaaaaguuauauuugcagcaguuccaccaaacuucccaacugaaggacuuucaccaucacaaguaacaauguuuccacauauaguaguugauguaagacaacuagaaccaguacuaauucccuuaccagaugucagaaacaauuuuuaucacuacaaccaaagcaaugacccaacaauaaaauuaauagcaaugcuuuauacuccuuuaagagcaaacaacgcaggagacgauguauuuacaguaucuuguagaguauuaacacgaccaucaccagacuucgacuucauauucuuagucccacccaccguugaaucuagaacaaaaccauuuucaguaccaguauuaacaguagaagaaaugaccaacucucgauuuccaauuccauuagaaaaacuauuuacaggaccaucuucugcauucguuguccaaccacaaaaugguagaugcacaacagauggagucuuacuaggaacaacacaauuaaguccaguaaauauauguacauuuagaggagacguaacccauauaacaggaucuagaaauuacaccaugaaucuggcaucacaaaacuggucaaauuacgacccuacugaagaaauaccagcaccucuuggaacaccugacuuugucggaaaaauacaaggcguacuaacacaaacaacacgaacagacgguucaacaagaggacacaaagcaacagucuauacuggaucagcagacuuugccccuaaauuaggacguguucaauucgaaacagauacagauagagauuucgaagccaaccaaaauacaaaauuuacacccguuggcgucauccaagauggaucaacaacccauagaaaugaaccacaacaauggguacuaccuucauauucaggaagaaauacuccuaauguacacuuagcaccagcuguagcaccuacauuuccaggagaacaauuacuauucuuuagaucaacaaugccaggcugcucaggauauccaaauauggauuuagacuguuuauuaccucaagaauggguacaauauuuuuaucaagaagccgcaccagcccaaucagauguagcauuacuaagauucgucaauccagacacuggaagaguuuuauucgaaugcaaauuacacaaaucagguuauguuacuguagcacauacaggacaacaugaucuaguaauaccaccaaacggauacuuuagauucgauucauggguaaaucaauucuacacucuagccccaaugggaaauggcacaggaagacgaagagcccuuuaa

SEQ ID NO: 32247 - RNA, 1623 nt, Artificial Sequence
  derived and/or modified sequence opt6 from VP1__Norovirus__BAU24921
augaaaauggcaucaucugaugcaaauccaagugaugguucagcagcuaaucuaguaccagaagucaauaaugaaguaauggcauuagaacccguaguaggagcagcaauagcugcuccaguagccggccaacaaaacguaauagaucccuggauaagaaacaauuucguacaagcaccuggcggugaauuuacagucucaccuagaaacgcuccaggagaaauucucugguccgcuccuuuaggaccagauuuaaauccauauuuaucacauuuagcaagaauguacaaugguuacgcuggagguuuugaaguacaaguaauacuagcagguaacgcuuuuaccgcuggaaaaguaauauuugcagcaguacccccaaauuuuccaacagaaggacuaucaccuucacaaguaaccauguucccucauauaguugucgacguaagacaauuagaaccaguacuaauaccuuuaccagauguaaggaacaauuucuaucacuacaaucaaucaaaugacccaacuauaaaauuaauugcuauguuauauacaccauuaagagccaauaaugcgggugacgauguauucacaguaaguuguagaguuuuaacacgaccaucuccagauuuugauuuuauauucuuaguaccuccaacagucgaaaguagaacaaaaccuuuuucaguuccaguauuaacuguagaagaaaugacaaauucuagauuuccaauaccauuagaaaaacucuuuaccggaccaucaucagcuuucguaguccaaccgcaaaauggucgaugcacaacagacggaguuuuauuagguacaacucaauuaucaccaguaaacaucuguacuuuuagaggagacguaacacauauuacaggcagucgaaauuauacaaugaaccuagcaucucaaaauuggucaaauuaugauccaacugaagaaauaccugcaccauuaggaacaccagauuuuguuggaaaaauacaaggcguucuaacacaaacaacucgaacagacggcucaacaagaggacauaaagccacaguauauacaggaagugcagauuuugcaccuaaauuaggacgaguccaauuugaaacagauacugaccgagauuuugaagcuaaucaaaauaccaaauucacaccuguaggaguaauacaagacgguaguacaacacauagaaaugaaccacaacaauggguauuaccaucauacucuggucgaaauacuccaaauguacaucuagcaccagcaguagcaccuacauuucccggagaacaauuauuauuuuucagaagcacaaugcccggaugcucagguuacccaaacauggauuuagauugccuuuuaccacaagaauggguucaauauuucuaccaagaagcagcaccagcacaaucagaugucgcacuucuccgauuugucaaucccgacacagggagaguauuauuugaauguaaacuucauaaaucagguuauguaacaguagcacacacaggacaacaugauuuaguuauaccaccaaaugguuacuuucgauucgacucauggguaaaccaauucuauacccuagcacccaugggaaacgguacagguagaagacgagcauuauag

SEQ ID NO: 32248 - RNA, 1623 nt, Artificial Sequence
  derived and/or modified sequence opt6 from VP1__Norovirus__BAU24924
augaaaauggcuucaucagacgccaacccaucugaugguucagcagcaaaucuaguaccagaaguaaacaaugaaguaauggcacuagaaccaguaguaggagcagcaauugcagcaccaguagcaggucaacaaaauguaauagauccauggauacgaaacaauuuuguacaagcuccaggcggagaauuuacggucucaccaagaaaugcaccuggugaaauauuauggucagcaccacuaggaccagaucuaaacccauauuuaucacacuuagcacgaauguauaauggauacgcaggaggauucgaaguacaagucauauuagcagguaaugcuuucaccgcaggaaaagucauauuugcagccguaccaccaaacuuuccaacagaaggauuaucaccaucucaaguaacaauguucccacacaucguuguagauguaagacaacuugaaccaguauuaauaccccuaccagacguacgaaacaauuuuuaucacuauaaccaaucaaacgacccuacaauuaaacuuauagcaauguuauacaccccuuuaagagcaaacaaugcuggagacgacguauucacaguaagcugcagaguuuuaacaagaccaagccccgauuucgauuuuaucuuucuaguaccaccaacaguagaaucuagaacaaaaccauuuucaguaccaguacugacagucgaagagaugaccaauucucgauuuccaauaccauuagaaaaauuauucacagguccaucuucagcauuuguuguacaaccacaaaacggacgaugcacaacagacggaguacuucuugguacaacucaacuaucaccaguaaauauuuguacauuuagaggcgacguaacacauauaacaggaucaagaaacuacacaaugaauuuagcaucacaaaauuggucaaauuaugaucccacagaagaaauaccagcuccacuagguacaccagauuuuguaggaaaaauucaaggugucuuaacacaaaccacaagaacagauggaucuacaagaggccacaaagcaacaguuuacacaggaucagcugauuuugcaccaaaacuuggaagaguccaauucgaaaccgauacagaucgugacuucgaagcaaaccaaaauacaaaauuuacaccaguaggagugauccaagauggaucaacuacacauagaaacgaaccucaacaauggguccuaccaucauauucaggaagaaauacaccaaauguacacuuggcaccggcaguagcaccaacauuuccaggagaacaauuauuauucuuccguaguacaaugccgggauguucaggauauccaaacauggaccuagacugucuacuaccacaagaauggguucaauauuucuaucaagaagcagcaccugcucaaagugauguagcacuacuaagauuuguaaauccagacacaggacgaguacuauucgaaugcaaacuacacaaaucuggauaugucacaguagcucacacaggacaacacgaucuaguaauaccacccaacgguuauuuccguuucgauucauggguaaaccaauuuuacacucuagcuccaaugggaaacggaacaggcagaagaagagcauuauaa

SEQ ID NO: 32249 - RNA, 1623 nt, Artificial Sequence
  derived and/or modified sequence opt6 from VP1__Norovirus__BAU24927
augaaaauggcauccucagacgcaaauccauccgacggaucugcagcaaacuuaguuccagaaguaaacaacgaagucauggcacuugaaccaguaguuggcgcagcaauagccgccccaguagcaggacaacaaaaugucauagacccuuggauuagaaauaauuucguucaagcaccaggaggagaauuuacaguaucaccuagaaacgccccaggagaaauauuauggucagcaccacuaggaccagaucuaaauccauaucuaucucaucucgcccgcauguauaauggcuacgcaggugguuuugaaguacaaguaauucuagcaggcaaugcauuuacugcuggaaaagucauauuugccgcaguacccccaaacuuuccaacagaaggucuaucaccaucccaaguaacaauguucccacacaucguaguugauguaagacaauuagaaccaguauuaauaccucuacccgacgucagaaacaacuuuuaccacuauaaccaaucuaaugauccuacaauaaaacuaauagcaaugcucuauacaccauuacgagcaaauaacgcuggagaugacguauuuacaguaucaugcagaguacuaacaagaccuucaccagauuucgauuuuauauuucuuguaccaccaacugucgaaagucgaacaaaacccuuuucuguaccaguacuaacaguagaagaaaugacaaacucuagauucccaauaccuuuagaaaaauuauucacugguccaucaucagcauucguuguacaaccucaaaauggacgaugcacaacugauggaguucuuuuaggaaccacucaacuaaguccaguaaacauuuguacuuuccgaggagauguaacgcauauaacagguucaagaaauuacacaaugaauuuagcgucacaaaacuggucaaacuaugauccaacagaagaaauaccugccccauuaggcacaccagauuuuguaggcaaaauacaaggaguuuuaacacaaacaacccgaacagacggauccacucgaggucacaaagccacuguauauacaggaucagcugauuucgcaccuaaauuaggcagaguacaauucgaaacagauacugaucacgacuucgaagcaaaucaaaacacaaaauuuacaccuguaggaguaauacaagacggaggaacaacacauagaaacgaaccacaacaaugggucuuaccaucauacucuggacgcaacacaccaaauguucauuuagcuccugcaguagccccaacauuuccaggcgaacaauuauuauuuuuuaggucgacaaugccugguuguucaggauauccuaauauggaacucgacugcuuauuaccacaagaauggguucaauacuucuaucaagaagcagcaccagcacaaucagauguagcccucuuaagauuuguaaacccagacacuggaagaguacuauucgaaugcaaauuacauaagucaggcuacgucacaguagcacacacaggacaacaugacuuagucauaccaccaaauggauauuuuagauucgacuccuggguaaaucaauuuuauacucuagccccuaugggaaacgguacaggacgaagaagagcauuauaa

SEQ ID NO: 32250 - RNA, 1623 nt, Artificial Sequence
  derived and/or modified sequence opt6 from VP1__Norovirus__BAU24930
augaaaauggcuuccuccgaugcuaauccauccgacgguucagcagcaaacuuaguacccgaaguaaacaaugaaguaauggcacuagaaccuguaguuggugcagcaauagcagcaccagucgcaggacaacaaaauguuauagacccauggauuagaaauaauuuuguacaagcacccggaggagaauuuacuguaucuccaagaaacgcaccaggcgaaauauuaugguccgcaccauuaggacccgacuuaaauccuuauuuaucucauuuggcaagaauguacaauggcuaugcaggaggauucgagguucaagugauauuggcaggaaaugcauuuacugccggcaaagucauauuugccgcaguuccaccaaacuuuccaacagaaggauuaucuccuucucaaguuaccauguucccacauauaauaguugacguuagacaauuagaaccaguucuaauaccccucccagauguaagaaauaauuucuaucacuauaaucaauccaacgauuccacaauaaaacuaauugcaaugcucuacacuccacuaagagccaacaaugcuggagaugauguauuuacaguaucuugcagaguacuaacacgaccaucaccagauuuugacuuuauauucuuagucccccccacaguugaaucacgcacuaaaccauuuucaguaccaguacuaacaguagaagaaaugacaaauucaagauuuccaauaccauuagaaaaauuauucacaggaccaucuuccgcauucguuguacaaccacaaaacggucguugcacaacagacgguguguuacuaggaaccacccaacuaucacccguuaauauauguaccuuuagaggagauguaacacauauuacuggauccagaaauuauacaaugaaucuagccagucaaaauuggaauaacuaugauccaacagaagaaauuccugccccacuaggaacaccagauuuuguaggaaaaauccaaggaauguuaacacaaaccacacguacagauggaucuacaagaggucacaaagcaacaguauacacagguucggcugacuuugcaccuaaauuaggcagaguucaauuugaaacugacacugaucaugacuuugaagcaaaccaaaauacaaaauucacuccuguaggaguuauucaagauggaucuacaacacacagaaacgaaccacaacaauggguacuaccaucauacucaggucgaaauacacacaacguacauuuagcaccagcaguagcccccacuuuucccggugaacaauuacuuuucuuuagaagcacaaugccaggcugcucuggcuaucccaacauggauuuagacugccuucuaccacaagaauggguccaauauuuuuaccaagaagcugcaccugcacaaucagacguagcacuacuuagauuuguaaauccagauacagguagaguauuauuugaauguaaauuacacaaaucaggauacguuacaguagcacauacuggccaacacgaucuagucauaccuccaaauggauauuuuagauuugauucauggguaaaucaauuuuauacucuagcaccaaugggaaacggaacaggacgucgcagaguuguuuaa

SEQ ID NO: 32251 - RNA, 1623 nt, Artificial Sequence
  derived and/or modified sequence opt6 from VP1__Norovirus__BAU24933
augaaaauggcaucauccgaugcaaauccauccgauggaucuacagcaaaccucgucccagaaguaaacaaugaaguuauggcacuagaaccuguaguaggagccgcaaucgcagccccagucgccggccaacaaaacguaauagacccuuggauccgaaauaacuuuguccaagccccaggcggagaauuuaccguaucuccucgaaacgcaccuggagaaauacucuggucagccccauuaggucccgauuuaaauccuuauuuaucacaccuugcacgaauguacaauggcuacgcaggaggauuugaaguccaaguaauacuagcgggaaacgcauucacagcaggaaaaauaauauuugcagcaguaccuccaaacuuuccaaccgaaggauuaucuccuucacaaguaaccauguucccacacauaauaguagauguacgacaacuagaaccuguuuuaauaccauuacccgaugucagaaauaauuuuuaucacuauaaccaauccaaugacucaacuauaaaacuaauagcaaugcuauauaccccauuacgcgcaaauaaugcaggagaugauguauucaccguaucuugucguguauuaacuagaccaucaccagacuuugacuuuaucuuucuaguaccacccacaguugaaucucguacaaaaccauucucuguaccaguuuuaacaguagaagaaaugacaaauucacgauuuccaauaccacuagaaaaacucuuuacaggacccucaucugcuuucguaguacaaccacaaaacggaagauguacaacagacggagucuuauuagguacuacacaacuuuccccaguuaauauauguacguuucgaggagacguaacacauauaaguggaucuagaaauuauacaaugaauuuagcaucacaaaauuggaacucauaugacccuacagaagaaaucccagcccccuuagguacaccagacuucguaggcaaaauacaagguguucuaacccaaacaacaagaacaaacggcucuacacguggacauaaagcaacaguauauacugguucagcagacuucucaccaaagcucggaagaguacaauucgcuacagauacagauaaugauuucgaaaccaaucaaaauacuaaauucacaccaguuggaguaauccaagauggaagcacaacaccacgaaacgaaccccaacaauggguucuccccuccuauucaggaagaaauauucauaacguccaccuagcacccgcaguagccccaacuuuuccaggagaacaauuacuauuuuuucgaucaacaaugccaggauguucuggauauccaaauauggacuuagacuguuuauuaccucaagaauggguacaauauuuuuaucaagaagcugcaccagcacaaucugauguagcacuacuaagauucguaaauccagauaccggcagagucuuauuugaaugcaaacuacauaaaucaggauauguaacugucgcucauacuggccaacacgauuuaguaaucccaccaaauggauacuuuagauuugacucauggguaaaucaauucuauacacuagcaccaaugggaaaugguacuggacgacgaagagcccucuaa

SEQ ID NO: 32252 - RNA, 1623 nt, Artificial Sequence
  derived and/or modified sequence opt6 from VP1__Norovirus__BAU24936
augaaaauggcaucuaacgacgcaaacccaucugacgguucagcugcuaacuuaguuccagaaguuaauaaugagguaauggcacuagaaccaguaguaggagcagcaaucgcagcaccaguugcuggacaacaaaauguaauagauccauggauaagaaacaauuucguacaagccccaggaggcgaauuuacagucucaccacgaaaugcaccuggagaaauauuauggucagcaccacuaggaccagaucuuaacccauaccucucacacuuagccagaauguacaaugguuaugcaggcggauucgaaguucaaguuauacuagcaggaaaugcauuuacugcuggaaaaauaauauuugcagcuguaccaccaaauuuccccaccgaaggacuaucacccucucaaguaacuauguuuccucauauaauaguagauguacgacaacuugaaccuguacucauuccacuaccagauguaagaaacaacuucuaucauuauaaccaaucaaaugacucuacuaucaaacuaauagcaaugcuauauacuccucuaagagcaaacaaugcaggagaagacguauuuacaguuagcuguagaguauuaacacgaccaucaccagacuucgacuuuauuuuucuaguaccaccaacuguugaaucaagaacaaaacccuuuaccguaccuauacuaaccguugaagaaaugacaaacuccagauuuccaauaccacuagaaaaauuauuuacaggaccaucuagcgcauucguaguucaaccacaaaacgguagauguacaacagacgguguacuauuaggcaccacacaauuaucaccagucaauauuugcacauuccgcggagauguaacacacauagcagguucuagaaauuacacaaugaaucuagcaucccuaaauuggaauaacuacgaucccacagaagaaauaccagcaccauuaggaacaccagauuuuguaggcaaaauacaaggaguauuaacacaaacaacuaaaggcgacggaagcacuagaggacacaaagccacaguauauacaggaucagcaccauuuacaccuaaauuaggcagcgugcaauucgguacagauacagaaaaugacuuugaaacucaucaaaacacaaaauucacuccuguaggcguuauucaagauggcgguacaacacauagaaaugagccacaacaauggguacuuccuucauauucuggccguaauguaccaaauguacaccuagcaccugcaguagcaccaacauuccccggagaacaacuauuauucuuucgaucaacaaugccaggauguucaggauauccuaacauggaucuagauugccuacuaccacaagaauggguucaacacuuuuaucaagaagcagccccagcacaaucugauguagcacuauuaagauucguaaauccagacacaggucgaguacuauuugaauguaaacuccauaaaccuggauauguuaccgucgcacacacaggacaacaugaucuaguaauaccaccaaaugguuauuuccgcuuugauucauggguaaaccaauuuuauacucuagcaccaaugggaaacggaacaggcagaagaagagcucuauaa

SEQ ID NO: 32253 - RNA, 1623 nt, Artificial Sequence
  derived and/or modified sequence opt6 from VP1__Norovirus__BAU24942
augaaaauggcaucaucagaugcaaacccaucugauggaucagcagcaaauuuaguuccagaaguuaauaacgaaguuauggcuuuagaaccaguaguaggagcagcuauagcagcaccaguugccggacaacaaaauguaaucgauccauggauaagaaauaauuuuguucaagcuccuggcggagaauuuacuguaucaccuagaaacgcaccaggcgaaauccuauggucugcaccacuugggcccgauuuaaauccauaucuaucacaccuagcaagaauguacaauggauaugcaggcgguuuugaaguccaaguuauacuagcugguaaugcauuuacugcaggaaaaguaauauucgcagcaguaccgccaaacuuuccaacagaaggauuaucuccaucacaagugacaauguuuccacauauaguaguagacguaagacaauuagaaccaguuuuaaucccauuaccugacguuagaaauaauuuuuaucauuacaaucaauccaaugauccaacaaucaaacuaauagcaauguuauauacaccauuaagagcaaauaaugcuggugaugaugucuuuacugucuccugcagaguacuuacaagaccaaguccagacuuugauuuuauuuuuuuaguaccaccaacaguagaaucaagaacaaaaccuuucucaguaccaguauuaacuguagaagaaaugaccaauucacgauucccaaucccacuagaaaaacuuuucacaggaccaucaagugcauuuguaguacaaccacaaaauggaagauguacuacagacggaguccuauuaggaacaacacagcucucacccguuaauauuuguacauuccgcggagaugucacacacauaacagguucccgaaauuauacaaugaaucuugcaagucaaaacuggucaaauuaugauccaacagaagaaaccccagcaccuuuagggacaccagauuuuguaggaaaaauacaaggcguauuaacccaaacaacacguaccgacggaucaacacgcggacacaaagcuacaguuuauacaggcucagcagacuuugcucccaaacuaggcaggguucaauuugaaacagauacugacagagauuuugaagcuaaucaaaauacaaaauucacaccaguaggaguuauccaagauggaucuacaacucaucguaaugaaccacaacaauggguacuaccuuccuauuccggacgaaacacccccaacguacauuuagccccagccguugcaccaacuuucccuggagaacaauuauuauucuucagaucaaccaugccaggaugcucaggauauccaaauauggaucucgauugucuucuaccccaagaauggguucaauauuuuuaucaagaagcagcacccgcacaaucagaugucgcauuacucagauucguaaauccugauacaggaagaguauuauucgaauguaaauuacacaaaucaggauacguaacaguugcacauacaggucaacaugaccuaguaauaccaccaaauggauauuuuagauuugauucuuggguaaaucaauuuuauacacuugcacccaugggaaacggaacuggacguagacgagcauuauaa

SEQ ID NO: 32254 - RNA, 1623 nt, Artificial Sequence
  derived and/or modified sequence opt6 from VP1__Norovirus__BAU24945
augaaaauggcauccucugaugcuaacccaucagauggaucagccgcaaauuuagucccagaaguaaacaaugaaguaauggcauuagaaccaguaguaggagcagcaauagcagcaccaguugcuggccaacaaaacgucauugacccuuggauaagaaacaauuuuguccaagcaccaggaggcgaauuuacagucucaccaagaaacgcaccaggagaaauauuauggucagcaccacuaggaccagaucuaaacccauacuuaucucaucuagccagaauguauaacggauaugccggaggauuugaaguccaaguaauucuagcuggaaacgcauuuacagcaggaaaaguaauauucgcugcaguaccuccaaacuuuccaacagaagguuuaucacccucacaaguaacaauguucccccauauaguaguagauguacgucaacuagaaccaguucuaauuccauuacccgacguaagaaacaacuuuuaucacuacaaccaaaguaacgacccaacaaucaaauuaauagcaaugcucuauacaccccucagagcuaacaaugcaggagaugauguuuuuacaguaucaugcagaguuuuaacaagaccaucuccagacuucgauuuuaucuuccuugucccacccacaguagaauccagaacaaaaccauuuucaguaccaguauuaacuguugaagaaaugacuaacucaagauuuccaauaccccuagaaaagcuuuuuacaggcccuucauccgcauucguaguacaaccacaaaacggaagauguaccacagacggaguacuccuaggcacaacucaauuaucaccaguaaauauuugcacauuuagaggugacguaacucacauaacuggaucucgaaacuauacaaugaaucuagccucucaaaauuggucaaauuacgacccaacagaagaaacaccagcaccauuaggaacaccagacuuuguagguaaaauacaagguguauuaacacaaacuacuagaacugacggaucuacaagaggacacaaagcaacaguauacacagguucagcagauuuugcaccaaaauuaggaagagugcaauucgaaaccgacacugaucacgauuuugaagcaaaucaaaauacuaaauuuacaccaguugguguuauccaagacgguucaacuacacaucgcaacgaaccacaacaauggguuuuacccucuuauucaggacgaaauacacccaauguacaucucgcuccagcagucgcacccacauuuccaggagaacaacuacuauucuuucgcucuacaaugccugguuguucagguuaucccaacauggauuuagauuguuuacuaccacaagaauggguccaauauuucuaucaagaagcagcuccagcacaaagcgacguagcacuccugagauucguaaacccagacaccggaagaguauuauuugaauguaaacuacacaaaucaggauauguaaccguagcucauacaggccaacacgaccuaguuauuccaccaaauggcuacuuccguuucgacucguggguaaaccaauucuauacucuugcaccaaugggaaauggcacuggacgaagaagagcacuauaa

SEQ ID NO: 32255 - RNA, 1623 nt, Artificial Sequence
  derived and/or modified sequence opt6 from VP1__Norovirus__BAU24948
augaaaauggcaucaucagaugcuaacccaucagacggaucagcagcuaacuugguaccggaaguaaauaaugaaguaauggcacuagaaccagucguaggagccgccauagcagcuccaguugcaggccaacaaaacguaaucgaccccuggauacgaaacaauuucguucaagcaccaggaggugaauuuacuguuucaccaagaaaugcaccaggagaaauauuauggagcgcuccacucggaccagacuuaaacccauauuuaucucauuuagcucgaauguauaaugguuacgcaggagguuucgaaguacaaguuauacuagcagguaaugcauuuacagcaggaaaaguaauauucgcugcaguaccaccaaauuuucccacagaaggacucaguccaucacaaguuacaauguuuccucauauaguagucgacguuagacaauuagaacccguauuaauaccccucccagauguaagaaauaauuuuuaucauuauaaccaaucaaaugacccaacaauaaaacucauugccauguuauacacaccauuaagagcaaacaaugcaggcgaugauguauucaccguaucauguagaguacuaaccagaccaucaccugauuucgacuucauuuuucuaguaccaccuaccguagaaucuagaacuaaaccauucucaguacccguauuaacaguagaagaaaugacuaauucaagauuuccaauuccacuagaaaaauuauuuacuggaccaucaagugcauuuguuguccaaccacaaaacggaagaugcaccaccgacggaguauuacuuggaacaacacaacuauccccaguuaauauuuguacuuuucguggagacguuacucauauaacaggauccagaaauuauacuaugaacuuagcaucccaaaauuggucaaauuaugauccaacagaagaaaucccugcaccccuaggcaccccagauuuuguaggaaaaauacaaggaguacuaacucaaacaacaagaaccgacggaucaacaagaggucauaaagcuacaguuuauacaggaucagcagauuuugcccccaaauuaggaagaguacaauucgaaacagauacagaccaugauuucgaagcuaaucaaaauaccaaauucacaccuguuggaguaauacaagacggauccacagcucacagaaaugaaccccaacaauggguacuuccauccuauucuggaaggaauacaccuaacguacaucuugcaccugcaguugccccuacauuuccaggcgaacaacuacuauucuucagaucuacaaugccaggauguuccggauaucccaauauggaucuagacugucuauuaccacaagaauggguucaauauuucuaccaagaagcagcaccagcucaaucagaugucgcucuacuaagauucguaaaccccgacacagguagaguuuuauucgaauguaaauuacacaaauccggauaugucacugucgcacacacaggucaacaugaccuuguuauaccaccaaaugguuacuucagauuugauuccuggguaaaucaauuuuauaccuuagcacccaugggaaauggaacaggaagaagacgagcacucuaa

SEQ ID NO: 32256 - RNA, 1623 nt, Artificial Sequence
  derived and/or modified sequence opt6 from VP1__Norovirus__BAU24950
augaaaauggccagcuccgacgcuaacccauccgaugguaguacagcaaaccuuguaccagaaguaaacaacgaaguaauggcauuagaacccguugucggagcagcuauagcugcaccaguagcuggacaacaaaacguaauugauccuuggauacgaaacaacuuuguacaagccccaggaggagaauuuacaguaucuccacgcaaugcaccaggagagauauuauggucugccccuuuaggcccagaucuaaauccuuaucuaagccacuuagcaagaauguauaacggauacgcugguggauucgaaguccaaguaauacuagcugguaaugcauuuacagcaggaaaaauaauauuugcagcaguaccucccaacuuuccaaccgaaggacuaucaccaucacaaguaaccauguucccacauauaaucguugauguucgacaauuagaacccguacucauaccacuaccagacguacguaauaacuucuaucacuauaaccaaucuaacgauuccacaaucaaacuaauagcaaugcuauauacaccccuaagagcuaauaaugcaggagacgauguauuuacaguaucuuguagaguacuaaccaggccuucaccugacuucgacuuuauuuuucuaguaccaccaacaguagaaucucgaacaaaacccuucucaguaccaguccucaccguugaagaaaugacuaauucaagauuuccaaucccacuagaaaaauuauucacaggaccuucauccgcauuugucguacaaccacaaaauggaagauguacaacagacggaguacuacuaggaacaacacaauuaucacccguaaauaucuguacauuuagaggagacguuacacacauacccggaucuagaaacuacacaaugaaucuagcaucacaaaacuggaacucauaugacccaacugaagaaaucccugcaccccuugguacaccagauuuugucgguaaaauucaaggaguauuaacacaaacuacaagaacaaauggaucaacaagaggucauaaagcaacuguauauacuggaucagcagauuuuuccccaaaauuaggaagaguacaauucgccacagacacagauaaugauuucgaaacaaaucaaaacacaaaauuuacacccguaggaguaauacaagaugguucaacuacaccuagaaaugaaccacaacaauggguucuaccaucauacuccggacgaaauauucauaacguucacuuagcaccugcaguagccccaacauuccccggugaacaacuauuauuuuuuagauccacaaugccagguuguucaggcuacccaaacauggaccucgauugccuucucccacaagaauggguacaauacuucuaucaagaagcggcaccagcacaaucagacguagcauuauuacgcuuuguaaacccagacacaggaagaguauuauuugaauguaaauuacacaaaucaggauacguaaccguagcucauacaggacaacacgaucuaguaauacccccaaacggauauuuccgauucgacucuuggguaaaccaauuuuauacucuagcaccaaugggaaacggaaccggaagaagaagagcacuauag

SEQ ID NO: 32257 - RNA, 1623 nt, Artificial Sequence
  derived and/or modified sequence opt6 from VP1__Norovirus__BAU24952
augaagauggcaucaucagacgccaauccuagugauggaucagcggcuaacuuagucccagaaguuaacaaugaagugauggcccuagaaccuguaguaggagcagcaauagcagcaccuguagcaggacaacaaaauguaauagacccuuggauaagaaacaacuuuguccaagccccuggcggagaauuuacaguuucaccucgaaaugcacccggagaaauacuaugguccgcaccucuugguccagaucuaaaucccuaucuaucacaucuagcaagaauguauaauggauaugcaggcggauuugaaguacaaguuauacuagcaggaaacgccuucacagcaggcaaagucauauuugcugcaguaccccccaacuuuccuacagaagguuuaucaccaucucaaguaacaauguuuccacauauuguaguagacguaagacaacuugaaccaguacuaauuccacuacccgacguaagaaacaauuucuaucacuauaaucaaucaaaugacccaacaauuaaacuaauagcaauguuauacacaccuuuaagagcaaacaaugcaggagacgauguauucacuguaaguuguagaguacuaacuagaccaucuccagacuucgauuuuauauuuuuaguaccaccaacaguugaaagcagaacaaaacccuucucaguaccuguacuaaccguagaagaaaugacaaacucacgauuuccaauaccauuagaaaaauuauucacaggaccaucauccgcuuucguuguacaaccacaaaacggaagauguacaacagauggagucuuauuaggaacaacucaacuaucuccaguaaauauauguacauuccguggagacguaacacacauaacugguucuagaaacuacacaaugaaccuugccucccaaaacuggaacaauuaugacccaacagaagaaauaccagcaccgcuuggaacaccagauuuuguugguaaaauucaaggaguauuaacucaaacaacaagaacagacggaucuacuagaggucacaaagcaacaguuuauacaggaucagcugacuuugcaccaaaacuuggccgaguccaauuugaaacagauacagaucaugacuuugaagcaaaucaaaauacaaaauuuacucccguuggaguuauacaagacgguuccacaacucaucgcaaugaaccacaacaaugggucuugccaucauacucagguagaaauacacccaacguccaucuagcccccgcaguagcaccaacauuccccggagaacaauuauuauuuuuuagaucaacaaugccagguuguucaggauauccaaauauggauuuagauugccuacuaccucaagaauggguacaauacuucuaucaagaagcagcaccugcucaaucagacguagcacuucucagauuuguuaaucccgauaccggacgaguacuauucgaauguaaacuccacaaaucaggcuaugucacaguagcgcauaccggccaacaugauuuaguuaucccaccaaacggauacuuuagauuugacucaugggucaaccaauuuuauacauuagccccaaugggaaauggaacaggaagaagaagagcacuauaa

SEQ ID NO: 32258 - RNA, 1623 nt, Artificial Sequence
  derived and/or modified sequence opt6 from VP1__Norovirus__BAU24954
augaaaauggccucaucagacgccaauccaucagauggaucugcagcuaacuuaguaccagaagucaacaaugaagucauggcacuagaaccaguaguaggugcagccauagcagcaccagucgcaggacaacaaaacgucauagauccauggauaagaaauaacuuuguccaagcaccaggaggugaauuuacaguaucaccuagaaaugcaccuggagaaauacuauggucagcaccuuuaggaccagauuuaaacccauaccuuucacaccuagcaagaauguauaauggauacgcaggaggauucgaaguacaagucauacuagcaggaaaugccuuuacagcugguaaagucauauucgcagcaguaccuccuaauuuucccacagaaggccuaucaccaucucaaguaaccauguuuccucacauaguaguagaugucagacaacuagaaccaguacuaauaccacuaccagauguaagaaacaauuucuaucacuacaaccaaagcaaugacccaacuauaaaauuaaucgcuaugcuauauaccccacuuagagccaacaacgccggagacgauguauucacaguaucauguagaguacuaacacgaccaaguccugauuuugacuuuaucuuucucguaccuccaaccguagaaucacgcacaaaaccauuuucaguaccuguuuuaaccguagaagaaaugacaaauucuagauucccaauaccacuagaaaaauuauuuacaggaccauccucagcauucguaguacaaccacaaaauggcagauguacuacugacggaguccuacuaggaacaacacaacucucaccaguaaauauauguacauucagaggugacguaacccauaucacaggaucaagaaauuacacuaugaaucuagcaagucaaaacuggaauaauuacgauccaacagaagaaauaccagcaccacuaggcgcaccugacuuuguaggcaaaauacaaggaaugcuuacacaaacaacacgagccgaugguucaacuagaggacauaaagcaacuguauacacaggcucugcugacuucgcuccuaaauuaggcagaguucaauucgaaaccgacacagaucaugauuucgaagccaaucaaaauacaaaauuuacaccaguaggaguaauacaagacggaucaacaacucaccgaaacgaaccacaacaauggguauuaccaaguuauucaggaagaaauacucacaauguucacuuagcaccggcagucgcaccuacauuuccaggagaacaacuauuauucuuuagaucaacuaugccaggaugcucuggauauccuaauauggaucuagacugccuucuaccacaagaauggguacaauauuuuuaucaagaagccgcaccagcacaaucugacguagcuuuacuacgauucguaaauccagacacaggaagaguccuauuugaaugcaaauuacauaaaucuggauauguaacuguagcacauacaggacaacaugaucuaguaauaccacccaacggauauuucagauucgauuccuggguaaaucaauucuacacauuagcucccaugggaaacggugccggaagacgaagagucguuuaa

SEQ ID NO: 32259 - RNA, 1623 nt, Artificial Sequence
  derived and/or modified sequence opt6 from VP1__Norovirus__BAU24958
augaaaauggcaucaucagacgcuaaucccucagauggaucugcagccaacuuaguacccgaaguaaauaaugaagucauggcacuagaacccguuguuggagccgccauagcagcaccaguagcaggacaacaaaaugucauagacccauggauucgaaauaacuuuguucaagcuccaggcggugaauuuacaguuagcccgagaaaugcaccaggugaaauauuaugguccgcgccacucggaccagaucuaaacccauaucuaucacaccuagcaagaauguauaaugguuaugcaggaggguuugaaguccaaguaauucuagcaggcaacgcauucacagcuggaaaaguaauauucgcugcaguuccaccaaacuuuccaacagaaggacucuccccaucacaaguaacaauguuuccccauauaguaguugauguuagacaacuagagccaguacuaauuccauuaccagacguaagaaacaauuucuaucauuauaaccagagcaaugauccuacuauaaaauuaauugcaaugcuauacacaccauuacgagcaaacaacgcaggugacgauguauucacaguuucaugucgaguacuaacacguccuagcccugacuuugacuuuaucuuucuaguaccaccaacaguagaaucacgaacuaaaccauuuucuguaccaguauuaacagucgaagaaaugacaaacucacgauucccaaucccauuagaaaaauuauuuacaggaccuucgucagcauucguaguacaaccucaaaauggccgaugcacaacagacgguguacuccuaggaacaacacaacuaucaccaguaaauauauguacauuuagaggugacguuacccauauaacaggcucucgaaauuacacaaugaaucuagcuucucaaaauuggaguaauuaugauccuacagaagaaaucccagcaccauuaggaacaccagacuucguaggaaaaauacaaggaguacuuacacaaacaaccagaacagauggaucaacaagaggccacaaagcaacaguauacacaggcucagcugauuucgcaccaaaacuuggaagaguucaauuugaaacagacacagacagagauuuugaagcaaaccaaaacacaaaauucacaccuguaggaguaauacaagaugguucuaccacccauagaaaugaaccucaacaauggguacuaccaucauauucagguagaaauacaccaaacguccacuuagcaccugcuguugccccaacuuuuccaggggaacaauuacuuuucuuccgcucaacaaugccaggauguucaggauauccaaauauggaucuugauuguuuacuaccacaagaauggguacaauauuuuuaccaagaagcagcuccagcacaaucagauguagcauuauuaagauucgucaacccagacacagguagaguacuauucgaaugcaaauuacauaaaucuggauauguaacaguugcccacacuggucaacacgauuuaguuauaccaccaaauggauauuucagauucgacucauggguaaaccaauuuuacacauuagcuccuaugggaaauggaacaggacgaagaagagcacuauaa

SEQ ID NO: 32260 - RNA, 1623 nt, Artificial Sequence
  derived and/or modified sequence opt6 from VP1__Norovirus__BAU24960
augaaaauggcaucaaaugacgcaaacccaucagacggaccugcagcaaaucuaguaccagaaguuaacaacgaaguaauggccuuagaaccaguaguaggagccgccauagcagccccaguagcaggacaacaaaaugucauagacccuuggauuagaaauaacuuuguucaagccccuggaggugaauucacagucucaccacgcaaugcuccaggcgaaauucuuuggucagcuccacugggcccagaccuaaaccccuaucuaucacaucucgccagaauguacaauggauaugcuggcgguuucgaaguccaaguaauauuagcuggaaacgcauuuacagcaggaaaaauaauauucgcagcaguaccaccuaauuuuccuacagaaggauuaucaccaucccaaguaacaauguuuccacacauaauaguagacguacgacaacuugaaccaguacuaauaccauuaccagacgucagaaacaacuucuaccacuauaaucaauccaaugacucaacaauuaaacucauagcuauguuauauacacccuuaagagcaaauaacgcuggagaagauguauucacuguaagcugcagaguauuaaccagaccaucaccagacuuugauuuuauauuucuaguaccaccuacaguagaaucacgaaccaaaccauucaccguacccauucuaacaguagaagaaaugaccaacucgagauuuccaauaccacuagaaaaauuauucacuggaccaucaucagcuuuuguaguacaaccacaaaauggaagaugcacaacagacggaguauuauuagguacaacacaauuaucacccguaaauauauguacauuuagaggugacguaacucauauagcaggauccagaaacuacacaaugaaccuagccucauuaaacuggaacaauuaugacccaaccgaagaaauaccugccccucuugguacaccugauuucguagguaaaauacaaggaaugcucacacaaacuaccaaaggagauggcucgacucguggacacaaagcuacaguuuauacagguucagcaccauuuacaccaaaauuagggucgguccaauuugaaacugauacugagaacgacuuugaaacccaccaaaauacaaaauuuacaccaguaggaguaauacaagauggaggaacaacacauagaaaugaaccacaacaauggguauuaccaucauauucuggacgaaaugucccuaacguucacuuagcaccagcuguagcaccaacauuuccaggagaacaacuauuauucuucagaucaauaaugccagguuguucagguuauccaaauauggaucuagauugcuuacuaccacaagaauggguacaacauuucuaucaagaagccgcaccagcacaaucagacgucgcacuacuaagguucguaaacccugauacaggccgaguccuauuugaaugcaaacuacauaaaucuggauauguuacaguagcacacacaggacaacaugaucuaguaaucccuccaaacggcuauuuccgauuugauucuugggucaaccaauuuuacacacuagcuccaauggguaacggcacaggcagaagaagagccuuauaa

SEQ ID NO: 32261 - RNA, 1623 nt, Artificial Sequence
  derived and/or modified sequence opt6 from VP1__Norovirus__BAU24962
augaaaauggcaucaucagacgcaaauccuagugacggauccgcugccaauuuaguaccagaaguaaacaaugaaguuauggcauuagaaccuguaguaggagcagcaauagcagcaccuguagcaggccaacaaaauguaauagauccauggauccgaaauaauuuuguacaagcaccuggaggcgaauuuacaguaucaccacgaaacgcuccuggagaaauucuauggucagccccuuuaggaccagauuuaaauccauaccucucacauuuagcaagaauguacaacggauaugcuggaggauucgaaguucaaguaauacucgcaggaaacgcuuucaccgcuggaaaaguuauauuugccgcuguaccaccaaauuuuccaacagaaggauuaucaccaucacaaguaacaauguucccacacauaguuguagacguaagacaacuugaaccaguauuaauaccauuaccagauguaagaaacaauuuuuaccauuacaaccaaucaaaugacccuacaauaaaauuaaucgccauguuauauacacccuuaagagcaaauaacgcaggagaugacguuuuuacagucucuugucgcguacuaaccagacccaguccugauuuugauuuuaucuuccuaguaccaccaaccguagaaucccgaaccaaaccauuuucaguuccugucuugacaguagaagaaaugacuaacucaagauuccccauuccauuagaaaaacucuuuaccggaccuucaucagcauuuguuguccaaccccaaaauggacgauguacaacagacggaguauuauuaggcacaacacaacuaucaccagucaauauauguacauuuagaggagacguuacacacauaacaggaucaagaaacuacacaaugaaccuagcaucacaaaacuggucaaauuacgacccaacagaagaaauaccagcaccacucgguacaccagacuuuguaggaaaaauacaaggaguacuuacacaaaccaccagaacagauggaucaacuagaggacacaaagcaacaguauauacaggaucugcagacuucgcaccuaaacuaggaagaguacaauucgaaacagacacugaucacgauuuugaagcaaaucaaaauacuaaauuuacaccuguaggaguuauucaagacgguucaaccacacaucgaaaugaaccacaacaauggguacuccccuccuacucaggaagaaacacaccaaauguacacuuagcaccagcuguagcaccuacauucccaggcgaacaauuauuauucuuuaggucaacaaugccaggaugcuccggcuacccaaacauggauuuagauugcuuacuaccacaagaauggguacaauauuucuaucaagaagcagcaccagcucaaucagacguagcacuacuaagauucgucaacccugacacaggcagaguacuuuucgaaugcaaauuacauaaaucaggauacguuacaguagcacauacaggacaacaugaucuaguaauacccccaaacggauauuuucgauucgacuccuggguaaaccaauuuuacacauuagcaccuaugggcaauggaacagguagacgcagagcauuauaa

SEQ ID NO: 32262 - RNA, 1623 nt, Artificial Sequence
  derived and/or modified sequence opt6 from VP1__Norovirus__BAU24964
augaaaauggcuuccaacgacgcuaacccuucagacggaucagcagcaaaccuaguaccugaaguaaacaaugaaguuauggcauuagaaccaguuguuggugcagcaauagcagcaccaguugcaggacaacaaaaugucauagacccauggauacgaaauaauuuuguacaagcaccaggaggagaauuuacaguaucaccaagaaacgcaccaggcgaaauccucuggucagccccauuaggaccagaucucaauccauaucuaucacacuuagcaagaauguacaaugguuacgcaggaggauucgaaguacaaguaauuuuagcaggaaaugcauuuacagccggaaaaauaauauucgcagcuguaccuccaaacuucccaaccgaaggucuaucaccaucacaaguaacuauguucccacacauaauaguagacguaagacaacucgaaccagucuuaauaccauuaccagauguuagaaacaacuuuuaccauuauaaccaaucaaaugacagcaccauaaaacuaauagccauguuauauacaccauugcgagcuaacaacgcaggagaagaugucuuuaccguuagcugucgcguauuaacacgaccauccccagacuucgauuuuauauuucucguuccuccaacaguagaauccagaacaaaaccuuucacaguacccauccuaacagucgaagaaaugacaaauucaagauuuccaauuccauuagaaaaauuauucacaggcccuucuucagccuuuguuguacaaccacaaaacggaagauguacuacggacggcguacuacuaggaaccacacaacuaucaccaguuaauauauguacuuuuagaggagauguaacacauauagccggaucacgaaauuacacaaugaaucucgcaucacuuaauuggaacaacuaugauccaacugaagaaauaccagcaccauuagguacaccagacuuugucggaaaaauacaaggaaugcucacccaaacaacaaaaggagacggaucuacucgaggucacaaagcaaccguuuauacaggaucagcaccauuuacuccaaaacuuggaaguguacaauuugaaaccgauacagaaaaugacuuugaaacacaucaaaauacaaaauucacaccaguaggaguaauccaagauggaggaacaacacacagaaaugaaccacaacaauggguccuacccucauauucaggacgcaauguaccuaacguucacuuagcuccagccguugcuccaacauucccaggagaacaacuauuauucuuccgaucaaucaugccaggauguucuggauacccaaacauggaucuagauugcuuauuaccacaagaauggguacaacauuucuaccaagaagcagcacccgcccaauccgacguagcacuacucagauucgucaacccagacacaggaagaguuuuauuugaaugcaaauuacacaaaucuggauacguaacuguagcucacacaggucaacacgauuuaguaauaccuccuaacggauauuuuagauucgauucauggguuaaucaauuuuacacacuagccccaauggggaauggaacaggacguagaagagcacuauaa

SEQ ID NO: 32263 - RNA, 1623 nt, Artificial Sequence
  derived and/or modified sequence opt6 from VP1__Norovirus__BAU24966
augaaaauggcaucaaaugacgcaaauccaagugauggaagcgcugcaaaucuuguaccagaaguaaauaaugaagucauggcauuagaaccaguaguaggugcagccaucgccgcaccagucgcaggccaacaaaaugucauagacccuuggauacgaaacaauuuuguacaagccccaggaggagaauuuacaguaucaccaagaaaugcaccuggcgaaauauuaugguccgcaccuuuaggcccagauuuaaaucccuauuuaucucacuuagcaagaauguauaacggauacgcaggagguuucgaaguucaaguaauacuugcuggaaaugcauuuacagcaggaaaaauaauauucgcagcaguaccacccaacuuccccacagaaggauuauccccuucacaaguaacaauguuuccacacauuauaguugacguacgacaacuagaaccaguacuaauuccauuaccagauguaagaaacaauuucuaucacuauaaucaaucaaaugacucaacaauaaaauuaauagcaauguuauauacacccuuaagagcaaacaacgcaggggaagauguauuuacaguaucuuguagagucuuaacaagaccaucaccagacuuugauuucauauuuuuaguaccuccuacgguugaaucaagaacuaaaccuuucacaguaccaauauuaacagucgaagaaaugacaaacucacgauuucccauaccauuagaaaaacuauuuacagguccaucaagcgcauucguaguucaaccacaaaauggcagauguacaacugauggaguauuacuaggaacaacacaauuauccccaguaaauauaugcaccuuuagaggugacguaacccauauagcaggauccagaaauuacacaaugaacuuagcuagcuuaaauuggaacaacuacgauccaacagaagaaauaccagccccucuuggaacaccagauuucguaggcaaaauacaagguauguuaacacaaacaaccaaaggagacggaagcacucgaggacacaaagccaccguuuauacaggaucagcaccauucaccccaaaacucggaucaguacaauuugaaacugauacagaaaacgauuucgaaacacaucaaaauacaaaauucaccccaguuggaguaauacaagacggaggcacaacccacagaaacgaaccucaacaauggguccuaccaucuuauucaggaagaaacguaccuaacguacaucucgcuccagcaguagcaccuacauucccaggugaacaacuauuauuuuuucgauccaucaugccaggcugcagcggauauccaaacauggaccuagacugcuuacucccacaagaauggguucaacauuucuaucaagaagcagccccagcacaaucagacguagcccuucuaagauucguaaacccagauacaggacgcguccuuuucgaauguaaacuccacaaaucaggauauguaacugucgcacacacaggacaacacgaucuaguuauuccaccaaauggauacuucagauucgacucauggguaaaucaauuuuacacacuagcucccaugggaaauggaacaggcagaagacgagcauuauaa

SEQ ID NO: 32264 - RNA, 1623 nt, Artificial Sequence
  derived and/or modified sequence opt6 from VP1__Norovirus__BAU24968
augaaaauggcaucaucagacgcuaacccaucagacggcucaacagccaauuuagucccagaaguaaauaaugaaguaauggcacuugaaccaguaauaggagcugcaaucgcagcaccaguugcaggccaacaaaauguaaucgacccauggauaagaaauaauuuuguacaagcaccagguggugaauuuacuguaucaccaagaaacgcgccaggagaaauauuauggucagcuccacuagggccugacuuaaauccauaucuaucacaccuaucacgcauguauaauggauaugccggugguuuugaaguacaaguaauuuuagccggaaaugccuuuacagcaggcaaaauaauauucgcagccguaccaccuaacuucccuacugaaggacuauccccaucacaaguuacuauguucccccacaugauaguagacguacgacaacuugaaccaguauuaauacccuuaccagacguucgaaacaacuucuaucauuauaaccaaucuaaugacaguacaauaaaacuuauagcaauguuauacacuccauuaagagcuaacaacgcaggagaugauguauuuacaguaucuuguagaguacuaacacgaccaucaccagauuuugacuuuauauuucucguuccaccaacaguugaaucuagaacuaaaccauucaguguaccuguauuaacagucgaagaaaugacaaauucacgcuuuccaauaccauuagaaaaauuauucacaggcccauccucagcguucguuguacaaccacaaaacggaagaugcacaacagacggaguacuacuaggaaccacccaacuuucaccaguaaauaucugcacauuuagaggagacguaacucauauaccaggaucacgcaauuacacaaugaaucuugcaucucaaaauuggaauucauacgauccaaccgaagaaauaccugcaccacuaggaacaccagauuucguaggcaaaauacaaggaguauuaacucaaacaacaagaacaaacgguagcacaagaggacauaaagccacaguuuauacaggaucagccgacuucucaccaaaauuaggaagaguacaauucgcaacagacacagauaaugauuucgaaacaaaccaaaauacaaaauucacacccguaggaguaauacaagacggaagcacaacaccacguaacgaaccacaacaauggguauuaccauccuauucaggacgaaauauccacaauguacaucuagcaccugcaguugcaccaacauuuccaggagaacaacuauuauuuuuucguucuacaaugccaggcugcucaggauauccaaauauggaucuagauugcuuacuaccucaagaauggguucaauauuuuuaucaagaagccgcaccagcacaaucagacguugcuuuacuaagauucguaaacccugacacaggacgagucuuauucgaauguaaacuacauaaauccggauauguaacaguagcacacacaggacaacacgaucuaguaauaccaccaaauggauacuuucgcuucgacagcugggucaaucaauuuuacacucuagcaccaaugggaaauggcacaggaagaagacgagcuuuauaa

SEQ ID NO: 32265 - RNA, 1623 nt, Artificial Sequence
  derived and/or modified sequence opt6 from VP1__Norovirus__BAU24972
augaaaauggccucaucugaugcuaauccaagugauggaucagcagcaaaucuaguaccagaagucaauaaugaaguaauggcauuagaaccaguaguuggagccgcaauagcagcccccguagcuggacaacaaaacguuauagaucccuggauaagaaauaauuuuguucaagcaccaggaggugaauuuacaguuaguccaagaaaugcaccuggagaaauucuauggagugcaccauuggguccagaucuaaauccuuaccuaucacaucuagcaagaauguacaauggauacgcuggagguuuugaaguacaaguuauacuagcaggcaaugcauuuacagcaggaaaaguaauauuugcagcaguaccaccaaauuuuccaacagaaggacucuccccaucccaaguaacaauguucccacauauaguaguagacguuagacaacuagaaccaguacuaaucccccuuccagauguacguaauaacuuuuaucacuauaaccaaagcaaugacccaacaauaaaguuaauugcaauguuauauacuccuuuaagagcuaauaaugcaggugaugauguauucacaguaucaugucguguucuaacaagaccaagcccugauuuugauuuuauauuucuaguaccacccacuguagaaucccgaaccaaaccauuuuccguaccugucuuaacaguagaagaaaugacaaauucacgcuuuccaaucccauuagaaaaauuauucacaggccccuccuccgcauucguaguacaaccucaaaacggaagaugcacaacagauggaguuuuauuaggaacuacacaacuuucuccagucaacauuuguacauuucgaggagauauaacacacauaacaggaucaagaaacuauacaaugaauuuagcaucucaaaauuggucaaauuaugauccaacagaagaaauaccagcaccacuaggcacaccugacuuuguaggaaaaauccaaggaguacuaacucaaacuacaagaacagacggaucaacaagaggacauaaagcaacaguuuauacugguucugcagacuuugccccuaaauuaggaagaguucaauuugaaacagauacagaucaugauuucgaagccaaucaaaauacaaaauucacaccuguuggcguaauacaagaugguagcacuacacaccgaaacgaaccacaacaauggguucuaccuuccuacucaggaagaaauacaccaaauguccaucuagcaccagcaguagcaccuaccuuuccuggagaacaauuauuauuuuuuagaaguacuaugccugguuguaguggauacccaaauauggacuuagauugucuacuaccacaagaauggguacaacacuuuuaucaagaagcagcuccagcucaaucagacguagcuuuauuaagauuugucaacccagacacaggaagagucuuauuugaguguaaacuacauaaaagcgguuaugucacuguagcacauacaggacaacaugaucuuguuauacccccuaauggauauuuucgauucgauucguggguaaaucaauuuuauacacuagccccaauggguaauggaacagggcgcagaagagcacuauaa

SEQ ID NO: 32266 - RNA, 1623 nt, Artificial Sequence
  derived and/or modified sequence opt6 from VP1__Norovirus__BAU24974
augaaaauggcaagcucagaugcaaauccaucugacggaucagccgcaaacuuaguaccagaaguaaauaaugaaguaauggcauuagaaccaguaguaggugccgccauagcugccccaguagccggacaacaaaacguaauugacccauggauacgaaauaauuucguacaagcaccaggaggcgaauuuacuguaucaccaagaaaugcaccuggagaaauauuauggucugcaccucuaggaccagacuuaaauccauaucuaagucaucuagcaagaauguacaacggauaugcaggaggauuugaaguacaaguaaucuuagcaggaaaugcauuuaccgcuggaaaaguuauauuugcagcuguaccuccuaauuuuccaacagaaggacuaagucccucacaaguaacaauguucccucauauaguuguagauguacgucaacuugaaccaguguuaauaccauuaccugauguaagaaacaacuucuaucacuauaaccaaucaaacgacccaacaauaaaauuaauagcaauguuauacacaccauuacgugcaaauaaugcaggugaugacguauuuacaguuuccuguagaguuuuaacgcgcccuucacccgauuuugacuuuauauuccuaguaccaccaacaguugaaucaagaacaaaaccuuucucgguuccagucuuaacuguagaagaaaugacuaauucccgauucccaauaccgcuugaaaaacuauuuacaggaccaucauccgcauucguaguccaaccacaaaacggaagauguacaacagacggaguauuauuagguacaacacaacuaucuccaguaaauauuugcacauuuagaggagauguaacucauauaaccggcuccagaaauuauacaaugaaucuagcuucacaaaacuggucuaauuaugacccuaccgaagaaauaccagcuccauuaggaaccccugauuucguaggaaaaauacaaggaguauuaacacaaacaacaagaaccgacggaucuacaagaggucauaaagccacaguauauaccggaucagcugacuuugcaccaaaacucggaagaguacaauuugaaacagauaccgaucgagauuucgaagcuaaucaaaacaccaaauucaccccaguaggaguuauacaagacgguucaacaacacaucguaacgaaccacaacaauggguauuaccaucauauucgggaagaacaacaccaaacguacaccuagcuccagcuguugcaccuaccuuucccggagaacaacuauuauuuuuuagaucuacaaugccagggugcucaggauauccuaauauggacuuagacugucuucuaccacaagaauggguacaauauuucuaucaagaagcagcaccagcacaaucagauguugcauuacuacgauuuguuaauccugauacagguagaguccuauucgaauguaaauuacauaaauccggauacgucaccguagcacauaccggccaacaugauuuaguaauaccaccaaauggcuacuuucgcuuugauuccugggucaaucaauucuacacucuagcuccaaugggaaaugguacuggccgccguagagcuuuauaa

SEQ ID NO: 32267 - RNA, 1623 nt, Artificial Sequence
  derived and/or modified sequence opt6 from VP1__Norovirus__BAU24976
augaaaauggcaucaucagaugccaacccaucagacggaucagccgcaaaccuuguaccagaagucaacaaugaaguuauggcucuagaaccaguagugggagcagcaauagcagcaccugucgcaggacaacaaaauguaauagacccauggauaagaaauaacuuugugcaggcuccuggaggugaauuuacaguaucaccgagaaaugcacccggagaaauacuauggucagccccacucggaccagacuuaaauccuuaccucucccacuuagccagaauguauaauggauacgcaggaggauuugaaguacaaguaauauuagcugguaaugcauuuacagcaggaaaaguaauauucgccgccguaccaccaaacuuuccaacugaaggacuauccccaucacaaguuacaauguucccacauauaguaguagacguaagacaauuagaaccaguacuaauacccuuaccugacguaagaaacaacuucuaucacuauaaccaaucaaaugacccaacaauaaaauuaauagcaauguuauacaccccauuacgugcaaacaaugcaggugacgauguauucacaguaucuuguagaguucuaacaagaccaucaccugacuuugacuuuauauuccucguaccaccaacaguagaaagccgcacuaaaccauuuucaguaccaguuuuaaccguagaagaaaugacaaauucuagauuucccauaccuuuagaaaaacuauuuacaggcccuucaagugcuuucguuguacaaccccaaaauggcagauguacaacagacggaguauuacuaggcacaacacaauuaucaccugucaauauaugcacuuuucguggcgauguuacucauauuacaggcucuagaaauuauacaaugaaucuagccucacaaaacuggaacaacuacgauccuacagaagaaauaccagcaccacuagguacucccgacuucguaggaaaaauacaaggagucuuaacacaaaccacaagaacagauggauccacuagaggacacaaagcaacaguauacacaggaucagcagauuuugcaccuaaacuuggccgcguacaauucgaaaccgauacagaucaugauuucgaagcaaaucaaaauacaaaauuuacaccuguuggcguuauacaagauggagguaccacacacagaaacgaaccacaacaauggguacuaccuucuuacucagguagaaauacucccaacguacacuuagcaccagcagucgcaccaacauuucccggagaacaauuauuauuuuuucgcuccacaaugccaggcugcuccggcuauccaaauauggaucuagauugucuacuaccacaagaauggguacaauauuucuaucaagaagcagcaccagcacaaucagaugucgcacuacuucgauucguaaacccagacacaggcagaguacuuuucgaaugcaaacuacauaaauccggauauguaacaguagcacacacaggacaacacgauuuaguaauaccaccaaauggcuacuucagauucgauucauggguaaaucaauuuuauacucuagcaccaaugggcaauggaaccggaagaagaagagcacuauaa

SEQ ID NO: 32268 - RNA, 1623 nt, Artificial Sequence
  derived and/or modified sequence opt6 from VP1__Norovirus__BAU24978
augaaaauggcauccucagaugcaaacccuucugauggaucagcugcaaaucuaguccccgaaguaaauaaugaaguaauggcuuuagaaccuguagucggagcagcuauagcagcuccaguagcuggacaacaaaauguaauugaccccuggauaagaaacaacuuuguacaagcaccaggcggagaauuuacaguaucaccuagaaaugcaccuggggaaauccuuuggucugcaccuuuagguccagaucuaaauccuuacuuaucacauuuagcaagaauguauaauggauacgcaggaggauuugaaguccaaguaauacuugcaggaaaugcauuuacagccggaaaaguaaucuuugcagcaguuccaccaaacuucccaaccgaagguuuauccccaucucaagucacaauguuuccacacaucguaguagauguacgacaauuagaacccguuuuaauuccuuuaccagacguaagaaauaauuuuuaccauuauaaucaaucaaaugauccaacuauuaaauuaauagcaauguuauacaccccucucagagcaaauaaugcuggugacgauguauuuacaguuagcugucgaguacuaacgagaccaucaccagacuucgacuuuauauuucuaguccccccuacugucgaaucaagaacuaaaccuuucuccguaccaguauuaaccguagaagaaaugacuaauucacgauuccccaucccauuagaaaaauuauuuacaggaccaucuuccgcauucguaguccaaccacaaaauggaagauguacaacagauggaguauuacuaggaacaacacaacuauccccaguaaacauuuguacauuucgaggugauguaacacauaucacaggcucaagaaauuauacuaugaaucuagccucacaaaauuggucaaacuacgauccaacagaagaaauaccagcaccuuuaggaacaccagacuuuguaggaaaaauacaagguguacuuacucaaacaacacgaacagacggcuccacacgaggacauaaagcaacaguauauacaggcucagcagacuuugccccaaaauuaggaagaguacaauuugaaaccgauacagaccacgauuuugaagcuaaccaaaauacuaaauuuacaccaguaggaguaauacaagaugguucaacaacucauagaaacgaaccccaacaauggguacuuccuucauauucagguagaaauacuccaaacguacauuuagcaccugcaguagcaccaacauucccaggagaacaacuauuauuuuuccgaucaacuaugccugguuguucaggcuauccaaauauggaccuagacugccuauuaccacaagaauggguacaauauuuuuaucaagaagcugcacccgcacaguccgacgucgcauuacuacgcuuuguaaauccagauaccggucgaguacuuuuugaaugcaaauuacauaaaagugguuacguaacagucgcacauacaggacaacacgaucuaguaauccccccaaaugguuauuuccgauuugauucauggguaaaucaauuuuacacauuagcaccaaugggaaaugguacagguagacguagagcauuauaa

SEQ ID NO: 32269 - RNA, 1623 nt, Artificial Sequence
  derived and/or modified sequence opt6 from VP1__Norovirus__BAU24980
augaaaauggccucaucugaugccaauccuucagacggaucagcagcaaauuuaguaccagaaguaaacaaugaaguaauggcauuagaaccaguagucggagcagcaauagcugcacccguagcaggucaacaaaauguaauagacccauggauuagaaacaacuucguacaggccccaggaggugaauuuacaguaucaccuagaaaugcaccaggagaaauuuuauggucagcaccccuuggaccagaucuaaauccauaucuuucucaccuugcaagaauguacaacggcuacgcaggaggguucgaaguacaaguaauauuagcaggaaaugcauuuacagcuggcaaaguaauauucgcagcaguccccccuaacuuuccaacagaaggacuaucaccuagucaaguaacaauguuuccccauauuguaguagauguuagacaacuagaaccaguacucauaccauuacccgacgucagaaauaauuuuuaucauuacaaccaaucaaaugacccaacuauuaaauuaauagcaaugcucuauacuccacucagagcaaacaacgcaggagacgauguauucacaguaagcuguagaguacuuacucgaccaucaccagacuuugacuuuaucuucuuaguuccucccacaguugaaucuagaaccaaaccauuuucuguaccaguacuaacaguagaagaaaugaccaauucacgauucccaaucccccuagaaaaauuauuuacagguccaucuucagccuucguaguacaaccacaaaauggacgcuguacaacagauggaguauuauuaggaacaacucaauuaucaccuguuaacauaugcacauucagaggugauguuacacacauaacuggaucucgcaauuauacaaugaacuuagcaucucaaaauuggucaaauuaugauccuacugaagaaaucccggcuccacuaggaacuccagauuucgucgguaaaauacaaggaguacucacacaaacaacacgaacagacggcucaacaagaggucacaaagcuacaguauauaccggcucugcagacuuugcaccaaaauuaggaagaguacaauucgaaacagacacagaccaugauuuugaagccaaucaaaauacaaaauuuacuccaguaggaguuauacaagacggaucaacuacacaucgaaaugaaccucaacaauggguacuaccaucauauucagguagaaauacccccaauguacauuuagcaccagcaguagcaccuacuuuuccaggagagcaacucuuauucuuucgauccacuaugccaggauguuccggauacccaaacauggaucuagauugcuuauuaccacaagaauggguacaauacuucuaucaagaagcugcucccgcucaaucagauguugccuuacuaagauucgucaaucccgauacaggacgagucuuauucgaaugcaaacuacauaaaagcggauacgucacaguugcccacaccggacaacaugaucuaguuauuccuccaaacggauacuucagauuugauucauggguaaaucaauuuuauacacuagcucccaugggaaacggaaccggaagaaggagagccuuauag

SEQ ID NO: 32270 - RNA, 1623 nt, Artificial Sequence
  derived and/or modified sequence opt6 from VP1__Norovirus__BAU24982
augaaaauggcaucaagugacgcuaacccaucagauggaucugccgcaaauuuagucccugaaguaaacaacgaaguaauggcauuagaaccaguaguaggagcugcaauagcggcaccaguagcuggucaacaaaauguuauagacccauggauaagaaauaauuucguacaagcgccuggaggagaauuuacaguuucaccaagaaaugcaccaggagaaauacuauggucagcaccacuagguccagauuuaaauccauauuuaucacacuuagcacgaauguauaauggauaugcaggcggauucgaaguacaaguaauacuagcaggaaaugcauuuacagcaggaaaagucauauucgcagcaguucccccuaacuucccaacugaaggucuauccccaucucaaguaacuauguucccucauauagucguagauguacgacaauuagaacccguucuaauuccacuuccagauguccgaaacaauuuuuaucacuacaaucaaagcaaugacccuacaauaaaacucauagccauguuguacacuccacugcgcgcaaacaaugcaggugaugauguauuuacaguuucaugcagaguacuaacaagaccuucaccagauuucgacuuuauauuuuuagucccuccaacaguagaauccagaacaaaaccauuuucagucccaguuuuaacaguagaagaaaugacaaacucaagauuuccaauacccuuagaaaaacucuuuaccggaccaucuucagcuuuuguaguacaaccacaaaauggaagaugcacaacagacggaguauuacuaggaacaacccaauuauccccaguaaauauaugcaccuuucgaggagauguaacccauauuacagguucacgaaauuacacaaugaaucucgcuagucaaaacugguccaauuacgauccaacagaagaaauacccgcacccuuaggaaccccagacuuuguaggaaaaauacaagguguauuaacacaaaccacacgaacagacggaucuacaagaggacauaaagccacugucuauacaggauccgcaaacuucgcaccaaaauuaggaagaauccaauuugaaacugauacagaucacgacuuugaggccaaucaaaauacaaaauucacccccguaggaguaauacaagauggaucaacuacacaucgaaaugaaccucaacaauggguauuaccaucuuacucaggaagaaauacaccaaauguacacuuagcaccugccguagcaccuacauuucccggagaacaacuccuauucuuuagaaguacaaugccagguuguuccggauaucccaauauggaccuagacuguuuacuaccacaagaauggguacaauauuuuuaccaagaagcagcacccgcccaaucagacguagcauuauuaagauuuguaaauccugacacaggaaggguccuauuugaauguaaacuacauaaauccggauaugucacaguugcacauacaggacaacacgacuuaguaauaccaccuaauggauauuuuagauucgauucuuggguaaaucaauuuuauacuuuagcacccaugggcaacggaacuggccgacgaagagcauuauaa

SEQ ID NO: 32271 - RNA, 1623 nt, Artificial Sequence
  derived and/or modified sequence opt6 from VP1__Norovirus__BAU24984
augaaaauggcaucaucagacgcuaauccaucagauggaucugccgccaaccuaguaccagaaguuaacaaugaaguuauggcacuagaaccaguuguaggugcagcaauagcagcuccuguagcaggacaacaaaacguaauugauccuuggaucagaaacaacuuuguacaagcaccagguggcgaauucaccguaagcccaagaaaugcuccaggcgaaaucuuauggucugcuccacuuggcccagauuuaaacccauaucuaucacacuuagcacguauguacaaugguuacgcaggaggauuugaaguacaagugauucuagcuggaaaugcauucaccgcaggaaaaguaauauucgcugcaguaccaccuaacuuuccaacagaaggauuaucaccgagucaaguaacaauguucccucauauagucguagauguucgacaacuagaaccagucuuaauuccauuaccagacguuagaaacaauuuuuaucacuacaaccaaucaaacgacccaacaauaaaauuaauagcaauguuauacacaccucuaagagcaaauaaugcaggagacgacguauuuacaguauccuguagaguacuaacuagaccuucuccugacuuugacuuuauuuuucuaguacccccuacaguagaaucuagaacaaaaccuuuuucaguuccaguauuaacagucgaagaaaugacaaauagcagauuuccaauucccuuagaaaaauuauuuacuggaccauccuccgcauucguuguccaaccacaaaauggaagaugcacaacagacgguguauuacucgguacaacucaauuaaguccaguaaauauaugcacauucagaggagauguaacacacauaacaggauccagaaauuacacaaugaauuuagcaucacaaaacuggucuaacuacgacccuacugaagaaaucccagccccacuaggaacccccgacuuuguaggaaaaauacaaggaguauuaacacaaacaacaagaaccgacggaaguacaagaggccauaaagcuacuguauacacaggaucagcagacuuugcaccuaaacuaggaagaguacaauucgaaacagauacagaccacgacuucgaagcaaaucaaaauacaaaauucacacccguaggaguuauacaagacggaucaacaacucacagaaaugaaccccaacaauggguacuaccuucguauucaggaagaaauacaccaaauguucauuuagcaccagcaguagcaccuacauuccccggugaacaacuacucuucuuucgaucaacaaugccaggaugcucaggauauccaaauauggauuuagacugcuuacuaccacaagaauggguucaauauuuuuaucaagaagcagcuccagcacaaucagacguagcauuacuacgauucgucaauccagacacuggaagaguuuuauucgaauguaaacuacacaaaucaggauauguaacaguugcccacacuggacaacacgacuuagucauaccuccaaacggauacuuccgauuugauucauggguaaaucaauucuacacacucgcaccaaugggaaauggaacaggaagaagacgagcacuauaa

SEQ ID NO: 32272 - RNA, 1623 nt, Artificial Sequence
  derived and/or modified sequence opt6 from VP1__Norovirus__BAU24986
augaaaauggcaagcucugacgcaaacccuucugauggauccgcagccaaccuaguaccagaagucaauaaugaaguaauggcauuagaaccaguuguaggagccgcaauugcugcaccaguagcaggucaacaaaacguuauugauccauggaucagaaacaauuucguacaagcacccggaggagaauuuaccguauccccccgaaacgcaccaggagagauacuauggucugcucccuuaggcccagaucuaaauccauauuuaucacacuuagcaagaauguacaauggauacgcaggcggauucgaaguacaaguuauacuugcuggaaacgcauucacagccggaaaaguuauuuuugcugcuguaccaccaaacuuuccaacagaaggauuaucaccaucccaaguuacuauguuuccacacauaguaguagacguuagacaauuagaaccaguauuaauaccauuacccgauguuagaaacaacuuuuaucacuauaaucaaucaaaugauccaacaauaaaauuaauagcuaugcuauacacaccuuuaagagccaacaacgcuggcgaugacguauuuacaguguccugcagaguucuuacacguccuucaccugauuuugacuucauauucuuaguuccaccuacaguagaaucacgaacaaaaccauucucaguaccuguacuaacagucgaagaaaugacaaauucuagauuuccaaucccuuuagaaaaacuuuucacaggaccaucaucagcuuuuguaguacaaccacaaaacggacgaugcaccacagacggaguccuacuaggcacaacacaauuauccccagucaauauuuguacuuuuagaggagauguuacucacauaaccggaucccgcaacuauacuaugaaccuagccucacaaaacuggucaaauuacgacccuacagaagaaauaccagcaccacuagguacaccugauuucguaggaaaaauacaaggaguguuaacacaaaccacacguacagauggaagcacaagaggucacaaagcaacaguauacacaggaucugcagacuuugcaccuaaauuaggaagaguacaauuugaaacugauacagauagagauuuugaagccaaucaaaauacaaaauucacaccaguagguguaauacaagacggaucaacaacucauagaaaugaaccacaacaauggguauuaccaucauauucaggacgaaauacuccaaacguacaucuugcaccugccgucgcaccaacauuuccaggagaacaauuacuauucuuuagaucaacaaugccaggaugcaguggauauccaaauauggaccuagauugucuacuaccacaagaauggguacaauauuuuuaucaagaagcagcaccagcacaaucugacguugcucuacuacguuucguaaacccugauacaggacguguacuauuugaaugcaaacuacacaaaucagguuauguaacaguagcucauacaggacaacacgaccuuguaaucccaccaaauggauauuucagauucgacucauggguuaaucaauucuacacucuagcaccuaugggaaacggcacaggccgaagaagagcacuauaa

SEQ ID NO: 32273 - RNA, 1623 nt, Artificial Sequence
  derived and/or modified sequence opt6 from VP1__Norovirus__BAU24988
augaaaauggcauccaacgacgcaaacccaucugauggcucagcagcuaaccuaguaccagaaguuaacaaugaaguaauggcacuugagccugucguuggagcugcaauagcagcaccuguagcaggacaacaaaauguaauagacccuuggauaagaaauaacuuuguacaagcaccaggaggcgaauuuacaguaucaccaagaaaugcaccaggcgaaauacuauggucagcaccauuaggaccagaccuaaauccauaucuaucgcaucuagcuagaauguauaacggauaugcaggaggauucgaaguccaaguaauacucgcuggaaacgcauucacagcaggaaaaauuauuuucgcagcaguaccaccaaacuuucccacugaaggacucuccccaucacaaguaacuauguuuccucacauuaucguagacguaagacaauuagaaccgguauuaaucccucuaccagauguacguaacaauuucuaucacuauaaccaauccaaugauucaacaauaaaacucauagcuaugcucuacacuccccuaagagcaaacaaugcuggagaagaugucuuuacagucucaugcagagugcuuacuagaccaucaccagauuuugacuuuauauuuuuaguaccaccaacuguugaaucuagaacaaaaccuuucacaguucccauucuaacuguugaagaaaugacaaauucacgauucccaauucccuuagaaaaauuauucacaggaccauccagcgcauuuguuguacaaccacaaaacggaagaugcaccacagacggagucuuauuaggcacaacacaauuaucaccaguaaacaucugcacauucagaggugacguaacacauauagcagguucgagaaauuacacaaugaauuuagcuucacuaaacuggaauaacuacgacccaacagaagaaauaccagccccauuaggaacaccugacuuuguaggaaaaauacaagguauguuaacacaaacaacaaaaggugauggaucaacaaggggacacaaagcaaccguauauacaggaucugcaccuuuuacaccuaaauuaggcucaguacaauuugaaacagauaccgaaaaugauuuugaaacccaccaaaauacaaaauucacaccugucggugucauccaagauggcggaacaacccaucguaaugaaccacaacaaugggucuuaccauccuacagcggaagaaacguacccaacguacacuuagcaccagcaguagcaccaacauuuccaggagaacaauuacuuuucuuccguucaacuguaccugguuguucuggauauccaaauauggaucuagauugcuuacuaccacaagaauggguccaacauuuuuaucaagaagcagcuccagcacaaucugacguagcacuucuuagauuuguuaacccagauacaggucgaguccuauuugaauguaaacuacacaaaucaggauacgucacuguagcacauaccggccaacacgacuuaguuauaccaccaaauggauauuucagauuugauucuuggguaaaucaauucuacacauuagcuccaaugggaaauggaacaggaagaagacgugcucuauaa

SEQ ID NO: 32274 - RNA, 1623 nt, Artificial Sequence
  derived and/or modified sequence opt6 from VP1__Norovirus__BAU24990
augaaaauggccucuucugacgcaaauccauccgacggaucugcagccaacuuaguaccagaaguaaacaaugaaguaauggcuuuagaacccguaguaggagccgcaauagcugcaccuguagcaggacaacaaaacgucauagacccuuggauuagaaacaacuuuguacaagcaccaggaggagaauuuacagucucaccuagaaaugcaccuggugaaauucuauggucagcaccacuuggaccugaucuaaacccauauuuaucacacuuagcaagaauguauaauggauacgccggaggauucgaaguacaaguaauauuagcuggaaaugccuuuacagccggaaaaguaaucuucgcagcaguaccaccuaacuuuccaacugaaggacuauccccaagucaagucacaauguuuccacauauaguuguagacguucgucaacuagaaccuguacuaauuccacuaccagacguaagaaauaacuuuuaucauuauaaucaauccaacgauccaacuauaaaacuaauugcaauguuguacacccccuuaagagccaacaaugcaggagacgauguauuuacaguuucaugcagaguauuaacuagacccucaccugauuuugacuuuauauuuuuagucccacccaccgucgaaucacguaccaaaccuuuuucaguaccaguauuaacaguagaagaaaugacaaacucucgcuucccaauuccauuagaaaaauuauucacuggaccaucauccgcuuucguaguacaaccacaaaauggacgaugcacaacugacgggguacuacucggaacaacacaacucucuccaguaaauaucuguaccuuucgaggcgauguaacacauauaacaggaucucacaauuauacuaugaauuuagcaucccaaaauuggaacaacuaugauccuacagaagaaauaccugcuccauuagggacaccagauuucguaggaaaaauacaaggagucuuaacacaaacuacaagaacugaugguucaacaagaggacauaaagcaacaguauacacgggcucagcugacuuugcaccuaaauuaggaagaguacaauucgaaacagauaccgaccaugacuuugaagcaaaucaaaauacaaaauuuacaccaguaggaguaauacaagacggaggaacuacucauagaaaugaaccacaacaauggguauuaccaucauauuccggaagaaauacacauaacguacauuuagcaccugcaguagcuccaacauuuccaggagaacaauuacuauucuuuagaucaacuaugccagguuguagcgguuauccaaauauggauuuagacugccuacucccccaggaauggguacaauauuuuuaucaagaggcagcaccagcucaaucagauguagcacuccuaagauuugucaacccagacacaggccgaguacucuucgaaugcaaauuacauaaaucaggauauguaacaguagcacacacaggacaacacgaucuaguaauaccuccaaacggauauuuccgauucgacucuuggguaaaucaauuuuacacacuagcaccuaugggaaacggcacuggaagacgacgagcaguauaa

SEQ ID NO: 32275 - RNA, 1623 nt, Artificial Sequence
  derived and/or modified sequence opt6 from VP1__Norovirus__BAU24992
augaaaauggcaucaucagaugcuaauccaucugacggcucagcugcuaaucuaguuccagaaguaaacaaugaaguuauggccuuagaaccaguuguaggagcggcaauagcagccccaguugcuggccaacaaaauguaauugauccauggauaagaaacaauuuuguacaagcaccaggaggagaauuuacagucuccccaagaaaugccccaggcgaaauauuauggucagccccauuaggaccagaccuuaacccuuacuuaucgcaucuagcccgaauguauaacgguuaugcaggaggauucgaaguucaaguuauacuagccggaaaugcauucacagcaggaaaaguaauauuugccgcaguaccaccaaauuuucccacagaaggauuaucucccucucaaguaacaauguuuccucauauaguaguagacguuagacaacucgaaccaguacuaauaccuuuaccagacgucagaaacaauuuuuaucacuauaaucaaagcaaugacccaaccauaaaauuaauugcuauguuauauacaccacuuagagcaaauaaugcuggagaugauguauuuacaguaucuuguagaguacucacuagaccuuccccagacuuugauuuuauauuucuaguaccaccaacaguagaaaguagaacuaaaccuuuuucaguuccaguccuaacaguagaagaaaugacaaacucaagauucccaaucccuuuagaaaaauuauuuacaggaccaucuagugcauucgucguacaaccacaaaacggucgauguacuacugacggaguacuauuaggcaccacacaacuaucuccuguuaacauaugcacauuuagaggagacguaacacauauaacaggcaguagaaauuacacuaugaauuuagcaucccaaaacuggucaaauuaugacccaacagaagaaaucccugcuccucuaggaacaccagacuucguaggaaaaauacaaggaguauuaacacaaacaacaagaaccgauggaucaacaagaggccauaaagcuacuguauauacugguucagcagauuuugccccaaaauuaggacgaguacaauucgaaaccgauacagauagagauuuugaagcaaaucaaaauaccaaauuuacaccaguaggaguaauacaagacggaucaacaacacaucgaaacgaaccacaacaauggguucuuccaucuuauagcggacgcuauacuccaaacguucaccuugcaccagcaguagcaccaacuuuuccaggugaacaacuauuauucuucagaucaacaaugcccggcuguuccggauacccaaauauggaucucgacugcuuacuaccacaagaauggguccaauacuuuuaccaagaagccgcaccagcacaaucagacguagcacuacuacgauuuguaaauccagauacagguagagucuuauuugaauguaaacuucacaaaucagguuauguaacagucgcucauacaggacaacacgacuuaguaauaccacccaauggauacuuucgauucgauucauggguaaaccaauuuuauacccucgcaccaauggguaauggaacuggcagaagacgugcuuuauaa

SEQ ID NO: 32276 - RNA, 1623 nt, Artificial Sequence
  derived and/or modified sequence opt6 from VP1__Norovirus__BAU24994
augaaaauggcaagcucugacgccaauccaagugauggaucagcugcuaaccuaguaccugaaguaaacaacgaagucauggcacuagaaccaguugucggcgccgcuauagcagccccaguagcuggacaacaaaacguaaucgauccauggauaagaaauaacuucguacaagcaccaggaggcgaauuuaccgugucaccaagaaaugcaccaggagaaauauuauggucagcaccacuaggaccagaucuaaauccauauuuaucacaccuugcaaggauguacaacggauaugcaggcggauucgaaguucaaguaauacuagccggaaaugccuucacugcaggaaaaguaauauuugcagcggucccacccaacuuuccaacugaaggccuaucaccuucacaaguuacaauguucccacacauaguaguagacguacgacaauuagaaccuguccuaauacccuuaccagacguaagaaacaauuucuaucacuacaaccaaucaaacgauccaacaauuaaacuuauagccauguuauacacaccccuaagagcuaacaaugcaggcgaugauguauuuacugugucaugucgaguauuaacaagaccaucaccagacuuugauuuuauauuucuuguaccaccaacaguagaaucaagaacaaaacccuucaguguuccaguauuaacaguagaagaaaugacuaacucucgcuuuccaauacccuuagaaaaauuauucacaggcccuaguucagcauuuguaguacagccacaaaauggaagaugcacaacagacggaguacuucuaggcacaacucaauuaucaccuguuaacauauguacuuucagaggagacgucacacauauuacaggaucuagaaauuacacaaugaaucuagccucacaaaacuggaacaauuacgauccaacagaagaaauaccagcaccauuaggcacacccgacuucgucggcaaaauccaagguguacuuacacaaacaacucgcacugacggaucaacaaggggacauaaagcuacaguauauacaggauccgcagauuuugcuccaaaauugggaagaguccaauucgaaacagauaccgaucacgacuucgaagcgaaccaaaacaccaaauucacaccaguuggcguaauacaagauggaggaacaacacacagaaaugaaccacaacaauggguauuaccaucauacucaggaagaaacacacauaauguccacuuagcaccagcaguugcaccaacauucccaggagaacaauuauuauucuuuagauccaccaugccaggauguucaggauauccaaauauggaccuagauuguuuauuaccccaagaauggguacaauauuucuaucaagaagcagcaccagcacaaagugauguggcacuauuaagauucguaaacccagacacaggcagaguauuauucgaauguaaauuacauaaaucugguuacguaacagucgcacacacaggacaacacgaucuaguaauaccaccaaauggauacuucagauucgacucauggguaaaucaauuuuacacauuagcaccaauggguaacggaacaggacgaagacgagcaguauaa

SEQ ID NO: 32277 - RNA, 1623 nt, Artificial Sequence
  derived and/or modified sequence opt6 from VP1__Norovirus__BAU24996
augaaaauggcaucauccgaugccaauccaucagauggaucagcagcaaauuuaguaccugaagucucaaaugaaguuauggcacuagaaccaguuguaggcgcagccauagccgccccaguagcuggacaacaaaacguaauagacccauggauuagaaauaacuuuguccaagcacccggaggugaauuuacaguaucuccacguaaugcaccaggagaaauauuaugguccgcuccauuaggacccgaccuaaauccauaccuaucacaucuagcaagaauguauaacgguuaugcaggaggauuugaaguacaagucauuuuagcuggaaaugcauuuacagcuggaaaagucauauucgcugcuguaccaccaaacuuuccaacagaaggucuuucuccaucacaaguaacuauguucccucauauugucgucgacguuagacaacucgaaccaguccuaauaccacuuccagauguaagaaauaauuuuuaucauuauaaccaaucaaaugauccaaccauuaaacuuauugcaauguuauauacaccccuaagagcuaauaaugcaggugacgacguuuucacaguaagcugccgcguacuaacccgaccaucccccgacuuugacuuuaucuuucuaguaccaccaacaguagaaucuagaaccaaaccauucuccguacccguauuaacagucgaagaaaugacaaauucaagauucccaauaccauuagaaaaauuguucacaggaccaucuucagcauucguaguacaaccacaaaacggaagauguacaacugauggaguauuauuaggaacuacucaacuauccccagucaacauaugcacauuuagaggagacguaacccacauaacgggaucaagaaauuauacaaugaaucuagcaucacaaaauugguccaauuaugacccaacagaagaaauaccagccccuuuaggaacaccagacuuuguagguaaaauucaagguguauuaacccaaacaacacguacagacgguucaacuagaggacauaaagcaacuguauacaccggaucagcugauuuugcaccuaaacuaggaagagugcaauuugagacagacacagauagagacuucgaagcaaaccaaaauacaaaauuuacaccaguaggaguaauacaagauggaucuacuacacaucgaaaugaaccucaacaauggguacuaccaaguuacagcggaagaaauacuccuaacguccacuuagcaccagcaguugccccuacauuuccaggagaacaacuauuauucuuuagaucuacaaugccagguugcucaggcuauccaaauauggauuuagauugcuuacuaccucaagaauggguacaauacuucuaucaggaagcagccccagcacaaucugauguugccuuauuaagauucguaaacccugauaccggaagaguuuuauuugagugcaaacuucauaaaucuggauauguaacaguagcacacacaggacaacacgauuuaguaauaccaccuaauggcuacuuuagauucgauuccugggugaaucaauuuuauacccuagcaccaauggguaauggaacaggcagaagaagagcacuuuaa

SEQ ID NO: 32278 - RNA, 1623 nt, Artificial Sequence
  derived and/or modified sequence opt6 from VP1__Norovirus__BAU24998
augaaaauggccucaucggacgcgaauccaucagauggaagcgcagcaaaucuagucccagaaguuaauaacgaaguuauggcuuuagagccaguuguaggggccgcaauugcugcaccaguagcaggacaacaaaauguaauagacccuuggauuagaaauaauuuuguacaagcacccggaggagaauuuacaguuucaccuagaaaugccccuggagaaauacuauggagugccccacuaggaccagauuuaaauccauaccuuucacaucuagcaagaauguauaauggcuacgcuggcggauucgaaguacaaguaauucuagcuggcaacgccuucacagcaggcaaaguaauauucgcagcaguuccaccaaacuuuccaacagaaggacucucaccaucacaaguaacaauguucccacauauaguagucgacguacgucaacuagaaccaguucuuauuccauuaccagauguuagaaacaauuuuuaucacuauaaucaaucuaaugaccccacaauuaaauuaauagcaaugcuauacacaccauuaagagcuaauaaugcaggagacgauguauuuacugucucauguagaguacuaacacgaccuucaccugacuucgauuuuauauuuuuaguaccaccaacaguugaauccagaaccaaaccauucucaguaccaguauuaacagucgaagaaaugacaaauucaagauucccuauaccauuagaaaaauuauuuacaggaccaucaagugcauucguuguccaaccacaaaacggaagauguacaacugacggaguauuauuagguacaacucaauuaucaccaguuaauauauguacauucagaggagacguaacccauauaacaggauccagaaauuauaccaugaaccuagcuucacaaaacuggaguaauuaugacccuacagaagaaauaccugcaccacuuggaacaccagacuuugucggaaaaauucaaggagucuuaacacaaacaacacguacugauggaucaacacgaggccacaaagcaacuguauauacagguucagcagacuuugcaccaaaauuaggccgaguacaauucgaaacagauacagaccacgauuucgaagcaaaucaaaacacaaaauuuacaccaguaggaguaauacaagaugguucaacaacccauagaaaugaaccccaacaauggguucuaccaucauauagugguagaaauacuccaaauguacauuuagcccccgcaguagcaccaacuuuuccaggagaacaacucuuauucuucagaaguacaaugccaggauguuccggauaucccaauauggaccuagauuguuuacuaccucaagaauggguucaauauuuuuaccaagaagccgccccagcccaaucagacgucgcauuacucagauucguaaacccagauacaggcagaguauuauucgaauguaaacuacauaaaucaggauacgucaccguggcacacacuggacaacaugacuuaguuauaccaccuaacggauauuuucguuucgauucuuggguaaaucaauucuacacacuagcucccaugggaaauggaacaggacgaagaagagcucuuuaa

SEQ ID NO: 32279 - RNA, 1623 nt, Artificial Sequence
  derived and/or modified sequence opt6 from VP1__Norovirus__BAU25002
augaaaauggcuucaucagaugcuaauccaucagacggaucugcugccaauuuaguaccagaagucaacaacgaaguaauggcauuagaaccagucguaggagcagcaauagcagcaccugucgcaggacaacaaaacguaauagauccauggauaagaaauaauuuuguacaagcaccaggaggcgaauuuacagucucaccuagaaaugcaccaggugaaauacuaugguccgccccauuaggaccugauuuaaauccauauuuaucacauuuagcaagaauguauaacggauacgcaggaggauucgaaguucaaguaauucuugcaggaaaugcauuuacagcagguaaagucauauuugcugccguuccaccaaauuuuccaacagaaggacuaucaccaagucaaguaacaauguuuccucacauaguuguagauguaagacaacuugaaccaguuuuaauuccacuuccugacguaaggaacaacuuuuaucacuacaaccaaucaaaugacucuaccauuaaauuaauagcaaugcuauacacaccacuaagagcuaacaacgcaggugaugauguauuuaccguaucuuguagaguuuuaaccagaccaucaccagauuucgauuuuaucuucuuaguuccucccacaguagaaucaagaacaaaaccauucucaguaccuguauuaacaguagaagaaaugacaaacucacgauuuccaauuccccuagaaaaacucuuuacuggaccaucaucagcauuuguaguucaaccacaaaacggacgauguacaacugauggaguucucuuaggcacaacacaauuaucaccaguuaacauauguacuuuucgaggugauguaacacacaucacaggaaguagaaacuauacuaugaaccuagcaucacaaaacuggucuaauuaugauccaacagaagaaauuccugcaccacucggaacaccugacuuuguaggaaaaauacaaggcguacuaacucaaacaacaagaaccgauggcucuacaagaggacacaaagccacaguauacacaggaucugccgacuucgcaccgaaauuaggucguguacaauucgaaacagacacugaccacgauuuugaagcaaaucaaaauacaaaauuuacaccagucggagucauacaagacgguucuacaacacauagaaaugaaccacaacaauggguucuaccaucauauucuggacgaaauacaccaaauguacaccuagccccagcaguagcuccuacauuuccaggagaacaauuauuauuuuuuagaaguacuaugccaggaugcucaggcuacccaaauauggaucuagacugccuccuaccacaagaauggguacaauacuuuuaucaagaagcagcucccgcacaauccgauguagcauuacuaagauucguuaauccagauacaggaagaguauuauucgaaugcaaacuacauaaauccggcuauguaacaguagcacauacuggacaacacgaucucguaauaccuccaaauggcuauuuccgauucgauuccuggguuaaccaauuuuauacacuagcaccaaugggaaauggcacuggcagaagacgagcacuauaa

SEQ ID NO: 32280 - RNA, 1623 nt, Artificial Sequence
  derived and/or modified sequence opt6 from VP1__Norovirus__BAU25004
augaagauggcauccucugaugcaaaccccucugauggauccgcagcaaaucuagucccagaaguaaauaacgaaguaauggcucuagaaccaguaguuggugccgcuauagcagcaccaguagcaggccaacaaaauguaauagacccuuggauacgaaacaacuucguucaagccccaggaggagaauucacugucucaccaagaaaugcaccaggagaaauauuauggucagccccacuaggcccagaucuaaauccauaucuaucacacuuagcuagaauguacaacggcuacgccgguggauuugaaguacaaguaauauuagcagguaacgccuuuacagccgguaaaguuauauucgcugcaguaccuccaaauuuucccacagaaggacuaucuccaucccaaguaacaauguucccucacauuguuguagacguaagacaauuagaaccuguauuaauaccccuaccagauguaagaaacaauuuuuaucauuauaaccaaagcaaugacccuacaauaaaauuaauagcaaugcuauacaccccccuacgcgcaaacaacgccggugacgauguauuuacugucucaugucgaguuuuaacacgcccaucuccagacuuugauuuuauauuucuaguaccaccuacaguagaaucacgcacaaaaccauucucaguacccguauuaacugucgaagaaaugacaaauucacguuuuccaauacccuuagaaaaauuauucacagguccaucaucagccuuuguuguccaaccucaaaauggaagauguaccacagauggaguauuacuuggaacaacccaacucucaccagugaauauaugcaccuucagaggagacgucacacauauaacaggaucccgaaauuauacaaugaacuuagcaucccaaaauuggucaaauuaugacccaacugaagaaauuccagccccacuuggaacaccagacuuuguagguaaaauacaaggaguacuaacacaaacaacuagaacugacggaucaacaagaggucacaaagccacaguauauacaggaucagcagauuuugcuccuaaacuaggaagaguacaauuugaaacagauacagaucgagauuucgaagccaaucaaaacacaaaauuuacaccaguagguguaauacaagacgguucaacaacacauagaaaugaaccacaacaauggguacuaccaucauacaguggaagaaauacaccaaauguacaccuagcuccugcaguagcaccaacauuuccuggagaacaauuauuauuuuucagaaguacaaugccuggcuguucaggauauccaaauauggaucuugacuguuuauuaccacaagaauggguacaauacuucuaucaagaagcagcaccagcacaaucagacguagcauuacuucgauuuguuaacccagacacuggcagaguauuauucgaauguaaacuacauaaaucagguuauguaacaguugcucauacaggacaacacgaucuaguaauaccacccaauggauauuuuagauuugauucaugggucaaucaauuuuauacauuagcaccuaugggaaauggaaccggaagacgaagagcauuauaa

SEQ ID NO: 32281 - RNA, 1644 nt, Artificial Sequence
  derived and/or modified sequence opt6 from VP1_protein__Norovirus__ADN84676
augaaaauggcuuccucagaugcagccccaucaaccgauggaucagccgguuuaguaccugaaguaaacaaugaaacaauggcccuagaaccaguuguaggugccccacucgccgcaccuguagcaggacaacauaauauaauugauccauggauuaaaaugaauuuuguacaagcaccuaauggagaauuuacaguauccccucgaaacgcaccaggagaaauacuauuagaucuagaauuaggaccagauuuaaacccauauuuaucacaccuugcaagaauguacaacggauaugcuggaggaauggaaguucaaguaguacuugcaggaaacgcauucacggcuggcaaaauaauuuuugcagcaguccccccaaacuuucccgcugaaaauuuaucagcagcccaaguaacaaugugcccacauguuauaguggauguucgacaacuggaaccaguaaugcuuccaaugccagauauaagaaacaaacucuuucacuacaaccaaguagacgauccaaaauuaagauuauuagccuacuuauauacuccacuaagagcaaauaaugccggagacgauguauucacaguaucauguagaguacuaacaagaccuacaccugacuuugaauuuauguucuuaguaccaccuacaguagaaucaaaaacaaaaccauucucauuaccaaacuuaacacucgacgaguuauccaacucucgcuuuccagcaccaauaguacaacuauauacaaauccacaugacaacuuaguuguucaaccccaaaacggaagauguaccauagauggauuacuacaaggaacaacacaauuaguaucuugcaacguuuguagcuuuagaggcacuaugggagaaggucaacccgcaagccacucagaagaugaaauaaugcccauggcuauaaauguacaaagagaaauuauguuagaaaauuuagauggaucaccauacgauccuacagaugacauaccagcaguacuaggcucaccagauuuucaaggaguaauguucggaauacuaucacaacgaaauacagauggccagacaagagcacaugaagcuaaaguagauacaagggcugcaagauuugcaccaaaacuaggcuuuguagucgcaacuguugaaucaacagacuuucacgcuaaucaaccuagcagauuuacaccuguuggacuaggaggagacgcuaaccgugacuuuaaucaauggcaauuaccugcuuacggaggugcauuaaccaacaacacaaauuuagcuccaccagucaugccuguauauccuggagaacaacuacuauuuuucagaucacaacuaccaucaucuggugguguuguagcuggauggcuagauugcuuauuaccacaagaauggguacaacauuucuuucaagaaucagcuacaucacaaucaaacguggcacuaguacgauauguuaaucccacaacaggcagaguccuauucgaagccaaauuacauaaacaagguuuuuuaacuguagcugcaucaggaucauacccauuaguaguuccagcugauggauacuucagauuugaaucuuggguaaacgaauuuuauacuuuagcaccaaugggaaauggaaguggucgaagaagagcuagauaa

SEQ ID NO: 32282 - RNA, 1623 nt, Artificial Sequence
  derived and/or modified sequence opt6 from VP1_protein__Norovirus__BAK68870
augaaaauggcuuccaacgaugcauccccaucagauggaucagcagcaaaccuagucccugaaguaaacaacgaaguaauggcccuagaaccaguaguaggagcggcaaucgcagccccuguagccggccaacaaaauguaauagacccuuggauaagaaacaacuuuguucaagcaccaggaggagaauucacaguaucaccacgcaaugcaccaggcgaaauucucuggucagcaccucuaggaccagaucuaaacccuuaucuaucacaucuugcuagaauguauaacggauacgcagguggauucgaaguacaaguaauauuagcaggcaacgcuuucaccgccggaaaaaucauauucgcagcaguaccaccaaacuuuccaacagaaggacuaucaccaucucaaguuacaauguuuccccacauaauaguagauguacgacaauuagaaccaguacucauuccccuuccagauguacgaaacaauuuuuaucacuauaaucaaucaaaugauucaacaaucaaauuaauagcaaugcuuuacacccccuuaagagcaaauaaugcaggagaagaugucuuuacuguaucauguagaguucuaacucgcccaucaccagacuuugacuucauauuccucgucccaccaaccguagaaagcagaacuaaaccguucacaguuccaauccuuacaguugaagaaaugacaaacucaagauuuccaauaccacuagaaaaacuuuuuacugguccuucaucagcuuucguuguacaaccacaaaaugggcguugcacuacugacgguguccuauuaggaacaacacaacucucuccuguaaacauuugcacauuuagaggagacguuacacauauagccggaucacgaaauuacacuaugaacuuagcuucacucaauuggaacaauuaugacccaacagaagaaauuccugcaccucuaggaacacccgauuuuguaggcaaaauacaaggaguauuaacucaaacuacaaaaggugauggauccacuagaggucauaaagcuacaguauauacaggaucagcaccauuuacaccaaaauuagguuccguacaauucucuacagauacagaaaacgauuucgaaacacaucaaaauacuaaauucacuccuguaggagucauacaagacggaucuacaacccaccgaaaugaaccccaacaauggguacuacccucauauucaggaagaaacguacauaacguucauuuagcaccagcaguagccccaacauucccaggugaacaacuacuauucuuuagauccacuaugccaggauguucagguuacccuaauauggaucuugauugcuuacuuccccaagaauggguacaacacuucuaucaagaagcagcuccagcacaaucagacgucgccuuacuaagauucguaaauccagacacaggaagaguuuuauucgaaugcaaacuacacaaaucuggauauguaacaguagcucauaccggacaacacgaccuaguaaucccuccaaacggcuauuucagauucgacucuuggguaaaccaauuuuauacucucgcacccaugggaaauggaacaggaagacgaagagcacuauaa

SEQ ID NO: 32283 - RNA, 1620 nt, Artificial Sequence
  derived and/or modified sequence opt6 from capsid__Norovirus__AAC54893
augaaaauggcuucaagugaugcuaacccuucagauggaucagcagcaaacuuagucccagaaguuaauaacgaaguaauggcacuagaacccguaguaggagcagcaauagcagcaccuguagcaggccaacaaaauauaauagacccauggauaagaaacaacuuuguacaagcaccagguggagaauuuacaguaucaccucgcaaugcaccaggagaaauauuauggucagcaccucuugguccagaccuaaauccauauuuaucacauuuaagucgaauguauaauggauacgcagguggauucgaaguucaaguaauacuagcuggcaaugcauuuaccgccggaaaaguaauauucgccgcaguacccccaaacuuuccuacugaaggucuaagucccucucaaguuacaauguuuccccacauuaucgucgauguaagacaacuugaaccaguuuuaauuccacuaccagacgucagaaacaauuuuuaucauuacaaccaaagccacgacuccacacuuaaauuaauagcuaugcuauacacaccacuucgugcaaacaaugcaggagaugauguauucacaguauccuguagaguacuaacuagaccaucuccagauuucgacuucauauuucuaguaccacccaccguagaaucaagaacaaaacccuucacaguaccaauauuaacaguagaagaaaugucaaacaguagauuuccaauuccauuagaaaaacuauacacagguccuaguucagcuuuuguuguacaaccacaaaaugguagaugcacuacagacgguguauuacuagguacaacucaauuauccgcagucaacaucugcaacuuuagaggagacguaacacacauaguaggaucacaugauuauacaaugaacuuagcaucacaaaauuggucaaauuacgaccccacagaagaaauaccugccccacuaggaacacccgacuuuguugguaaaauccaaggauuauuaacacaaacaacacgagcagauggaucaacuagagcucauaaagcaacaguaaguacuggaaguguacacuucacaccaaaacuaggaucgguacaauucacaacagauacaaacaaugauuuucaaaccggacaaaacacuaaauuuacacccguuggaguaauacaggacggagaccaccaccaaaacgaaccacaacaauggguacuuccaaacuauucaggucgaacaggacacaauguccauuuagccccugcaguagcaccaacuuuuccuggagaacaacuacucuuuuuccguucaacaaugccaggauguucuggauauccaaauaugaauuuagacugucucuuaccucaagaauggguuuuacacuucuaucaagaagcugccccugcacaaucagacgucgcccuauuaagauuuguaaauccagauaccggucgaguucucuuugaaugcaaauuacauaaaucaggauacauaacaguagcacacacgggaccuuuugaucuaguaauaccaccaaacggauauuucagauuugauuccuggguuaaccaauuuuauacccucgcccccauggguaacggaacaggucguagaagagcauuauaa

SEQ ID NO: 32284 - RNA, 1647 nt, Artificial Sequence
  derived and/or modified sequence opt6 from capsid__Norovirus__AAW30195
augaagauggcauccaaugacgcaacuccaaguaacgauggugcagcaggauuaguaccagaaauuaauaacgaagccauggcauuagacccagucgcaggagcagcaaucgccgcaccguuaacuggacaacaaaacauaauagauccauggaucaugaacaacuucguacaagcaccaggaggagaauuaacaguaucaccucgaaauuccccaggagaaguuuuacuaaacuuagaacuaggaccagaaauuaaccccuaccuagcacauuuagcuagaauguacaaugguuaugcaggaggauuugaaguccaaguaguacuagcaggaaacgcauucacagcuggaaaaauaauauuugcugcaaucccaccaaacuucccaauagacaaccuaucagcagcacaaauuaccaugugcccacacguaauagucgacguaagacaacuugaaccaguaaauuuaccuaugccagauguuagaaacaauuuuuuucauuacaaccaaggaucagacacacgacuacgauuaauagcaauguuauauacaccuuuacgagcaaauucauccggagacgaugucuucacugucucaugccgaguacuaacaagaccaagcccagauuucucauuuaauuuuuuaguaccaccuacuguagaaucaaaaacaaaaccauucacuuuaccaauccuuaccauauccgaaauguccaacucacgauuuccaguaccuauagacagucuacauaccucaccaaccgaaaacauuguaguucaaugucaaaacggacgaguaacacuagacggagaacucaugggcacaacacaacuauuaccaucacaaaucugcgcauuuagaggaaugcucacuagauccacaucuagagcaucagaucaagcagacacugcagcaccaaggcuauuuaacuaucacuggcauauccaacuagauaaccuaaacggaacaccauaugauccagcugaagauauaccaggaccacuagguacaccagacuuuagaggaaaaguauucgguguagcuucacaaagaaauccagauucaacaacaagagcacacgaagcaaaaguagauacaacagcagguagauuuacaccaaaacuaggaucauuagaaauuuccacagaaucaggagauuuagaccaaaaccaaccuacaaaauucacacccgucggaaucgguguagaucacgaagaagacuuccaacaauggucacuaccagacuauuccggacaauuuacacauaauaugaacuuagcccccgcaguagcaccaaauuuuccuggagaacaacuacuauuuuuucgaucucaauuacccucauccggcggcagaagcaauggaauuuuagauugcuuaguaccacaggaauggguccaacauuuuuaccaagaauccgcaccagcacaaacacaaguagcuuuaguaagauacgucaacccugacacaggacgaguccuauuugaagcaaaauuacauaaacuaggauuuaugacaauugcaaaaaacggagacuccccaauaacugucccaccaaacggauacuucggauucgaaucuuggguaaacccauuuuacacuuuggcucccaugggaacaggaaacggaagaagacguauacaauaa

SEQ ID NO: 32285 - RNA, 1647 nt, Artificial Sequence
  derived and/or modified sequence opt6 from capsid__Norovirus__ABD36491
augaaaauggcuagcaacgaugcagcacccaguaaugauggagcagcaggucuaguaccagaaauuaauaaugaagcaauggcacuagaaccaguagcuggagcugcaaucgccgccccauuaacaggacaacaaaacauuauagauccuuggauaaugaacaauuuuguacaagcaccaggaggcgaauuuaccguaucucccagaaacucuccaggagaagucuuacuaaauuuagaauuagguccagaaauaaauccuuauuuagcccaucuagcaagaauguauaauggauacgcaggagguuucgaaguucaaguaguacuugcuggaaacgcauucacagcaggaaaaguaauauucgccgcaauaccaccaaauuuuccaauagauaaucuaucagcugcacaaaucaccaugugcccgcacgucauuguagauguaagacaacucgaaccgauuaauuuaccuaugccugacguacgaaauaauuuuuuucauuauaaucaagguucagacucacgucuccgacuaauagcaauguuauacaccccacuaagagcuaauaacucaggugaugacguauuuaccguuucuuguagaguauuaacucgcccuucacccgauuuuucauuuaauuuuuuaguucccccaaccguugaaucuaaaacaaaaccauucacacuaccaauauuaacaauaucagaaaugucaaauaguagauuccccgugccaauagauucccuucacacuucacccacagaaaauauaguaguucaaugccaaaauggaagaguaacacuagacggugaacuaaugggaacuacacaacuacuaccaucucaaauuugugccuuuagaggaacacuaacaagaucaacaucuagagcaucagaucaagcagauaccgcaacaccaagauuauucaauuauuacuggcacauucaacuugacaacuuaaauggaacaccauaugacccagcagaagauauuccagcaccucuaggaacaccggauuuucguggcaaaguuuucggagucgcaucucaaagaaauccagauucaacuacccgagcucacgaagcgaaaguugauacuacaucagguagauucgcaccaaaacucgguucucuagaaauauccacugaaucaucagauuuugacaguaaccaaccuacacgauuuacaccaguaggaauaggcgucgacaacgaagcagauuuucaacaauggucucucccagauuauucgggacaauucacacauaauaugaaucuagcuccagcuguagcuccuaauuucccuggcgaacaacuucuauucuucagaucacaauuaccaagcuccggaggucgaucaaauggaauacuagacugucuaguaccacaagaauggguacaacacuuuuaucaagaaucugcaccggcacaaacacaaguagcuuuaguaagauauguaaauccagacacaggcagaguauuauucgaagcaaaguuacauaaauuaggauucaugacaauagcaaaaaauggugacucgccaauaacuguaccuccuaaugguuacuuucguuuugaaucauggguaaauccauuuuacacccuagcuccaaugggaacaggaaauggaagaagaagaauacaauaa

SEQ ID NO: 32286 - RNA, 1629 nt, Artificial Sequence
  derived and/or modified sequence opt6 from capsid__Norovirus__ABD36494
augaaaauggcaucaaaugacgccgcucccagcaaugacggagccgcaucacuaguaccagaagguauaaacgaaaccaugccccuagaacccguagcaggagcaucaauagcagcaccaguagcaggucaaaccaacauaauagauccauggauacgcacaaacuucguccaagcaccaaauggcgaauuuacaguaucaccuagaaacucaccaggcgaaaucuuacuaaaccuagaacuaggcccagaccuaaacccauacuuagcucauuuaucaagaauguauaacggauaugcagguggagucgaaguacaaguccucuuagcaggaaacgcauucacugcaggaaaaauacuauucgccgcuauaccucccaauuucccaguagauaugaucucaccagcacaaauaacaaugcucccacacuuaauaguagacguaagaacucuagaaccaauaaugauaccauuacccgauguacgaaacgucuucuaucauuucaacaaccaaccccaaccacgaaugagauuaguugcaauguuauacacaccacuaagaucuaauggaucaggagacgacguauucaccguaucauguagaguucuaacuagaccuacaccagacuuugaauuuauauacuuaguaccuccaucaguagaauccaaaaccaaaccauucacccuccccauccuaacuauaucagaacuaacaaacucaagauucccuauaccuauagaacaauuauacacugcaccaaacgaaaacaacguaguacagugucaaaacggaagaugcacacuugacggagaacuccaaggaacaacucaacuacuauccucagcaauaugcagcuaucgaggaagaacaguagcaaacaacggagacaauugggaccaaaaucuucuacaacucacauauccaaacggcgcuucuuacgauccaacagaugaaguuccagccccacuagguacacaagacuucucaggaaugcuauacggaguccuaacacaagacaauaccaacguauccgcaggagaagcaaaaaacgcaaaagguauauauauaucaacaacaucaggaaaauuuacaccaaaaauaggaaguauaggccuacacucaauaaccgaacacguauacccaaaccaacaaucaagauucaccccaguuggcgucgcaguaaacgaaaacacaccauuucaacaauggguacuaccccacuacgcugggucucuagcacuaaacacaaacuuagcaccagccguagcaccaaccuucccaggagaacaauuacucuucuuucguagcagaguaccauguguacaaggacaacaaggccaagacgucuucauagacugcuuacucccacaagaauggguaaaccauuucuaccaagaagcagcuccaagccaagcagauguagcacuuauacgauacguuaauccagacacaggucgaacacucuucgaagcaaaauuacaccguucaggauuuauaacaguaucucacacaggagcuuauccauuaguaguaccaccuaauggacacuucagauucgauucauggguaaaccaauucuacuccuuagcaccuaugggaaccggcaacgguagaagacgaauacaauaa

SEQ ID NO: 32287 - RNA, 1614 nt, Artificial Sequence
  derived and/or modified sequence opt6 from capsid__Norovirus__ABD36497
augaaaauggcaucaaacgaugcagcaccaucaagcgauggagcagcaggccuuguaccagaaauaaaucaugaaguuauggcaaucgaaccaguagcaggugccuccaucgcagcacccguagucggucaacaaaauauaauagauccauggauucgaaauaacuucguacaagcuccagcaggugaauuuacagucucaccaagaaaugcacccggggaauuucuucuagaucucgaacuuggaccagauuuaaauccuuaucuugcccauuuagcucguauguauaauggucacgcaggaggaauggaaguacaaauaguauuagcuggcaaugcauucacagcaggaaaaauucuuuucgcaguaauaccaccaggauuuccauaugaaaaucuaucucccgcacaauuaacaauguguccacauguagucguagauguaagacaacuagaaccaguaauguuaccaaugccagauauacgaaacacauuuuuucauuacaaucaagauggaggacccaggcuaagacuaaucgccaugcuuuauacaccacuaagagcuaacaauucaggggacgacguuuuuacuguaucauguagaguauuaacacgaccagcaccagauuuugaauuuaccuuucucguaccaccaucaguagaaucuaaaacuaaagcauuuacuauaccaguacuaaaaauaagugaaaugaccaauucuagauuuccaguaccaguagaccaaauguauacaaguagauccgaaggcauuguuguucaaccucaaaacggaagagcaaccauagacggagaauuauuagguaccacucucguaucaccuguuucaguauguaauuucaaagguaauuuacaaacagaaguuccuggacaacaccaacaauaucaauuacaguuaacuaauuuagacggcuccccuauugauccaacagacgauacaccuggaccauuagguuguccagacuucauugguuuacuauauggaguagcuucccaaagaggaccaggagacgcuacaagagcacaugaagcuagaauagacacaggaucugauacauaugcaccaaaaauaggucaaguaagauuuuauucuacaucaaauaacuuugaaaccaaucaaccuacccauuuuacuccuguuggaguauacaucgaaggcucaucaagugauuucaaccaauggcaacuaccacguuauggaggacauuuagcaaacaauaaccaucuugcuccagcaguuagcccauuauucccuggagaacaaauacuauuuuuuagaucauucauacccggagcaucaggacauacuaacggugaaauggauugucuacuaccacaagaauuuguacaacauuucuaucaagaagcugcaacagcucaaucagaaguagccuuauuaagauuuguaaauccagauacaggaagaguucucuuugaaagcaaauuacauaaacaaggauuuaugacuauagcuucuucuggugaucacccaauaauaaugccaacuaauggauacuuuagauucgaagcauggguaaaucaauuuuacucuuuagcaccaguaggaacaggaucugguagacgaagaauacaauaa

SEQ ID NO: 32288 - RNA, 1623 nt, Artificial Sequence
  derived and/or modified sequence opt6 from capsid__Norovirus__ABL74387
augaaaauggcaucaaacgacgcaacaccaucagacggcucaacggcaaaucuagucccagaagucaauaacgaaguaauggcacuagaaccaguaguaggagccgcaauagccgcaccaguagcuggacaacaaaauguuauagaccccuggauaagaaauaauuuuguacaagcaccuggcggagaauuuacuguauccccacgaaaugcuccuggugaaauuuuauggucagcuccacuaggccccgacuuaaauccauacuuaucacaccuagcaagaauguauaauggauaugcaggaggcuuugaaguacaaguuauucuagcuggcaaugcauucacagcaggaaaaauaauauucgcugcaguaccaccaaacuuuccaacugaaggucuuucaccaucccaaguaacuauguucccacauauaauaguagauguucgacaauuagaaccaguccuaaucccacuaccagacguacgaaacaauuuuuaucauuauaaccaaucaaaugauccaaccauaaaauuaauagcaauguuauauacuccauuacgagcaaauaaugcuggagaugauguauuuacuguaagcuguagaguauuaacacgcccaagcccugacuuugacuuuauauuuuuaguuccacccacaguagaaagcagaaccaaaccauuuagcgucccaauccucacaguagaagaaaugacuaauucaagauuccccauaccauuagaaaaacuauucaccggaccuucaucugcauucguaguucaaccucaaaaugguagaugcacuaccgauggaguuuuacuaggaacuacacaacuaucccccgucaauauuuguaccuuuagaggcgauguuacccauauugccggaacucaaaacuacacaaugaaucuagccucucaaaauuggaauaauuaugacccaacagaagaaauuccagccccacucggcacuccagacuuuguaggaaaaauacaagguguauuaacacaaacaacaagaagagauggcucaacaagaggacauaaagcaacaguuucaaccggaucgguucauuucacaccaaaauuaggaucaguucaauuuucuacagacacaucaaaugauuuugaagccggucaaaauaccagauuuacaccaguagguguaguacaagauggauccacaacacaucaaaaugaaccacaacaauggguacuuccagacuauucuggaagagauucacauaauguacaucuagcacccgcaguugcacccacauuuccaggagaacaacuacuauuuuucagaucaacaaugccaggaugcuccggauauccaaauaugaaucucgacugcuuauuaccacaagaauggguacaacauuucuaucaagaaucagcaccagcacaaucagacgucgcauuacuacgauuuguaaacccagacacaggaagaguucuauuugaaugcaaauuacauaaaucagguuauguaacaguagcuuacacuggacaacacgauuuagucauaccuccaaauggauauuuccgauucgauucaugggucaaucaauucuacacacuagcaccaaugggaaacggugcaggaagaagaagagcauuauaa

SEQ ID NO: 32289 - RNA, 1623 nt, Artificial Sequence
  derived and/or modified sequence opt6 from capsid__Norovirus__ABL74389
augaaaauggcuuccaaugaugcaacaccuagugauggaucuacagcaaaucuuguccccgaagucaacaacgaaguuauggccuuagaacccguaguuggugcagccauagcagcaccaguagcaggucaacaaaauguaauagacccauggauaagaaacaacuuuguacaagcacccggcggugaauuuacagucuccccaagaaaugcaccaggcgaaauucuauggucugcaccacuaggcccagacuuaaauccauaucucucucaucucgcccgaauguauaacggauacgcaggagguuuugaaguacaaguaauauuagcaggaaaugccuuuacagcaggaaaaauuauauuugcagcaguaccaccaaauuuuccaacagaaggauuaucaccaucacaaguuacuauguuuccacauauaauaguagauguaagacaauuagaaccaguauuaauuccauuacccgauguucgaaauaauuuuuaucauuacaaucaaagcaacgauccaacaauacgacuaauagcaaugcuuuacacaccccuaagagcaaacaaugcuggagacgacgucuuuacaguaucauguagaguucugacaagaccuucaccagauuuugacuuuauauuucuaguaccaccaacaguagaaucuagaacaaaaccuuucucugucccuauacuuacaguagaagaaaugacuaauucaagauuuccuauaccccuagaaaaacuauuuacuggacccucuucagcauucguaguacaaccacaaaacggaagaugcacaacagacgguguccuauuaggaaccacacaacuuagcccagucaauauuuguacauuuagaggagacguuacacauauugcuggaacacaaaauuauacaaugaaucuagcaucacaaaacuggaauaauuaugauccaacagaagaaguacccgcaccacuaggcacaccagauuuuguaggcaaaauacaaggaguauuaacacaaacuacacguggagacggaucuacaagaggccacaaagcaacaguaucaacuggauccguacacuuuacaccaaaacuggguuccguacaauucucaacugauaccucaaaugauuucgaaacuggacaaaauacaagauucacaccaguaggcguuguucaagacggaucaacuacacaucaaaaugaaccacaacaauggguacuacccgacuauucaggcagagacaaucauaauguucauuuagcaccugcaguagcaccaacauuucccggagaacaacucuuauuuuuucgcucaacaaugccagguugcucuggauacccaaacaugaauuuagauugcuugcuaccacaagaaugggugcaacauuucuaucaagaaucugcaccagcacaaucagacguggccuuauuaagauuuguaaacccagacacaggacguguauuauuugaaugcaaauuacauaaaagcggauauguuacaguagcucacacaggacaacacgaccuugucauaccaccaaauggauauuuucgauucgauucauggguaaaucaauuuuacacuuuagcacccaugggaaauggagcaggaagacgacgagcauuauaa

SEQ ID NO: 32290 - RNA, 1623 nt, Artificial Sequence
  derived and/or modified sequence opt6 from capsid__Norovirus__ABL74397
augaaaauggcaucaaaugacgcuaacccauccgauggaucugcagccaaccuaguuccagaaguaaacaaugaaguuauggcccuagaacccguaguaggagccgccauagcagcaccaguggcaggacaacaaaauguaauugauccauggauaagaaauaauuuuguacaagcuccuggaggagaauucacuguuuccccaagaaaugcaccuggugaaauccuauggucugcaccacuuggaccagauuuaaaucccuaucuaucacaucuagcacgaauguauaacggauaugcuggaggauuugaaguacaaguaauacuagcuggaaaugcauuuacagcaggaaaaaucauauucgcagcaguaccaccaaacuuuccaacagaaggucuaucccccucucaaguuacuauguucccucacauaauaguagauguaagacaacuagaaccaguuuuaaucccauuacccgacguccgcaacaacuuuuaucacuacaaucaaucuaaugauuccaccauaaaauuaauugccauguuauauacaccuuuaagggcaaacaaugcaggugaagaugucuuuacaguaucaugcagaguacuaacaagacccucaccagacuuugacuucaucuuuuuaguuccaccaacuguagaaucaagaacaaaacccuucaccguccccauacuaacaguagaggaaaugacaaauuccagauucccaauuccuuuagaaaaacuauucacagguccauccggagcauuuguaguacaaccacaaaauggccgcugcacuacagaugguguacuucuagguaccacacaacucagcccaguaaauaucugcacauuuagaggcgacguaacccacauagcaggaucuagaaauuacacaaugaaccuugcaagccuuaauuggaauaauuaugauccuacugaagaaauacccgcuccccuaggaacaccagauuucguaggcaaaauacaagguguauuaacacaaacaacaaaaggggauggcucuacuagaggacauaaagcaacaguauacacagguucugcuccauuuacaccuaaacuuggaucaguccaauuuaguacagauacagaaaacgauuuugaaacccaccaaaauacaaaauuuacaccaguugguguuauacaagauggaucaacaacacaucgcaaugaaccacaacaauggguucuaccaucauauuccggaagaaauguacauaauguacaucuugccccugcaguagcaccaaccuuuccaggcgaacaauuacuguucuuuagaucuaccaugccaggcugcucaggauacccaaauauggauuuagauugcuuacuaccucaagaauggguucaacacuucuaucaagaagcagcaccagcacaaagcgacguagcauuacuaagauuuguaaaccccgacacuggaagaguccuauucgaaugcaaacuacauaaaucaggauauguaacaguagcacacacaggacaacaugaucuuguaauaccaccaaauggauauuucagauucgauucuuggguaaaccaauuuuacacucuagcuccaaugggaaacggaacagguagaagaagagcacuauaa

SEQ ID NO: 32291 - RNA, 1593 nt, Artificial Sequence
  derived and/or modified sequence opt6 from capsid__Norovirus__ABQ44562
augaugauggcauccaaagacgcaaccuccaguguugacggagcuucaggagcuggucaacuuguaccagaaguaaaugcaucugauccacuagcaauggacccaguugcagguaguucaacagcaguugcuacugcuggacaaguuaauccaauagauccauggauaauuaauaauuuuguacaagcuccucaaggagaauucacuauaucuccaaauaacaccccaggagacguccuauucgauuuaucacucggaccacauuuaaacccauuuuuauuacaccuaagccaaauguacaauggauggguagguaauaugagaguaagaauaaugcuagcaggaaaugcuuuuacagcaggaaaaauaauaguaucaugcauacccccagguuucggaucacacaacuuaacuauagcucaagcaacccuuuucccucauguaauagcugacguuagaacuuuagauccuauagaaguaccccuagaagauguaagaaauguguuauuucauaauaaugaucguaaucaacaaaccaugcgauuaguaugcauguuauacacacccuuaagaacaggcgguggaacaggagauucguuuguaguagccggaagaguaaugacauguccuuccccagauuuuaauuuuuuauuucuaguaccucccacuguagaacaaaaaacccgaccuuucacauuaccaaaccuaccacuaucaucacuuuccaacucacgagcaccauuaccaauaagcggaaugggcauaucaccagauaauguacaaucaguucaauuucagaacgguagaugcacucuagacggaagauuaguaggaacuacacccguaucauuaucacaugucgcaaaaauaagaggaacuucaaacggaacaguaaucaaccucacagaauuagauggcacaccauuucauccauuugaagguccagcacccauaggauucccagaucuaggaggcugcgauuggcauauaaacaugacucaauucggccauucaucccaaacacaguacgacguagacacaacuccagauacuuuugucccacauuuaggauccauacaagcaaauggaguaucuucaggcaauuauauagguguacuuucauggguaucuccucccucacauccuuccggaucacaaguagauuuauggaaaauacccaauuacggaaguucaauuacagaagcaacucaucuagcuccaucgguauauccacccggauuuggugagguauugguauuuuuuauguccaaaauaccuggacccggcgcauauucacuacccugucuacuuccucaagaauauauaucacauuuagcuagcgaacaagcaccaacagucggggaagcugcauuauuacauuauguagauccagauacaggaagaaauuuaggagaauucaaagccuaccccgauggauuucuaacauguguaccaaacggagcauccucaggaccacaacaauuaccaauuaauggugucuuugucuuuguaaguuggguaucaagauucuaccaauuaaaaccaguuggcacugccucaacagccagaggcagacuuggccuacgcagauaa

SEQ ID NO: 32292 - RNA, 1638 nt, Artificial Sequence
  derived and/or modified sequence opt6 from capsid__Norovirus__ABQ44563
augaugauggcaucaaaaggugcuccaacaaauauggauggaacaucuggagcaggacaauuaguaccagaagcaaacacugcagaacccauaucaauggaaccaguagcaggugcugcaacugcagcagcaacagcaggucaaguuaacaugaucgauccuuggauaaugaacaauuacguacaagcaccucaaggagaauuuacaauaucaccaaauaauacaccuggugacauauuauuugauuuacaauuaggaccacauuuaaauccauuucuaucucauuuagcacaaauguauaauggaugggucggaaauaugaaaguuaaagucuuauuagcaggaaaugcauuuacagcaggaaaaauaauuauaaguuguauuccuccagguuuuguggcacaaaacauaucaaucgcacaagccacaauguucccucauguaauagcagauguaagaguauuagaaccaaucgaaguuccucuugaagauguuagaaacguacuauuucacaacaaugauaacacaccaacaaugagacuaguauguaugcuuuacacaccuuuaagagcaucaggauccuccucaggaacagauccauuuguaauagcuggaagaguauuaacauguccaucacccgauuucucuuuucuuuuucuuguaccaccaaauguagaacaaaaaacuaaaccauucucaguaccaaauuuaccacuaaacaccuuaucaaacucucguguacccucauuaauuaaaucaaugauggucucaagagaucacggccaaaugguccaauuccaaaaugguagaguuacucucgacggacaacuccaagguacaacaccuacuucagcaucucaacuauguaaaauuagaggaucaguauuucaugcaaauggaggaaacggauauaauuuaacagaauuagacggaucaccuuaucaugccuuugaaucaccagcaccaauuggauuuccagaccuuggugaaugugacuggcauauggaagcauccccaacaacacaauucaauacaggcgacgucauaaaacaaauaaacguuaaacaagaaagcgcauuugcaccacaccucgguacaauacaagcugaugguuuaucagaugucucaguaaauacaaacaugauagcuaaacuagaauggguaucaccaguaucugacggacauaaaggcgacguagauccauggguaaucccucgauauggaucaacacucacagaagcagcacaauuagcaccaccaauauauccaccuggauuuggagaagcaauuguuuuuuuuaugucagauuuucccauagcacauggaacuaauggacuaucaguacccugcacaauuccacaagaauucguaacccacuuuguuaacgaacaagcaccuacaagaggugaagcagcacuucuacauuaccuagauccagacacacaucguaauuuaggagaauuuaaacuauacccagauggauuuaugacuugcguaccaaacucuaguggaacaggcccacaaacuuuaccaauaaauggaguauucguuuucgucucauggguuuccagauucuaucaauuaaaacccguaggaacugccggaccugcuagaagauuaggaauaagacgcucuuaa

SEQ ID NO: 32293 - RNA, 1635 nt, Artificial Sequence
  derived and/or modified sequence opt6 from capsid__Norovirus__ABQ44564
augaugauggcuucaaaagaugccacaccaucagcagauggugcaacuggagcuggccaacuaguacccgaaguaaauacagcagacccaauaccuauagacccaguagcaggaucuucaacugcacuagcuacagcaggacaagucaaccucauagacccauggauaaucaauaacuucguacaagcaccacaaggagaauucacuauuucaccuaacaacaccccaggagauguauuauuugauuuacaacuaggcccacauuuaaaccccuucuuaucacacuuaucccaaauguacaacggauggguagguaauaugagagucagaguaguucuagcaggaaaugcuuucacagcagggaaaguuauaauauguuguguacccccaggcuuucaaucacguacauuaucaaucgcacaagcaacauuauuuccacaugucauugcugauguucgcacuuuagauccuguugaaguccccuuagaagauguaagaaacguucuauaccauaacaacgauacacaaccaaccaugagacuccuuugcaugcuuuacacaccacucagaacagguggagcaucaggaggaacagacucauucguaguagcaggcagaguucuaacaugcccaggaccggacuucaauuuccucuuccuaguuccacccacgguagaacaaaaaacacgaccauuuacaguaccuaauauaccacuaaaauacuuaucaaauucaagaauaccuaaccccauagaaggaaugucucuuucaccugaucaaacacaaaacguacaauuucaaaauggacgauguacaauugauggccaaccauuaggaacaaccccaguaagcguaucacaacugugcaaauucagaggacgaauaacaucuggacaaaaaguacuuaauuuaacagaacuagauggaucaccuuucauggcauucgcugcaccagcucccgcaggauuuccagauuuaggcuccugugauuggcauauugaagucuccaaaauacccaauucaucaacacaauccaauccaauagucgucaacucaguaaaaccaaauucacaacaauuuguaccucacuuaucaucuauaacacuagacgauaauguaucaucagguggagauuacauaggcaccauacaauggacaucaccacccagugauucaggaggagcaaacacaaacuuuuggaaaauaccagauuacggaucuuccuuagcagaagcaucacaacuugcuccagcaguauauccaccugguuuuaacgaaguaauaguauauuucauggccucaauacccggaccaaaucaaucuggauccccuaacuuaguaccaugucuauuaccucaagaauacauaacucauuuuaucucagaacaagcuccaauucaaggagaagcagcauuauuacauuacguagauccagacacaaacagaaauuuaggcgaauuuaaacuauauccaggaggauaucuaacaugcgucccaaauuccagcucaacaggaccucaacaacucccuuuagauggaguauuuguauucgcauccuggguaucaagauucuaccaacuuaaaccaguaggcacugcaggaccagcaagaggaagauuaggaguacguagauaa

SEQ ID NO: 32294 - RNA, 1623 nt, Artificial Sequence
  derived and/or modified sequence opt6 from capsid__Norovirus__ABQ44565
augaugauggcaucuaaagaugcaccaacauccccagacggagcaucaggagcaggccaauuaguuccugaagcuaauaccgcagaacaaauuucgauggauccaguagcaggagcaucaacagcuguagcaacugcaggucaaguaaauaugauagauccauggauauucaauaauuucguccaagccccacaaggagaauuuacaaucagcccaaauaauacaccaggagauauauuauucgaucuucaauuaggaccccauuuaaacccauuucuagcacaucuuucacaaauguauaauggauggguaggaaauaugagaguacgaauuuuauuagcagguaaugcauuuacugcaggaaaaauuauuauaugcuguguuccaccaggauuugaugcaagaauauuaacaauagcucaagcaacccuauuuccacaucuaaucgcagacguacgaacacuagaaccuguagaauuaccccuagaagauguaagaaacguacuuuuucauaacaguucucaaccccaaccuacaaugcgcuuagucgcaauguuauauacaccccuacgaacaggaggaggaucuggagguacagaugccuuuguaguagcaggacgaguauugacauguccagcuccagauuuuucuuuccuauuucuuguaccuccaucaguagaacaaaaaacuagaguauuuucaguaccaaaugucccacuaaaagauuuaucaaauucaagaguaccuguucccauacaagguauguuuaugucacccgauguaaaucaaucaguacaauuucaaaacgguagaugccaaauagacggacaacuucaagguacaacaccaguauccuuaucucaauuaugcaaaauuagaggaaaaacuucaucuaacgcucgaguucuuaaucuuucugaaguagacggaucaccuuucauaccacuugaaaguccagcaccaguaggauuccccgauuuaggaggaugugacuggcacguuaauuuuacauuucaagcccaagaucaagauccaucacaaucaguaacauuugcuacaaaugaugcaucauucguaccuuauuuaggaucaauaucuccacauaacggaggagauuuucauucaggugacaucauugguagccuaggauggauaucagcaccaucagauucuucucaauuaaacguauggacaauaccaaaauacggcuccucccuaccugauguaacucaucuagcaccagcaguauucccaccugguuucggagaagucauuuuauauuuuuauucaacuuuccccggauccggacaaccaggacaauuacaagucccaugucuucuaccacaagaauucauaacacacuucuguaaugaacaagcaccaauugcuggcgaagcugcacucuuacauuauguagacccagauacaggcagaaauuuaggagaauucaaauuauauccagacggauucaugacuugcguaccgaacucuguaaguucaggaccacaaacacucccuauaaauggaguauuuguauuuguuucauggguaucacgauuuuaucaauuaaaaccaguaggaacagcaagcguagcaagaagauuaggacuacgaagaauuuaa

SEQ ID NO: 32295 - RNA, 1635 nt, Artificial Sequence
  derived and/or modified sequence opt6 from capsid__Norovirus__ABQ44566
augaugauggcuaguaaagacgcaccaacaaauauggacgguaccucuggugccggucaacuaguaccugaagcaaacacagcagaaccaauaucaauggacccaguagcuggagcagcaacagccguugcaacagcaggccaaauaaacaugauagauccauggauaaugucuaauuucguacaggcaccacaaggagaauuuacuguaucaccaaauaauacaccaggagauguucuauucgaucuacaacuuggaccgcaacuaaaucccuuucucgcacaucuagcucaaauguauaaugguuggguaggaaauaugagaguaaaaguauuacuugcaggaaacgcauucacugcuggaaaaauaaucauauccuguauaccaccagguuuuacuucacaaaacauuucaauugcacaaaugacuauguucccacauguaauagccgauguaagaguauuagagccaauugaaguaccacuagaagauguccguaauguauuauuccacacaaaugauaauagaccaaccaugcgauuaguaugcauguuauauacaccauuacgagcaaauggaucaagcucagguacugauccauuuguaauagcaggcagaguacuaacaugccccgacucaaauuuuucauuucuuuuucuuguaccaccuaauguagaacaaaaaacacgaccauucucuguuccaaacauaccacucaauacacuaucuaauucuagaguaccauccuuaauaaaaagcaugacuauaucuagagaccaaaaccaaauaauacaauuccaaaauggcagaguaacauuagacggccaauuacaaggaacaacaccaaccucaguaucccaauuaugcaaaauaagaggaacaacauaucaugcaacaggcggaaauggaauaaaccuuacagaacucaacggagaaccauaucaugcauucgaaucaccugccccaauuggauuuccagaucuaggcgguugugacuggcauuuaacugcaacacccacacaagcauuuaaugacggagcaaaaguaguaagacuuucaguaacucaaggcgcagcauuugcuccucauuuaggaaccauacacuacacaaccacagacacagauuauuccccaaauacauccauaauaugcacacuagauugguuaucacaaacuacaggccaaucaaacgucgacccauggcaaauaccaacauauggaucuacauuaaccgaagccgcccaauuagccccaccaauauuuccaccagguuuuggugaaaccuuaguauucuuccuauccgauuuucccauaucuaacggaaaaaaugguuuaucaguaccuuguacauuaccccaagaauuuguaacucauuuugucaaugaacaagcaccaauaagaggagaagcagcauugcuccacuauguagacccagacacacacagaaaucuuggugaauuuaaacuguauccagaaggcuucaugacauguguaccaaauacaucuggaggaggaccacaaacacuacccaucaacggaguauucguauuugucaguuggguaucacgauuuuaccaacuuaaaccaguaggcacagcaggcgcagcaagaagauuaggaauacgaagaucauaa

SEQ ID NO: 32296 - RNA, 1608 nt, Artificial Sequence
  derived and/or modified sequence opt6 from capsid__Norovirus__ABQ44567
augaaaauggcaucaaacgaugcagcuccuucaaacgauggagcagcaggacuaguaccugaaguuaauaacgaaacaauggccuuagaaccagucgcaggagcuucaauagcugcaccauuaacaggacaaaacaaugucauagauccuuggauaagaaugaauuuuguacaagccccaaauggagaauuuacaguaucucccagaaauucaccuggagaaauauuacuaaaucuugaauuagguccagaauuaaauccauuuuuagcacaccuaucgcgaauguacaauggauaugcaggaggaguagaaguacaaguacuacuagcuggcaacgcauuuacagccgguaaacuaguauucgcagccauaccaccucauuucccuauagaaaacuuaucaccuggacaaauaacaauguuuccacacgucauaaucgauguucgcacauuagaaccaguacuuuuaccuuuaccagacguaagaaauaacuucuuucauuauaaucaagaacccgaaccccguaugcgauuaguugcaaugcuauacaccccucuccgaucaaaugguucuggagaugauguauucacugucuccugcagaguacucaccagaccaucaccagauuucgacuuuaauuaccuuguaccaccaacaguagaaaguaaaacaaaaccuuuuacuuuaccaauuuuaacaauaggagaacucucaaauucucgauucccugcaccaauagacgaacuauacacuucaccaaaugaaggccucguaguacaaccacaaaacggaagaaguacacuagauggcgaacuacuaggaacaacacaacuaguucccucaaacauauguucacuccguggacgaauuaacgcucaucuaccugacaaccaacauagauggaauaugcaaguaacaaaugcaaaugguacaccauuugacccaacugaagauguacccgcaccacuaggaacuccagacuuccuagcaaauauauacggaguaacaucucaacgaaauccagacaacacaugcagagcacaugauggaaucuuagcaacuuggaguccaaaauuuacaccaaaauuagguucuguaguacuaggaaccugggaagauagagauuucgacauaaaucaaccuacccgauuuacacccgucggacuauaugauacagaucacuuuaaucaaugggcacuaccaaauuauucaggagccuuaaccuuaaauaugaaucuagcacccuccguagcaccucuuuuuccaggugaacaauuacuauuuuuuagaucucacauuccacuaaaaggaggaacaucaucaggcgccauagacugccuauuaccacaagaauggguccaacacuuuuaucaagaaucagcacccuccucuaccgauguagcucuaaucagauauaccaacccugauacagguagaguauuauucgaagcaaaacuucaccgucaaggauucauaaccguugcgaacucaggaucacgcccaauuguaguaccaccaaacggauauuuuagauuugauaguuggguaaaucaauucuauucauuagcaccuauggguacaggaaacggaagaagaagaguucaauag

SEQ ID NO: 32297 - RNA, 1629 nt, Artificial Sequence
  derived and/or modified sequence opt6 from capsid__Norovirus__ABQ44568
augaacauggccucaaaugaugcugcaccuucaacagacggagcagcuggccuaguuccugaaucaaauaaugaaguuauggcacuagaaccaguagcaggcgccgcauuagcagcaccuguaacaggacaaacaaauaucauagauccuuggaucagggcuaauuuuguccaagcuccaaauggagaauuuacaguaucaccucgaaacgcuccaggugaagucuuauuaaaccuugaacuaggccccgaauuaaauccauacuuagcucauuuagcaagaauguauaauggauaugcaggcgguauggaaguucaaguaaugcucgcugguaacgcauucacagcaggaaaacuaguauuugcagcuguaccaccacauuucccaguagaaaauuuaucaccccaacaaauaacaauguuuccucauguaauuauagauguccguacauuagaaccaguauuacuaccacuuccagacguaagaaauaauuucuuucauuacaaucaaaaagacgauccuaaaaugcgcaucguagcuaugcucuacacaccccuuagaucaaauggauccggcgaugacguauuuacaguaucaugucgaguauuaacaagaccaucaccugacuuugauuuuacauaucuaguacccccaaccgucgaaucuaaaacaaaaccuuuuacccuuccaauauuaacacuaggagaauuaucaaauucacguuucccuguaucaauagaucaaauguacacaaguccaaaugaagucauaucuguacaaugccaaaacggaagauguacuuuagauggagaauuacaaggaaccacacaauugcaaguuagcggaauaugugcauuuaaaggagaaguaacagcucaucuacacgauaaugaucaccuauauaacguuacaauuacaaauuuaaacgguucaccauuugauccauccgaagauauaccagcaccauuaggaguaccugauuuucaaggacgaguuuucggcguaauaucacaaagagauaaacaaaaugcugcaggacacaaugaaccagcaaauagaggacaugaugcaguuguuccaaccuauacugcacaauacacaccuaagcuaggacaaauacaaaucggaacauggcaaacagaugaccuuaccgucaaucaaccuguuaaauucacaccuguugguuugaacgauacagaacacuuuaaccaauggguaguaccacgauacgcaggcgcacuaaaucuaaacacaaauuuagcaccaucaguugcuccuguauuuccaggagaaagauuacuuuuuuuuagaucauauauaccacuuaaaggagguuauggaaauccagcuauugacuguuuauuaccccaagaauggguacaacauuuuuaucaagaagcagcuccaucaaugucagaaguagcacuaguaagauacauaaauccagacacaggaagagcuuuauuugaagcuaaacuccauagagcaggauuuaugacagugucaucaaauacaucagcuccaguaguaguuccugcaaaugguuauuucagauuugauucuuggguuaaucaauucuauucacuugcuccaauggguaccggaaacggacgacgaagaguacaauaa

SEQ ID NO: 32298 - RNA, 1647 nt, Artificial Sequence
  derived and/or modified sequence opt6 from capsid__Norovirus__ABQ44569
augaaaauggcuucaaacgaugcugccccaucaaacgacggagccgcuggacuaguaccagaaauaaacaaugaagcuauggcccuagacccugucgcaggcgccgcaaucgcagcaccuuuaacaggacaacaaaacauaauagacccauggauaaugaauaacuuuguucaagcaccaggaggugaauuuacaguaucaccaagaaauuccccaggugaaguucuacuaaauuuagaauuaggaccugaaauaaauccuuaccucgcucauuuagcacgcauguacaacgguuacgcuggaggauucgaaguacaagucguuuuagccggcaaugcuuuuacagcaggaaaaauaauauuugcagccaucccaccuaauuuuccaaucgauaacuuaucugcagcacaaauuacaaugugcccacauguuaucgucgacguacgucaacuagaaccaguaaacuuaccaaugccugacguucgaaacaauuucuuucacuacaaccaagguucagacucaagacucagauuaaucgcuauguuauacacaccauuaagagcaaauaacucaggagaugacguauuuacaguaucuugucgaguccuaacaagaccaucaccagacuuuucauucaacuuccuaguaccaccaacaguugaaucaaaaacaaaaccauucacucuacccauacuaacaauaucggaaauguccaauucaagauucccaguaccuauugacucauuacacacaucuccaacagaaaacaucguaguacaaugccaaaacgguagaguaacauuagauggcgaacuaaugggaaccacccaauuacucccaucacaaauaugugcauuucgaggaguacuaaccagaaguacaucuagagcuucagaucaagcagauacagcaacaccaagauuauuuaacuacuacuggcauauacaacuugauaaccuaaacggaaccccauacgauccagcagaagauauuccuggaccauuaggaacaccugauuucagaggcaaaguauucggagucgcaagccaaagaaauccagauucaacaacaagagcacaugaagcaaaaguagacacaacagcaggaagauuuaccccaaaauuaggaucacuagaaauaagcacagaaucugacgauuuugaucaaaaucaaccaacaagauuuacccccgucggaauagguguagaccaugaagcugauuuucaacaauggucucuaccagauuauucuggccaauucacacacaacaugaaucuagcaccugcaguagccccaaauuuuccuggugaacaacuccuuuucuuuagaagucaacuuccaucaucaggaggaagaucaaacggaauauuagauugucuaguaccacaagaauggguccaacauuuuuaucaagaaucugccccagcacaaacacaaguagcauuaguacguuacguuaacccagauacuggacgagucuuauucgaagcaaaacuucacaaauuaggauuuaugacaaucgcaaaaaacggagacucuccuauaacaguaccccccaauggguacuucagauucgaaucuuggguaaaccccuuuuacacacucgcuccuaugggaacaggaaauggaagaagaagaauacaauaa

SEQ ID NO: 32299 - RNA, 1623 nt, Artificial Sequence
  derived and/or modified sequence opt6 from capsid__Norovirus__ABQ44570
augaaaauggccucaaaugaugcagcaccuucuaaugacggagccgcaggacuagucccagaaaguaacaaugaagcaauggcacuugaaccuguaaugggugcuucacuagcugcaccuguaacaggccaaacuaacaucauugacccauggaucagaacuaauuucguacaagcaccuaauggugaauuuacagucagccccagaaacucaccuggagaaauacuuguaaauuuagaauuaggaccagaacuaaaucccuaucuagcacaccuagcacgaauguacaacggauaugcaggcgguauggaaguucaagucauguuagcaggaaacgcauucacagccggaaaaauuauauuugcagcaguaccaccuuauuuuccaguagaaaacuuaucaccaucacaaauaacaauguuuccacauguaaucauagauguaagaacauuagaaccaguucuauuacccaugccagauguacgcucaacacuauuccauuuuaaccaaaaagaugaaccaaaaaugagauuaguagcaauguuauauacaccucuaagaucaaauggcucaggagacgacguauucacaguaucaugccgaauacuaacuagaccaucacccgaauuugauuucacauaucuuguaccacccacugucgaaucuaaaaccaaaccuuucaccuuaccaguucuaacacuuggagaacuauccaauucaagauuucccuuaaguaucgacgaaaugguaacuaguccaaaugaaucaauaguuguacaaccucaaaacggaagaguaacauuagacggagaacuauuaggaacaacacaacuacaagcuugcaauauauguucuauaagagguaaagucacaggacaaguacccaaugaacaacacauguggaaucuggaaguaacuaaucuaaacgguacacaauucgacccaacagacgauguccccgcuccacugggcguaccagauuucgcaggagaaguauuuggcguauuaagccaacgaaaucgaggugaaucaaacccagcaaacagagcccacgaugcuguaguagcaacauauucugauaaauauacaccaaaacuaggacuaguccaaauaggaacauggaauacaaaugacguagaaaaucaaccaacaaaauuuaccccaauagguuuaaaugaaguagcaaacggacauagauuugaacaauggaccuuaccuagauauucaggugcucuaacacuuaacaugaaucuugcaccagcagucgcaccucuauucccaggagaacgauuacuauuuuuuagaucauauauuccauuaaaaggaggguuuggaaauccugcgauugauugccuaguaccccaagaauggguccaacauuuuuaccaagaaucagcuccuucuuuaggcgauguugcacuagugagauauguuaauccagauacaggacguguauuauuugaagcuaaauuacacaaaggaggauucuuaacaguaucaucaacaucuacagguccaguagucguaccagccaacggauauuuccguuuugacucauggguaaaucaauuuuauucacuagcaccaaugggcacagguaaugguagaagaagguuccaauaa

SEQ ID NO: 32300 - RNA, 1653 nt, Artificial Sequence
  derived and/or modified sequence opt6 from capsid__Norovirus__ABQ44571
augaaaauggccuccaaugacgcagcaccuucaaacgauggcgcagcaaacuuaguuccagaagcaaacaaugaaguaauggcauuagaaccaguaguaggcgcaaguauagccgcaccaguaguaggacaacaaaacauaauagacccauggauuagagaaaacuuuguacaagcaccacaaggcgaauucacaguaucaccaagaaauaguccaggagaaauguuacuaaaucuugaacuaggaccugaauuaaacccauauuuaucucauuuaaguagaauguauaacggcuacgcuggaggaaugcaaguccaaguuguacuagcuggaaacgcauuuacagccggaaaaauaauauuugcagcaguaccaccacacuuucccguagauaauauaagugccgcacaaauaaccauguguccucauguaauuguugauguaagacaacucgaaccaguauuauuaccacuaccagauauaagaaaccgcuucuuccauuauaaucaagaaaauaccccacgaaugagacuugucgcaauguuauacacaccauuaagagcuaauucuggagaagauguguucacgguauccugccgaguauuaacacgaccagcaccagacuucgaauucacuuucuuaguaccaccaacaguagaaucaaaaaccaaacccuuuacauuaccaauuuuaacacuaggagaauuauccaacucuagauucccagcagccauagauaugcuauacacggauccaaaugaaagcauaguaguacaaccucaaaauggaagauguacauuagauggaacauuacaaggcacaacacaacuaguaccaacacaaauuugugcauucagagguacauuaauaucccaaaccgcacgcgcagcugauucuacugacucgccccaacgagcucgugaucacccacuacauguacaaguaaaaaacuuagacggaacacaauacgacccaacagaugauauaccagcaguacuuggagcaauagacuuuaaaggaacaguguucggaguagcaucacaacgcgacgucuccggcccacaagaacaaggacacuaugcaacaagagcacacgaagcacauauagauacaacagacccaaaauaugcaccuaaauuaggaacaauacuuauaaaaucagaauccaaugacuuuaucacaaaccaaccaauaagauuuaccccaguagguaugggagacaacaacuggagacaaugggaacuucccgacuacucaggaagauuaacacuaaacaugaaccuagcaccagcaguaucuccaucuuucccaggagaaagaauauuauucuuuagaucuauagugccaucugccggaggauauggcucaggauauauagauugccuaauaccacaagaauggguucaacauuucuaucaagaagccgcaccaucucaaucagcaguagcauuaguacgauacguuaacccagauacaggaagaaacauauuugaagcaaaacuacaucgugaaggauuuuuaaccguagccaauucaggaaacaauccaauuguaguaccaccaaaugguuauuucagauucgaagcauggguaaaucaauuuuacacacuagcaccaaugggaucaggucaaggaagaagaagggcacaauaa

SEQ ID NO: 32301 - RNA, 1623 nt, Artificial Sequence
  derived and/or modified sequence opt6 from capsid__Norovirus__ABQ44572
augaagauggcauccaacgacgccgcaccauccucagacggcgcagcaggauuaguaccagaaauaaacaaugaaguuaugccacuugauccuguugcaggugcuucacuagccacuccagucguaggacaacaaaauauaauugacccauggauacgaaauaauuuuguacaagcaccagcuggagaauuuacaguaucaccaagaaacucuccaggagaaauacuacuagaucucgaauuaggcccagaacucaacccauauuuagcucaccuugcacggauguauaacggucaugcagguggcauggaaguacaaauaguccuagcaggcaacgccuuuacagccggaaaaauuauauucgcagcuauaccaccaggauuucccuacgaaaauuuaucuccaucacaaauuacaaugugcccacacguaauaauagauguaagacaauuagaaccaguccuacuaccaaugccugacauaagaaacaauuucuuccacuauaaucaaggaaacgacccaaaauuaagacuaguagcaauguuauacaccccacuacgagcaaacaauucuggagacgacguauuuacuguuuccugucgaguacuaaccaaaccaagucccgacuuugaauuuacauuucuuguaccacccacagucgaaaguaaaacuaaacaauucacacuaccaauccuaaaaauuucagaaaugacaaacuccagauuuccuguaccaguagacguaauguauacagcacgaaacgaaaaucaaguaguccaaccucaaaauggacgaguaacauuagacggagaauuacucggaacgacaccacuuuuagcugucaauauaugcaaauucaaaggugaaguaauagcaaaaaauggagacguacguuccuauagaauggacauggaaauaacaaacacagacggaacacccauagauccaaccgaggacacaccaggaccaauuggaucaccagacuuucaggguauauuauucggaguagcaucucaacgaaacaaaaacgaacaaaauccagcaacacgcgcucaugaagcuaauauuaauacagguggagaucaauaugcuccaaaacuagcacaaguaaaauuuuuuagugaaucacaagacuucgaaguacaucaaccaacaacauuuaccccaguaggaguagcaggagauaauucucacccauuuagacaauggacacuaccacgauauggaggacacuuaaccaacaacacucacuuagccccugccguagcaccacuuuucccaggagaacaauuauuauuuuuucgaucucaaauaccaucaucaggaggacacgaaucuggauauauggauugcuuaguaccacaagaauggguucaacauuucuaccaagaagcugcaacagcacaaucagaaguugcauuaauuagauucauuaauccagacaccggaagaguauuauucgaagcaaaacuacacaaacaaggauucauaacaguagcacacacaggagacaauccaauaguaaugccaccuaauggauauuuccgauuugaagcaugggucaaccaauuuuacucuuuagccccuguaggaacuggaaauggaagaagaagaguucaauga

SEQ ID NO: 32302 - RNA, 1608 nt, Artificial Sequence
  derived and/or modified sequence opt6 from capsid__Norovirus__ABQ44573
augaaaauggcaucaaaugacgccgcaccaucaaacgacggcgcugccggacuaguuccugaagccaacaacgaaacaauggcccuagaaccaguugcuggagccucaauagcagcaccucuaacaggacaaaacaauauaaucgacccauggauccgauuaaacuuuguacaggcaccaaacggcgaauucaccguaucaccaagaaauucacccggagaaguuuuacuuaaucuagaacuaggaccagaacuaaacccuuacuuagcacauuuaucaagaauguauaauggauaugcaggaggcgucgaaguacaaguacuucuagcagguaaugccuuuacagccggcaaauuaguauucgccgcaguaccuccccauuuuccacucgaaaacaucucccccggacaaauaacaauguucccucauguaauaaucgauguaagaacacuagaaccaguucuauuacccuuaccagacguacgcaauaauuuuuuucauuacaaucaacaaaacgaaccuagaaugcgauuaguagcaauguuauacacaccacuuagaucaaauggaucuggagaugauguauucacagucucaugcagaguauuaacccgucccucaccagacuuugacuuuaauuaccuaguaccaccaacagucgaauccaaaacaaaacccuuuacacucccaauccuaacaauaggagaauuaacaaacagccgauucccaguuccaauagacgaacucuacacaucaccaaacgaaucacuuguaguucagccacaaaacggaagaugugccuuagauggagaauuacaaggaacaacacaacuccuucccaccgccaucugcucauucagaggaagaauaaaccaaaaaguuucaggagaaaaccacguauggaauaugcaaguuaccaacauaaacggaacaccauucgacccaacagaagaugucccuguaccacuaggaacaccagacuuuucaggaaaacuuuucggcguacucucacaaagagaucaugacaaugccugcagaucacacgaugcaguaaucgcaacaaauucagcuaaauucacaccuaaacuaggcgccauacaaauaggaacaugggaagaaaacgauguacauauuaaccaacccacuaaauucacacccguagguuuauuugaagacgaagguuuuaaucaauggacccuaccaaacuauucuggagcuuuaacuuuaaacgucggacuagcaccaccaguugcaccaaccuucccaggagaacaaauacuauucuucagaucacacauuccacuaaaaggagguguagcugaccccguaauagacugcuuacuaccacaagaauggauacaacaucuauaccaagaauccgcaccuucacaaucugacguagccuugaucagauucacaaacccagacacaggccgaguucuauuugaagcaaaauuacacagaucaggcuacauaacaguagcaaacaccggaucacgaccaaucguaguaccagcaaacggauacuucagauuugauucuuggguaaaccaauuuuacucauuagcaccaaugggaacaggcaacggacgcagaagagugcaauaa

SEQ ID NO: 32303 - RNA, 1614 nt, Artificial Sequence
  derived and/or modified sequence opt6 from capsid__Norovirus__ABQ44574
augaaaauggcauccaaugacgcaacaccauccgacgauggagcagcuggcuuaguuccagaaauaaacaaugaaguaauggcacucgaaccaguagcaggagcaucaauagcugccccggucguaggccaacaaaauauaauugacccauggauaagaaauaacuucguacaagcuccagcaggagaauuuacuguaaguccaagaaauucgccaggcgaauuacuacucgaucuugaacucggcccagaauuaaauccauaucuagcacaucuagcaagaauguacaacggucaugcuggaggaauggaagugcaaauaguacuugcaggaaaugccuucacagcaggcaaaauccuauuugcagcaauaccacccucauucccuuacgaaaauuuaucaccagcccaacuaaccaugugcccucacguaauaguugacgucagacaacuagaaccuguucuacuaccuaugccugacauaagaaauguauucuaucacuauaaccaaaacaacucacccaaacuaagauuaguagccauguuauauacaccauuaagagcaaauaauagcggcgacgauguauuuacaguauccuguagaguacuaacaagacccuccccugacuuccaauuuacauucuuaguaccaccaacaguagaaucaaaaacaaaaaacuucacucucccaguauuaagagucucugaaaugacaaacucacgaguaccaagauguuucggaaccaaauguauacaagccagaaaugaaaacauaauaguucaaccacaaaauggucgauguacaacagauggagaguuauuagguaccacaacauuacaaagcguaucaauaugcaauuucagagguacaaugcaagccaaauuaaacgaacaaccaagauaucaacuacaauuaacaaaccuagauggaucaccaauagauccaaccgacgauaugccagcuccauuagguacccccgauuuucaagcaauguuauacggcguagcaucacaacgaucuucaagagauaaugcaacaagagcacaugaugcucaaauagauacagcaggagauacauucgccccaaaaauaggccaaguaagauucaaaucaaguuccggcgauuuugauuuacacgacccaacaaaauucacaccaauaggaguuaacguugacgaccaacacccauuuagacaauggucauuaccaaauuaugguggucaccuagcccuaaauaaccacuuagcgccagccguuacaccucuauuuccaggagaacaaauccuauuuuucagaucacauauaccauccgccgguggucacacagauggagcaauggacugcuuauuaccacaagaauggauagaacacuucuaccaagaagccgcaccuucccaaucagauauagcacucguacguuuuauuaauccagacacaggaagaguacuauuagaagcaaaacuacacaaacaaggauuccuaacaguagcagcuucaggagaccacccaauagucaugccaacaaauggauacuucagauucgaagcauggguaaauccauucuauacauuagcuccaguaggcacaggauccggaagaagaagaauacaauag

SEQ ID NO: 32304 - RNA, 1641 nt, Artificial Sequence
  derived and/or modified sequence opt6 from capsid__Norovirus__ABQ44575
augaaaauggcaagcaaugaugcugccccaucuaacgacggagcugcaucacuaguacccgaaggaaucaaugaaacaaugcccuuagaaccuguagcaggcgcaucaauugccgcuccugucgcaggacaaacuaacauaauagaccccuggauaagaacaaacuuuguacaagcaccaaacggagaauuuacaguaucuccaagaaacucaccaggagaaauccuacuaaacuuagaacuaggucccgaccuaaauccauaucuagcacaucuaucccgaauguacaauggauacgcugguggaguugaaguacaaguacuauuagcaggaaacgcauucacugcaggcaaaauacuauuugcagcaauaccuccaaacuuuccuguggacaugauuuccccagcucaaauaacaaugcucccucaccuuauaguagacgucagaacucuagaaccuauaaugauaccuuuaccagacguaagaaauguauucuaccacuuuaacaaccaaccacaacccagaaugagauuaguagcaaugcuauauaccccccuuagaucuaauggaucaggagaugacgucuuuacaguaucaugccgaguacuuacacgaccaacaccagacuucgaauucauauauuuaguaccuccaucagucgaaucaaaaaccaaacccuucacccuaccaauacuaacaauaucagaauuaacaaacucaagauucccuauaccaauagaacaauuauacacagcaccaaacgaaacaaaugucguacaaugccagaacggccguugcacccuagauggagaauuacaaggaacaacacaacuacuauccuccgcuguauguucauacagaggacgcacagucgcaaacaacggagacaacugggaucaaaacuuacuucaacuaacuuauccaaacggagcaucauacgauccaacagacgaaguaccagcuccccuaggaacacaagacuuuucuggaaugcuauaugguguauuaacacaagacaauguaaacguauccaccggagaagcuaaaaacgcuaaagguauauacauaucaacuaccucuggaaaauucacaccaaaaauaggauccauaggacuacacucuauaacagaacacguacauccaaaccaacaaucaagauuuacacccguuggaguagcagucaaugaaaacacaccauuucaacaauggguacuuccccacuaugcaggaucucuagcccuaaauacuaaccuugcuccagcaguugcaccaacauuuccaggagaacaauuauuauucuuuagaucacguguuccaugcguucaaggucuacaaggacaagaugcauucauagauugccuacuaccacaagaguggguaaaccacuuuuaccaagaagcagcaccagcaccagcaccaucccaagcagacguugcacuaauacgcuacguaaauccagacacaggaagaacucuuuucgaagccaaacuacaucgaucuggauucauaaccgucucccacacaggcgcauacccacuaguuguuccaccaaacggacacuuccgauucgauagcuggguuaaucaauucuacucauuagcaccaaugggcacaggaaacgguagacgaagaauccaauaa

SEQ ID NO: 32305 - RNA, 1623 nt, Artificial Sequence
  derived and/or modified sequence opt6 from capsid__Norovirus__ABQ44576
augaaaauggcaucuaacgaugccgccccaucuaaugacggugcugcugguuuaguaccagaaguaaauaacgaaacauuagcacucgaaccagucgcuggugcuucaauugcagcaccacuaacaggucaaaacaacguaaucgauccuuggaucagauuaaacuuuguacaagcaccaaauggagaauucacaguaucuccacgcaauucaccaggcgaaauauuauuaaaucucgaacugggaccagaauuaaauccauaccucgcucaccuugcaagaauguacaauggauaugcaggaggaguagaaguacaaguauuauuagcaggcaacgcauuuacagcugggaaauuaguauucgcagcuauucccccacauuucccuguagauaaucuauccccaggccaaauaacaauguuuccacauguaauaaucgaugucagaacguuagaacccguccuucuaccuuuaccagacguacgaaacucauucuuccacuacaaccaacaaucagaucagcguaugagauuaauugcaaugcuauacacaccacuuagaucaaauggcucaggggacgacguauuuacaguaucuugccgcguacuuacaagaccuucaccagauuucgauuuuaauuaccuuguaccaccaacugucgaaucaaaaacaaaaccauuuucaguaccaguacuaacauuaaaugaacucacaaauucacgauucccaguaccaauagaugcuauguacacauccccaaacgauucuauaguaguacaaccacaaaauggccgagcaacaaucgacggcgaacuauuaggcacaacacaacucauaccuucaggcauaugcucuuuuagaggaaaaauaacuacacaccuaucagaugacagacaucuauggaauauacaaguuacaaaucuaaauggaaccccauuugauccuacagaugauguccccgcuccucucggaaugccugauuucucaggccaaauauuugguguaguuucacaaagagauacaggaacaaacccagcaaauagagcacaugaugcaguacucgcuacauauucagcaaaauauacaccaaaacuuggcucuguccaaauagguacaugggacacagaagaccuuuuagaacgacaaccuguaaaauucacacccguaggucuaaacgaaauaggccaagacaaacauuucgaucaauggguacuaccuaacuacucuggagcuuuaggacucaacaugcaucuagccccagcaguaucccccuuauucccaggagaaagauuacuauuuuuccgaucauauauaccccuaaaaggaggacacggagacccauucauagacugucuagucccacaagaauggauacaacacuuuuaucaagaaucagcaccagcacaaucaucaguagcuuuacucagauauguaaacccugauacaggacgaacacuauucgaagccaaauuacacaaagaagguuuuauuaccguaucaucaaccgaaaaucgaccaguuguaguaccaccaaacggauacuuuagauuugacucauggguaaaucaauucuauucccuagcaccaauggguacugguaaugguagaagaagaaugcaauaa

SEQ ID NO: 32306 - RNA, 1569 nt, Artificial Sequence
  derived and/or modified sequence opt6 from capsid__Norovirus__ACJ04900
augaaaaugacugacagagauacaauagauucagcaccagcauuaggacaaguacuaccucccgaaguugaagcuucugucccagucgaaccuacugcaggggcaccaguugcagcaccaacugcaggccaaguaaauccuauagauccauggauauucgccaacuuuguucaagcaccacaaggagaauuuaccauuucuccuaauaauaaucccggugaaauuuuauuugaacuagaauuaggaccagauuuaaauccauauuuagcccacuuacgacgaauguauaaugguuggacaggaaguaugagaguucgcguacuauuagcagguaaugcauuuucagcagguaaaguuguagucuucuguguaccuccaggauuugauacaucauauuuaacaccaagucaagcaacucaauuuccucauguccuaauagacguaagagcaccugagccagucgaaaugccauuagaagacguacgaaacauacuuuuccaucaagguccagauucaagaaugagauuaaugggaaugcuauauacuccucuccgagcaaauucaggagccgauccuuuuguuguaacaggucgaguucuaacaugucccucaccaaauuucucauuuuuuuuccuaguuccaccaacugucgaagaaagagaaacuccauucacuuuaccaaaccuuccaguuaauucauuaucacacucacgcgccauggaaccaauugcucaaaugaugucuaguagaaauuucccagcuucuguucaauuucaaaacggaagauguacacuaucuggugauuuauuaggaacaacaccaucauccccugcagacguaggaacuuuuguaggacuaauagcagaaccaggaucucauguaguugaacuaagucaaccaaaccaagaagacuuucaugcuggaucagccccagcaccuuucggcuuuccagauuuuucagauuguucauuaacuuuuguagucgcaucagcaucuacgguaggagaaagaaccguaaacacaagaucaccucaaaacuuuacacccgcauuaggucauauaacauuugaugaagaagcuccugcagaucuuuuucgugcccauuuaagaaacuuaugggauccaacagaacauucauuuuggagaauaccagauuauagagcagauguauuaggcggagaauuugcaccaucaguaucugcaccagguguuggagaaacauuacuuuuuuucauguguaacguaccaagaucaaauggagcuaauccaaauccauguccuugccuauuaccucaagaauggauaacacauuucguaucugaaagagcagcauuacaaucugacgucgcucuacuaaauuauauaaaccccaacacaggacguguauuauuugaaugcaaacuauacgcaaauggauuccuuacaguaaauuuaggcgcuucagaucaagcaacuuuaccuguagaugguauauucaaauucguaucauggguaucauuuuauuaucaauuaagaccagucggcaauauaggaguagguagaagacuaccacgauuagaugguuuuuaa

SEQ ID NO: 32307 - RNA, 1569 nt, Artificial Sequence
  derived and/or modified sequence opt6 from capsid__Norovirus__ACJ04903
augaaaaugacagacagagauaccauagauucagcuccugcccugggccaaguacuacccccagaaguagaagcaucaguaccuguagaaccuacagccggagcaccaguagcagcaccaacugcaggacaaguaaacccaauagacccauggauauucgcuaacuuuguccaagcuccacaaggcgaauucaccauauccccaaacaauaauccaggugaaauucuuuuugaacuugaacuaggaccagacuuaaacccauaucuagcacacuuaagaagaauguacaaugguuggacaggaagcaugcgaguucguguacuauuagcaggaaaugcauuuucagcaggaaaaguaguaguauuuugcgugccaccaggauuugauacaucauaucuaacuccaucacaagcaacucaauuuccacauguauuaauagauguacgcgcacccgaaccaguugaaaugccauuagaagauguuagaaauauacuuuuucaucaagguccagauucaagaaugagacuaaugggaauguuauauacaccccuaagagcuaacucuggagcagauccauucgucguuacaggaagaguucuaacauguccaucaccaaacuuuucauuuuuuuuuuuaguaccaccaacuguagaagaaagagaaacaccauucacuuuacccaauuuaccaguaaauucacuaucacauucaagaguuauggaaccaauagcccaaaugaugucaucaagaaacuucccugcaucaguacaauuccaaaacgguagauguacucuuucaggugacuuauuagguacuacuccauccucgcccgcagauuuaggaacuuucgucggauuaauugcugaaccaggaucucacguagcagaauuaucucaaccaaaucaagaagauuuccacgcuggcucugccccugcacccuuuggauucccagacuuuuccgaauguucacuaacauucguaguagcaucagcaucuacaguaggagaaagaacaguuaacacaagaucauuacaaaauuucacaccagccuuaggacacauaacauuugaugaagaagcaccagcagauuuauucagagcucauuuaagaaaccuaugggauccaacugaacauucauuuuggagaauaccugauuaucgagcagacguccuaggaggagaauucgccccgucuguaagugcuccaggaguuggagaaacauuauuauucuucauguguaauguaccaagauuaaauggagcaaauccaaauccauguccaugucuacucccccaagaauggauaacacacuuuguuucugaaagagcagcacuccaaucagauguagcucuuuuaaauuauauuaaccccaacacaggaagaguucuuuucgaauguaaacuauacguaaauggcuuucuaacuguaaacuuaggagccucugaucaagcaacacuaccaguagacggaauauuuaaauucguaucaugggucucauuuuauuaucaacuucgucccguagguaauaucgguguaggcagacgccuaccaagacuagacgguuucuaa

SEQ ID NO: 32308 - RNA, 1569 nt, Artificial Sequence
  derived and/or modified sequence opt6 from capsid__Norovirus__ACJ04906
augaaaaugaccgauagagacguaacugacucagcaccagcacuaggacaagucuuaccaccagaaguagaagcaucaguaccaguugaaccaacugcuggagcaccaguagcagccccaacagcaggacaaguaaacccaauugauccauggauauucgcaaauuuuguccaagcuccacaaggcgaauuuaccaucucaccaaauaauaauccaggagaaauacuauucgaacuagaauuaggaccagauuuaaauccauauuuagcccaucucagacguauguauaacggauggacuggcuccaugagagucagaguuuuauuagcuggaaacgcauuuucugcuggaaaaguaguaguauuuugcguuccaccagguuuugauacaucauauuuaacaccaucacaagcuacacaauucccucauguacuuauugauguaagagcuccagaacccguugaaaugccacuagaagauguaagaaacauauuauuucaucaaggaccagacucaagaaugagacuaauggguauguuauacaccccacuacgagcaaacucaggugccgauccauucgucgucacaggaagaguccuaacauguccauccccaaacuuuuccuuuuuuuuuuuaguaccuccaacugucgaagaaagagaaccaccuuuuacucuuccuaauuuaccaguaaacaacuuaucacacucaagaguuauggaaccaauagcucaaaugaugucuucaagaaauuuuccagcaucaguucaauuucaaaauggacgaugcacauuaucaggagauuuauuaggaacaacaccaagcuccccuucugauuuaggagcauuuguagguuuaauagcagaaccuggaucaagaguuguagaauuaucccaaccaaaucaagaagauuuccacgccggaucagcaccagcuccauucggauuuccugauuuuucagauuguucucuuacauucguaguagcaucagcaacaacaguaggugaaagaacaguaaaugcccgaucuccccaaaacuucacaccagcacuaggacauauaacauucgacgaagaagcaccugcagacuuauuucgcgcacaccuaagaaaucuaugggaucccacugaacauucuuuuuggcguauaccagauuauagagcagauguauuaggaucugaauucgcaccuucaguaucagcaccagguguaggagaaacacuauuauucuuuaugugcaauguaccuagacuaaacggcgcaaauccaaacccauguccaugcuuacuaccacaagaauggauaacccauuuuguaucagaaagagcagccuuacaaucugacguagcauuauuaaauuauguaaacccaaauacaggaagaguacuauucgaagcaaaacucuacgcaaauggauuuuuaacuguaaauuuaggagcaucagaucaagcuacucuucccguagauggaauuuuuaaauuuguauccuggguaucauucuauuaucaacuuagaccaguaggcaaugcuuccguagguagaagacuaccaagacuugauggauuuuaa

SEQ ID NO: 32309 - RNA, 1623 nt, Artificial Sequence
  derived and/or modified sequence opt6 from capsid__Norovirus__ACY00565
augaaaauggcaucaaaugaugcaaauccaucagauggauccgcagcuaauuuagucccagaaguaaauaaugaaguaauggcauuagaacccguagugggagcagcuauagcagccccuguugcaggacaacaaaacguaauagacccauggauacgcaauaauuuuguucaagcaccaggcggugaauuuacaguuucaccaagaaaugccccaggagaaauucuuuggucagcaccacuaggaccugaucuaaauccuuauuuaagucauuuagcaagaauguauaacggauacgcuggagguuuugaaguacaaguaauauuagcaggaaaugcauuuacagcuggaaaaauaaucuuugcagcuguaccuccuaacuuccccacugaaggauuaucuccaucacaagugacuauguucccccauauaauaguagacguuagacaauuagaacccguauuaauaccauuaccagaugucagaaacaacuucuaucauuacaaucaaaguaacgacucaacaaucaaacuaauagcaauguuauacacuccauuaagagcaaacaaugcaggagaagaugucuucacuguuucauguagaguacuaacaagaccaucaccagacuuugauuuuauauuucuagucccaccaacagucgaaucuagaacaaaaccuuucacaguaccaauauuaaccguagaagaaaugacaaacucaagauucccaauaccauuagaaaagcuauucacaggucccagcucagcuuucguagugcaaccacaaucaggaagaugcacaaccgacggaguucuauuaggaacaacucaauuaucuccaguaaauauaugcacauuuagaggagauguaacacauauugcaggcucaagaaacuauaccaugaaucuagcaucacuaaacuggaauaauuacgauccaacagaagaaauaccugcaccuuuaggaacaccagauuucguaggaaaaauacaaggaguuuuaacucaaacaacaaaaggagacggaucuacccgaggacacaaagcaacaguuuauacugguucagccccauucacgcccaaacuaggauccguacaauucucuacagauacagaaaacgacuucgaaacacaucaaaacacaaaauuuacaccaguugguguuauacaagauggaggaacaacucaucguaacgaaccacaacaauggguacuaccauccuacucaggaagaaauguaccaaacguucacuuagcaccagcaguagccccaaccuuuccuggugaacaacuauuauuuuuuagaucaacaaugccagguugcucuggcuacccuaaugucgaucuagauuguuuacuaccacaagaauggguucaacauuucuaccaagaagcagcaccagcacaaucagacguagcacuccuacgcuucguaaacccugacaccggacgaguacuuuuugaauguaaacuacacaaaucagguuaugucacaguagcucauacaggacaacaugaucuaguuauaccaccaaauggauauuucagauucgauucauggguaaaccaauuuuauacucuagcaccaaugggcaacggaacaggaagaagaagagcacucuaa

SEQ ID NO: 32310 - RNA, 1623 nt, Artificial Sequence
  derived and/or modified sequence opt6 from capsid__Norovirus__ACY00568
augaaaauggcaaguaaugaugccaacccaucagauggaagugcugcaaacuuaguaccagaagucaauaaugaaguaauggcacuagaaccaguuguaggagcagcaauagcagcuccaguagcaggacaacaaaauguaauagauccauggauaagaaacaauuuuguucaagcaccaggaggagaauucacagucucaccacgaaacgcaccaggagaaauuuuauggucagcaccuuuaggaccagaccuaaauccauacuuaagucaccuagccagaauguauaaugguuaugcagguggauucgaaguccaaguaauacuagcaggcaacgcauuuacggcaggaaaaauaauuuuugcugccguaccaccuaauuuuccaacagaaggccuaucaccaucacaaguaacaauguuuccacacauaauaguagacguacgccaacucgaaccaguacuuauuccacuaccagauguaagaaacaauuucuaucauuauaaccaaucaaaugacucuacuauaaaacucauagcaauguuauacacuccacuuagagcuaauaaugcaggcgaagacgucuuuacaguaaguugucgaguauuaacaagaccauccccagacuucgacuuuaucuuuuuaguuccuccaacuguugaaucacgaacaaaaccauuuacuguaccuauacuaacaguagaagaaaugacaaacucaagauuuccaauaccauuagaaaaauuauuuacaggaccuaguagugccuucguaguacaaccucaaaacggacgauguacaacugauggaguacuacucgguacaacucaacuaucaccaguaaacauaugcacauuucgaggagauguaacucauauagccggauccagaaacuauacaaugaaccuugcaucauuaaauuggaacaacuacgacccaacagaagaaauuccagcaccauuagguacacccgauuuuguaggaaaaauacaaggagucuuaacucaaacaacaaaaggagauggaucaaccagaggacacaaagcaacuguauauacagguucagcaccauuuacaccaaaacuuggaagcguacaauucucaacagacacagaaaaugauuucgaaacccaucaaaauacaaaauucacaccaguaggaguaauucaagacggcuccacaacacaucgaaacgaaccacaacaauggguauuaccaucauauucaggaagaaauguaccuaacguacaucuagcgcccgcaguugccccaacuuuuccaggagaacaacuacuuuucuuuagaucuacaaugccuggauguucaggauaucccaauauggaccuugauugccuacuaccucaagaauggguacaacauuucuaccaagaagcagcaccagcacaaucagaugucgccuuacuaagauucgucaacccagacacuggcagaguauuauucgaaugcaaacugcauaaaagcggauaugucacuguagcacauacaggucaacacgauuuaguaaucccuccaaauggauauuucagauuugauagcuggguaaaccaauucuauacucuugcuccaaugggaaauggcacaggcagaagacgagcacuauaa

SEQ ID NO: 32311 - RNA, 1623 nt, Artificial Sequence
  derived and/or modified sequence opt6 from capsid__Norovirus__ACY00571
augaaaauggcaucuaaugacgcaaacccaagcgauggaucagcagcuaacuuaguaccagaaguaaacaacgaaguaauggcacucgaacccguuguuggagcagcuaucgcugccccuguagcaggacaacaaaacgucauugaucccuggauaagaaauaauuuuguacaagcuccaggcggagaauuuacuguaucuccaagaaaugcaccuggagaaauacuauggucagcucccuuaggaccugacuuaaacccaaaucuaucucacuuagcuagaauguauaacggauaugcagguggauucgaaguacaaguaauccuagcaggaaaugcauuuacagcaggaaaaaucauuuucgccgccguaccaccaaacuuuccaacugaaggauuaucccccucacaaguuaccauguucccacacaucaucguugacguaagacaacuugaaccuguucuaaucccacucccagauguaagaaauaauuucuaucacuacaaccaaucaaaugacuccacaauaaaauuaauagcaauguuauacacccccuuacgugcuaacaaugcaggagaagauguauuuacaguaaguugucgcguacuaacuagacccagcccagauuuugacuuuauauuucuaguaccaccaaccguagaaucucgaacuaaaccauucacaguaccuauucuuaccguagaagaaaugacaaauucaagauuuccuauuccccuagaaaaacuuuuuacaggaccaucuuccgcauuuguagugcaaccccaaaacggaagauguacaacagacggaguacuguuaggaacaacacaacuaucaccaguaaacauauguaccuuucgcggugacguuacacacauagcuggcagcagaaauuacacaaugaacuuagcaagucuaaauuggaacaacuacgauccaacagaagaaauaccugccccccuuggaacacccgacuucgucggaaaaauacaaggaguauuaacucaaacaacaaaaggagacggauccacuagaggacacaaagcaaccguauacacaggaucagcaccauucacacccaaacuaggaucaguccaguuuagcacagauacagaaaaugauuucgaaacacaucaaaacacaaaauucacuccagucggaguaauucaagacggaggaacaacacacagaaaugaaccccaacaauggguacuaccuuccuauucuggaagaaacguacaaaauguacacuuagcaccagcaguagcuccaacauucccaggugaacaauuacuauuuuuuagaucaacaaugccagguuguucaggauacccaaacauggaucuagacuguuuauuaccucaagaauggguucaacauuucuaucaagaagcugcuccugcucaaucagacgucgcacuauuaagauuuguaaacccagauacaggaagaguccucuucgaauguaaauuacacaaaucuggauacguaacaguagcacacacuggucaacacgaccuaguaauaccaccaaauggcuauuucagauuugauagcuggguaaaucaauuuuacacauuagcaccaaugggaaauggaacagggagaagaagggcacuauaa

SEQ ID NO: 32312 - RNA, 1623 nt, Artificial Sequence
  derived and/or modified sequence opt6 from capsid__Norovirus__ACY00573
augaaaauggcaucaaacgaugcuaacccuucagauggaucagcagccaaucucguaccagaagucaacaaugaaguuauggcucuagaaccaguaguaggagcagcaauagcagcaccuguagcuggccaacaaaauguaauagauccuuggauaagaaauaacuuuguacaagcaccaggaggcgaauuuacaguaucacccagaaaugcaccaggagaaauacuauggucagccccacuaggaccagauuuaaauccauaccuaagucaccucgccagaauguacaacggguacgcaggcggauucgaaguccaagucauacuagcuggcaaugcauuuaccgcaggaaaaauaauauucgcugcuguaccacccaauuucccaacagaaggucuaucaccuucucaaguaacaauguucccacauaucauuguugauguacgccaauuagaaccaguacuaauaccucuaccggauguaagaaacaacuucuaccauuauaaccaauccaaugauucaacgauaaaauuaauagccaugcuauacacaccacuuagagcuaacaaugccggagaagacguauuuacaguauccuguagaguacuaacaagaccuucuccugauuuugacuuuauauucuuaguccccccaacaguagaaucaagaaccaaaccauuuaccgucccaauacuuacaguugaagaaaugacaaauagucgauuuccaauacccuuagaaaaauuauuuacaggaccaucuggugccuuuguaguccaaccacaaaauggcagauguacaacagauggaguucuauuaggaacaacacaauuaucaccaguaaacauaugcacauuuagaggugauguuacacacauagcaggaucucgaaauuacacaaugaaccucgcaucacuuaacuggaauaauuacgauccaacggaagaaauaccugcuccacuaggcacuccugacuuuguaggcaaaauacaaggugucuuaacacaaacaacuaaaggagacgguucaacuagaggacacaaagccacuguauacacaggaucagcaccuuucacacccaaauuaggcucaguacaauuuucaacugacacagaaaacgauuucgaaacacaucaaaacacaaaauucacaccuguuggaguuauacaagauggaucaaccacacacagaaacgaaccacaacaauggguucuaccaucauauuccggaagagauguacauaacguccacuuagcaccagcaguagccccaacauuuccaggagaacaacuuuuauuuuuuagaagcacuaugccaggaugcucaggauaucccaacauggauuuagacugccuacuaccacaagaauggguacaacacuuuuaucaagaagcagcaccagcacaauccgacguagcauuacuuagauuuguaaaucccgauacaggacgaguauuauuugaauguaaauuacauaaaucuggauauguaacuguugcccacaccggacaacacgaucuuguaauaccuccaaacgguuauuucagauucgacucauggguaaaccaauuuuacacccucgcuccaaugggcaacggaacaggaagaagaagagcacucuaa

SEQ ID NO: 32313 - RNA, 1623 nt, Artificial Sequence
  derived and/or modified sequence opt6 from capsid__Norovirus__ACY00576
augaaaauggcuucaaacgaugccaacccuucagauggaucagcagcaaaucuaguaccagaagucaauaacgaaguaauggcacuagaaccuguagucggagcagcaauagcagcaccaguagcuggacaacaaaauguaauugauccauggauaagaaacaacuuuguccaggcacccggaggagaauuuaccguaucaccacgaaacgcaccuggagaaauccuguggucugcaccauuagguccagauuuaaauccauauuuaucacacuuagcaagaauguauaacggauaugcuggaggcuucgaaguacaagucauacucgcaggaaacgcauuuacagcaggaaaaauaauauucgcagcaguaccaccaaacuuucccacagaaggacuaucgccaucccaaguaaccauguuuccacauaucaucgucgacguucgacaauuagaaccuguauuaauuccauuaccagauguaagaaacaauuuuuaucacuacaaucaaucuaaugacucgacaauuaaacuaauagcuauguuauacacaccuuuaagagcuaauaacgcaggugaagauguauuuacaguaucauguagaguauuaacaagaccaucaccugauuuugacuucauuuuucuuguaccaccaacuguggaaucaagaaccaaaccauuuaccguaccuauccuaacaguugaagaaaugacaaauucuagauucccaauacccuuagaaaaauuauucacaggaccaucuuccgcauuugucguccaaccacaaaacggacguuguacaaccgaugguguacuuuuagguacaacacaacuaucuccaguaaacauuugcaccuuucggggugauguaacccauauagcuggaacacacaauuacaccaugaaucuagcaucauuaaacuggaacaauuaugauccaacagaagaaauaccugccccccuaggaacaccugacuuuguaggaaaaauucaaggaguacuaacacaaaccaccaaaggagauggauccacuaggggacacaaagcaacaguauacacaggauccgcaccauuuaccccaaaacuaggaucaguacaauuuucaacagauacagaaaacgacuuugaaacacaucaaaauacaaaauuuacacccguaggaguaauacaagacggcuccacaacacauagaaacgagccucaacaauggguucuaccaucauauucaggaggaaauguacaaaacguacaccuagcaccagcaguagcacccacauuuccaggugaacaacuacucuuuuuucgaucaacaaugcccggauguucuggauacccaaauauggaucuagauugcuuauuaccacaagaauggguacaacauuucuaucaagaagcagcuccagcccaauccgacguugcacuguuaagauucgugaacccagauacaggaagaguacucuucgaaugcaaauuacauaaaucaggauaugucacaguagcacacacaggacaacacgaucuuguuauaccuccaaauggauauucaagauucgacccuuggguaaaccaauuuuacacacuagcaccaaugggcaauggcacaggaagaagacgagcauuauga

SEQ ID NO: 32314 - RNA, 1623 nt, Artificial Sequence
  derived and/or modified sequence opt6 from capsid__Norovirus__ACY00579
augaaaauggccucaaaugaugcuaauccaucagaugguucagcagcaaaccuaguaccugaaguuaacaacgaaguaauggcacuagaaccaguuguaggagcagcaauagcugcuccagucgcaggccaacagaauguuauagaccccuggauccgcaacaauuucguacaagcaccuggaggcgaauucacuguaucuccaagaaaugcaccuggagaaauacuuuggucugcaccauuagguccugauuuaaauccauaucuuucacaccuagcacgcauguauaaugguuacgccggaggauucgaaguacaaguuauauuagcaggcaaugcuucaacagccggaaaaauaauuuucgcagcaguacccccuaacuuuccaacagaaggacuauccccaagucaaguuacaauguuuccucauauaauaguugacguacgacaacuugaaccaguacuuauaccacuaccagauguuagaaacaauuuuuaccacuauaaucaaucaaaugacuccacaauaaaacuaaucgcaauguuauacacuccucuaagagcaaauaaugcuggagaagauguauuuacagucuccugcagaguauuaaccagaccaucaccagacuuugacuucauuuuccuaguuccccccacaguagaaucuagaacuaaacccuucacagucccuauacuaaccguugaagaaaugaccaacucacgcuuuccaauaccauuagaaaaacuauuuacaggaccaucaucggcauucguaguacaaccacaaaauggaagauguacaacagauggcguauuauuaggcacaacacaauuauccccaguuaauauuugcacuuucagaggagacguaacacauauagcaggaacacacaauuacacaaugaaucuagcaucacuaaauuggaacaauuaugauccaacagaagaaauaccagcaccuuuagguacaccugacuuugucgguaaaauccaaggaguauuaacacaaacaacaaaaggugacggaucaacuagaggacauaaagcaacaguauacacaggaucagcaccauucacaccaaaauuagguucaguacaauucucuacugauacugaaaacgauuuugaaacccaucaaaauacuaaauuuacuccagucggaguaauacaagauggaaguacaacacaccgaaaugaaccacaacaauggguauuaccaucauauucugguggaaauguacaaaacguucacuuagcaccugcagucgcacccaccuuuccaggcgaacaauuauuauucuuuagaucaacuaugccaggcuguucugguuaccccaauauggaccucgacugcuuacuaccucaagaauggguacaacauuuuuaccaagaagcugcaccugcacaaucugacguagcauuacuacgauucgucaauccagauacaggaagaguuuuauuugaaugcaaacuacauaagucaggauacguuacaguagcucacacaggacaacaugacuuaguaauaccaccuaauggauauuuccgcuucgauuccuggguuaaucaauuuuacacuuuagcacccaugggaaauggaacaggacgaagaagagcccuauaa

SEQ ID NO: 32315 - RNA, 1623 nt, Artificial Sequence
  derived and/or modified sequence opt6 from capsid__Norovirus__ACY00582
augaaaauggcaaguaaugacgccaaucccuccgaugguucaguagccaauuuaguccccgaaguaaacaacgaaguaauggcucuagaaccuguaguaggagccgcaauagcagcaccaguagccggucaacaaaacgucauugauccauggauaagaaauaauuuuguccaagcaccaggaggagaauuuaccguuaguccaagaaacgcaccaggagaaauauuguggucagcaccacuagguccagauuuaaauccauacuuaucacacuuagcacgaauguauaauggauacgcuggaggauuugaaguacaagucauacuagcuggaaacgcauuuaccgcuggaaaaauaaucuuugccgcaguuccaccaaacuucccaacagaaggcuuaucaccaucacaaguuacaauguucccucacaugaucguagacguuagacaacuagaaccaguacuaauaccauuaccagaugucagaaauaacuuuuaccauuauaaccaaucuaaugacucaacaauaaaacuaauagcaauguuauauacaccauuaagagcagacaacgcaggagaagacgucuuuacaguaagcugccgaguauuaacaagaccaucaccugauuuugacuuuauauuucucguacccccaacaguagaaucuaaaacuaaaccuuucacuguaccuauauuaaccgucgaagaaaugacuaacucuagauuucccauuccccucgaaaaacucuuuacagguccaucaucuacauucguuguacaaccacaaaacggaagauguacaacagacggcguauuacuagguacuacacaauuaucaccagucaauauauguacauuuagaggagacguuacacauauagcaggaucaagaaacuacacuaugaaccucgcaucuuuaaacuggaacaauuaugaucccacugaagaaauaccagcaccacuaggaacaccugacuuuguaggaaaaauucaaggaguauuaacacagaccacuaaaggagaugguaguacaagaggacacaaagcaacaguauauacaggaucagcuccauuuaccccaaaauuagguucaguacaauuuucaacagauacugaaaacgacuuugaaacacaucagaauacaaaauucacaccaguaggaguuauacaagauggaucaacaacacauagaaaugaaccucaacaauggguucuaccaucauauucaggacgaaauguacacaacguacauuuagcuccagcugucgcacccacuuuuccaggugaacaauuacuuuuuuucagaucaaccaugccagguugcucaggcuauccaaauauggacuuagauugcuuacucccacaagaauggguacaacauuuuuaucaagaagcagcucccgcacaaucugaugucgccuuacuaagauuuguaaauccugacacaggucgaguucucuucgaaugcaaauuacacaaaucaggauauguuacagucgcccauacaggacaacacgaucuaguuauaccaccaaauggauauuccagauuugauucauggguaaaucaauuuuacacccuagcuccaaugggaaacggcacaggaagaagacgagcacuauaa

SEQ ID NO: 32316 - RNA, 1623 nt, Artificial Sequence
  derived and/or modified sequence opt6 from capsid__Norovirus__ACY00588
augaaaauggcuucaaacgaugccaacccuucagacggcucagcagcaaacuuagucccagaaguaaauaaugaaguaauggcauuagaaccuguuguaggagcagcaaucgcugcaccaguagcaggacaacaaaauguaauagacccauggauacgaaauaacuucguacaagccccagguggagaauucacagucuccccaagaaacgcaccaggugaaauauuauggucugcaccauuaggucccgacuuaaacccguaucuaucacaccuagcacgaauguacaacggauacgcaggagguuuugaaguccaagccauuuuagcuggaaaugcauuuacagcaggaaaaauaauauucgcugcaguaccacccaauuuuccaacagaaggccuuagcccaucacaaguaacaauguuuccacacauaauaguagauguaagacaauuagaaccagucuuaauucccuuaccagacguacgaaacaacuucuaucacuacaaucaauccaaugacucuacaauaaaauuaauugcuaugcuauacacaccauuaagagcaaacaaugcaggagaagacguuuuuaccguuucaugucgaguuuuaacaaggccaucaccagacuuugauuuuaucuuucuugucccuccaacaguagaaucaagaacaaagcccuucacaguaccuauacuuacagucgaagaaaugacuaacucaagauucccaauaccauuagaaaaauuauuuaccgguccaucauccgccuucguaguacaaccacaaaacgguagauguacaacagauggcguauuacuugguaccacucaacuuagcccagucaauaucuguacauuuagaggagauguaacccauauagcagguucacgaaauuacacuaugaaucuagcaucacuaaacuggaacaauuacgacccaacagaagaaauaccagcaccauuaggaaccccagauuucguaggcaaaauacaaggcguacuuacccaaacaacuaaaggugacggcucaacaagaggccauaaagcaacuguauauacuggcucagcaccauuuacaccuaaacuuggaucccuacaauuuucaaccgacacagaaaacgacuuugaaacccaccaaaauacaaaauuuacaccaguuggcguaauccaagacggaggcacaacccauagaaaugaaccucaacaauggguacuacccucauacucuggaagaaauguaccaaauguacauuuagcaccugccguagcaccaacuuuuccaggagaacaauuauuauucuuucgaucaaccaugccuggaugcucaggcuauccaaacauggaucuagauugucuauuaccacaagaauggguccaacacuucuaccaagaagcagcuccagcacaaucagaugucgcccuccuaagauucguaaacccagacacaggaagaguauuauuugaauguaaacuccauaaaucaggauauguuacagucgcccauacaggacaacaugauuuaguaauaccaccaaauggauauuucagauuugauucauggguuaaccaauuuuacacucuugccccuaugggaaacggaacaggaagaagaagagcacuauaa

SEQ ID NO: 32317 - RNA, 1623 nt, Artificial Sequence
  derived and/or modified sequence opt6 from capsid__Norovirus__ACY00594
augaaaauggcaucaaacgaugcuaacccaucagauggaucagcagccaaucuagucccagaaguaaauaacgaaguaauggcccuagaaccaguaguaggagcagccauagcugcaccuguugcaggacaacaaaauguaauagacccauggauacgcaauaauuuuguucaagcuccaggcggagaauuuacaguaaguccuagaaaugcaccaggagaaauauuaugguccgcaccacuaggaccagaucuaaauccauaucuuucacaucuagcuagaauguauaacggauaugccggaggcuucgaaguacaagucauacuagcuggcaacgcuuuuacagccggaaaaauaauuuucgcagcaguaccaccuaacuucccaacagaaggccucucuccaucccaaguaacaauguucccacacauaauaguagacguaagacaauuagaaccaguacuaauuccccuuccagauguaagaaauaauuucuaucacuacaaccaaccaaaugacucaacaauaaaacuaauagcaauguuauauaccccauuaagagcuaauaaugccggagaagacguuuuuacaguuucaugucgaguacuaacacgaccuucuccagacuucgacuuuauauuucuaguaccuccuacaguagaaucaagaacaaagccauucacaguaccaauccuaacaguagaagaaaugaccaacucaagauuuccaauaccuuuagaaaaacuauuuacaggaccauccagcgcauuuguuguccaaccacaaaauggcagauguacaacagacggaguauuacuaggaaccacacaauuaucuccaguaaauauauguacauuccgaggagauguuacacacauagcaggaagcagaaauuauacaaugaauuuagcuuccuuaaauuggaacaauuaugacccaacugaagaaauuccagccccucucgggacaccagacuuuguaggcaaaauucaaggcguauuaacacaaacgacaaaaggcgaugguuccacacacggacauaaagcaacaguauauaccggaagugcacccuuuacacccaaacuaggaucuguccaauucucaacugauacagaaaaugauuucgaaacacaucaaaacacuaaauuuacuccaguagguguaauacaagauggaucaacaacacauagaaaugaaccacaacaauggguacuaccauccuacucaggaagaaauguacagaacguacacuuagcaccagcaguugcaccaacauuuccaggagaacaauuacucuuuuuuagaaguacuaugcccggcuguucagguuauccaaauauggaccuagauugcuuacuaccacaagaauggguucaacauuucuaccaagaagcagccccagcacaaagcgacguagcauuacuacgauuugucaaucccgacacaggacgaguccuauucgaaugcaaacuacauaaaaguggauauguaacaguugcacacaccggacaacaugaucuaguaauaccaccaaauggauauuucagauuugacucaugggucaaucaauuuuauacauuagcaccaaugggcaauggaacuggaagacgaagagccuuauaa

SEQ ID NO: 32318 - RNA, 1623 nt, Artificial Sequence
  derived and/or modified sequence opt6 from capsid__Norovirus__ACY00597
augaaaauggcaucuaaugaugcaaauccaucagacggcucugcugcaaauuuaguaccugaagucaacaaugaaguaauggcacuugaacccguaguaggagccgccauagcagcuccaguugcuggacaacaaaauguaauagauccauggaucagaaauaauuucguacaagcaccaggaggagaauuuacagucucuccaagaaaugcaccaggcgaaauacuauggucugcaccauuaggacccgacuuaaauccauacuuaagccacuuagcaagaauguauaaugguuacgcuggagguuuugaaguucaaguaaucuuagcaggaaaugcauuuacggcaggaaaaauaauauuugcggcaguaccaccuaacuuucccacagaaggauuaucacccucacaaguaaccauguuuccacacauaaucguaggaguacgacaauuagaacccguacuuauuccacuaccagauguuagaaauaacuuuuaccauuacaaccaaucaaacgauucuacaauaaaauuaaucgcaaugcuuuacacuccauuaagagcaaauaacgcaggagaagauguauuuacaguaucuugucgcguacuaacuagaccaucaccagauuuugauuucauauuuuuaguaccaccaacaguagaaucccgaacaaaaccauucacuguacccauacuaacaguagaggaaaugaccaauucacgauuuccaauaccacuagaaaaacuauuuacaggaccaucaagcgcauucguaguacaaccccaaaauggaagauguacaacugaugggguacuucuuggaacaacacaacuauccccagucaauauauguacauuuaaaggagauguaacacacauagccggcucaagaaacuacacaaugaaucuagcaucacuuaauuggaauaauuaugauccuacagaagaaauaccagcaccacuaggaacaccagauuuuguagguaaaauacaaggaguacuaacacaaacaacaaaaggagacggaucaacacguggacacaaagcuacagucuauacaggaucagcaccauuuacaccuaaauuaggaucuguucaauucucuacagauacagaaaacgauuucgaaacacaucaaaacacaaaauucacaccuguuggaguuauacaagacggcggaacuacccacagaaaugaaccccaacaaugggucuuacccucauauucaggacguaacguacaaaacguucacuuagcaccugcaguugccccaaccuuuccaggagaacaauuauuauuuuucagaucaacaaugccaggauguucuggauauccuaauauggauuuggacugcuuacucccacaagaauggguucaacauuuuuaccaagaagcugcuccugcacaaucagacguagcacuacuacgauucguuaacccagauacaggucgaguacuauucgaaugcaaacugcauaaaucuggauauguaacaguagcacacacaggacaacaugacuuaguaauacccccuaauggauauuucagauucgauucauggguaaaucaauuuuacacucuagcaccaaugggaaaugguaccggacgaagaagagcauuauga

SEQ ID NO: 32319 - RNA, 1623 nt, Artificial Sequence
  derived and/or modified sequence opt6 from capsid__Norovirus__ACY00600
augaaaauggcaucaaaugacgcaaaucccucagauggaccagcagcuaacuuaguaccggaaguaaauaacgaaguaauggcacuagaacccguaguaggagcagcaauagccgcaccaguagcaggucaacaaaauguaauugaccccuggauuagaaauaacuuuguccaagcaccaggaggagaauuuacaguuucaccaagaaaugcaccuggagaaauucuauggagcgcaccuuuagguccagauuuaaauccguauuuaucucauuuagcaagaauguauaauggauaugcaggagguuuugaaguacaaguaauauuagcaggcaaugcuuucaccgcaggaaaaauaauuuucgcagcaguaccuccaaauuuuccuacagaaggccuaucuccaucacaaguaacaauguucccacauauaaucguagacguaagacaacuugaaccaguauuaauaccacuacccgauguacguaacaauuuuuaccacuacaaccaauccaaugauagcacaauaaaacuaauagcaauguuauauacaccauuaagagcaaacaaugcaggugaagauguauucacugucucaugcagaguauuaacacgaccaucaccagauuuugacuucauauuucucguuccaccaacaguagaaucucguacaaaaccauuuacaguaccaauacuuaccgucgaagaaaugacaaacucuagauuccccauaccauuagaaaaauuauuuacaggaccauccuccgcauucgucguucaaccacaaaacggaagauguacaacugacggcguauuauuaggaacaacacaauuaucaccaguaaacauauguacauucagaggagacguaacacacauagcaggaucaucaaauuacacaaugaacuuagcaucacuaaacuggaacaauuacgauccaacugaagaaauaccagccccucuugguacaccagacuuuguaggaaaaauacaagguguacuaacacaaacaacaaaaggagacggaucgacacgaggacacaaagcaacagucuauacaggauccgcucccuuuacaccaaaauuaggaucuguacaauucucaacagacacccaaaaugauuucgaaacacaccaaaauacuaaauucacaccagucggcguuauacaagacggaggaacuacacaccgaaaugaaccacaacaauggguacuaccauccuauucagguagaaauguacaaaacguucaucuagcaccagcagucgcaccaacuuuucccggagaacaacuccuuuuuuucagaucaacaaugccaggaugcucuggauauccaaauauggaucuagacugcuuacuaccacaagaauggguccaacauuucuaucaagaagcagcuccagcacaaucagacguugcacuacucagauuuguaaauccagauacaggacgagucuuauuugaaugcaaacuucacaaaagucgauauguaacaguagcacacacaggucaacacgacuuaguaauuccaccaaauggauauuucagauucgacucauggguaaaucaauuuuauacucuagcaccaauggguaauggaacaggccgaagacgugcccuauaa

SEQ ID NO: 32320 - RNA, 1623 nt, Artificial Sequence
  derived and/or modified sequence opt6 from capsid__Norovirus__ACY00603
augaaaauggcauccaaugacgcaaacccuucagauggaucagcugcaaacuugguaccagaaguaaauaacgaaguaauggcucuagaaccuguaguuggagcagccauagcagcucccguagccggucaacaaaauguaauugaucccuggauaaggaauaacuuuguacaagccccaggaggcgaauuuacaguuucaccucgaaaugcacccggagaaauccuauggucagcaccccuaggcccagaccuaaauccuuauuuaucucaucuugcacgaauguacaauggauacgcaggaggcuuugaaguucaaguaauauuagcaggaaacgcacuaaccgcuggaaaaauuauauucgcagcggugccaccuaauuuuccuaccgaaggauuaucaccaucacaagucaccauguucccucacauaauaguagacguaagacaacuagaaccaguauuaauaccauuaccagauguacgaaauaauuucuaucacuauaaccaaucaaaugacuccacaaucaaauuaauagcaaugcuauacacuccauuacgagcaaacaaugcaggugaagacguauuuacaguauccuguagaguacuaacaagacccucaccagauuucgacuuuauauuccuaguaccaccuacaguagaaaguagaacuaaaccauucacuguacccaucuuaacaguagaagaaaugacaaauucaagauuuccaauaccacuagagaaacuauuuacuggcccaucuucugcuuuuguaguucaaccccaaaacggcagauguacgacagauggagucuuacuagguaccacccaacuaucaccuguaaauauauguacauuuagaggagauguaacucauauugcagggaguagaaauuauacaaugaaccuagccucacuaaacuggaacaacuacgauccaacagaagaaauaccagcaccuuuaggaacacccgauuuuguaggaaaaauacaaggaguaccaacucaaacaacaaaaggagacggaucuacaagaggucauaaagcaacuguuuauacaggaagcgcaccauucacuccaaaacuaggaucaguccaauucucaacagauacagaaaacgauuuugaagcccaucaaaacacuaaauucacaccaguuggaguaauacaagacggaggaacuacacauagaaacgagccucaacaauggguacuuccaucauauucuggaagaaauguaccaaacguucacuuagcaccagccguggcaccuaccuuuccaggagaacaacuauuauucuucagaucaacaaugcccggaugcucaggcuauccaaauauggauuuagauugucuauuaccucaagaauggguacaacauuucuaccaagaagcagcaccagcacaaucagacguagcucuauuaagauuuguaaacccagacacaggaagaguacuauucgaaugcaaauuacauaaaucagguuacgucacagucgcucacaccggacaacacgaccuuguuauaccuccaaacggauauuuuagauuugauucauggguaaaucaauuuuauacuuuagcaccaaugggaaaugggacaggaagaagacgagcuuuauaa

SEQ ID NO: 32321 - RNA, 1623 nt, Artificial Sequence
  derived and/or modified sequence opt6 from capsid__Norovirus__ACY00606
augaaaauggcuucaaaugacgcuaacccuucagauggcucugcagcuaaccuagucccagaaguaaauaaugaaguaauggccuuagaaccagucguuggugcagcaauagcagcaccuguagccggacaacaaaauguaauagauccauggauuagaaauaauuucguacaagcccccggcggagaauuuaccguaucaccuagaaacgcaccaggagaaauauuauggucagcaccauuaggaccagacuuaaauccauaucuuucacaucuugcaagaauguauaauggcuacgcuggaggauucgaaguucaaaugauauuagcuggaaaugcuuuuacagccggaaaaauaauauuugcagcaguaccaccuaauuuuccaacagaaggauuaucaccaagccaagucacaauguuuccacauauaauaguugauguaagacaacuagaaccaguuuuaauaccacuaccagauguaagaaauaauuuuuaucauuauaaccaaagcaaugacucaacgauaaaauuaaucgcuauguuauacacacccuuaagagcaaauaaugcaggcgaagauguauucacagucucauguagaguauuaaccagaccaucaccugauuuugacuucauauuccuaguuccaccaacaguagaaucaagaacaaaaccauucaccguuccaauauuaacaguugaagaaaugacaaauucaagauuuccuauaccacuagaaaaacuuuuuaccggaccaucaucagcguucguaguucaaccccaaaacgguagauguacgaccgaugguguacuccuaggcaccacacaauuaucuccaguaaacauuuguacauuuagaggagacguaacacauauagcaggaaguagaaauuauacaaugaaucuagcaagccuaaauuggaauaauuacgaucccacagaagaaauaccugcaccccucggcacacccgauuucguaggaaaaauacaaggaguacuaacacaaacaacuaaaggagacggauccacuagaggucacaaagcaacaguauacacaggaucagcaccauuuacacccaaacuuggaucaguucaauucucaaccgauacagaaaacgauuuugaaacacaccaaaacacaaaauucacaccaguaggaguuauacaagaugguggcacgacucauagaaaugaaccucaacaauggguucuaccaucauauucaggaagaaauguaccaaauguacaucuagcaccagcaguagcaccuacuuuuccaggugagcaacucuuauuuuucagaucaacaaugccaggcugcucagguuauccaaauauggauuuagauugucuauuaccacaagaauggguacaacacuucuaccaagaagcagcaccagcucaaucagauguagcacuacucagauucguuaauccugacacuggaagaguccuauucgagugcaaacuacauaaaucuggauacguaacaguugcacacacaggacaacauggauuagucauaccuccaaaugguuauuuccgauucgacucuugggucaaucaauuuuacacacuagcaccaaugggaaauggaacaggcagacgccgugccuuauaa

SEQ ID NO: 32322 - RNA, 1623 nt, Artificial Sequence
  derived and/or modified sequence opt6 from capsid__Norovirus__ACY00609
augaaaauggcauccaacgaugcaaacccuucagacggaucagcagccaaccuaguuccugaaguaaacaaugaaguaauggcacuagaaccaguugucggagcagcaauagcagcaccuguagcuggacaacaaaaugucaucgacccauggauaagaaacaacuucguacaagcaccaggaggugaauucacaguaucaccaagaaaugcaccaggcgaaauauuaugguccgcaccucuaggaccagaucuuaauccauacuuaucacaucuagcaaggauguacaaugguuacgcuggaggauuugaaguacaaguuauacuagcaggaaacgcauuuacagcaggaaaaauaauauuugcagcaguacccccaaacuuuccaacagaaggauuaucaccaucacaaguaacuauguucccucacauuauagucgacguaagacaauuagaaccuguucuaauuccacuacccgacguaagaaacaauuucuaucacuauaaccaaucaaaugacucaacuauaaaacuaauagcuaugcuauacacuccauuacgagcaaauaacgcaggagaagauguauuuaccguaagcuguagaguauuaacacgaccuaguccugauuuugacuuuauauuuuuaguaccaccaaccgucgaaucucgcacaaaacccuucacuguucccauacuaacugucgaagaaaugacaaauucgagauuuccaauuccccucgaaaagcuauuuacagauccaucauccgcuuucguaguucaaccccaaaacggaagauguaccacagacgguguacuauuagguacaacacaacuaucuccaguaaacauauguacauucagaggugauguaacacacauugcaggaucuagaaacuauacaaugaauuuagcauccuuaaacuggaacaauuaugacccaacagaagagauaccagcaccucuaggcaccccagacuuuguaggaaaaauacaaggaguauuaacacaaaccacuaaaggagauggaucuaccagaggacauaaagcuacugucuacacagguucagcaccuuuuaccccaaaacuuggaucaguacaauuuuccacagauacagaaaacgacuucgaaacacaucaaaacacaaaauuuacuccaguaggaguaauacaagaugguggaacaacccauagaaaugaaccacaacaauggguacuuccaaguuacaguggaagaaauguaccuaauguacacuuagccccugcaguugcacccacauucccuggagaacaauuacucuucuuucgaucaacaaugccaggauguucaggauacccaaacauggaucucgacugcccacucccucaagaauggguacaacauuuuuaccaagaagcagcacccgcacaaucagacgucgcucuucucagauuuguuaacccagauacaggacguguccuauucgaauguaaauuacauaaaaguggcuaugucacaguagcacauaccggacaacacgauuuaguuaucccacccaacggcuacuuucguuucgauucauggguaaaucaauuuuacacccucgcucccauggguaacggaacaggccgaagacgagcacuguaa

SEQ ID NO: 32323 - RNA, 1623 nt, Artificial Sequence
  derived and/or modified sequence opt6 from capsid__Norovirus__ACY00612
augaaaauggcaucuaaugaugcuaacccuucagauggaucagcagcuaaccuuguaccagaaguaaacaacgaaguaauggcauuagaacccguaguaggagcagcaauagcagcaccaguagcaggacaacaaaauguaaucgaucccuggauuagaaauaacuuuguucaagcuccagguggcgaauuuaccguaucaccacgaaaugcuccaggagaaauacuuuggucagcaccauuaggcccagauuuaaauccauaucucucacacuuagcaagaauguacaaugguuacgcaggaggauuugaaguucaaguaauccuagccggaaaugcuuuuacagcuggaaaaauaauuuucgcugcaguacccccaaacuuuccaacagaaggacuaucccccucacaaguuacaauguucccacacauaauuguugauguaagacaacuagaaccaguacuaauaccauuaccagacguacgaaacaauuucuaucauuauaaucaaucaaacgacucuacuauaaaauuaauagcaauguuauacacuccacuaagagcuaacaaugcaggagaagaugucuucacaguuagcuguagaguacucacucgaccauccccagacuucgacuuuaucuuucuaguaccaccaacaguagagucacgaacaaagccuuuuacaguacccauacuuaccguagaagaaaugacuaauucaagauucccuauaccauuagaaaaacuauuuaccggcccauccucagcauucguaguacaaccccaaaacgguagaugcacaacagacggaguacuccuaggaaccacucaauuaucucccgucaauauauguacauucaggggagauguaacacauauagcugguucacgaaauuauacaaugaaccuagcuucauuaaauuggaacaauuacgacccaacugaagaaauaccugcaccacucggaacaccagauuucaugggaaaaauucaaggaguacucacccaaacaaccaaaggagacggauccacaagaggccacaaagcaacgguuuauacagguuccgcuccauucacccccaaauuaggaucaguacaauucuccacugauacagaaaacgauuuugaaacacaucaaaauaccaaauucacucccguaggagucauacaagacggaggaacaacacacagaaaugaaccccaacaauggguauuaccuuccuauucuggaagaaauguacccaacguccaccuagcaccagcaguagcacccacauucccaggagaacaauuacuauucuuuagaucaacaaugccaggauguucuggcuauccgaauauggaccuagauugccuacuaccacaagaauggguucaacauuucuaccaagaagcugcuccagcacaaucugacguagcauuacuacgauucguaaacccagacacuggacguguacucuucgaauguaaacuucacaaaucuggauauguaacuguugcacauacaggacaacaugaucuagucauaccuccuaauggauauuuccgauuugacucauggguaaaccaauucuacacacuagcacccaugggaaacggaaccggaagaagaagagcauuauaa

SEQ ID NO: 32324 - RNA, 1632 nt, Artificial Sequence
  derived and/or modified sequence opt6 from capsid__Norovirus__ACY00615
augaugauggcauccaaagacgcuccaaccaauauggacggaacaaguggagcaggccaacuaguaccagaagcaaauacagcagaaccuuuaccaauaaaaccaguagcaggagcugcaacagcaguagcaacagcaggacaaguuaacaugauagauccauggaucaugaauaauuuuguacaagccccacaaggagaauuuacaauuucuccaaacaauacaccaggugauauauuauuugacuuacaacuaggaccacauuuaaauccauuucuggcucaucucucucgcauguauaacggcugggucgguaauaugcaaguacguauaauguuagcagguaacgcauucuccgcaggaaaaauaauuguaugcugcauuccgccaggauuuucuucacaaucaauaucuauugcccaagcaacuauguuuccacauguuauagcagauguaagaguacuagaaccuauugacguaccauuagaugacgucagaaaugugcuauuucacaauaaugacaacccucaaaccaugcgauuauuaugcaugcuuuauacaccauuaagauccggcggaaccucauccgguacagauccauucguaauagcaggacgcguacuaacaugcccaacuccagauuuuaguuuccucuuuuuaguaccaccagauauagaacaaagaacaaaaccauucucugucccaaacauaccuaugaaucucaugucuaacucaagaguaagcaugcuuauagauggaaugaugguaagcaaugaucaaaaucaaguaccucaauuccaaaauggacgaguaacacuagauggacaauuacaagauacaacaacuguaucggcugcauguguagcacgaaugagagguagaauauucaauaauaacggaaauuauggcguuaauuuaacagaauuagauggaaauccauaucacgcauuugauucaccagcaccauuaggauuuccggacuuuggaaacugugaccuccauaugaccuuuguuaaaaucaauccaaaugaauuaucaucaggcgaccccucagguaaaguagugauucauaguuaugaugcaacauucgcaccacauuuaggaacaguaaaacucgaaaaugaugacgaacuugcuagauuuguaggaaaagaaguagucuuagaauuaacauggguauccaauagagaaggagcaacauuaaauuuaugggcaguaccaaauuauggaucuucauuaacccaagcaucacaauuagcuccaccaauauauccaccugguuuuggagaagcaauaguauauuucacauccaccuucccuacaguaucuaacccaaaaguaccaugcaccuuaccacaagaauuugucucucacuuuguaaacgaacaagccccuacccgaggcgaugccgcuuuauuacauuauguugauccagauacacacagaaacuuaggagaauucaaaauguacccagaagguuauaugacauguguaccaaaugcaggaggagguccacaaacacuuccaauaaauggaguauucguauuuauuucauggguaucaagauauuaucaacuaaaaccaguaggaacagcaggagcagcaagacgcuuaggacucagaagaucauaa

SEQ ID NO: 32325 - RNA, 1623 nt, Artificial Sequence
  derived and/or modified sequence opt6 from capsid__Norovirus__ACY00618
augaugauggcaucaaaagacgcaccaacaucaccugauggugcaucuggcgcaggucaacuaguaccugaagcaaacacagcagaacaaauauccauggacccaguagcaggugcuucaacugcaguagcuacagcaggacaaguaaacauggucgauccauggauauuuaauaauuuuguacaagcuccacaaggcgaauuuacuauauccccaaauaacaccccaggcgacauauuguuugaucuacaauuagguccacauuuaaauccuuuccuagcacaucuaucucaaauguauaauggauggguuggcaauaugagaguuagaauucuauuagcuggaaaugcauucacugcaggaaaaauuaucauuuguuguguaccaccaggauuugaugcaagaauccuuacaaucgcucaagcaacuuuauucccacauuuaauagcagacguaagaacauuagaaccaguagaauuaccccuagaagauguucguaacguucuuuaucauaauuccucucaaccacaaccuacaaugcgucuaguugccaugcuuuacacuccauuacgaacaggaggaggaucaggaggaacagacgcuuuuguaguagcuggaagagucuuaacaugcccagcaccagauuucucuuuuuuauuccuaguaccaccaagcguagaacaaaaaacucgaguauucucaguaccaaacaucccccuaaaagauuuaucaaauucacgcgucccaguaccaauucaagguauguuuaugucacccgauguaaaucaaucuguccaauuccaaaaugguagaugucaaaucgacggucaauuacaagggacuacaccaguuucuuuaagucaauuauguaaaauaagaggaaaaacuucaucaaacgcaagaguacuaaauuuauccgaaguagauggaacuccuuuuauuccucuagaguccccagcaccaguuggauuuccugaccuaggugguugcgauuggcauguaaauuuuacauuucaaacacaagaucgcgacccaucucaaucaguaacauuugcaaccaaugaugcaucauuuguaccuuauuuagguucaguuucaccacauaauggagaaggauuucaagcuggugauauaauuggaucccucgguuggauuuccgcaccaucugauaauagucaauuuaauguuugggcaauaccuaaauacggaucuucauuaccugauguaacccauuuagcaccugcaguauucccacccggauuuggagaaguaauacuauacuuuuacucaaccuucccaggaucaggucaaccaucacaacuacaaguuccauguuuauuaccacaagaauucauaacccacuuuugcaaugaacaagcuccuauagcuggugaagcagcuuuacuacauuacguagauccugauacagguagaaaucuaggugaauuuaaauuauauccagacggauuuaugacuuguguaccaaauucaguaucaucaggaccacaaacauuaccaauaaacggaguauucguauuuguaucauggguaucaagauuuuaccaauuaaaaccuguaggaaccgcuucagcugcucgacgucuuggacuuagaagaauauaa

SEQ ID NO: 32326 - RNA, 1623 nt, Artificial Sequence
  derived and/or modified sequence opt6 from capsid__Norovirus__ACY00621
augaugauggcuagcaaagaugcaccaacaucuccagauggugcauccggugcaggucaacuaguaccagaagcaaauaccgccgaacaaauaucaauggacccaguagcaggagcauccaccgcaguagcuacagcaggacaaguaaacaugauagauccuuggauauucaauaauuuuguucaagcuccacaaggagaauuuacaauauccccaaacaauacuccaggcgacauuuuauucgauuuacaauuaggcccacaucuaaauccauuuuuagcucauuuaucacaaauguauaaugguuggguagguaauaugcgaguucgaauacuauuagccggaaaugcauucacugcaggcaaaaucauaauuuguugcguaccaccagguuuugacgcuagaauauuaacaauagcacaagcuacacuauucccacacuuaauagcagacguuagaacauuagaaccaguugaacucccuuuagaagacguaagaaauguccucuaccacaacuccucccaaccacaaccaacuaugagauuaguagcaaugcuauacacaccauuacgaacaggcggaggauccggaggaacagaugcuuucguaguagcaggaagaguauuaaccuguccagccccagauuuuagcuuuuuauuuuuaguuccccccucaguagaacaaaaaacaagaguauuuucaguacccaauauaccauuaaaagaucucucuaauucaagagucccaguaccaauucaaggaauguucauguccccugacguuaaccaaucaguucaauuccaaaauggacgaugucaaauagacggacaauuacaaggaacaacucccgucucacuaucacaauuauguaaaauuagaggaaaaacaagcucaaaugcaagaguacuuaauuuaucagaaguagacggaacaccuuuuauaccuuuagaauccccagcaccaguaggcuuuccugaccuuggaggaugugauuggcauguuaauuucacauuucaaacucaagauagagauccaucucaaucggucaccuuugcuacaaaugaugcaucuuuuguaccuuaucuagguucaguuucaccacauaacggugaaggauuucaagcuggagauauaauuggaucacuuggauggauuucagcuccuucagauaauucacaauuuaacguaugggccauucccaaauauggcucaucauuaccagacguuacacaucucgcaccagccguauuuccaccuggauuuggugaaguaauauuauacuuuuauucaacauuuccagguucuggacaaccaucacaauuacaaguuccaugccuacuaccucaagaauucauuacacauuuuuguaaugaacaagcacccauugccggagaagcugcauuauuacauuauguugacccagauacuggaagaaauuuaggugaauucaaauuauauccagacgguuuuaugacaugcgucccaaauucaguauccuccggaccucaaacauuaccuauaaauggaguauucgucuuuguuuccugggucucucgauuuuaucaacucaaacccguuggcacagcaucagcagcucgaagacuaggacuaagaagaauauaa

SEQ ID NO: 32327 - RNA, 1611 nt, Artificial Sequence
  derived and/or modified sequence opt6 from capsid__Norovirus__ACY00623
augaaaauggcaucaaaugacgccacaccaucugaugacggagcagcagguuuaguuccagguauaaauuccgaaguaauggcauuagaaccaguagcaggugcuucaauagcagcaccaguagucggacaacaaaauauaaucgauccauggauucgaaauaauuuuguucaagcaccugcaggcgaauuuacaguaaguccaagaaauucaccaggggaauuauuauuagaucuagaacuaggacccgaacuaaauccauaucuagcacacuuagcaagaauguauaacggacacgccggaggaauggaaguucaaaucguauuagcugggaacgccuuuacagcaggagaaauauuauucgcagcgauacccccaucuuucccauaugaaaaucucucaccagcccaacuuacaaugugcccccauguaauaguagacguaagacaacuagaaccaguauuauuaccaaugccagauauaagaaaugucuuuuaucauuauaaccaaaacaacuccccuaaacuuagacuaguagcaauguuauacacaccauuaagagcaaauaauuccggagacgauguauucacaguaucauguagaguucuuacucgacccucacccgacuuccaauucacauuucuaguaccaccuacaguagaaucuaaaacaaaaaauuucacuuuaccuguauuaagaguaucagaaaugacuaacaguagauuuccaguuguuuuagaccaaauguauacaucuagaaaugaaaauauaauaguucaaccacaaaauggaagauguaccacagacggagaauuacucgguacuaccauccuacaauccgugagcauauguaacuuuaaaggcacaaugcaagcaaaacuaaacgaagaaccuagauaccaauuacaauuaacaaaucuagauggaucaccaauugacccaacagacgacaugccagcaccccuaggaacacccgauuuucaagcaaugcucuaugguguagcaucacaaagaucuucuacagauaacgcaacuagagcacaugaugcacaaauagauacagccggagauacauucgcucccaaaauuggacaaguccguuucaaaucaucaucaaaugacuuugaucuacaugacccaacaaaauucacuccgaucggaguaaacguagaugaucaacacccauuuagacaauggucccuccccaacuacggaggacacuuagcgcuuaauaaccaucuagcaccagccguaacaccacuauuuccaggagaacaaauacuauucuuuagaucauacauacccuccgcaggaggacauacugacggagcuauggacugccuauuaccacaagaauggguugaacauuuuuaucaagaagccgcuccaucacaaucugacauagcucuaguuagauucauuaacccagacacuggccgaguacuauucgaagcaaaacuacauaaacaaggauuuuuaacaauagccgcaucaggugaccacccuauuguuaugccaacuaauggauauuuuagauuugaagcuuggguaaauccauuuuacacacuagcaccaguuggaacaggaucaggcagacgccgaauacaauaa

SEQ ID NO: 32328 - RNA, 1647 nt, Artificial Sequence
  derived and/or modified sequence opt6 from capsid__Norovirus__ACY00629
augaaaauggcuucaaucgaugcugcaccaucaaacgauggugcagcaggacuaguaccugaaaucaacaacgaagcaauggcccuagauccaguagccggagcugcaauagcagcgccacucacaggacaacaaaauauuauagacccauggaucaugaacaauuuuguacaagcccccggaggagaauuuacaguaucaccacgaaauucaccuggagaaguuuuauuaaaucuagaauuagguccagaaaucaauccauaucuagcacacuuagcaagaauguacaacgguuucgcuggaggauucgaaguacaaguaguauuagcgggaaacgccuuuacugcaggaaaaauaauauuugcagcaauaccucccaacuucccuauagauaauuuaagugcagcacaaauuacaauguguccacauguaauaguagauguuagacaacuagaaccuguaaaucuuccaaugcccgacguacguaacaauuucuuccacuauaaccaaggaucugacucaaaacuaagacuagucgcaaugcuuuacacaccacuuagagcaaauaacucuggcgaugaugucuuuacagucucuugcagaguacuuacacgucccucaccugacuuuucauuuaauuuuuuaguuccaccuacuguagaaucaaaaacuaaaccauucacauuaccaaucuuaacaauaucagaaaugaguaauucaagauuuccaguaccaauagacucucuucauacaucuccuacagaaaauauaguaguacaaugucaaaauggacgaguuacacuagauggcgaacuuaugggcacuacacaacuccuacccucucaaauuugugccuuuagaggaguuuuaacaagaucaacaucccgagcuucagaccaagccgacacagccacuccaagauuauuuaauuauuacuggcacauacaauuagauaauuuaaauggaacaccuuaugauccagcagaagauauaccaggaccacuaggaacaccagacuucagaggaaaaguuuuuggugucgcaucacaaagaaauccagacucuacuacacgcgcacaugaagcaaaaguagacacaacagccggccgauucacacccaaacucggaucauuagaaauauccacugaaucugacgauuuugaucaaaaccaaccaacaagauuuacaccaguaggcauaggaguugaccaugaagccgacuuccaacaauggucccuaccagacuauagcggacaauuuacacacaauaugaaucuagcaccagcuguagcaccuaacuuuccgggugaacaacuauuauucuuuagaucucaacuaccaucuucuggaggcagaucaaauggaauacucgacuguuuaguaccccaagaauggguacaacauuucuaucaagaaucagccccagcacaaacacaaguagcauuaguaagauacguaaacccagauacaggacgaguacuauuugaagcuaaauuacauaaauuagguuucaugacaauagcuaagaacggagauagcccaauaacaguaccuccaaauggauauuucagauuugaaaguugggugaauccuuuuuauacacuaguuccuaugggaacaggcaauggcagacgccguauccaauaa

SEQ ID NO: 32329 - RNA, 1614 nt, Artificial Sequence
  derived and/or modified sequence opt6 from capsid__Norovirus__ACY00632
auggcaucaaaugaugcagcacccucaaacgacggagcaacuggauuaguaccagaaauaaauacagaaacccuuccucuagaaccuguagcaggagcugcaauagcagcgccugucacaggacaaaacaacauuauagacccauggauacguaacaacuuuguucaagcaccaaacggcgaauucacagucucccccagaaacucuccaggagaaauauuaaugaaccuugaauuaggacccgauuuaaauccauaccuagcacacuuaucaagaauguacaacggauacgcuggcggaguagaaguccaaguucuauuagcaggaaacgcauucacagcagguaaaauccuuuucgccgccguaccaccaaauuucccaguagauaugcuaucaccugcacaaauaacaaugcuaccacaccuuauugucgauguaagaacacucgaaccaauaaugauaccacuaccagacgucaggaacguauuuuaucauuucaacaaccaacccgcaccaagaaugagauuaguagcuauguuauacacaccauuacgaucaaauggauccggugaugacgucuucacaguaucauguagaguauuaacaagaccaaccccagauuuugaauuuaccuaucuuguaccaccaucuguagaaucuaaaacaaaaccauucacccuaccaauauuaacaauaggugaacuaacaaacucacgcuuuccagcacccauagaucaauuauauacaagcccaaacgcugacauaguaguucaaccacaaaauggucguuguacauuagacggagaauuacaaggaacaacucaacuauuaacaaccgcaauuuguucauaccgagguaugacaucaaauccaacaucagauuacugggaugaucaucuacuacaccucguccauccaaacggagcuacauacgacccaacugaagacgucccagcaccauucggaacacaagauuuccgcggcaucuuauacggaaugcuuacacaaaauccucguacuucaggagaugaagcagccaauucacauggaauuuacaucucaucuacuucagaaaaauuuacaccaaaauuaggaacaaucggacuacaucaaguucaaggaagacacucacaacaucaacaaucaaaauucacaccaguaggaauagcaguaaacggcaacacaccauucagacaaugggaacuaccaaauuacucaggagcucuaacacuaaauacuaaucuugcuccagcagucggaccaaacuucccaggagaacaaauacuauucuucagaucuaacguaccauccguacaaggaggacaaccaauagaaauagacugccuaauaccccaagaauggguuucacacuuuuaccaagaaucugccccaucccaaucagacguugcauuaguacgauauguaaacccagacacuggacgaacaauauucgaagcaaaacuacacagacaaggauucauaaccauagcggcaacaggaucaaauccaguagucguuccuccaaauggauacuuccgauucgacucauggguaaaucaauuuuacgcauuagcaccaaugggaacaggaaacggaagaagacgcguacaauaa

SEQ ID NO: 32330 - RNA, 1617 nt, Artificial Sequence
  derived and/or modified sequence opt6 from capsid__Norovirus__ACY00635
augaaaauggcuucaaaugaugccgcuccauccaaugacggcgcagcuggauuaguacccgaaauuaauaacgaaguaauggcauuagaaccagucgcuggaggagcaauagcagcuccacuaacaggccaaacaaauguaauugacccuuggauuagaacaaacuucguacaagcaccaaacggcgaauuuacgauauccccuagaaauucaccuggagaaguauuauuaaauauggaacuaggaccagaacuaaauccauuccuaggacaucucuccagaauguauaacggauaugcaggugguauagaaguacaaguauuaauggccgguaaugcuuucacagccggaaaaguaauuuucgcagcaguaccaccccacuuuccuguugaaaauuuaagcccaccacaaguaacaauguucccacacguuauaguagacguaagaacauuagaacccauucuucuaccacuacccgacgucagaaaucaauuuuuucauuacucacaaguagacgaaccaaaaaugagacuagucgcaaugcucuauaccccauuaagaucaaacggcucagcagaagauguuuuuacaguaucaugcagaguacuaacaagaccaucaccugacuuugaauuuaacuaccuaguaccaccaaccguagaaucacgaacaaaaccauuuacaguaccuauauuaacaauaggagaaaugucaaacagucgauuuccagcucccauagacguuauauauacaucaccaaaugauaaccaaaauguucaaccacaaaacgguagauguacacucgacggcgaauuacaaggaacaacacaauuaguaccaucagguguaugugcauuucgaggcagaauaacaucccacgaaggaucagaacaaaaucaauggcauaugcaacuaacaaacuuaaacggaacaccauuugacccaacagaagacauaccugcaccacuaggaaccccagacuuuaaaggagaaauauucggcuucauaucacaaagaaaugcacaaaacgacccuggacaaucucaaccagcuaauagagcacacgaugcaguaguaucaacaagagcacccaaauucacaccuaaauuaggcucuguaaugauaggcaccuggguaaacucagacauagaaaaucaaccauccaaauuuacaccuguaggacuaaauaguucagaaaacuuuaaacaaugggaacuuccagauuacucuggaguucuaacacuaaauaugggucuggcucccgucguacauccaaccuacccaggugaacaaauauuauuuuuccgaucguauauaccuuuaaaaggcggucacggaaauccagcaauagacuguuuauuaccucaagaauggauccaacauuuuuaucaagaaagugcacccucacaaacagauguugcauuauuaaacccugacacaggaagaguauuauucgaagcaaaacuacauagacaaggauauauaacaauagccaaaucaggagauggaccaauugucguaccuccaaacggauacuuccguuucgacucauggguaaaucaauucuacucucuugccccaaugggcaaugguaauggucgaagacguguccaauaa

SEQ ID NO: 32331 - RNA, 1632 nt, Artificial Sequence
  derived and/or modified sequence opt6 from capsid__Norovirus__ACY00638
augaugauggcaucaaaagacgccccaacuaauauggacggaacauccggugcuggacaauuaguccccgaaguaucaaccgccgaaccuauaucaauggaaccaguagcuggcgcagcaacagccgcugccacugcagggcaaguaaauaugauagauccauggauuauguccaacuauguucaagcaccucaaggugaauuuacaauuucaccaaacaacacaccaggagauauauuauucgaucuacaauuagguccccacuuaaauccauuuuuaucacaucuagcccaaauguauaacggcuggguaggaaauaugaaaguaagaguacuuuuagcaggaaacgccuuuacagcaggaaaaauaauaauaucaugcguaccaccaggauuugccgcacaaaacguauccauagcacaagcaacaauguucccccacgucauagcagacgucagaguucuugaaccuauagaaguaccauuagaagauguaagaaauguccuauuccacaauaacgacucaaccccaacuaugcgauuaaucuguauguuauacacaccauuacgugcaucaggaucaucuucaggcacagacccauucguaauagcaggcagaguacuaacauguccaucccccgacuuuaauuuccuauucuuaguacccccaaauguagaacaaaaaaccaaaccauuuucaguuccagacuuaccacuuaauguacuauccaauucacguguuccauccuuaauaaaaucaaugauggucucccaagaccacggacaaaugguacaauuucaaaauggaagaguaacucuugauggacaacuacaaggaacaacaccuacaucagcaucccaauuauguaaaauaagaggaacagucuaucacgcuacagguggacaaggcuuaaaucuaaccgaaauagauggaacaccuuaccaugcuuucgaaucacccgcaccaauagguuuuccagauuuaggcgaaugcgauuggcauauaaaugcuucaccagcaaaugccuucacugauggauccauuauccauagaauagaugucguacaagauccaacauucgcaccccauuuaggaacaauacauuacacuaaugcaaauuaugacgcaaauguaucccuaauaugcucauuagaauggcuaucuccaccuucagguggcgcauuaaaagcaaauccuugggcaauaccaagauauggauccacacugaccgaagcugcacaacuugccccaccuauauauccccccggauuuggagaagcaauuguauuuuuuauguccgacuucccaauagcaaacggauccgacggucucagugucccuuguaccaucccacaagaauuuguaacacacuuuguuaaugaacaagcaccaacacguggagaagcagcacuucuccacuacguagauccagauacccacagaaauuuaggagaauucaaauuauauccugaagguuuuaugacauguguaccuaacucuucaggaagugguccccaaacauuaccaauaaauggaguauuuacuuucauaaguuggguaucacgauuuuaucaauuaaaaccaguaggaacaacuggaccaguacgcagacuaggaauaagacgaucauaa

SEQ ID NO: 32332 - RNA, 1635 nt, Artificial Sequence
  derived and/or modified sequence opt6 from capsid__Norovirus__ACY00641
augaugauggcaucaaaagaugccccaacuaauauggacggaacaucaggagcaggccaauuaguuccagaagcuaauacugccgaaccaauuucuauggauccaguagcuggugccgcaacugcaguagcaacagcaggacaaauaaauaugauagauccauggauaaugucuaacuucguacaagcaccacaaggagaauucaccguauccccaaauaacacaccaggagauguauuauucgaccuccaacuagggccacaauuaaauccauuccuagcacacuuagcacaaauguauaacggaugggucggaaacaugagaguaaaaguauuacuagcagguaacgcauuuacagcaggaaaaauaauaauuuccuguauacccccaggauucacaucacaaaacauuucuauagcucaaaugacaauguuuccucauguuauugcagauguaagaguacuagaaccaauagaaauaccauuagaagauguuagaaacguacuauuccauacaaacgauaaccguccaacaaugagacuaguuuguaugcuauacacaccacuuagagcaaacggaucaucaucagguacagauccuuucgucauagcaggacgaguacuaacauguccagacucuaauuucucauucuuauuuuuaguuccacccaauguagaacaaaaaacaagacccuuuuccguccccaauauaccauuaaauacuuuaaguaacucacgaguacccucacuaauuaaaucaaugacaauuucucgagaucaaaaccaaauaauacaauuccaaaacgguagaguaacucuagacggacaauuacaaggaacgacuccaacauccguaucucaauuaugcaaaauuagaggcacuacuuaucacgccaccggcggauccggaauaaaccuaacugaauuaaacggagagcccuaccaugcauucgaaucaccagcaccaauaggauuuccagauuuaggaggaugugacuggcaucuaacagccacaccuacucaagcauuuaaugauggugcaaaaguuguucgacuaucaguaacacaaggagccgcuuuugcaccccauuuaggaaccauucacuauacaacaacugacaccgauuauaaucccaauaccagcauaaucuguacauuagacuggcuaucccaaacaaccggacaauccaauguugaucccuggcaaauaccaacuuauggaucaaccuugacagaagcugcacaacuugcuccacccaucuucccaccagguuuuggagaaacauuaguuuucuuuuuaucagauuucccaauaucaaaugguaaaaauggcuuaucaguuccauguacacucccacaagaauuuguaacccauuuuguaaaugaacaagcuccuauaagaggagaagcugcauuauugcacuaugcagacccagauacacacagaaacuugggugaauucaaacucuauccugaagguuuuaugacaugcguacccaauaccucagguggaggcccacaaacucuaccuauuaacggaguauucguauuuguuucuuggguaucaagauuuuaucaauuaaaaccuguagguacagcuggagcugcacgcagacuaggcauaagacguucuuaa

SEQ ID NO: 32333 - RNA, 1635 nt, Artificial Sequence
  derived and/or modified sequence opt6 from capsid__Norovirus__ACY00645
augaugauggcuucuaaagaugccccaaccaauauggauggaacuuccggagcaggacaacuaguaccagaagcaaauacagcagaacccauauccauggacccaguagccggagcagcuacagcaguagcaacagcuggacaaauaaauaugauagacccuuggauaaugaguaauuucguacaagcaccacaaggagaauucacaguaucaccaaacaacacacccggagauguacuauucgaucuucaacuaggaccacaauuaaauccauuucuagcucaucucgcucaaauguacaacggcuggguuggcaauaugagagucaaaguucuauuagcaggaaacgcauucaccgcaggaaaaauuauaauuucaugcauaccccccgguuuuacuucacaaaacauaucuauugcacaaaugacuauguuuccacauguaauagccgacguaaggguauuagaaccaaucgaaauuccacuugaagaugucagaaauguucuauuucacacaaaugacaaccgccccacaaugagacuuguauguaugcuauauacuccuuuaagagccaauggaucaucuucaggaacagauccauuuguaauugcaggaagagucuuaacaugcccugauaguaauuuuagcuuuuuauuccuuguaccgcccaacguugaacaaaaaacccgaccauucucuguaccuaauauaccauuaaauacauuaucaaacucaagaguaccaaguuuaauaaaaucaaugacaauaucaagagaucaaaaucaaauaauacaauuucaaaauggacgaguaacacuagacggacaauuacaaggaacaacaccaacaucuguaucacaauuaugcaaaauucgugguaccacguaccaugccacuggcgguuccggaauaaaucuaacugagcuuaauggcgaaccuuaucaugccuuugaaagcccugcuccuauaggauucccagacuuaggaggcugcgauuggcacuuaacagcuacuccaacacaagcauuuaaugauggagcaaaaguaguuagacuaagcgucacccaaggcgcagcauuugcaccacaucuagguaccauacacuauacaacaacugauacagauuauaauccaaacacuucaauaauaugcacauuagacuggcucagucaaacaacaggacaaucuaacguugauccauggcaaauaccaacauaugguucagcacuaacagaagccgcacaauuagcacccccaauauuucccccaggcuuuggagaaacauuaguauuuuucuuaucugacuucccaauauccaauggaaaaaauggacucagcgucccuugcacauuaccacaagaauuuguaacacacuucguaaaugaacaggcaccaauaagaggagaagcagcccucuuacauuauguugacccagauacccaucgaaaccuaggagaauuuaaacuauauccugaagguuucaugacauguguaccaaacacaucagguggugguccucaaacacuaccaauaaauggaguuuuuguuuucgucucauggguaucaagauuuuaccaacuaaaacccgucggaacagcuggagcagcacgaagacuaggaauaagaaggucauaa

SEQ ID NO: 32334 - RNA, 1635 nt, Artificial Sequence
  derived and/or modified sequence opt6 from capsid__Norovirus__ACY00647
augaugauggcuucuaaagaugcgccaacuaauauggauggaaccucaggcgcaggccaauuaguuccagaagcaaauacagcagaaccuauuucaauggaaccaguagcaggagcagcaacagcugcagcuaccgcuggacaaguuaauaugauagacccauggauaaugaacaacuauguacaagcuccacaaggggaauuuacaauuuccccaaacaauacaccaggugauauauuauuugauuuacaacuuggaccccaucuuaauccauucuuaucucaccuagcacaaauguacaaugguuggguaggaaauaugaaaguaaaaguauuauuagcaggaaaugcauuuacagcagguaaaauuauaauaucauguauaccaccaggauuugcagcucaaaacauuucaauagcacaagcaacuauguucccacauguuauagcagacguuagaguacuagaaccuauagaagucccucuagaagacguucgaaauguauuauuccauaauaaugauaacucaccuacaaugagauuaguaugcaugcuuuauacuccacuacgugcaucagguucauccucagguacagaucccuuuguaauagcaggaagaguucuaacuuguccaucacccgacuucucuuuuuuauucuuaguaccaccaaaugucgaacaaaaaacaaaaccauuuuccguaccuaaucuuccacuaaauacauuaucaaacucaagaguaccaagucuuauaaaugcaaugaugauauccagagaucauggacaaaugguacaauuucaaaauggccguguaacuuuagauggacaacuacaagguacaaccccuacaucuuuaagucaauuguguaaaauaagaggaaaaguauuucaugccucagguggaaauggacucaauuuaacagaauuagacggaucagcauaucacgcauucgaaucuccugcaccuauaggauucccagacauaggagagugugacuggcauaugaaugcaacagcaacaucaaauuuuacugguucaaacgaugaauaccaaauuuuaguaaaacaggaaucuacauuugcuccucauuuaggacauguacaagccgacucacuuagugcagaugcuaauacagaccucaugguaucucuaucuuggauaucaccaguuucagaccaacauagaagagacguagacccauggguaauaccuagauauggaucaucacuaaccgaagcagcacaacuagcuccacccauuuauccaccaggauuuggagaagccauaguauucuucaugucugacuuuccaguagucucuggaguuaacggaaugcgaauacccuguacuuuaccacaagaauaugucgcacauuuuguaaacgaacaagcaccaacuagaggagaagcagcacuauuacacuauguagacccagacacacaucgcaacuuaggagaauuuaaaauguauccagaaggauuuaugacaugcguuccaaauagcucaggaucaggaccgcaaacauuaccaauuaauggcguacuaacuuuuguauccuggguaucaagauuuuaucaauuaaaaccaguaggaacugcaggaccagccagaagacuugguaucagaagaucuuaa

SEQ ID NO: 32335 - RNA, 1668 nt, Artificial Sequence
  derived and/or modified sequence opt6 from capsid__Norovirus__ACY00650
augcgaauggcaucaucagaugcaccuguaagugguacagauggcgcagcaggacuaguuccagaaucucagcaagaggucuuaccauuagaacccguagcaggaguacaauuagccgccccaguugcaggacaauccaauauaauagaucccuggauuagaaugaauuuugugcaagcgccagcaggagaauuuacuguaucuccaagagaugcaccaggagaagucuuaauugacuuagaacuaggaccugaacucaauccauaccuaaaucaccuugcaagaauguauaaugguuacgucgguggaauggaaguagaaguaguauuagcugguaaugcuuuuacagcugguaaaauauuauuugcagcaguaccacccucuuuuccuacacacggaauaucagccgcucaagcaacaaugcuuccucauguaaucguagauguaagacaauuagaacccguaagacuaccauuaccagacguuagaaacguuauguuucacuuuugucaagaaaauaaagaaccaagaaugagaauaguagcaauauuauauacuccacucagagcuaacggcgcaggagaugacguauucacuguaucuugucgaguauuaacacgcccuucaccagauuuugacuuuauauuucuaguauuaccauccguagaaucuaaacuaaaacaauucacacuaccuaaccuacaacccaacgaaaugaccaauucaagauuuccaaccggaaucauacaauuauacacaucaccaaauacaaacuuaguaguacaauuccaaaacgguagaugccuacucgacggaacauuauuaggaacaacaccaguacgugcugccgacauaugcucuuucagaggaguuaccucaacagaaguugacgcaaccgauucaccacgaguagcuggaucccauagaauaaugguucaauuaaaagaaccagauggugaagaauuuucaccaacaggcccaaaucccgcacccguuggaacaccugauuuucaagcagcaauauuuggcacacuaucucaaagaaauaccggaggagccggucaaaacaguaacagagcaagauuugcauauuuuuauacuagaaacccgacauuugcaccaggaauaggaacaguaguauuuuccuuugauaccaccgauuuucaaaaucgacaaccaacaaaauuuucaccaucaggaguauuugacgaugacuccucagaaccuuuuaaccaauuuucacuaccauauuauaauggaucacuaggugcaguagaugcaggaaaauuagcaccacccguugcaccaaauuauccaggagaacaaauauuauauuuuagaggaaauauacccuuuaaaggugguuacggugaaggagagauagauucacuauuaccucaagaauggauaacccauuuuuaugcagaacaagcaccaacacaaggagaugcagccuuacuaagauacuauaauccugacacaggaagaguacuuuucgaaugcaaauuacauagagaaggauucauaacaauuaauuacacaggaucaaaugcucuugcagucccagucaaugguguauucagauuugaaggcuggguaaacaaauucuauacacuuacaccaaugggcaacgguaacggcagaagaggcagaagaagagaauuauaa

SEQ ID NO: 32336 - RNA, 1617 nt, Artificial Sequence
  derived and/or modified sequence opt6 from capsid__Norovirus__ACY00656
auggcaaguaacgacgccgcuccuucaaaugauggagccgcuggauuaguaccagaagucaauaacgaaaccauggcauuagaaccaguugcaggcgcaucuauagcugcaccccuaaccggacaaaauaacgugauagauccauggauaagacucaauuuuguccaagcucccaacggagaauucacaguaucaccacgaaauucaccaggugaaauacuacuaaacuuagaacuaggccccgaauuaaacccauacuuagcacacuuaucacgcauguauaauggauacgcugguggaguugaaguccaaguacuucuagcagguaacgcuuuuacagcaggaaaacuaguauucgcugcaauaccaccucauuucccuguagauaauuuaucaccaggucaaauaacuauguucccacacguaauuaucgauguaagaacccuugaacccguuuuacuaccauuaccagauguuagaaauaacuuuuuccacuauaaccaacaaucagaucaaagaaugagauuaguagcaauguuauauacaccccuacgaaguaaugguucaggagaugauguuuucacgguaucauguagaguauuaacacguccaucaccagauuucgauuucaauuaccuaguaccaccaacaguagaaucaaagacaaaacccuuuucaguaccagucuuaacauuaaaugaauuaacaaauucaagauucccagucccuaucgaugccauguacacuuccccaaacgauuccauaguuguacaaccccaaaauggacgcgcuacuauagauggagaacuauuaggaacaacacaauuaauaccuagcggaaucuguagcuucagagguaaaauaacaacacauuuagcagaugaucgucacuuauggaauauccaagucucaaaucuaaacggcaccccuuuugauccaacagacgauguaccugcaccacuaggaaugccagauuuuuccggucaaauauuuggcguuguaucacaaagagauacuggcacaaacccagcaaauagagcacaugacgcuguacucgcaacauauuccgcaaaauacacaccaaaacuaggaaguguucaaauagguacuugggacacagaagauuuauuagaaagacaaccaguuaaauucacaccaguaggauuaaaugaaaucggacaagauaaacacuucgaccaauggguccuaccuaauuauucaggagcacucggauuaaauaugcaucuugcaccugccguaucaccacuauucccaggugaacgccuuuuauuuuuuagaaguuauauaccacuaaaaggugggcacggcgauccauuuauagacuguuuaguaccucaagaauggauacaacauuuuuaucaagaaucagcaccagcacaaucaucaguagcuuuauuacgauauguaaaucccgauacaggaagaacauuauuugaagcaaaacuacacaaaggaggauucauaacaguaucaagcacagaaaauagaccaguaauuguaccaccaaacggauauuuucgauuugauucauggguaaaucaauuuuauucacuagcaccaauggguacuggaaauggacgaagaagaaugcaauaa

SEQ ID NO: 32337 - RNA, 1623 nt, Artificial Sequence
  derived and/or modified sequence opt6 from capsid__Norovirus__ADK47170
augaaaauggccucaucugacgcaaaccccucagauggauccacagcaaaucuuguacccgaaguaaacaaugaaguaauggcauuagaacccgucgucggugcagcuaucgcugccccaguagcaggacaacaaaacguaauagaccccuggauccgcaauaacuucguacaagccccaggaggagaauuuacagucucacccagaaaugcaccaggugaaauauuauggucagccccacuagggccagaccuaaauccauaucuaucacacuuaucacguauguacaaugguuaugcgggaggauuugaaguacaaguaauacuugcuggaaaugcauuuacagcaggaaaaauaauuuucgcagcaguaccacccaacuuuccgacagaaggucuauccccaucccaaguuacaauguuuccacacauaauuguugacguacgacaacuagaaccaguacuaauuccguuaccagauguacguaacaauuuuuaucacuauaaucaaucaaacgacccaacaauaaaauuaauugcuaugcuuuauacaccauuaagagcuaacaaugcaggagaugacguauucacaguaagcugccgcguacuaacccguccuucaccagacuuugauuuuauauuccuaguaccaccuaccguugaaucaagaacaaaaccauuuucuguaccaguauuaacuguagaagaaaugacuaacucucgauuuccaauacccuuagaaaaauuauuuacuggaccaucaucagccuuuguaguacaaccacaaaacggaagauguacuacagacggaguacuacuaggaacaacacaacucucaccaguuaacaucuguaccuucagaggugacguaacacauaucccuggaucacgaaacuacacuaugaaccuugcaagccaaaacuggaacucauacgacccaacagcagaaauaccagcaccauuaggaacaccagauuuuguaggaaaaauacaagguguucuuacacaaacaacuagaacaaauggaucaacacgaggacacaaagcuacuguauacaccggaucggccgauuuuucucccaaacuaggaaggguacaauuugcaacagacacugauaaugacuuugaaaccaaucaaaauacaaaauuuacuccagucggaguaauccaagacgguucaacaacaccuagaaaugaaccacaacaauggguccuaccaucauacucaggaagaaauauacacaauguucaucuugcaccagcaguagcaccaacuuucccaggugaacaacuacucuucuucagaaguacaaugccaggauguucaggauauccaaacauggaucuagacugcuuauuaccacaagaauggguacaauacuuuuaccaagaagcagcaccugcccaaucagacguagcacuucuaagauuuguaaacccugauacaggaagaguacuauucgaaugcaaacuacacaaauccggcuauguaacuguagcacacacuggacaacacgaccuaguuauaccaccaaaugguuacuucagauuugauucuuggguaaaucaauuuuacacauuagcaccuauggggaauggaacuggacgacgaagagcauuauaa

SEQ ID NO: 32338 - RNA, 1644 nt, Artificial Sequence
  derived and/or modified sequence opt6 from capsid__Norovirus__ADR30514
augaaaauggcauccaacgaugcagcuccuucaaaugacggagcagcagauuuaguaccggaagccaauaaugaagucauggcacuagaaccaguagucggugcaucaauagccgcaccaguaguaggucaacaaaauauaauagauccauggauuagagaaaauuuuguccaagcaccccaaggagaauuuacuguaucaccucgaaauaguccaggagaaauguuauuaaauuuagaacuaggaccagaacuaaauccauauuugucucaucucucacguauguacaauggcuaugcagguggaaugcaaguucaaguuguauuagcaggaaaugcauucacagcagguaaaauaauuuucgcagcuguaccaccacacuuuccuguagaaaauauaucagcagcacaaauaacgaugugcccacacguaauaguagauguccgacaauuagaaccaguucuguuaccacuaccagacauuagaaaucgauuuuuucauuauaaucaagaaaacacaccaagaaugagauuaguagcuauguuauacaccccucuaagagcaaacucaggcgaagauguuuuuacugucaguuguagaguacuaacaagaccagcgccagacuuugaauucacuuucuuaguaccaccaacaguugaaucaaaaacuaaaccauucacauuaccaauacuaacgcucggcgaauuaucaaacuccagauucccagcaccaauagauaugcuuuauacagauccaaaugaaggaauagucguucaaccucaaaauggcagauguacauuagauggaacacuacaaggcacuacacaacucguaccaacacaaauaugugcuuuccguggaacauuaauaggacaaaccucaagaucaucagacucaacagauucagcaccuagaagaagagaucauccuuuacauguucaauuaaaaaaucuagacggaacucaauaugauccaacagacgaaguaccagccgucuuaggagcaauagauuuuaaaggaaccguauucgguguagcaucacaaagagauguauccggucaacaaguuggagcaacaagagcacacgaaguacacauaaauacaacagauccuagguauacucccaaacuaggaucaauauuaaugcacucugaaucugacgacuuuguaacaggccaaccaguaagauuuacaccaauuggaaugggugauaaugauuggcaccaaugggaauuacccgauuauucaggucaucuaaccuuaaacaugucacuagccccagccguagccccagcuuuuccaggagaaagaauacuuuuuuucagaucaauaguaccaagugcagguggauacgguucaggacaaauagacugccucauaccccaagaauggguacaacauuucuaucaagaagcagcaccaucucaauccgccgucgcacuuauaagauacgucaauccugacacagguagaaauauauuugaagcaaaacuacaucgagaagguuucaucacagucgcuaauuccggcaauaacccaauagucguaccaccaaauggauauuuuagauucgaagcauggguuaaucaauucuauacacuaacucccaugggaacuggacaagggagaagaagaaaucaauaa

SEQ ID NO: 32339 - RNA, 1623 nt, Artificial Sequence
  derived and/or modified sequence opt6 from capsid__Norovirus__ADR78255
augaaaauggcaagcuccgacgcaaauccuuccgauggcucaacagcaaaccuuguaccagaaguaaauaaugaagucauggccuuagaaccaguaguaggagcagcaauagcagccccgguagcaggacaacaaaacgucauugauccuuggauucgaaacaacuuuguacaagcaccaggcggagaauuuacaguaucaccaagaaaugcuccaggcgaaauacuaugguccgcaccacuaggaccagaucuuaacccauaucucucacaucucgcuagaauguauaacggauaugcaggaggauucgaaguacaaguaauccucgccggaaaugcauuuacagcaggaaaaauaaucuuugcagcaguaccaccaaacuuuccuacagaaggucuuucacccucacaaguaaccauguucccacauauaauaguugacguucgacaauuagaaccaguauuaauaccauugccagauguuagaaacaauuucuaccacuauaaccaaucuaaugauccaacuauaaaauuaaucgcaauguuauacacacccuuacgcgcuaacaaugcaggagacgaugucuuuaccguauccuguagaguccucacuagaccaucaccugacuuugacuucauauuuuuaguacccccuacaguagaauccagaacaaaaccauucucaguaccaauacucacaguugaagaaaugacaaacucacguuuuccaauaccauuagaaaaacuuuuuacuggaccaagcucugcauucguaguacaaccacaaaacggcagguguacaacugacgguguauuauuagguacaacacaauuaucaccuguuaauauaugcacauuuagaggagacguaacacauauagcaggauccagaaauuauacaaugaauuuagcaacacaaaauuggaauuccuacgauccaacugaagaaauaccugcaccauuaggaaccccagauuuuguaggaaaaauucaaggaguauuaacacaaacuacucgugccgaugguuccacaagaggacauaaagccacaguauauacaggaagcgcugacuucucacccaaauuaggaagaguacaauucgcuacagacaccgacaacgauuucgaugcaaaucaaaacacaaaauucacaccagucggaguaauacaagacgguaauacagcccacagaaaugaaccacaacaauggguacuucccagcuauucugguagaaauucucauaacguacaucuagcaccagcaguagcaccuacauuucccggcgaacaauuauuauucuuucgaucaacaaugcccggaugcuccggcuauccaaauauggaccuagauuguuuacuaccacaagaauggguucaauauuucuaucaagaagcagcccccgcccaaucugacguagcacuacuacgauucguuaauccagacacuggaagaguacuauuugaaugcaaacuacacaaauccggauaugucacagucgcacacacgggacaacacgaccuuguaauaccccccaauggauauuuuagguuugauagcugggucaaucaauucuauacacuagcaccaaugggaaaugguaccggacgaagacgagcacuauaa

SEQ ID NO: 32340 - RNA, 1623 nt, Artificial Sequence
  derived and/or modified sequence opt6 from capsid__Norovirus__ADR78259
augaaaauggcuuccucugaugcaaauccuucugauggauccaccgcaaacuuaguuccagagguuaacaacgaaguuauggcccuagaaccaguaguuggagcugcaauagccgcaccaguagcaggccaacaaaaugucauagauccauggauacgaaauaauuuuguacaagcccccggaggcgaauuuacaguuuccccacguaacgccccaggugaaauuuuauggucagcaccacuaggacccgaucuaaacccauaucuaucacaccuaucaagaauguauaauggauaugcuggagguuucgaaguacaaguaauucucgcagguaaugcuuucacugcaggaaaaauaauauucgcagcaguaccaccaaacuuucccacagaaggacucagcccuucacagguuacuauguuuccccauauaauaguagauguaagacaauuagaaccuguacuaauuccccuaccagauguaagaaacaauuuuuaucacuauaaucaaaguaaugauccaacaauaaaacuaauagcaauguuauauacaccauuacgagcaaacaaugcaggugacgauguauucaccguaucauguagaguacuaacaagaccaucccccgauuuugauuuuauauuccuaguaccaccuacuguagaaucaagaacaaaacccuucaguguaccaguccuaacuguagaagaaaugacaaauucuagauuuccaauaccuuuagaaaaacuauucacaggucccucaucagcauucguaguacaaccacaaaauggaagauguacuacagauggcguacuauuagguacaacucaauuaucaccagucaauauauguacauuucgaggagacguaacacacauuccuggcagucgcaauuauacaaugaaccucgcuucacaaaauuggaauuccuacgaucccacagaagaaaucccagcaccacuaggaacacccgacuuuguaggaaaaauacaaggaguauuaacacaaacaaccagaacaaauggaucuacaagaggacacaaagccacuguauauaccggauccgcagauuuuucacccaaacuaggaagaguucaauucgcaacugauacagauaaugauuuugaaacuaaucaaaauacaaaauuuacaccagucggcgucauacaggauggcucaacaacaccaagaaacgaaccacaacaauggguacuucccuccuacucaggacgaaauauucacaacguacacuuagcuccagcaguagcuccaacauuuccaggagaacagcuauuauuuuuuaggucaacaaugccaggauguucuggcuacccaaacauggaccuugauuguuuauuaccacaagaauggguacaauauuucuaucaagaagcagcaccagcacaaucagauguagcauuauuaagauuuguuaauccagacacagguagaguauuauuugaauguaaauuacauaaaagcggauauguaacaguagcccauacaggacaacaugaucuuguaauaccacccaacggcuacuuucgauuugauucuuggguaaaccaauuuuacacucuugcaccuaugggaaaugguacaggacgacgacgagcacuauaa

SEQ ID NO: 32341 - RNA, 1623 nt, Artificial Sequence
  derived and/or modified sequence opt6 from capsid__Norovirus__ADR78262
augaaaauggcaucauccgacgcaaacccaucugacggcucaaccgcaaauuuaguaccagaaguaaauaaugaaguaauggcacucgaaccaguuguuggagcagcaauagcagcaccaguagcaggacaacaaaacgucauagacccauggaucagaaauaauuuuguacaagcaccaggcggagaauucacuguuucuccaagaaacgcacccggagaaauccuauggagugcaccauuaggacccgacuuaaauccauauuuaucacaccuauccagaauguacaacggcuacgcaggaggauuugaaguacaaguaauccucgcagguaaugcauuuacagcaggcaagauaauuuucgcugcaguaccaccaaacuuuccaacagaaggacuaaguccaucccaaguuacuauguucccacacauaauaguagacguaagacaauuagaaccaguucuuauaccacuaccagacguccgcaauaacuucuaucacuauaaccaaagcaacgacccaacaauuaaacuaauagcaauguuauauacaccucuacgagcaaauaacgcaggcgacgauguauuuacaguaucaugucgcguacuuacaagaccaaguccagacuucgacuuuauauuccuaguaccaccaacaguugaaucacgaaccaaaccauucucuguaccaguucuaacaguugaagaaaugacaaacuccagauuuccaauaccuuuagaaaaauuauucaccggcccaucuagcgcauuuguaguacaaccccaaaauggacgcuguacaacagacgguguacuguuaggaacaacacaacuuagcccuguaaacauauguaccuucagaggugauguaacucauauaccaggcucaagaaauuauacaaugaauuuagcaucucaaaacuggaacucauacgauccaacagaagaaaucccugccccccuagguacaccagacuucguaggaaaaauacaaggaguacuaacacaaacaacaagaacaaacggaucaacacgaggacacaaagcaacaguauauaccggauccgcagacuucucacccaaacuaggacguguacaauuugcuacagacacagacaacgauuucgaaacaaaucaaaauacaaaauucacuccaguagguguaauccaagauggaucaacuacaccaagaaaugaaccacaacaauggguacuucccucauacucaggacguaacacacauaacguacaccuagcacccgcaguugcaccaaccuuuccaggugaacaauuauuauucuuucgcucaacaaugccagguugcucugguuaucccaauauggaccuagauuguuuauuaccacaagaauggguacaauacuucuaccaagaagccgcuccagcccaaucagauguagcauuauugcgauucguuaacccagauacaggccgaguauuauucgaaugcaaacuacauaagucaggauacguaacaguagcucacacuggacaacacgacuuagucauaccaccaaauggcuauuucagauucgacagcuggguaaaccaauucuauacacuagcacccaugggaaauggcacuggaagacgaagagcauuauaa

SEQ ID NO: 32342 - RNA, 1623 nt, Artificial Sequence
  derived and/or modified sequence opt6 from capsid__Norovirus__ADR78266
augaaaauggcaucuucagacgcaaacccaucagauggauccacagcaaaucuaguaccagaaguaaauaacgaaguaauggcccuagaacccguaguaggugcagcaauagcagcaccuguugccggacaacaaaauguaauagauccuuggauucgaaauaauuuuguacaagcuccaggcggagaauucaccguaucuccacguaaugcuccaggagaaauacuuuggucagcaccacuaggaccagauuuaaauccuuacuuaucucaucuaucaagaauguauaacgguuaugcuggcggauucgaaguacaagucauacuagcaggaaaugcauuuacagccggaaaaaucauauucgcugccguaccaccaaauuuuccaacagaaggccuaucaccaucccaaguaacaauguucccacauauuauaguugauguuagacaacuugaaccagucuuaaucccccuaccagacguuagaaauaauuucuaucacuacaaucaaucuaacgauccaacuauaaaauuaauagcuaugcuauauaccccuuuacgugcaaacaaugccggagacgacguauuuaccguauccuguagaguauuaacaagaccaagcccagauuuugauuuuaucuuuuuaguaccaccaaccguagaaucaagaacaaaaccauuuucaguuccuguacuaacuguugaagaaaugacaaacucacgauuuccaauuccauuagaaaaacuuuuuacaggacccucaucagccuuuguaguacaaccccaaaacggacgauguacaacagacggaguauuacuuggaacuacacaacuauccccuguaaauauaugcacauuuaggggagauguaacucacaucucaggaucccgcaacuauacaaugaaccuugcuucucaaaauuggaacaguuacgacccaacagaagaaauaccagcaccacuaggaacaccagacuucguuggaaaaauacaaggcguauuaacacaaacaacaagaacaaauggaagcacaagaggacauaaagccacuguauauacagguucugcugauuuuucaccaaaacuaggucgaguacaauuugcaacagauacggauaacgauuuugaaacaaaucaaaauacaaaauuuacacccguaggaguuauacaagacggauccacuacaccucgaaaugaaccccaacaauggguccucccaucuuacucuggacgaaacauccacaacguacaucuagccccagcaguagcaccaaccuucccaggcgaacaauuacuauucuucagaaguacaaugccuggcugcucaggauacccaaauauggaucuagacugcuuacucccccaagaauggguacaauauuuuuaucaagaagcugcaccagcacaaucagauguagccuuacuaagauuuguaaacccagacacaggaagaguauuauucgaauguaaauuacauaaaucaggauauguaacugucgcacacacaggacaacacgacuuaguuauuccaccaaauggauauuuuagauucgacuccuggguaaaucaauucuacacacuagcaccuaugggcaacggaaccggacgaagaagagcacuauaa

SEQ ID NO: 32343 - RNA, 1623 nt, Artificial Sequence
  derived and/or modified sequence opt6 from capsid__Norovirus__ADR78268
augaaaauggcuucaucugaugcaaauccaucugauggaucuacagcaaaccuaguaccugaaguaaacaaugaaguaauggcccuagaacccguagucggagcagcaauagcugccccuguagcaggacaacaaaauguaauagauccuuggauacgaaauaacuuuguucaagcaccaggaggagaauuuacaguuucaccucgaaaugccccuggagaaauauuauggucagcaccauuaggaccagaccuaaacccauauuuaucacacuuaucaagaauguauaacggauacgccggaggauuugaaguacaaguuauacuagcuggcaaugccuuuacagcaggaaaaauaauauucgcagcaguaccaccuaauuuuccaacugaaggacuaucaccaucacaaguaacuauguuuccccauauuauaguugacguacgucaacuagaaccaguacuaaucccauuacccgauguccgaaacaacuucuaucacuacaaucaaucaaaugacccaacaauuaaacuuauagcaauguuauauaccccacuuagagcuaauaacgcaggagacgauguauuuacaguuaguuguagaguacucacaagaccaagccccgauuuugauuuuauauucuuaguuccaccuacaguagaaucucgaacaaaaccauuuucaguaccuguauuaacagucgaagaaaugacuaacucacgauucccaauaccccuagaaaaacucuucacagguccaucuucagccuuuguaguacaaccucaaaauggaagauguacaacugauggaguacuacuaggaacaacacaacuaagcccaguaaauauauguaccuuucgaggagauguuacccauauaccaggaucaagaaacuacacaaugaaucucgcaucacaaaauuggaacucauaugauccaacagaagaaauacccgccccucuaggaacaccagacuuuguaggaaaaauacaaggaguacuuacacaaacaaccagaaccaacggcagcacacguggacacaaagcaacaguauauaccggaucagcagauuuuucaccaaagcuaggcagaguucaauucgcuacagacacugacaacgauuuugaaacuaaucaaaacacaaaauucacaccagucgguguaauacaagacggaucuacuaccccccgaaacgaaccacaacaauggguacuaccgagcuacucagguagaaauauacauaacguacaccuagcaccagcaguggccccaacauuucccggagaacaacuauuauucuuuagaucuaccaugccaggaugcucaggcuaucccaauauggaucuagacuguuuacucccucaagaguggguacaauacuuuuaucaagaagcagccccagcccaaucagacguagcuuuacuaagauuugucaauccagauacaggucgaguacuuuucgaaugcaaauuacauaaaagcggauauguaacaguagcacacacaggacaacacgaccucguaauaccacccaacggauacuuccguuucgauucauggguaaaucaauuuuacacuuuagccccaaugggaaacggcacaggaagaagaagagcacuuuag

SEQ ID NO: 32344 - RNA, 1569 nt, Artificial Sequence
  derived and/or modified sequence opt6 from capsid__Norovirus__AFQ00093
augaaaaugacagacagagauauaguagauucugcaccagcauuaggacaaguacuaccaccagaaguagaagcaucuguaccaguagaacccaccgcaggagcaccaguugcugcaucaacagcuggaagaguaaacccuauagacccauggauauucgcaaacuuuguccaagcuccacaaggagaauuuacaauaucaccaaauaacaauccuggagaaauucuuuuugaauuagaacucggaccugaucuaaauccauaucuagcccauuuaagacgaauguauaauggauggacuggaucuaugagaguucgaguacuucucgccgguaacgcuuuuucagcaggaaaagucgucguauuuuguguuccaccaggauuugauacaucauaccucaccccaucacaagcaacacaauuuccccauguuuuaauugaugucagagcaccagaaccaguugacaugccauuagaagauguccgaaauauucuguuucaucaaggacccgauucaagaaugcgacuaaugggaauguuauacacaccucuacgagcaaauucuggugcagauccauucgucguuacuggaagaguacuaacuuguccuucaccuaauuuuucuuuuuuuuuccuaguacccccuacuguagaagaacgagaaccuccauuuacuuuaccaaaucuaccuguuaacucuuuaucacacucacgcguaauggaaccaauagcucaaaugaugucuucucgaucauuuccugcaucaguacaauuccaaaacggcagaugcaccuuauccggcgaucuucuaggaacaacaccuucaucaccagcagaccuaggcgccuuuguaggucuaauagcagaaccugguucaagagucgucgaacucucucaaccaaaccaagaagauuuccaugccggauccgcaccagcuccauuuggauuuccugauuucuccgaauguucagucacuuucguaguagcaucagcaacaacuguuggagaacgaacaguaaaugcacguaauccacaaaauuuuaccccagcacuuggccauauaacauuugaugaagaagccccagcugaucuauucagagcucgauuuagaaacuuaugggaaccuacagaacauucauuuuggagaauuccagacuaucgagcagacguuuuaggauccgacuucgcccccucaguaucugcaccaggaguaggcgaaacacuucuuuucuuuaugugcaaugucccuagacuuaacggagcuaaucccaauccuuguccauguuuauuaccacaagaauggauaacacauuuuguaucagaaagagcagcacuacaaucagaugucgcucuacuuaauuacguuaauccaaacacuggacgaguauuauuugaagcuaaauuauacgcaaauggauuuuuaaccguuaaccuaggugcaucagaccaagcaauacucccaguugauggaauuuuuaaauuuguaucuuggguaucauuuuacuaucaauuaagacccguaggaaauauaucaguuggucgaagacuaccuagacuugauggauuuuaa

SEQ ID NO: 32345 - RNA, 1629 nt, Artificial Sequence
  derived and/or modified sequence opt6 from capsid__Norovirus__BAI52939
augaaaauggcaucaaaugaugcagcuccaucuacugacggcgcagccggauuagugccagaaucuaacaacgaaguaauggcucuagaacccguugcaggagcagcauuagcagcaccaguuacaggacaaacaaauauaauagauccauggauucgugcaaauuuuguucaagcuccaaacggagaauuuacaguaucaccacgaaaugcaccuggagaaguacuauuaaauuuagaacuaggaccugaauuaaauccauacuuagcucaccuagcccgaauguauaacggauacgcaggaggaauggaaguucaaguaauguuagcaggaaaugccuuuaccgcuggaaaauuaguauuugcagccguaccaccacacuuucccauagaaaaucuaucaccacaacaaauaacaauguucccacacgucauaauagacguaagaacuuuagaaccaguacuacucccauuaccagacguuagaaauaacuucuuccauuacaaucaaaaagaugacccuaaaaugcgaauagucgcaaugcuauauacuccacuacgcucaaacggcaguggugacgacguauuuacuguauccugucgaguacuaacaagaccaucccccgauuuugauuuuacauauuuaguuccaccaaccguagaaucaaaaacaaaaccauuuacacuacccauacuaaccuuaggcgaacuaucaaacucuagauuuccagcaucuauagaucagauguacacaucuccuaaugaaguaauuucaguccaaugucaaaauggacgcugcacucuugauggagaauuacaaggaacaacacaauuacaaguaucaggaauuugcgcauuuaaaggagaaguaacagcccaucuccaugauaaugaucaucuauacaauauaacuauaacaaaucuuaauggaagcccauucgaucccucagaagacauacccgccccccuagguaugccagacuuucaaggaagaguauuuggaauuauaucacaaagagacagacauaauucuccaggacauaacgaaccugccaauagaggacaugaugcaguaguaccaacauauacugcacaauauacaccaaaacuaggacaaauucaaauuggcacauggcaaaccgacgaucuaacagucagccaaccaguaaaauuuacuccaguuggacuaaacgauacagaacacuuuaaucaauggguaguaccaagauaugcuggagcuuuaaauuuaaauacaaaucuagcucccaguguagcacccguauuccccggagaacguuuacuauucuuucgaucauacauaccacuaaaaggugguuauggaaacccagcaauugacugccuucucccacaagaauggguacaacacuucuaccaagaagcagcacccucaaugucagaaguagcacuuguuagaugcauaaauccagacacugguagagccuuauuugaagcaaaauuacauagggcaggauuuaugacaguuucaucaaauacaucagcaccaguaguaguaccagcaaauggauauuuucgauuugauucauggguaaaucaauucuacucucuagcacccauggguaccggaaauggaagacgucguguucaauaa

SEQ ID NO: 32346 - RNA, 1623 nt, Artificial Sequence
  derived and/or modified sequence opt6 from capsid__Norovirus__BAI52940
augaaaauggccucaaaugaugcaaauccuuccgauggaucagcagcuaaccucguaccagaaguaaacaaugaaguuauggcauuagaaccuguagucggagcagcuauagcagcaccagucgcaggacaacaaaacguaauugauccauggauaagaaauaacuucguacaagcaccaggaggugaauuuacaguaucaccuagaaaugcaccaggagaaauauuauggucagcuccacuaggaccagaucuuaauccauaccuaucacaucuugcccguauguacaacggauaugccggaggauucgaaguacaaguaauacuagcuggcaaugccuuuacagcaggaaaaauuauauucgcagcaguuccaccaaacuuuccaacagaaggccuaggcccaucacaaguaacaauguucccacauauaauaguugacguaagacaacuagaaccaguacuuauuccacuuccugauguaagaaacaauuuuuaucacuauaaucaaucaaacgacucaacaauuaaauuaauugccauguuauacacacccuuaagagcuaacaaugcaggugaagauguauuuacaguaucaugucgaguacuaacacgcccaucaccagacuuugacuuuaucuuuuuaguccccccgacaguagaaucuagaacaaaaccauucacaguaccaauacuaaccguagaagaaaugacaaauucaagauucccaauaccccuagagaaauuauucaccggaccuucuucugcuuuuguuguacaaccacaaaacgggcgauguacgaccgacggaguuuuacuaggcacaacacaacucuccccagucaauauauguacuuucagaggugacguaacaagaauagcaggaucaagaaauuacacaaugaauuuagcuucacuaaacuggaacaauuacgacccaacagaagaaaucccagcaccacuaggaacuccagauuucgucggcaaaauacaagguguacuaacacaaacaacaaaaggagacgguucaacaagaggccacaaagcaaccgucuacacuggauccgcacccuucacgccgaaacuaggaucaguacaauucucaacagacacugaaaaugauuuugagacacaccaaaauaccaaauuuaccccaguaggaguuauacaagauggaggcacaacacacagaaaugaaccucaacaauggguucuaccuucuuauaguggcagaaauguaccaaauguacacuuagcaccugcaguagcaccaacauuucccggggaacaacuacuauuuuucagauccacuaugccaggaugcucugguuaucccaauauggaucuagauugccucuuaccacaagaauggguucaacauuucuaucaagaagccgcuccagcccaaucugaugucgcacuucuucguuucguaaaucccgacacaggaagaguauuauucgaaugcaaacuacacaaaucaggauacguaacaguagcucauaccggccaacacgaucuaguuauaccaccaaacggauacuuuagauucgauucauggguaaaucaauucuauacacuagcacccaugggaaauggcacuggaagaagaagagcuuuauaa

SEQ ID NO: 32347 - RNA, 1623 nt, Artificial Sequence
  derived and/or modified sequence opt6 from capsid__Norovirus__BAQ20801
augaaaauggcaucaucugacgccaaccccuccgauggauccgcagcaaacuuaguaccugaagucaacaaugaagacauggcuuuagaaccaguaguaggugccgcaauagcagcaccugucgcaggacaacaaaacguuauagauccauggauacgaaacaacuuuguccaagcaccaggaggcgaauuuacuguaucuccaagaaaugcaccuggugaaauacucuggucagcaccacuaggaccagacuuaaaccccuacuuaagucacuuagcacguauguacaacgguuacgcaggaggauucgagguacaaguaauauuagcaggaaaugcauucacugcgggaaaaguaauauucgcagcaguuccaccaaauuuuccaacagaaggauuaucaccuucacaaguaaccauguuuccacacauaguugucgacguaagacaauuagaacccguauuaauaccacuaccagacguacguaacaacuucuaccauuauaaccaauccaacgacccaacaauaaaacuuauagcaaugcuauacacuccauuaagagcaaacaaugcaggagacgauguauuuacagucucaugccgaguacuaacaagaccuuccccagauuuugauuucaucuuucuaguucccccuacuguagaaucaagaacaaaaccauucaguguaccaguacuaacuguagaagaaaugacuaauucaagauuuccaauucccuuagaaaaacuauucaccggcccaucuucagcauucgucguacaaccacaaaacggcagauguacaacugacggcguauuacuaggaaccacacaacuauccccaguaaacauauguacauuucgaggagacguaacacacauaacuggaucuagaaauuacacuaugaaucucgccucacaaaacuggaauaacuaugacccaacugaagaaauacccgcaccacuaggaacaccagauuuuguagguaaaauacaaggaguuuuaacccaaaccacaagaacagacggauccacacguggacauaaagccacaguauauacagguucagcaaacuuuucaccuaaacuuggcagaguacaauuugaaacagauaccgaucaugauuucgaaguaaaccaaaauacgaaauucacaccagucggaguuauacaagacggaggaaccacccaccgaaaugaaccacaacaauggguauuaccaucauacucaggaagaaauacaccaaacguacacuuagcaccugccguugcuccaaccuuuccaggagaacaauuacuauuuuuuagaucaacuaugccagguuguucuggauaccccaauauggaccuagauugccuccuaccgcaagaauggguucaauacuucuaucaagaagcagcaccugcacaauccgauguagcacuacuaagauuugucaauccagauacuggaagaguccuauuugaauguaaauuacauaaauccggauacguaacaguugcucauacaggacaacacgacuuaguuauccccccaaauggauacuuccgauuugauuccugggucaaucaauuuuacacauuagcuccaaugggaaauggaacaggacguagaagagcacuauga

SEQ ID NO: 32348 - RNA, 1623 nt, Artificial Sequence
  derived and/or modified sequence opt6 from capsid__Norovirus__BAQ20803
augaaaauggccaguagcgaugcaaacccauccgauggaucagcagcaaacuuaguacccgaaguaaacaaugaagucauggcucucgaaccaguuguaggagcagcaauagccgcaccaguagcuggacaacaaaauguuauugacccauggauaagaaauaacuuuguacaagcacccggaggagaauucaccguaaguccaagaaaugcuccaggcgaaauacuuuggucagcaccacuaggaccagaucucaauccauaucucagucacuuagcucguauguauaacggauacgcaggaggauuugaaguccaaguuauauuagcaggaaacgcauucacagcaggcaaagucauuuuugcugcuguacccccaaacuucccaacagaaggacucucuccaucccaaguuacaauguucccacacauuguuguagacguucgacaauuagaaccuguuuuaauaccauuaccagacguuagaaauaauuuuuaucacuacaaucaaucaaaugauccaaccauuaaauuaauugcuauguuauauaccccccuaagagcuaauaacgcaggagacgauguauuuacaguauccugucgaguccuaacaagaccaucaccagauuuugacuuuauauuucucguaccaccuacuguugaaucuagaacaaaaccauucucaguaccuguacuuacaguagaagaaaugacuaauucuagauuuccaauaccacuugaaaaacuuuucacaggaccaucaucagcauucguuguacaaccucaaaacggacgcuguacaacagacggaguauuacucgguacaacccaacuuucaccuguaaauauauguacauuuagaggagacguuacacauauaacaggcucccgcaauuauacaaugaaucuagcaucacaaaacuggaacaauuaugauccaacagaagaaauaccagcaccacuaggaacacccgacuuuguaggcaaaauucaaggaguauuaacucaaacaacaagaacugacggaucaacacgaggacacaaagcaacaguauacacagguucagccaauuuuucaccaaaacucggaagaguacaauuugaaacagacacagaucacgauuucgaagugaaucaaaauacaaaauuuacaccaguaggagucauacaagacggcucaacaacacauagaaaugaaccccaacaauggguucuaccaaguuauagcgguagaaacacaccuaacguucaccuugcaccagcaguagcacccacauuuccaggagaacaacuacuuuuuuucagaucaacaaugcccggaugcucaggcuacccaaacauggaucuagauuguuuacuaccacaagaauggguacaauacuucuaucaagaagcagcuccugcacaaucugauguugcucuauuacgauucguuaauccagacaccggaagaguauuauucgaaugcaaacuacauaagucuggauacguaaccguugcacauacaggacaacaugaucuaguaauaccacccaacggauacuuuagauucgauuccuggguaaaccaauucuacacacuagcuccaaugggaaacggcacaggaagaagaagagcauuauaa

SEQ ID NO: 32349 - RNA, 1623 nt, Artificial Sequence
  derived and/or modified sequence opt6 from capsid__Norovirus__BAQ20805
augaaaauggcaucaucagaugcuaacccaucugacggaucugcagccaauuuaguaccagaaguaaauaaugaaguaauggcauuagaaccgguuguaggagcagcuauagcugcaccuguagcaggccaacagaauguaauagacccauggauaagaaacaacuuuguccaagcaccuggaggugaauucacaguuuccccaagaaaugcaccaggagaaauacuuuggucagccccacuuggaccagauuuaaauccuuauuuaucucaccuagcacgaauguauaauggauacgccgguggauucgaaguacaagucauauuagcaggaaaugcauuuacagcaggaaaaguaauauuugcagccguaccaccaaacuuuccuaccgaaggcuuaucuccaucacaaguaacaauguucccacacauaguagucgauguaagacaauuagaaccugucuuaauaccacuuccagauguaagaaacaauuucuaucauuauaaccaaucuaaugaccccacaauaaaacuaauagcaauguuauauacaccacuaagagcuaacaacgcaggagaugacguauuuacaguauccuguagaguacuaacaagaccauccccagauuuugacuucauauuucuaguaccaccaacuggcgaaucaagaacuaaaccauucucuguuccuguacuaacaguagaagaaaugacaaauucaagauuuccaauaccauuagaaaaacuuuuuacagguccuucaucagcauuuguuguacaaccucaaaaugguagauguacaacagaugguguacuauuaggaacaacacaauuaucaccaguaaauauauguacauucagaggagauguaacacauacaacagguucacauaacuauacaaugaauuuagcaucacaaaauuggaauaacuaugauccuacagaagaaauaccugccccuuuaggaacuccagacuucgugggaaaaauccaaggaaugcuaacucaaaccacacgaacagacgguuccacacgaggacauaaagcaacaguauauaccgguagcgcagacuucgcacccaaacuaggcagaguccaauucggaacugacacagaucacgaccuagaagcaaaucaaaauacuaaauuuacaccuguaggcguaauacaagauggaucaacaacccacagaaaugaaccacaacaauggguacuaccaucauauucaggcagaaauacacccaacguccaucuagcaccagcaguagcuccaacuuucccaggagaacaacuacuauuuuuccgcuccacuaugcccgguuguuccggcuauccaaauauggaccuagauuguuuacuaccacaagaauggguacaauauuucuaucaagaagcagcuccagcucaaucagauguugcacuauuacguuucgucaacccagauacaggaagaguucuauucgaauguaaauuacacaaaucaggauacguuacaguggcacacacaggacaacacgaucuaguaaucccaccuaauggauauuucagauucgacagcuggguaaaccaauucuacacauuagccccaauggguaauggaacaggaagaagaagagcacucuaa

SEQ ID NO: 32350 - RNA, 1647 nt, Artificial Sequence
  derived and/or modified sequence opt6 from capsid_protein__Norovirus__AAB06271
augaaaauggccagcaauagagcagcccccuccaaugacggagcagcuugucuuguaccugaaaucaacaacgaagccauggcacuagaacccguagcaggagcagcuauugcagcaccacuuacaggacaacaaaacauaauagaccccuggauaaugaauaacuuuguacaagcaccaggaggagaauucacuguaucuccacguaauucuccaggagaaguacuacuuaaccuagaacucggaccagagauaaauccauaucuagcacaccuagcacgaauguacaauggcuacgcaggaggauuugaaguacaaguuguucuagcuggaaaugccuuuacagcagccaaaauaaucuuugcagcaauucccccaaacuuuccaauagauaaucuaucagcagcccaaauuacaauguguccacaugucaucguagauguaagacaacuagaaccaauuaaucuaccuaugccagauguacguaacaauuucuuucacuauaaucaaggcuccgacucaagacuaagacuuauagcaauguuauauacaccccuuagagcuaacaauucaggagaugacguauucacaguauccugccgaguacuaacacgaccaucaccagacuuucuuuuuaauuucuuaguaccaccaacaguugaaucaaaaacaaaaccauucacacuacccauacuaacaaucagcgaaauguccaacucaagauuuccuguuccaauagacucacuucauacaucaccaacagaaaacauagucguccaaugucaaaauggaagaguaaccuuagacggugaacuuaugggaaccacacaauuacuaccaagucaaauaugugccuuuagaggaacauuaacaggaucaacaucacgugccucagaccaagcugauaccccaacaccccgacuauucaaucaccauuggcauauucaacuagauaauuuaaacggaaccccauacgauccagccgaagauauaccagcaccauugggaacaccagacuucagaggaaaaguauucggaguagcaggucaaagaaauccugacucuacaacaagagcacaugaagcaaaaguugauacaacaucaggacgauucacuccaaaacuagguuccuuagaaauaacuacugaauccgaugaccuagaccuaucacaacccacaaaauucacuccaguaggaauaggaguagacaaccgagcagaauuucaacaauggucacuaccagauuacucuggucaauuuacacacaacaugaauuuagcaccagcuguagcaccaaacuuuccaggugaacaacucuuauuuuuucgaucucaacuuccaaguucuggcgguagauccaaugguguacuagacugccuaguaccacaagaauggguacaacauuucuaccaagaauccgcuccugcacaaacacaaguagcauuagucagauacguaaacccagauacaggacguguccuauuugaagcaaaacuacacaaauuaggauucaugacaguagcaaaaaauggagauucccccauaacaguccccccaaaugguuacuucagauucgaaucuuggguuaaccccuucuacacacuagcaccaaugggaacuggaaauggaagacgacgaauacaauaa

SEQ ID NO: 32351 - RNA, 1620 nt, Artificial Sequence
  derived and/or modified sequence opt6 from capsid_protein__Norovirus__AAK96218
augaaaauggcaucauccgacgcaaacccaucagauggcucuacagcaaaccuagucccagaaguuaacaaugaaguaauggccuuagaaccaguaguaggugcagcaaucgcaggaccaguugcaggacaacaaaauguaauugauccuuggauuagaaacaacuuuguacaagcaccuggaggagaauuuacaguauccccaacaaaugcaccaggagaaaucuuauggucagccccauuaggaccagacuuaaauccauacuuaucucauuuagcaagaauguacaacggauacgcuggaggcuucgaaguacaaguaauccuugccggaaaugcauuuacagcuggaaaaauuauauucgcagccguaccaccuaauuucccaacagaaggcuuaagcccaucucaaguaacaauguuuccacacauuauaguugacgucagacaauuagaaccuguacuaauaccccuuccugaugcaagaaacaacuucuaucacuacaaccaaucaaaugauucaacaauuaaacucauagccauguuauauaccccacucagagcaaacaaugcaggagacgauguauucacaguauccuguagaguauuaacacgcccaucaccagacuuugauuuuauuuuucuaguaccaccuacaguagaaucacguacuaaacccuuuacuguuccaauauuaacaguugaagaaaugucaaacucaagauuuccaauaccacuagaaaaacuauauacaggaccaucaucuguauucgucguucaaccucaaaacggacgauguacaacagaugguguacuauuaggcacuacacaacuaucagcagucaacauauguacauuuagaggcgacguaacccauauugcuggaucacaugauuauaccaugaauuuagcaagucaaaauuggaauaauuaugauccaacagaagaaauaccugcaccauuaggaacacccgacuuuguaggaaaaauacaagguaugcuuacacaaacaacuagagaagauggcucuacuagagcaaccaaagcaacaguaucaaccggaucaguccacuucacaccaaaauuagguucaguacaauacacagcagauaccaacaacgacuuccaaacaggacaaaacacaaaauucacaccaguuggaguaauacaagacggcucaaaucaccaaaacgaaccacaacaauggguccuaacaaauuacagcggaagaacaggacauaauguacaccucgcuccugcagucgcaccaacauuucccggcgaacaauuacuauuuuuuagaucuacaaugcccggaugcucaggauauccuaacaugaaucuugacugccuacuaccacaagaauggguccaacacuucuaccaagaagcagcaccagcacaaucugauguagcacuacuuagauuugucaauccagacacaggcagaguacuauuugaauguaaacuacauaaaaguggcuacguaacuguagcacacacagguccacaugaucucguuauaccaccaaauggauauuuuagauucgauccauggguuaaucaauuuuauacauuagcaccuauggguaacggugcaggaagaagaagagcacuuuaa

SEQ ID NO: 32352 - RNA, 1623 nt, Artificial Sequence
  derived and/or modified sequence opt6 from capsid_protein__Norovirus__AAR97648
augaaaauggcaucaaacgacgcuaaccccucagauggcucaacagcaaauuuaguaccugaaguaaacaaugaaguuauggcauuagaaccuguuguaggugcagcuauagccgcaccaguagcaggucaacaaaauguaauagauccauggauacgaaauaacuuuguacaagcaccaggaggagaauucacaguaucaccaagaaacgcaccuggugaaauccuauggucugcaccccuaggaccagaccuaaauccauauuuaucucaccuagcacgcauguauaacggcuacgcaggaggauucgaaguacaaguaauacuugcuggaaaugcauuuaccgcaggaaaaauuauauuugcagccgucccaccuaauuuuccuacagaaggccuaucaccuucucaaguaacaauguuuccacacaucauagucgacguucgacaauuagaacccguacucauaccucuaccagaugucagaaacaacuucuaccauuauaaccaaucaaaugaccccacuauaaaacuaauagcaauguuauauacuccccuaagagcuaacaaugcaggagaagauguauucacaguuucauguagaguacuaacaagaccaucaccugauuucgauuucaucuuccucgucccaccaacaguagaaucacgaacaaaaccuuucacaguaccaaucuuaacaguagaagagaugacuaauuccagauucccaauuccauuagaaaaacuauuuacaggcccaucaggcgcuuuuguaguacaaccacaaaauggaagauguacaacagacggaguccuacuuggaacaacacaacuaucaccaguaaauauauguaccuuccgcggagacguaacacacauagcuggaacucacaacuauacaaugaauuuagcaucacaaaauuggaacaauuaugacccaacagaagaaauaccagcaccucuaggaaccccagauuuuguagguagaauacaaggaauguuaacacaaacaacaaggggugauggauccacaagaggucacaaagcaacaguauccacaggagauguacacuuuacaccaaaauuaggaucaauacaauuuaauacagauacuaauaacgauuucgaaaccggucaaaauacaaaauuuacuccuguaggaguaguacaagacggaaacggaacacaucaaaaugaaccacaacaauggguacuaccaaguuacucagggagaaccggacacaacguacaccuagcaccagcagucgcuccaaccuucccuggugaacaacuauuauucuuuagaucaacaaugccaggaugcucuggcuaucccaauaugaacuuagauugccuuuuaccacaagaauggguacaacauuucuaucaagaagcagcaccagcucaaucugauguagccuuacuuagauucguaaacccugacacaggaagaguauuauucgaauguaaacuucauaaauccggcuauguuacuguagcacacacuggacaacacgauuuaguuauaccaccaaauggauauuuccgauuugauucauggguaaaccaauuuuacacacuagcaccgauggguaauggaacaggcagaagaagagcccuauaa

SEQ ID NO: 32353 - RNA, 1623 nt, Artificial Sequence
  derived and/or modified sequence opt6 from capsid_protein__Norovirus__AAR97651
augaaaauggccucaaaugacgcaaacccuucagauggcucaacagccaauuuaguuccugaagucaacaaugaaguuauggcauuagaaccaguaguaggugcagcaauagccgcaccaguugcaggccaacaaaauguaauagaucccuggauaagaaauaauuucguacaagccccuggcggagaguuuacaguaagcccaagaaaugcacccggagaaaucuuauggucagcucccuuaggcccagauuuaaacccauacuuaucacaucuagcucgaauguacaauggauacgccggaggauuugaaguacaagugaucuuagcaggaaaugcuuuuacugcaggaaaaaucguauuugcagccguuccaccaaacuuuccaacagaaggacuauccccaucacaaguaacaauguucccucacauuauaguagacguccgacaacuagaaccaguacucauaccauuacccgauguuagaaauaauuucuaccauuauaaccaaagcaaugaccccacuauaaaacuaauagcuauguuauacacaccauuaagagcaaacaaugcaggugaagauguauucaccguaucauguagaguucuuacaagaccaucaccugacuucgacuucauauuuuuaguaccaccuacaguagaaucacgaacaaaaccuuucacaguacccauccuuacaguagaagaaaugacaaacucccgcuuuccaauuccuuuagaaaaacuuuuuacaggcccaucaucagcauuuguaguacaaccacaaaacggucgcugcacaacagauggaguuuuauuaggaaccacacaacuauccccaguuaauauaugcacauuuagaggcgacguaacacauauagcaggaacacauaauuacacaaugaauuuagcuucucaaaauuggaacaacuaugacccaacagaagaaaucccugcaccacuaggaacccccgacuuuguuggaagaauucaaggaaugcuaacacaaacaacacgaggggacggaucaacucgaggccauaaagcaacaguaucuacaggagacguucauuucaccccaaaacuaggaucaauacaauucaauacagauacuaauaacgacuucgaaacaggccaaaauaccaaauucacucccguugguguaguucaagacggaaauggaacucaccaaaaugaaccacaacaauggguucuaccuucauauucuggaagaacaggacauaauguacacuuagcaccugcaguagcaccaacauuuccaggagaacaauuacuauucuucaggucaacaaugccaggauguucaggauauccuaacaugaaccuagauugcuuacucccucaagaauggguacaacacuuuuaucaagaagcagcuccagcacaaucugacguugcauuacuaagauuuguaaacccagacacaggaagaguacuuuucgaaugcaaauuacauaaaucuggauauguaacaguagcacauacaggacaacaugaucucguaauaccuccaaacggauauuuuagauuugauucauggguaaaccaauuuuacacuuuagcuccaaugggaaacggaacagguagaagacgugcauuauaa

SEQ ID NO: 32354 - RNA, 1623 nt, Artificial Sequence
  derived and/or modified sequence opt6 from capsid_protein__Norovirus__AAR97654
augaaaauggcaucaaaugacgcaaacccauccgacggaucaacagcaaaccuuguaccagaaguaaacaacgaaguaauggcacuugaacccguaguaggagcagcgaucgcagcaccugucgcaggucaacaaaauguaauagauccuuggauucgaaauaauuucguacaagcaccaggaggagaauuuacaguaucuccaagaaaugcaccaggagaaauccucuggucagcgccacuaggaccagaccucaauccauaccuaagucaccuagcccgaauguauaauggcuacgcaggagguuuugaaguccaaguaauuuuagcaggcaaugcauuuaccgccggcaaaauaaucuucgcugccguaccaccaaauuuuccaacagaaggauuaucaccuucacaaguuacuauguucccucacaucauaguugauguaagacaacuagaaccagucuuaauaccauuacccgauguaagaaauaacuuuuaucacuauaaccaaucaaacgauccuaccauaaaauuaauagcuaugcuauauacaccauuaagagcuaauaaugcuggagaagauguauucacaguuucaugucgcguacucacaagacccuccccagacuuugauuuuauauuuuuaguaccaccaacaguugaaucacguacaaaaccauuuacaguaccaauauuaaccguagaagaaaugacaaacucaagauuuccaauaccauuagaaaaacuauuuaccggaccaucaggugcuuuuguaguacaaccacaaaauggcagauguacaacugacggaguccuucuagguacaacacaacucucuccaguaaauauauguacauuuagaggagauguuacacauauugccggaacacacaauuacacaaugaauuuagcuucccaaaauuggaacaacuacgauccaacagaagaaauaccagcaccacucggcacacccgacuuuguaggaagaauacaaggaaugcuaacucaaaccacaagaggugauggcagcacaagaggacauaaagcaacaguaagcacgggagauguacauuucacaccaaaacuaggaucaauccaauucaauacagauacaaauaaugauuuugaaacaggacaaaacacuaaauucacaccaguaggaguaguacaagacggaaacggcacacaucaaaaugaaccacaacaauggguacuccccucauacucaggaagaacaggucauaacguacaccuagccccagcaguagccccgacauucccaggugaacaauuauuauucuuuagaaguaccaugccaggaugcaguggcuacccaaacaugaaccuagacugccuccuaccacaagaauggguacaacauuucuaccaagaagcugcaccagcucaaucagacguagccuuacuccgauuuguaaacccagacacaggaagaguauuauuugaauguaaacuacacaaauccggauaugucacaguagcacauacaggacaacaugaucuuguaauaccaccaaauggauauuuccguuuugauucuuggguaaaucaauuuuauacucuagcuccaaugggaaauggaacaggaagaagacgugcauuauaa

SEQ ID NO: 32355 - RNA, 1623 nt, Artificial Sequence
  derived and/or modified sequence opt6 from capsid_protein__Norovirus__AAR97657
augaaaauggcaucaaaugacgcaaacccaagcgacggaucaacagcaaacuuaguuccagaagucaacaaugaaguaauggcucuugaaccaguagugggagcagcaaucgcagccccuguagcaggacaacaaaacguuaucgauccauggauacgaaauaauuuuguacaagcccccggaggagaauuuacaguuaguccuagaaacgcgccuggugaaauucuuuggucagcaccuuuaggaccagauuuaaaucccuacuuaucacaccucgcaagaauguacaacggguacgcugguggauucgaaguccaagucauauuagcaggaaaugcauuuaccgcaggaaaaauaauauuugcugcaguaccaccaaacuucccaacagaaggauuaucaccaucccaaguaacuauguucccccacauaauagucgauguuagacaauuagaaccaguacuaauuccacuuccagacguacgaaauaacuucuaucauuauaaccaaucaaaugauccaacaauaaaauuaauagccauguuauacacaccacuaagagcaaacaaugccggcgaagacguauucacagucuccuguagaguacucacucgaccauccccagacuuugauuucaucuuucuaguaccaccaaccguugaaucacgcacaaaaccauucacuguaccaauacuaacaguugaagaaaugacuaacagcagauucccaauaccccucgaaaaauuauuuacuggaccaagcggugcauuuguaguacaaccacaaaacggucgauguacaacagacggcguucuccuaggaacaacacaacuaucaccaguaaauaucuguacuuuuagaggagacguaacacauauagcugguacucauaauuacacaaugaauuuagcuucccaaaacuggaacaauuacgauccaacagaagaaauaccagccccacucggaacaccagauuuuguagguagaauccaaggcaugcuaacucaaacaacaagaggagauggaagcacuagaggucacaaagcaacaguauccacaggagauguacauuuuacacccaaauuaggauccauacaauuuaacacugauacaaauaacgacuucgaaaccggacaaaauacuaaauuuacaccagucggaguuguacaagacggaaacggaacucaccaaaaugaaccacaacaauggguacuaccaucauacucagguagaacaggacacaacguacacuuagccccagcagucgcacccacauuuccuggcgaacaauuauuauucuucagaucaacuaugccaggaugcucuggcuauccuaauaugaaucuagauugucuacuuccucaagaauggguacaacauuucuaucaagaagcagcaccagcacaaucagauguagcccuucuaagauuuguaaauccagauacaggacgcguacuauuugaaugcaaacuacacaaaagcggauacguaacaguagcacauacaggacaacacgaucuaguaauaccacccaacggguacuuuagauuugauucaugggucaaucaauuuuauaccuuagcucccauggguaauggaacaggaagaagaagagcacuuuaa

SEQ ID NO: 32356 - RNA, 1623 nt, Artificial Sequence
  derived and/or modified sequence opt6 from capsid_protein__Norovirus__AAR97660
augaaaauggcaucaaacgaugcuaacccaucagacggcucuacagcuaaccuagucccagaaguaaauaaugaaguuauggcacuugaaccagucgucggagcagcaauugccgcaccagucgcaggccaacaaaacgucauagacccauggauuagaaacaacuucguccaagcaccaggaggagaauucacaguaucaccaagaaaugcacccggagaaauccuauggucagcaccuuuaggacccgaccuaaaucccuaucuaucucacuuagcaagaauguauaacggcuacgccggcggauuugaaguacaagucauuuuagcaggaaaugccuuuacagcuggaaaaaucauauuugcagccguaccaccaaacuuuccaacagaaggucuuuccccaagucaaguaacaauguuuccucacauuauaguugacguacgacaacuagaaccaguuuuaauaccauuaccagauguacgaaauaauuuuuaccauuauaaccaauccaaugauccaacaauaaaacucauagcuauguuauauacuccacugagagcaaacaaugccggagaagacguauuuacaguaucaugccgaguacuaacaagaccaucuccagacuuugacuuuauauuucuaguccccccaacaguagaaucaagaacuaaaccguuuacaguaccaauacuuacaguagaagaaaugacaaauuccagauucccaauaccccucgaaaaacuauuuacuggacccucuggugcuuuuguaguccaaccccaaaauggccgcugcacaacugacgguguacuucuaggaacaacccaacuaucaccagucaauauauguacauuucgaggcgacguaacacauauagcuggaacucauaacuauacaaugaaccucgcaucucaaaacuggaauaacuacgacccaacagaagaaaucccagcaccauuaggaacaccugauuuuguuggacgaauacaaggcaugcuaacacaaacaacccgcggugauggaucaacacgaggucacaaagcaacaguaucaacaggagauguucauuuuacaccaaaauuaggaucaauacaauucaauacagauacaaauaacgacuuugaaacaggucaaaauaccaaauuuacaccaguaggagucguacaagauggaaauggaacacaucaaaaugaaccacaacaauggguacucccauccuauagcggaagaacuggccauaacguacauuuagcaccagcaguugcaccuaccuuccccggagaacaacuacuauuuuuuagaucaacaaugccaggaugcucagguuacccaaauaugaauuuagacugcuuacuaccacaagaauggguccaacauuuuuaccaagaagccgcuccagcacaaucugacguagcauuauuaagauucguaaauccagacacaggaagaguacucuucgaaugcaaauuacauaaaucuggauaugucacaguagcccacacaggacaacaugauuuaguaauaccaccaaaugguuauuuccguuuugauucaugggucaaucaauuuuacacacuagcaccaaugggaaauggcacaggacgcagaagagcucucuaa

SEQ ID NO: 32357 - RNA, 1623 nt, Artificial Sequence
  derived and/or modified sequence opt6 from capsid_protein__Norovirus__AAR97663
augaaaauggccagcaaugacgcuaacccaucugacggaucaaccgcaaaucuaguaccugaaguaaacaaugaaguuauggcacuagaaccaguaguaggagccgcuauugcugccccaguugcaggacaacaaaacgucauugacccauggauacgaaauaacuuugugcaagcaccaggaggagaauucacaguuucccccagaaacgcacccggagaaauauuauggucagcaccuuuaggaccagauuuaaauccauauuuaucacaccuagcaagaauguauaauggcuacgcaggagguuuugaaguccaggucauauuagcaggcaaugcauucacagcaggaaaaauaauauuugcagccguaccaccaaauuuuccaacagaaggacuaagcccaagccaaguaacaauguucccucacauaauaguagacguaagacaauuagaaccaguacugauaccauuaccagauguaagaaauaauuuuuaccauuacaaccaauuaaacgacccaaccauaaaacuaauugcaaugcuauauacaccacuaagagccaacaaugcaggagaagacguauucacaguaucauguagaguacuaacaagaccaucaccagacuuugacuuuauauucuuaguuccaccaacuguagaaucccgaacaaaaccauucaccguaccaauauuaaccguagaagaaaugacaaacucaagauuccccauaccacuagaaaaacuauucacaggaccuucaggagcauuugucguccaaccacaaaacggcagauguacuacagacggaguauuauuagguacaacacaauuaucacccguuaacauaugcacauucagaggagacguuacucauauugcuggaacucauaauuauacaaugaacuuagcaucacaaaacuggaacaauuacgauccuacugaagaaauaccagcaccauuaggaacuccagauuuuguaggucgcauucaagguauguuaacacaaacaacaagaggagacggaucaaccagaggucacaaagcaacagucucaacaggagauguucacuuuaccccuaaauuaggaagcauucaauuuaauacagauacuaauaacgauuucgaaacuggccaaaauacaaaauuuacuccaguaggaguaguacaagacggaaacggaacccaucaaaaugaaccucaacaauggguauuacccucauacucaggacgaacgggacauaacguacaucuagcuccagcagucgcuccaaccuuucccggcgaacaacuuuuauuuuuuagaucaaccaugcccggauguucugguuauccaaauaugaaucucgauugucuacuaccacaagaauggguacaacauuuuuaccaagaagccgcaccagcucaaucagacguagcauuauuaagauucguaaacccagacacaggacgcguacuuuuugaaugcaaauuacauaaaucaggauacgucacaguagcacacacaggacaacacgaucuuguaauaccucccaauggauauuucagauuugauucuugggucaaucaauuuuauacucuugcaccaaugggaaaugguacaggaagacgaagagcccuauaa

SEQ ID NO: 32358 - RNA, 1623 nt, Artificial Sequence
  derived and/or modified sequence opt6 from capsid_protein__Norovirus__AAS86774
augaaaauggcuucaaacgaugcugcaccaucaaacgauggagcugcuggauuaguccccgaaguaaacaaugaaacaauggcacuugaaccaguagcaggagcaucuauagcagcaccauuaacaggccaaaacaacguuauagauccuuggauaagacuuaacuuuguacaagccccuaauggcgaauuuacaguaucaccaagaaauucaccaggagaaauucuauuaaacuuagagcuaggcccagaacuuaauccuuauuuagcacaucuagcucgcauguauaacggcuacgcaggagguguagaaguacaaguacuacuagcaggaaaugcauucaccgcuggcaaauuaguuuucgcagccauaccaccacacuucccaguagauaaucuaucaccaggacaaauaaccauguuuccccaugucauaauagacguaagaacacucgaaccagucuuacuacccuuaccagacguaagaaauaacuucuuucauuauaaucaacaaagcgaucaacgaaugagauuaguagcaauguuauacacaccauuacgaucuaaugguuccggagacgacgucuucacugucucaugcagaguauuaacacgacccucaccagacuucgauuuuaauuaccucguaccacccacuguagaauccaaaacaaaaccuuuuucaguuccaguucuaaccuuaaaugaauuaacaaauaguagauuucccguuccaguagacgcuauguauacuucacccaaugauuccauaguuguacaaccacaaaauggacgagcaacaauagacggcgaauuauuaggcacuacacaacuaauacccucuggaauauguucauuucgaggcaaaaucacaacacaucuuagcgacgauagacauuuauggaacauacaaguauccaaucuaaaugguacaccauuugauccaacagaugacguaccugcuccauuaggaaugccagacuucaguggacaaauauucggaguugucucucaacgagauacuggaacuaauccagcaaauagagcccacgacgcuguacuugcuacauauucugccaaauauacaccaaaacuagguucaguacaaauaggaacaugggauacagaugacuuacuagaaagacaaccaguaaaauuuacaccagucggauuaaaugaaauuggacaagauaaacauuucgaucaauggguccuccccaauuacucaggcgcauuagguuuaaauaugcaccuugcuccagcaguaucaccauuauuuccaggagaaagacuacuauucuuuagauccuauauaccauuaaaaggaggucauggagauccauuuauagauugccucguaccacaagaauggauacaacacuuuuaucaggaaagugcaccugcacaaucaucaguagcauuauuacgauauguuaauccugauacuggaagaacacuauucgaagcuaaauuacacaaagaagguuuuauaacaguaaguucuacugaaaaucgaccaguaauuguaccacccaauggauacuucagauucgacucauggguaaaucaauucuauucacuagcuccaaugggaacuggaaauggaagaagaagaaugcaauaa

SEQ ID NO: 32359 - RNA, 1623 nt, Artificial Sequence
  derived and/or modified sequence opt6 from capsid_protein__Norovirus__AAS86777
augaaaauggcaucaaaugaugcagcccccucaaacgauggugcagcaggacuaguuccugagguaaacaaugaaacaauggcauuagaaccuguagcuggagcuucaauagcugcuccccuaacaggccaaaauaauguuauagauccuuggaucagauuaaauuuuguccaagcaccaaauggagaauucacaguaucacccagaaacucaccaggagaaguauuauuaaaccuagaauuaggaccagaacuaaaucccuacuuagcacauuuagccagaauguacaauggauaugcuggcggaguagaaguccaaguucuauuagcugguaaugcauuuacagcaggaaaauuaguauuugccgcaauaccaccucacuuuccaguagauaaccuaucuccgggacaaauaacaauguucccacauguuauaauagauguuagaacacucgaaccaguauuauuaccacucccugacguacgaaacaacuuuuuucauuacaaccaacaaucagaucaaagaaugagacuaguagcaaugcuuuauacaccauuaagaucuaaugguucaggcgacgauguauuuacaguauccugcagaguacuaacaagaccaucaccagauuuugacuucaauuauuuaguaccaccaacaguagaaucaaaaacaaaaccauuuucagugccaguuuuaacucuaaacgaauuaacaaacucuagauucccuguuccaauagaugcaauguacacgucaccaaacgauuccauaguuguccaaccacaaaacggcagagcuacaauagauggcgaauuacuagguacaacccaacuaauuccuucuggaauauguucauuucgcggaaaaauuacaacccacuuaucagaugaccgacaucuauggaauauacaaguaucaaaucuuaauggaacacccuucgauccaaccgaugacguaccagccccccuagguaugccagauuucuccggacaaauauucggaguaguuucccaaagagauaccggaacuaauccagcaaauagagcacaugacgcaguacucgcaacauauagugccaaguauaccccuaaauuaggcuccguacaaauaggaaccugggacacugaagaucuauuagaaagacaaccugucaaauucacaccaguuggacuaaacgaaaucggacaagauaaacauuucgaucaauggguucucccaaacuacaguggagcacucggucuaaacaugcauuuagcaccugcaguaucuccucuuuuccccggagaaagacucuuauuuuuuagaucauauauaccacuaaaaggaggcuauggagaccccuucauagauuguuuaguaccacaagaauggauacaacacuuuuaccaagaaucagcuccagcacaaagcuccgucgcacuacuaagauauguaaacccagacacuggcagaacucuauuugaggcaaaacuacacaaagaaggauucauaacuguaucaucaacagaaaaccgaccaguaaucgucccaccaaacgguuauuuccgauuugacaguugggucaaucaauucuauucauuagcaccaaugggaacagguaauggaagaagaagaaugcaauaa
